United States Patent 9,328,346 (POLYCOMB-ASSOCIATED NON-CODING RNAS) - sequence listing, part 47

SEQ ID NO: 8406 - RNA, 22618 nt, Mus musculus
aaaguuaauguuuucuggguucguguaaauguuuauauuaaaauauugagcacuuaaaaguauagacauaaccauggugauaguauuuauucugacucacagugcaguuucagagaacugccucuggcugggcauggugcuauauacuggaaauccuugcacuagcacuggggggcuagaggccugagauaggaggaucagccuuggauacaaaugagacccugucuuagaaagagaaugaggacauuguaucuauacuaugucugcuuuuguucagaauguggcaaaaugauauugagugugaaaaauagauuuuuauaauuuagugaaaaacaaaugaauuguagggaaaugauuacauuucaguuauaaaacauucuauuuggaaaguuugaugguaacauugugucagaacauucuaagaauguuaaacuauaguggacugaguuguagguaguuucauuuuuauuuucauaaauauaauucugaggcauuucacuuuaugcuucacugcaaaaaaagacacauuaauauuacguuauagaaauuaacugguuagauaacuuguuucuuaaauuuuauuuauucuagagacgaagagaguaugaguaguguuacucggcauagaacaagaacauugaguguuacgucugcgggcagugcccuaagcuguucaacaaucccuccaguaagugcuacaugugccaguuguuggggucagagcugugggcagaguggugaccuuuggguacugucaggauuucaggucauuuagauauuuggaucucauauguuaauguuauaacauggucagcauguagaaguuuucaccaggaauaagcaaagcuuucagggauaaggcaacauauaaauuaguuuaaauuuauggaauaaaauguuaauguaguuuguaguuccccaugauucagucuuugguuuuuaacaaggaagguuacaugacauugcccaaagguagcaauauggcugaaauguagagguauaucacccccccccccccuugcuuacaucugggaaaugggugauuuuaaaugucuuuacuaucaaauuuuuguuggucccuugggcaucuuacauuuguauccaagcaguuuacaaaagggauauuuucuagacaggacagggagcagaauauucuagcccagcugagguucuggcauguaagccagccucucuuuagaccuacccagaaggaagagucaguguggagaugaccgcaccccacaaagcagcccccucucuguggccuuuggagaagcguuucucuaacuccacacacauuuggauuaugcagcuacuaggucucauucacaucugacauuuggaaagagcagggauuuacaagucauuauuccucucaggaaucgaggcagacuuuguuggguuugcuugccuuccugauccguuagcagucagcagaagucacccaccugccucauuucaggauuaugcaguguguuuugaagacuaauugugcuuccuaaaaauuauuuucugucuaaaauuuaaaaaguaaacuuggcaauagccauguaacaaaauaguaaguaauuuaucaaauuuugaugcuuuacagcaauuuuuguuauguuggacucuuuucuucuguuuaaguaaaauuguguguuacuaaagcuaguuuuuagagauaauuuccucauagugaacaaagaaggaaacaguucagaagggaaaaaaugaaaaagugaaauggcuguacacagaguaaacucaagauaaauuacuucauuuuucuaaauguauuaaaauucagauguuauuagugaauuagaauguuuuguuuuggauagaaugagacauuauaauauuaaaugagagcuauccagaaugacauuguaucccaaaugcacacauaaaaagcuagcuagacguggugagguaugucuguuaacucaccacaaacaagugaagacaggagaauuccuggagcuuguugacugucaccagguucagugagagacagacccugucucaaacgaacaagauggggaguggcagaggaagacuauauaugcuggccucuggcuucagcacacacguguacacacaaggaugcauguacacacagaagaauaaaguaaaaaauagcuaauaguaguuucuauuacaguucuggggcuguucagaaacauuuaggauuuggcagagcaauaacagugaaauucucaaaaauguaauuuuuucauauuccuucuaaacuugucuaagaaaauuuacuugauuuucuaaauauaaaauugaaaucugugaagcauguaauacauuaaaagauaaaguuuugagccaggcauggaggugcacgccuuuaaucccagcacucgggaggcagaggcagguggauuucugaguucgaggacagcuagggcuauacagagaaacccugucucaaaaaaccaaaaaaaaaaaaaaaaagauaaaguuuucaguacagauaucucgcaguucauuaaauaaccuuuuugcuuuucgcuuuuauacucucuguucuuacugggauuuaucugcccccuuucuuugauuucgcaguaucagaacagaauugguagcagguucagacuuguguggccuucuguguggcugugccgauggaagcagaugucaagcugcucuaguuccucuuuaccaggcagaggcugcucuucucauguguugugguuuuagucuucaagguuuugucuugagcuuugugaguuguagaugagccuguauccuaaggagaauacaagaccuucagccuaacuccaugaacagagaucucugugcacacaagguugucuuuaaacuuuuaauugaaaaucauuuuuuuucguacacuauauucugagcagaguuucccuucccagcucugcuuccuuucauccacccuugcuccucaugccucugcucucagcugcuaggauggcaggccauagccaacgccuccugacacuuuucucauacugcuucuuuucuguuuuguaaagaugacagaagaaaacaguuaccucaguggacuuggugguggugguuuuggaauuuauauaaagacaaaaagggcuuaaauuccuuaaaauuguaucauaaaaucuguucccuccuuaauucuuuuaucauuccuauuuauuggcucuuaugcuauacauaaacuuauaauuuauaaacacaauagucauuuguaaauucuguucuugaaaacaugaaacagaauuaaguaauuguugccuuuauacauacauguggcuagagcuaaugggagaccuuuuuacucuuaacagcaagugaugauuuccauguaguugcuaaaauaacacaauauuuuacuucauguuguacccagguuuuucuuacacacaaaaaauuaccguguaggauuuguacauuguuuggaauugggcuauaagagaaaccaaaagucauuaugaacugaauuuuuuaaaaaaacguuuucagucaugugauuuguacauauggcauuugugguuguuaacuaugagacagugcucugcaucugcauacucugugaggacuuccuaugcgugacugccgcccccaggccucuucucugucccaagcaccacagggcuggcuacguaauuccagccuuuggaagggcaggcaggggcuagaagaucgaggccaucugacuacgguccaguuuaaggccagccagggcacccaggcuacaggagaguuuaccucagggagggagggagcgagcaaauaauuacaaaaucauguguuuuaccaagacggguuuuuccccccaacucauuguucauaauggucacuagguggcacucuagcaguugauaauuuaaacugaccacuuuugcuguauaaucuguauuucugggaagaauauaaauuuuaaaaacuuucaacagcuucuccuguuuuaucuacuaguucauauaguguccuuaggauucuuaaaauucaucuuuaacauguaaauuugaaagauacuaccaguguaaaucuuggauaauaauuugauaaugauuucucugcuccuuaucaagaugguugucagugauacuaauucacaagaucuuugcaggaacuggugaagcagaaggugaagcgucagcugacaaggcagcagaaggcggcugccagacgccggcugcagaaaggagaagccaauguguuuaccaagcagcggagggaaaacaugcagaauauuaaaucgaguuuggaagcagccagcuuuuggggagacuaauagauuucugauauguauuauuuuuuuagaugcuauaauuuuauuuuuagccaguauauuggucuuuuuuggaccaaagccaguaaauuauggaaauaaagccucuuuagacucagagcuuccaaggucugauuaauaguaaaucugccaagcacucuguuucuuaaaauuuuucagguaacuaauuuaaauauaaaauaacgugugaaaaaaacuucauuggcaguaauugcaaaacauggacaucauuuuuauuucacugugauguucagacucugccuuaaacagguagaaaaaugacuugccucagauucuggauuuacauguaauaaauaauagaacaacuuaaugcaaucuguaguucucucuuuucuccuucagucggucacacuugggcuuuuacuacauuggugaguuggcuuuaggaucaccugagacagucaguacacaguuauuugaccauuggagugaaacugaucgucuucuguuucuuuagacuucuggaguggagaugaaucaguaauggguagacgagcagcagcgggucuuuuggugccguucucauuggcccuguggucgugggaaaaggaaguuuagguuccuaccaguauuuuugcaguugucagcuuuccccagguuucagcagaaguggggggagggagggagggagggagggagggagggagagagagagagagagagagagagagagagagagagagagagagagagagaaugcaugacuccaggauguguuccuaccucaguguuaacaagucucuagaacaacacucuggugugauucaucccucaagcgcauucuaauucagucaguggaagugaguguaaguauacaagcacugucccuucagcuucccugagcagaucucgaauagaagaucgucuucagcaagaagugaccaccagauggcaguguuugccagcagugacaugauaaaaacaccagcuucccuuuuaccuuagcaaaauucauucugacuauuuguaacugaucacuaucuaagcgcauuuaaauguuuggauauaugaauaugucaagugcaguuucuuugaaaauuagacugauuuuuggaaguguugauauagcccuguuuuaaaauguaguuuaagcucagauacucauuuuuuauacucugcuaaaaguguuucuauaacauaaacugauguugaagauaguuuaauaagaccacagaauguuuauuuuguaauacguuuuucuuauguccaaagcagauugggaauaaaaguguuugaccucauuuuucuuggcuuuacuucacuacugcuacauaagaagcuuguuucuauuugauuuauaugguuugugauagugucuaucagaguugugaagacuagauggaagaggauuugugaaaaggacuggacacguaacacagugguagaguguauuuucauuuacuuuuguaucacaaaacccuuaccagagccggggugguggugccuuccuuuaauuccaagcacucaggaagcagccuggucuacacacuuugaggacagccagagcuauguagaaagacccugucugguaaguaaauaaaaacauagccaggcaugguggcaaucagcagguagauuggaguuugaggucauccuggucuggagagugaguuccaggagagccaagauuacacaaacccugucuccaaaaaaacaaaacaaaacaaacaaacaaacaaaaaaacgcaaagaaagauuaauguacuuucaaauaugguguggauuuauuaggcuaaaauuacuaauauaccccuuaaagcuacuaaagaaaauuaacuagacuaaccaucuuuucuauuucauuaaacgcaagcugugauccuuucuaguauuaugauuuacacuggguuagcaugguugaagcccaaggucaguguccacccaaaccaaaacaucucugugagaagcuuugcuuuccacuuucuuuaauaguugacuucguucccauuaaacaagcuuuuuucuaugcaacauguaacuuauauuugugcuaaccugguauugguagccacugaucuauucaacaugcagcuggcuuugaacuccagaaccauagaauauuuagaggguauuaaucauagggugagugcaacuuaaaauaacuauucuuuuucgucgcguacuugguaaaauuucugacaaauagcuacccaauuaauaucucugcugcuaucuccaaguuuagcagccaccuccaggauaggcagaagcccauuauccauguccucuguaccucagaauguagagcauuaagcuacaucuuaauuugccauugguuugcaauauguaauauugucuuagcacaacugaauuaacaccguuggagguuaaaagucaguaucuagccaggcgugguggcgcacgccuuuaaucccagcacuugggaggcagaggcaggcagauuucugaguucgaggccagccuggucuacagagugaguuccaggacagcccgggcuacacagagaaacccugucucgaaaaaaccaaaaaaaaaaaaaaaaaguaucuagaggaccucagagcugugugauaaccaggaguauggggauaguuccaaagcccaggaacuuaaaaaacuagcguccuuaagucuuuuaccucaauauuguaaaguauagauaguaauaccauuaaaacauguuaaauuguuuaaaauuagacagaggaaggaguugguucguagguuaaaaugcuagcuguucaagcaugaggaccuaaaugucaauccuuagcacccuuguauaggagaaggcaagcacuguugcgugucugugaaucagugcugccgugcugaggauucagaaggagguaagucucugguucaggcgggccagccagguuagccaaaacagcaagcuuccauuucaccaagaggagcucucaguaaggugaaaggcaacaaaggaagacaguguugaccuuuagcuuacaacacacacacacacacacacacacacacacacacauuacauaacaaauuaguaucaaugcacuuucuuaaguauacaucauaauacaaauuuguugcuugacaugaguaucauaauauaugccuccccccccuuuuuuuaauaaaagaaagugacuauuuaaacacuacuauaauucuauguaaccucgauuaagagguaaaaaaaauuauguuauuccuagaucuguuuuccaaaaccuugguaguguaaagcuaccaggggaaaguacauggguuuuuaagauaauaauuuguaguuggcacaucaucucagacaaauuaugaguaagcugaccaaccuuaggagaaaaagccugguaccaaacugaugcagaugaacaacgagugcaaggaaguguuccuggggaaaguacucugugggagagggauuugguuaaauagacagacugagaaagacaggauguaaaagaggaagucaugcagaaaauuugggagacagaaguguagugugauuugcuguaaucaaaagagagcaagucacagaugacuucaguggaauggggacaauacugcauaagggaaaagcagcuugguuuugagcagcacaguuacuugauuuuagagauuauaggugggacucagggauacuugucaauguuaaaaugauuugaaaggaauuuggacugaaauuuacacggcagaaacauuguggaacagggccuauucuaucguacuagaguuaccgagauucacuauaaccucauuuuaauuguagcuguaagcaaacagcuuuaaaugucaacucucuagccucaagucacagaaugaguaagguugggaaagcauugaugacaagauggagcugaugaagugauagcaaagugaaucacaggacagccgcauuggggugcauggaguguguaccugauuggggucucuguagagucacugggcacugcaccuaucuuaccuuacaggcacuaagaauugcuaaggagacaguucaccuaaccagauuuuggggucuauccugccauaccuaacauuuuaagaaacacagucuuucuuuccuuuacauguucaagaaaauccaucucaauagauaaauucucucugagcacauucuuggaguuuguggaugagggacacacuguccuugagcucaaggcuacccaaguauuuuuuuaagaggaguagaagacuuugcgguuuuguacuuugggcguucucugauuuacaacuuguaggaaaauggggcuccuuugugugcuguuuccuauccuucaagcaaauuuugaaaaggcauaguucuuugucagcagaaugcuugcuaagugcaguccucugaucgugacagccuaggaagcacguggaaauuauaauuuacagugugaaauggaagggcaugaggcuuuuaucuuaauguaagcauauccauaaguagccggaacugaauuaagugucugcugcugaugcaaccuuuacaggaaaccucaucuaaaauagaugaagcugugaaaugacugguugcuggaaccuuguaucaucagcuaaucucauacuuaaaucauuuguuuguaaccaauaaacauuuccacuuuguuuuaagcugauacuuuuucuucuagucucucugugucucuuuucuaccucucucucucucuccccauauauauauguauguauauauauauauauaugugugugugugugugugauuuauuaauuauuuuuugcaaaauuuaaguguucugcacaaccauaccccccagaaauaugacuuuuaaaaauggugucucagcccccagcacacucuguagaagacccauccucuucauuugaggagugacucaaacaaugccggaguucaguagccucuccacagacaaaucucaguaugcagcugucucuuauaaaagccuuuauccaaacaccacauuggucuccucccaacagacaauaagcucugagcuguacauucacuucuuuuaauuauuaaaguggaugcuuaaaagccacuuauucucuuuucuagcuucuuucuaucugaggugacgcuaaacaucaacaacaucaacuucugagucuccuuucuccucccacccuuccugggcaauaguacugaucagugacuuugaccucuuuugccaguuccucauuucgccuguccaguucacccugcccaucuucauuggacucugucugucagugccuguaaacucuuugucuuaacacuuuaacuccauaccucugcuuccucuugauuuccucugucuugucauagacuuuagcaucaagggaagugagucauuauuucaaagaggauauguucucagcucucccucagggucccccuucccuccuuuccugucaucugauucacuaggaguaaaauaugucaguggucacugagauggcucacugagcaaaggugcuugguguacaagccuggcugccgugguuggaucagcaaaaccccgguaagggacagacucagcuccccaaagcuucuuugguccucacaugcacuccaaggcauggaaagugcaccucacuuuaccaguuacucucacacacaauaggaauaauauuuuuuaaaaagaguguauguuaguugaggcuacuaugacuacagcccuauccuuuaaagcugccuugacaagguuggccaccuucuccagaguauagcacgcuguuggcaugaggagaaguuuucuuuuucauuuuuaacuaauggugacacuuugguacacucugugguuucuaaauuccaauugguagcccccauaccauucuuauaaacguauagugaguugcuauuuugcaauaagcaugcuacugggaaaugagcaaagcucuuuucguguguuccauacaucccucuggaagcugggaaugcgcguccucuuucacugacggcacccucuuaggugccaaguuuccaaaggaugagcaugucaguuggauaccauuucucauccuuuaaauuaguacucucacaguguuagaagaucauuuucuguacuguagucuauuaucucauuuccauauagauauuuauauauuugauuuuuuucaagacaggguuucucuguguagcccuggccauucuagaacacacuuuguacaccaggcuggccccgaacucagagaucugccugccucugccucccaagugcugggauuaaaggcauguaacaccaccacccaguagacccaagaaauguuuauggauauuuaaagaauauguaagcagaggcuuagaaagacuuaauugaaagauugaacuuaauggugaaacaaugcuaauugugauguuguguaaucugucuuuauuguuuucauuuauuaaaugagaaucauaaaaggcuaugaaaucauaaauuugcucugaaggucuugugaagauacucauaguuuucuuucaaauuccuuuguggcuuuggcagugaacaucuuugaauuuaucauauugauauugguuauguuuacuacaaaugaaugguuagguugaaugggacuagaagcgacuuucuaaauaucagucuagcauuuaugaaaugaaucugugacuuucuacaugucuagaaacucugugcucauauuuguguuuaaccacagaaucaugggcuuuagaacuuaaagggaacauucagauucgcucccugguuuuauggaugaaaauuguaaacucaaagaugaauggcuugucacgguuagaugacaaaaauauaauccuaggccuuauuaaacccacacuuauuguuccuccuaccacgcuauuuuuaagauuagaaauugagucucaagugauggcugcuuuuccagaguauccagguuuaagucccagcauccacagacaccagguacauaugugauacagauacauaugcaggcaaaacaccaguacacauaaaguaaaacaaaauguguuagacaauuauuacauucaauuuuaauuuacaggaaaagcccauucacugaucagacuucaggcaucaaucauuuucuguuuccuauuaugaguaucacucuuuugaaaaaauugaaaaauaacuuuguuauuuguccuggcucuauaaugagaacauugucuugguuucuaauacuauguuacucucaaagcacuuacauagguacuaugugucuaaucucuuguguaacagaauuuuuugucauccaccagucauccagauuauuuuugaaacuaagaaccucuuuucacaaaauaaaaaaaaaugaauuuaaaauucuuggaugccgggcacuugggaggcagaggcagguggauuucugaguucgaggccagccuggucuacaaagugaguuccaggacagccagggcuacacagagaaacccugucucgaaaaacaaacaaacaaauaaauaaaauaaaauucuuagacuacagacaguaacuuuuuucuggccugaaguuauugcucaaugauagauaaauugccaagccuguacaagucucuggguuuggucuucagcaacacacacacacacaaacacacaugugagcauucaugccugcugcucacaauuugaugcaaggcauauauagcauacuuugugacccaaaguaagucucuucacaugagguucaagcauauauaugaacuauaaauagaucuauguaucauuucauuuugucuaugugacaauccugaauuucuucucuggguggccuaaauuuccuguggguauuugucaaggaauaaucauuauaauagcauuuauuaucacugcuacuuuuuccuucucuguuuuuuauuaagcccacccuucuacaacuagcugaagaaauugaucacaugaaagacauucuauuuauauagucuuuaaagaauuaguuucacaauaauggaaugugaagauuggaaggaacaugagacaacaaucugugaguucuguguaaaaaaaaaaaaaaaacuucaaaugaagcagcaaaguccuucacagcgccucaacaacaagagcauacagcuaguaaaguugguucguuuguuucugauauuacauauuccugaagugugauaugugaucacaugacauguuugucucuugucaaaguguuauuuuacacauguguacggaucuguagagauaggaaagagucucauuugcugaguucuuuuaauaacuuucuauuaaacuuuucuuuuaaagguauugcuuuuugcucuuagucgauagaaauucuugucacuguuguugcugcuguuguuuuugguguugcugguggugguggugggcugguggugugguggugguaguuguagugucuguagucuaugcagguguguauguaagagcauuccagagaaugauaguagauagcuucuaucacucuccaccuuaguuuuugaaacagcaucuuucagagaauaugaagcuacccauuuuugccaaauugacugguagacauguccugggagccaccugucucagcuuccggacccuaauguuaccuguacaugcagccauguauaugcaaccauguccugcuuucacuuacaugccaggaauuugaacuaaguucucuugcuuucacaagaguccugacacccugagccauuucuccagaucucaccauuaaauuuuuaacagaauaaauuaugagagaaugauaucaggauuaauuaaagucaaucuugggaacgauuugucuuggaggguaacagaaaaagaaauauggucaggcaaaguauaaaagaguucacuagggauugcuugcuacugcucaccagaagugacugucauugcagggaggauucugauuucagaaauaaugcauuaucucacucuaaucguaaucuuuauaguuccucuuucccaaaggggaauuuagauuguugguuguagugguuauucaaugauggcagucccaagccuuccccuuguaauuuaggaaccugcaggacgaugccuucuugaguaccuauuccgggggcagcacauuuaaagaaggaaggcugaaagaaaugcccaaaugggaaggcagcacagcauccaggcaaaaucugguuggagaagaaaucuguucucaugaugacugagcuuccccagccugccuguagguggguguguuuaacagaacgaagccaugggaaccagccugucagccagccuuucaggcuaauuagcucagcauacaacaaagauaagugagccugagaggagggcccugagggucuuuagauucugggaaaugucugauuggcagauguuaaaagggauucuuuaguaauccacugcaucaaugagcugcacaaauucaguccagagcugcaagaauucaggcaugaggagacugugcaggaggcuugcacaggcagacucgagauggacagaaccuuggaaucucugaggcacaucauugcccaagccuugccucacagagacccggcuuuggucuucaaagacuguaaguacugaaggaaaaaaaaaaaaaaaaaccuuuuuucccccccugacuuuuuagaaaauaguccuaagugucuagucacaucuuguuuaacuacgauuucugcuagaucuuuguagucguguucugugggcuaagcaauauuuaaauuguucccgacuucagccaggagaaggcuuuccuuuuaccuacgcccacaagacucugggcuguuuugccaagacaguacuguguagaugacuuuuucuaaagucuaaaaccugccaagucuuaaugaucuuuuccagaugcuuuuuaaauaaaacaaagcugaguggaacucaaugaaaacuaaaaauaacuuggaaaugauaauuaaaaaaugcacugcucguuguucaucuauuuaaucuuucacaccauaacuagacacauuaaaucagguauuguuuuaucuaaaaguauuguagcaaacaaaauuuaauuuuaaccacugagcuccuaaauuuuaauagcaaauuauaaugccaauaaaaugugaugccuucuaacuucagccucauucccgacauccccacccccacccccacauggcauggcaaaguuauuuuuaaaucuuuuucuaaaaugauuaugaaaaauaauucagccaaucuuuacaauuccagcaauacuauuaaaccauuugucauauaaguucgcuucuggaaccaauuugauuucucgcugcugcaaaacagacuaucuucauaguguaucuuaucuacagugggugucagauuacaaagggcuucuggaauagaauugcucuuuggaucugcccaaaaggugaaaaugcauauggaauguuuuuagccugcaauacguuacagcuuccuuucuugugacucuagugaugugugucuccaucaaaguaucagugguuuggauucugcuuucugauuagugaauaaugccccuuuccagaugucccugaagcuuguauuucucauaugugugaugaaaaaaaagcagagagagaaagagagagagagagacagagagagaaagaaaugucuggccucuuuauucuauaaaacuucccucuuagaaauuaaauuguaaccaaucuguccucuaaggcauaaaaugaaagcuacuuucuuucucaguuuaaaaaaaaaaauguugccuucaagcauuugucaauagcuauguuagaaauaauaaaagucacuccaucuucaagcuuagccuggcgucuauucuggcuugcuauguuucucccagugaaagagaaggaaagaaugucuuucuccuucaaugcauucaaaucuuagugaagggugaaaggcuuuggcauguccaaagcuuuggauaaauuguaagaacuuagaccuagaauuuggagagcagaagaaauaaaaggaaauggaaagaaaaguucaaauaugacguuguaugguccaguucuuaagcugaacuaauuucuuccaauugcauacaguuuagaagagaaacuaugaguuguuaaagggacaaugucugucaccaaaauuuuugcaagaacgcuauuuauuuuuugcuguuguuuucuucugagacccuuguaagccacacagaauguuuuuuuucccauauggaaaaacugugucacauuucauauauuucguucauuaacaacaaaaaucccaacauuaguaugugucauuguggacuuacucuggaaugaaccacuugcucugccgcugcucuguccagugagugugaauacgagaauguuagauccuuuccuuuccagcuuuucuaaccuggaaauacaaugacugaaugauauaagcuaaagggcaaaugucuaccaaucuuagaaauggguuugcuuucugagucaggacaucagaugucugcuugaggaucaagccauacacugccaacugugggugcuacacaugucagccuggcucaugaacuuuguuacuuuggcacgaauuuaaauugcugccacggcccuccugcuggcaaccuaaaaagcugccaccagccuuaauggcaguucuuaaaagucuucuuccuguccuccuagcccauucaaggcuccuccccugccgccacccaccuagucucugccaggaggaacacauaaaaagaauugcuuccuugcuuuccuggaagaugaaaagggacuuagagaaauuauaaaacacaacucaagugaacaaaggagcauaaaaaagaaacugccgccuguuucuaaacuucucuucugugaaugcaaagugggguuuccuuuacucuuuagacacacaguacagagagcaaaaauuggccuccugagacauucaucgcccucgguuggcuuuugauuugcuuacaaacaagcaacaguggguaaauuuucucuucaaguugauuaggaaaagcacucuaagaguuuucuggucugaggcagaaccaugugggaacgguuacauucgcuuaaggaaguaauguugaauucauggcucagccuucagauggcauuuuacaguauguccagucuguuauaguuuagauaaguuguucaucuacaauaacuguguuuuuaaugguauuauuuucuuuuuuuucuuuuuuucuuuuuuuuaaaaggaaagaaaucccacagcauuuuucuuuacuuccuaguggacauucaaaugaaagaaguuugggaugaggugggcucccaguaugaacuuugcuucugaaggcugcaugaagcugaucuccacaacaggagcaucucugccacaggcagcacuggauagcuccacggggccaagcagagugugugugcagagagauuauggcauauguccaugcugccuuccacucugagcucucugccauccaguuucauucugugggucaugagucacaagcaagggugagcugucuuaagagcagccccuguccucuuuuguggagcaugcacuugcuauuuguuugcuacuguuugaccaugccaagggguuuucucaaaagaaacuauugcaugauuucaagauggcuguagagcagaucuuaacccaggcacuaauuuuucccauuaccaaaggauaagguaguuaccuaucuaaucuguagaguguuucuucauucauuuuauagaaacuaggaugauaaauucuuauuguaugacagauucuaugccagaaacauuuauucuucauaguaagccaguaaauauagauaguucuguguguacuguugcuauaagugaaggaauagaagcaaauugaccaagucccaccauagucgggguugaaggcuagacacaaaugcugucuuccaacccuuuaccuuuagucacucacugcaugacacugcuucuuagagcugccaguuaccauauuaucagggcuguaagcgaaagcagagaauggagagaaaugagcuuuucugagaggugggagagccuaauaaguaguugucacugaacagaguaugacagaaguguagaggugggggcauuuuuagaggagaagaaaccacuuugccaaaggccagggagcacagauugaaugggagcugacuaggagaagcagguucaaucuugcugacacccagguacuggauuuagguaugaccuuaaacuaugcaggaguuuauggcuuuauguguccugggacaaagccuagauggcaucugcuggagguauguguacugauagcaauacuaggaagaacuguagcuuuuaucaguaggaaaccaacuggucaaaucaggaaagguguaagguuaguaaaugguaaauaugucucugggaagaaguuacuugcacgaacugaaaaccaaaucaaaacaacuuuauccaaaagauaguuuagaagcuaucucgauugucauuucagcuucaagaguuagcgggugaaggguuagcuuuauaaaguuacauguuagauuucacugauuuuuuuuuuccacacuaugaugaaaaagcaagauggcgucuuugcuaaauguagcucaguuagaugcaaauuucucacauauuugaggugcauugacuuuuuuuauuugaaaaacauuucucugcauggaagguuuuauguauaucagauaggugaauacuuaacuucaaagagcacauuucuacccuuuagaaaacucagaccagacuacaaggcuauuaaaaacagcuuaguaaucaugaaucuggcaguguauagccugggagaagaaaaauucucuccaggaaaguauuuuuuuuucugccccauucucuuuaguguaguuacuugaaaucuauaaauuugaugauacauuuauaguuuucacauucacagaggggguggauguaagaaauguaaaaaucccugcacacgcugcuacaguguauuccaccauauaaacugcccuugaaggaacuccauuuuaguucagaauuccaucuuaauugcaauagaguaaauguugauacuuuuaguauuaaacuagaaacgcauguuuuauggaagccugcucaaaugccaauuuuauuuuauuuauaacaggacacagugacuuuuauuugaauuuagacugauaaaaugcaaacuucagcucagcuauuagcgguauaaaggauguucucuuuaucuuuuaucagcaaaugcucauuugacaguuuaaauauugaaagacagccuaaggagaaaauauuucaaagucuuuuaaagaggggaguaacuuaaguaacucacucacuuaaaggccauaucuguuuuaauaccuuuucccucauauauaaauacauuuaaaaggucaaaauaaaauaugauagacucuuaucccaugaagccuuuucauaggcugcugcccaucucaccagagggguuuuuuuuuuuaauuuuauuuuauccaacaguugagauuuguuagcuugaacucaauuuuaacaacuucugaaacucaugugcuaaguuacagccuguaauaggauacagcugcccaagggugagguucuaaguuaugaucuuucuguuuaaaugauaugguuuuacugauuacgugcuacagauugauuuaagaaauguuagacaacuuuagaagccuuucauaauggaauuuuuauuuaauauauuucauauucaaguuuuaaccccaaaggcuuuuauuucuuuuccuccauguucaaaugcccaugucaguuuagucugaagagguauuuaaaacaauuccauuuuaaaagaaaaagaauccuauugaaaguuaagagaggagacagugacucauccugcaguucuccccauugucucucggagucaauggaauguuauggcuuuaaucguugguuggcuuuauuuuuguccucuaaugcggugauaaucaguugaucccuacuucgauuucauccuguugagcagcugugagaacccaucacuaacccaccccucuguugguauuuguggccuaugcuuguccaucugcauuucuucaccaugcuucucaacuaccuguuauaauuuccccagcgugguuuuguccauaacuuaguuguaaaucucagggcagagacagacuuuguauuuuugucacauggcagaagcguucuacaguuccaaguaccuggaagguauauggcagacauguuuaaacuauuaauuggcuaauuuuucuccccugugaaaggggaggaguuuucccaccaccaaguauucuccuuaaugaugaaauaaacgucucagcucuauucuaagccuuccucaguuggcacaauugucagagaauaacuacauuuaggaauaaguuaacauaaaaauagguguggggugggggaaacaugaaagaagcaaccuuauagacaaaaagccacuucaggcaauucagccaggaagcugccucaggcuagccuccagccaggaagcugccucagacuagccuccagccaggaagcugccucaggcuagccuccggaaacacuccacaguaucagaauucaucccuacaaucauccugaguaugacuccaguuaagggucacuaggacauucuucuauagcccaauucuaccugcgucuuacacacuggcccuguagcagauacuaaaaagcauucuuuaaaucauuauuuccagggaaauacauuauauaccuaagaccguauuuuuacagauuugaccauuuuuauaaaacuaaauugugugaagaaauagcuucagcuaguuaugucacaauagcacucccuccagggguccgacauacagugcaaugucagugcccaguagagcgugggggaagauaaauaccccugguugguaaauaggucacaucuacacagauuuuuaaaugggaugacaucaucuggcccaugcuacaauguaaaacccacaugugaacucuaccaugcagcagcagcugcugcugcuguuuaagugugauacauacaguuuaauuggccuuugcaguuuccuuuuguuccuccauacuucucucuucucccuguguccgugcaguuauauaugaaacauaaaugcuauuuaacuuuucucauaaaagaauuuacacuucugccuuuuuaaauucuaaaggugaaaaguaaugccugcccccagugggggaaaaaaaaaagaaagauaugacuuuuaauuauuuuguagacccuccagaaagguuaacuauguaaaacaacugaaaggauuuccauuccuucagagaaauguuugggguaagggauggaaguggaaaaaaaaaaaaaaaaaggaaagaaaaagcaaacaaaagccaaccagccuuccagcugcugaaggagcuggggcacaacccuugaagagugccccugccgggaacagagaggacuccagcugccugcccacugggccagagcgcugccuuaaaagaacuuuugcauaaaaggaaaagaggccaaggcuccccuuuugcugcaggacacagggccaguguccacaagaguugaguguccuggccaaagccaaagcuagggaucauugaaaaugccugggcagcuggcauggcugaucaguuucuggaacacagccaggcucagcacaagauccagaggggccccauuuuucaaccuauugugcaugcauuauaaauuaauauaucaugaguuugccuuuuacguuaagaguucuuuuccuguuuuuccuuaauaaaauuagaaaaaucacacuaaugagaacaaguugauggaguaguaaagacuacuuaauguuauauaaaaugucaccucuuaacagguuuuuaauuaaaggugauauuaaaauaucaaaaacauaaauccaucuguuuaaaagcagagaaucaauuugaaaauauguuaucuugaaagcugcuuaaugauuuguaaauggcagccuuuccaacgugucuuaguuguuuuuggcaagcgauauuuuacucugcuagaaauuuuuaugauauaagaugaaagaaauugguucuuuuucauaguagauuuauaacagacuguuacaauccuuuguauauaugugugugaacaaauggccucuucuaggacuugcaucuuaacucauuggacugggccauuguugcgauuauaaaaagauaaagggguauaagaauauguuuuaugggaauguggugaggugugggggaagggggugucucaaugggcccaugccaaggcaucccuuuccccagagguauaguauagaauagaguuuauucaggaccuggggaaggaaguuaagagggcaguagaggcagagaaaggcagaaagagagagggaauaaagagaagagaagaggagaggggaagggagcagaggggaggggaggggaggggagguagaggcuggccaugaccauguggagagagggggaagggaggggcgaagggaaaagaccaagagggcaugagagaagugagagggaaucaagaguaagagagagagaagggggcaagcagcaccuuuuauagugggucaaggccuaccuggcuguugccagguaacuguggggguggaguccagacagaauaccaacagucaugaaauauauuguuucuacuuucuugaggcacaugaagucacuaaguauuaauuuaaaauaaaaguuuuuauuucucuuauuccugcuucucucccgugccucuugcccccuugucccccccucucccaacucccuucccccucucucuccacauggucauggccggccucuacuucucuacucucuccuucucugugccuuucucugccucugcuacgcucuuaacucgccuucacaugcccugaauaaacucuauucuauacuaaaaaaaaaaaaaaaauguuuuaauuuuuuaauguaaaaugauuuaagaaauccucuguaguuuuugcuaagagcagauccauugccuuuagaaucagaaaaugaaaacguaggauacuaauaucucgagauauugaggcaugaaaucuuucauucccuuacuuucuggcuauucuaaauuuuugacuuaaccaaugaaaguucauaaaagagcuugcucucuucaaccucugaacuccucauguauuugggcaauaaaccacacaauguauuaaugagagaagucucagacauacagacuauuuuuagaguauuuaaugauaagguuucuaaaacucuaugagcuauuagcuucaaagaugcaauaugcaaacauauaauuaugucugccuucaacaucucugaucacaauagcuaaggcaccaguauuagcauuagcacgugugcauguguggagcccgacucugaguauuuucuucucucucucucucuuccucucucucucucucucucucucucucucucucucucucucucucucucucucucucccucccucccucccucccucccucccucccugccccccucaccugucuuuuucuuucuuucuguuguuguuguugcuguuccugcugcugcugcuguuuugcuuuucaugacaggguuucucugugucucugugcaacuuuggcuauccuggaauucacacuguagaccaggcuggccuugaauucacacagauccaucugccucugccucccaagugcu

SEQ ID NO: 8407 - RNA, 602 nt, Mus musculus
gagggagagagagagagagagagagagagagagagagagagagagagagagagagaaugcaugacuccaggauguguuccuaccucaguguuaacaagucucuagaacaacacucuggugugauucaucccucaagcgcauucuaauucagucaguggaagugaguguaaguauacaagcacugucccuucagcuucccugagcagaucucgaauagaagaucgucuucagcaagaagugaccaccagauggcaguguuugccagcagugacaugauaaaaacaccagcuucccuuuuaccuuagcaaaauucauucugacuauuuguaacugaucacuaucuaagcgcauuuaaauguuuggauauaugaauaugucaagugcaguuucuuugaaaauuagacugauuuuuggaaguguugauauagcccuguuuuaaaauguaguuuaagcucagauacucauuuuuuauacucugcuaaaaguguuucuauaacauaaacugauguugaagauaguuuaauaagaccacagaauguuuauuuuguaauacguuuuucuuauguccaaagcagauugggaauaaaaguguuugaccucau

SEQ ID NO: 8408 - RNA, 11882 nt, Mus musculus
cagacacacucagauugcagaacaagacggagaagagagaauccaggaggacccacagccaugagacagguguguguguguguguguguguguguguguguguguguguguguguguguguguguguucgugugugguaucugccgccaugcgggguaauuacuaccauaugugugaccauauguauuggggucuaguaagaaugugcuuguaagugcauguggugaguccauguguaucuauguaugacaguguucauguguucagugagcaugugaagaugagugugugaguguccaucucuguguucacugccgugagguuugccuuccauagaugucuaugauucuguaaauauauguuuguguucccugggagugaaagaagauucugccuguguguaacacaugcauuuuggcuuuugauuguuuuaugggaucagaaucuacuuaguugaaaaacaugcagucagcaauagucaaccucucuugcccuguaaaauuagcaguuucauauguuugggguucauuuuaacuguucaguauuucuucugaaaccuuauguuucagaugacugucuuuguauuuauugacauauugcuauaucuccuugauacuguuucuuccugaugcugaggccuuauguccucagguccccuaaaugacugucaaaggaacgcuguguucagccugagacgugguacucuugugaagcauggugcuuuuaguugugugguuuuaauguuguggguacagccguaggugcauguauccauauugcuggcaucaaaaaacuuccuucuaagaugagcuagcccuaggagcccaggcagagcuguguuugacacaaaagggcaggaacaaaggagucuaaaagaauaauuguuauugguuauuuaaauuuucuaucucuaguuggguaccauguaccugaggucuuagauacuuggcugagacagggggaugcuugagucuaggaguuugaggguaaucugggcaauacagggagacccuguaucuucuuuaaaaucccauaaaaaaaaaaguaacucaucucuacugcucagaaacgugaacuaaacugcaauauauuguuuuaaauccucuugaaaaguaaagaggggucaugagaugcucugggggguaaaggagcuugaugcuuagccugacaauuugaguuuggucuccaagauccacauggcaaaaaagagagaaccugccaggcagugguggcgcaugccuuuaaucccaucacuuaggaggacgaggcagguggauuacuggguucgaggccaggccagccuguucuaaagagugaguuacaggacagccaggaauauacagagaaacccugucaagagagagagagagagagagagagagagagagagagagagagagagagagagccauaauuaucuuccaacccuucccaccacccaucccccacacaaguauacagcaaggcacaugcacuauggcaugcauauacccacacagauacacacaagauaaacaaauaaauaucuguaaacuuucaaggaaaaugaaaggaaauuaaguuuggcaguuucuuugcucuaauccagugugugagauggcuauaagcuuuucuaccaaauaccaggugauauuauuuggagacugaagaacacugcauucucugucaaaacuguucaaccuugauauucuacaguggccucaugcuugaguuaagaagacuggaguuuugaacuguguguaacguucaugcuccacaaaaauauuuuuguuccccuuuagcuuuaaaaacaauuugcaaauguaaaacauuacuuauuuguaagcgguacuggaaauuaguguacugaccacuacuguauacuuuaaaauaugauuauuuggggcugacaaggugcuugcugcuaagucugauuaccugaguucguuccccuacauguuaucaggagaacugucuccugaagguugcccugacuuucacucacacgcuauggcaugugcacuugugcauacacauaaacacacauacagacacuuuuggaacaggauugcuuuagggaauagggauguagcuaagcugauagagugauugcucugcaugcacaaagacacagauucagucccagcaccaaauaaauugagcuuaccucuaucaucacucagaaguuagaagcagacacaucagaaauccaagcacauucuuggacacacagugaagccaagguaaucuugggcuuuaugaaacacugucuaggggcuggugagaugggucagcgguuaagaucaccgacugcucuuccaaagguccugaguucaaaucccagcaaccacauggugccuuacaagcauccauaacgaaaucugaugcucucucuucuggagugucugaagacaacuacaguguacuuacauauaauaaauaaauaaacaaacaaauaaauaauuuaaaaaagaaacacugucuagaaaacacaaugguuuuuuuguugguuuuuuuuguuuuguuuuguuuuguuuucuuuucuuuuuugguuuuuggggguuuuuguuuguuuguuuguuuggggguuuuuuuuguuuugguuuguuuuuuuuuguuuuucaagacaggguuucucuguguagcccuggcuguccuggaacucacuuuguagaccaagcuggcuuuaaacucagaaauccaccagccucugcuucccaagugcugggauuaaaguugugcaccaccaugcccgaccacaaugguuauuuuaauacuuugcuaccacaaaauauuaaugaggccucuuguuuuguuacccaccccagacuaagacugaaaaguacaauguauaaaacgugguuuaaucuggguuuagguuuuugugaaauugacaguuaagaagagaagggucauguaucauacuuggucaaaacauauuucaaagcuuuucaguaaccaaauggagcuaaaugaaaauuuuguuuuaaauuauguauuuccauaugaagugcucgggauugaauccagggcuucaugcaugcuuggaaaauguucuacagcugagcuuuacaccaccaucuuuuuaccuuuuuuuuuaaaacauuugugugucugugugugugucuguguguguguguguguuugcuuacaaguuuggaagucagaggacaauuugcaagagucuguuuucucccuccucuauuugaggcugugguucuauggcugcuuaccugucacaggguucugucaaccuuugucuuugcuaucuauaccaugacuguaaaugcugucucugagugcucuccugagaggagaacucaguauagaaggacugauuaaugguuggcaucauggauucaagucccauaaucuuauauguaacucugggcauuugcauuucuaugacuauguaccucaucuggaaaaugggaaugauaaaaguacuuaccugggguuagaaauguagcucaguugguagaauacuugcauaaacucagcauagugguacaugccugacaucccaggacuccagaaguagcaaaaggagggucagaaguucaaagacauccuuggcuacauauaggccaggcugggcuacaggagaacucaucucuaagauaagcaaguuuguacaaaaggguuuuaaaaaagcaguucauacacauuuuguguuaacuguuuaguaugugguauugugucuuggcacagagaaacuuccauuugugaaguuauucuuaacuuuauuuuguuuuuuaauuguaaaaauuacuuuuuuaugggaggguacaccaagacauuuguuuuaaucaaagaacagcaaguugauuucucuccuucaauucuguggguuccaaggaccaaacucaguugucaguuguggaggcaggcaccuuuaucgccagccccauauuauguaugggccacuaacaaaaacagaguaaaagucuggggaguugcacuguguaauccuuuuauauacuagagauguuaaaacugugggagagcaaggcauuguaacuuacuuuaguaggcagccaguaaaagccuggcuuggugacucucuccuuucuucccuguacucaggagguugaggcuagaaauuuggguguuuuagaucagcuggggcgacauggaccuuuucuacuaaaaggggaggggacuaauaaaaguaggcauuaagccaagauuauagccacaauugcuucaaauauggugcucagaguaucuucuuuauaagaaguccugagagauagguaucuccaugguuaauggcauaugauguccuugcagaggaccugaguaugguucccaagaucaaacgauuucacaauuaccugugacucaaacuaucccauacccuuucuggccuccacggucaccagacacaggguccggggacaugcgugcagacaaaacacccacacacauuaaauaaaaauaagcaaguauuuaaaauauaaaauauaucauuaaaaaguucugagaugucagcauccaguuuaggagaaggauuaccaggaguaaagucaccuccaucagggccccagggcuaauccuucuccuuggucacccacaggacaugccaaagcccucagaggcagcgcguugcugcucuggccuggccaggcgagcacucacgaucaucuuugcccugcucauccugggccucaugaccugggccuacgccgcaggcguuccucuggcuucagaucgcuauggacuccuggccuuuggccucuauggggcauuccucagcgcacaccuaguggcacagagccucuucgcuuaccuggagcaccgaaggguggcagcggcugcgcggcgcuccuuggcgaaggggccccuggaugcggccacugcacgcagcguggcacucaccaucucagccuaccaagaggaucccgcuuaccugcgccagugcuugaccuccgcgcgcgccuugcuguacccgcacacgagguuacgcgugcucauggugguggacggcaaccgcgcugaggaucuguacaugguggacauguuccgagaagucuucgccgaugaggaccccgccacuuaugugugggauggcaacuaccaucagcccugggaaccagcggaggcuacgggcgcugucggugaaggugccuaccgggagguggaggcggaggaccccgggcgguuggcgguggaggcgcuggugagaacacgcaggugcgugugcguggcucagcguuggggcggcaaacgugaggucauguacacagcuuucaaggcacugggcgacuccguggacuacgugcaggugagugauggguuucccagggacacuuguaaguaugauaucauacccccacuaccaccaccaccaccaccaccaccacuuaagaaagaguagggugcauccaagcccaugcuugggagguggaggcgcaaggaucagaaauucagucugguuugaacuuuuauccgaccuccaauagaccauccauucuuuaauauagauaagagucaauuuugucuucucuuaauugugugugugugugugugugugcgcgcgcgcgcgcuccaauucccauuaccaccccccagcauuauauugcaggcaggcauaugcagccacaccuagucuuuuacacggaugcuguggauucaaaucuagguccucaagcuugcacagcacucacucacucuugucugcacagcuaucugccaggcuuuuaaaacuuuucuucuuucgucaucacacguucagacucucauucauucauccauucauucauucaccaacuacugaugaauugauuuaauguggauauuuagccaaucauaucuauccauuugcuaugaguccuuucucccuuugaugugauucuuuuucauucagugguacaugcagugaauucacucuauccauuuguaugcugcuuacugugacaaaauaucagaccaaagcaacuuagagcaggaagagucuauucugacucacagcuugcugguguguguaucaugauaaggaaggaauggacucaggagcuugacgaagcugaucacacuucuccugcagauaagaagcagaccaaguguucaaacacagcaaucuaugggagacauuucacauucaaaccacaacaacacuaaaugaaaaaaaacaaaaacgaacacauuaccuucuuucauucauauagccacugaaaaacagaaggaaacuaugugaucauacauuuguucauucauguagcuagcuacucauucauuuacuauaaugauucauucacuuaugcacccaccaaccuagccagucauuguauaaugcuauuuucuuucuucauguaauauagaaauucuuuuaccguucuacucacccauguauuuucuauacaaccaguguggagcuuacccacuuauuuuuucacuuacauuuuuauauagggguuguucucuccucccagucccuuucuugcuuuuuuuaucaauguugacauuuuugucauccauccaccuaugaaauacagaccuuuauuuccucauacguucauccauucauuggucauucacuaauaugcuacugucuuaguuucuuuucaugucacugugagaaauacucccggaaaaacaccuucagggaaaaagggcuuguuuuuugcucacagcucaaguagcuucuucauggaggggaauucaaggcaucgagggcuuuaagccauugcauccauccacagucaggaugaaugcuuguguucagcucacuuccuucuuuuuauauaauuuaugaacccagucuggagauugguuuaaaguguccauaaaccuuuccaagccgcagcccaguucaggguucuagucugaucuggcucccuuccucuucacaggucugugacucagacacaagacuagaccccauggcacugcuggagcuugugcgaguguuggaugaagacccccggguaggggcuguuggaggggaugugaggauccuuaacccucuggacuccugggucagcuucuugagcagucuucgauacuggguagccuucaauguggaacgagcuugucagagcuacuuccacuguguguccugcaucagugguccucugggugaguggaagcagcuuggagggcuuguggguagggaacgaaggagaaaggaaggcagaggcaagguaaaguugaggacaaagggcuagggucuggauuucaggcaacauaacauuggggccaguggguagagaugauguuagagcuaagcugaauuuacugaagaggaauaaaguuaggaaggggaaaaggauggagauuggggaaguugcugcaaaaguguuguggaaaggaguaaggugagguugaacagaguaccgagaaugcaguggauuuuuggggagauugaugaguuuggugacauggucaggugacaaacacauuggaaugaguuugauccuaagacuggggcugguuggggggauagugugguacaagaauggagauaaggaagcacggcgugggaaacagagaacauuguccauaccagaggcugaugcuuggauacuccccacucuaccuaggucuauacagaaacaaucuccugcagcaguucuuggaggccugguacaaccaaaaguuccugggcacccacugcacauuuggggaugacaggcaccucaccaaccgaaugcuuagcaugggcuaugcuaccaaguaaguuaagaggaccaaguggucaaaugugugaagcaagugaguuucuuugauggagagagugagagagaaagagagagacugagaauagauaccauaaaaggcagaggagccauuuguauuuagccaguggucuucggagaguuugguauuaggagaaaauuggagguauuguaaagguuggaaaggguuuucaugaacucuuuucauuaaauagucuccaucaaacaaagugaggguauauuaacuccacauggaagagacaagguagguggguugagugaccuguaccaaggaaaccaagccagcauugaaguaaaguaagaggggugagaugaguggguaggguaagugaaaacaggugacaaaugcaguaagaaaaaguagccaacugcuggcugagaagagugccugauggccucuaagcacucuggagaagucuuucauugacaacaugaauuugguuacuaagucucuguugaaugcucuagaggcacaucaguagacaaaggaagacguaaauucuuccuugcuuugaggagacaauguaucuaucaguauguuuugagacuuuucccaggagaggagucuugaucuaauuuaauuuuuguuucugccacaaauauccuugacugaaaacaacuuaagagagggccuguuuauuuggccuacaccaaucccugaucccggugcuucaaggcaggaacucaagcagccaguaacaucacauccauagucaaaagcagagagaaaugaauggaacuugccaagcugccaccuucugcugacuacauagauagcuuucucuacgcuuacacuguccagugccugcccugugaaguagugcuacucaaguucacaugagucuugucaccucagugaacaaucaaaagaguucccaacagauaggccaaaggccaaccugaucuagacagcuccucaauggaggcuuuccucuauauuguggcaaguugaaacuaaccagcacagauguaaacagacauccauuuaccccagucugggcacaaaugacauaccaaaacagacaaauaacggagcaaaacaaaaucuaccgaaguuuaacauggugcuagugagauuguuggguuugcuuauguaugaaugauucugaggcagcuuuggcagcuuacaagagcugcaucuguagaguucccugcauaccuugcaagcagcuccacugcagaaucccccuccccugccacacacaccucccuuaggaggguucuucuucuaacacuuuaagcuuccugggucuacgucuuauaaguuccaugcgcaucuauuaacuuuuuaaauaucccccuccucucuccaagaggaaauguuucaguuuggagaauacuguuagauuuggaauaaucucauuuuagccuagggcaccaggaaagaagacagaaggccaacacggguccccuuguaaaaaggcucauagggccuucaccaaaaaagaaugguggugggcuuuaaggagaagauuggcauguaccagcauccucagacagcugguuugggugcaaacagcaaaggcaaaaucaaacagggcauggagugagccaaaugacucaaagaagagagacucugucaaguacugcccuuggaaauagacuaguuugacugauauugccuaaugaacuaaauguuucugaccaccugugacuuucccuaauuggguuucuaucuaaccuugauggguguggcuaagucaugcagggacagaauaaugguuucugccucagccacaaggaguccaacuguucuuuucagaauuucuuacgcagagacuaaccugaguagcugccagucucaucuugcuccucaugucaggaccugccaauuuagucagcacuuagucaagucacugacgguguuagugucgaugacuaucauauuagucaugucuguaguuacaguguuagucacaggaaaaacagcaguagcucacauugaucgagcaguuacuagaaacugcuuggaauuucgaucuucauccaaucuggguuguuguaaauaugaaauaaugguauaggaucauagaaaguaugcuuagaaggcuggagaggcaguucguugguuaagaguaccucuuccagaggacucaaguugaauucuagcaacgccaucugguguucacaauugccucuacaggggacauucuucuugccuccuugugcauccauacacgugggcauccacaccccaccaccaccacuuucccagacacacacagacacacagacauacacacaaaauuacacacauaggcaaaaaauaaaacaaaccuuucaacaccaaaauggagcucagagaggcuacguaugauagcuaguauugucaacuuugcggaacguaugaucaccuagaagacaaaucucuaggcaugucggucagggauuuucuagacuagguucauaaaagugauaagacccauccuaaaugugggcagcgcuagccauuuuguagggugagguaccccagauuguguacaaaguagcaagcugggaaagcuagguugccuuggcugauaaagaucugaggaugagagcagauuccuguaaagaguccacuaaccgccacucaaugcuugcacauguacacaaacacacacacauacacacacacacacacacacacacacacacacacacacacacacacacaccauucauuucucucugcuuccuguccaugggugcaaugugaucagaugucucauauugcugucuccgugcuuucucuuccaugccagacuuuaucucugaacuaugagccauaguuuuuccuuccuuaagucaucauugccaugugucuugucacagugacaacaaaacauacacggaacagaaaaaggaaaggaaaggaaaggaaaggaaaggaaaggaaaggaaaggaaaggaaaggaaaggaaaggaaaggaaaggaagagacccccaauaguagugaaaauggucacugugaaauucugccaacuggacagcaugaacaccucgcucugggaagggaccaaguuucaauugccagcacccauauggaaguucacaaucuccuagaacuccacuuauaacucugugaugccccucuucugaccucuuuaggcaccauggacauauauagcacacauacauacaugcaggcaaaauaugcaggcagauaaaauuaucuuaaaauuuaaaacuccugcccagaccccagggagaaaaacacugaugccuuucuuucucugugccugucagguauaccucgcgcuccagaugcuacucggagacgcccuccuccuuccuucguugguugagccaacagacccgcugguccaaaucuuacuuccgagaguggcuauacaaugcucugugguggcaucgccaccacgcauggaugaccuaugaagcgguggucucgggccucuucccuuucuucguggcugccacgguguugaggcucuucuaugcagggcgcccgugggcucugcucugggugcugcucugugugcagggcguagcacuggcaaaggcagccuuugcagccuggcugcguggcugcgugcgcauggugcugcugucacucuaugcaccacucuacaugugcggccuccugccugccaaauuccuagcguugguuaccaugaaucaaagugguugggguaccucgggccggaagaaacuggcugcuaacuacguccccguguugccccuggcacucugggcucuacugcugcuuggaggccuggcccgcaguguggcccaggaggccagagcugacuggaguggcccaucccgagcagcugaagccuaccaccuugcugcuggggcuggugccuauguggccuacugggugguaauguuaacuaucuacuggguaggugugaggaggcugugcagacgucggagcggugguuaccguguccaaguaugagucuggacaugaagaugcagcugagggcucuuaaaggaggaguccuugugaggcacccccuggagucauggcuuucuggggacucaguuuaccuucucuuugaaaugagggaguuauuuaagauucuucaauauggacuguauuggaacucagaucuaggucucuggggagggguaauuuauugaucagggagugggauuguaggaccagggccagaacgucuccauuuucucccuguugcuauuuaauguuuguacuguaagauuauauaauaaauuuuuuauuuauuuucuuccaag

SEQ ID NO: 8409 - RNA, 2028 nt, Mus musculus
cuuuuuuuuuuuuuuuuuuuuuuuuuuuuaaacaggugggguagcaacacuuuauuaggcuaggccaaccaggaggcagcacuggagugaauggccccauagcacauuaggggcaaagaccuccagguguauacuacuuuucagcccugccucagugcuguccacucaaggcugggccauggauugugcagcauaggucuggaagcgggugugggcucgcuggugugugagcagucuuagagacauuguguccacagcugccuccaguccuggcugcugagugaucuccacuguguagucauuagccaguugcaaggaggccagcauggagcggcacaccucaaaagcaggcugcccugcuacaagcucugaaaagggacaccauucauugagcugggggaaccgggaagccaacugguccccauagauauggauaucaaagggcauaugcugcuccugcuucuggagcaggggcuggaugguaucuucccagucccugaugcguuggcucagcucugucuccuggauacacuucugggagguggcaaugaagaguuccacauuucuucgaaccagcuccuuguaucucauggccucugcaucaaggucagcagcugcuuugggcaucaccccugcaggcuccuccacauacuccucgggcucuagaaagucaucugcuaccccgagguccuccucuguaggccacagauccugcuuggccccagguagccaucucuuguuuaucuuacgucuccgcaguuucugaagggucucgagcuguucuuucacguguuuccaguacaggacuuccaugucugcaaagguugggcccuuccaccgagcccuccugccgucaggguguucagcauaggcauccuuguaccacuuguggaaguucugcaacuugguggcacccuuccucuugugcuucuguccuggagccuccuccacaccagguggcacagaauaggguuucccuuucuggaggaccuuagauucuaaggagucaaaaggguccaggcucugccaggggucuggggucuccugcagccgagaggcaggcuccggggccccuuagcauguaucuccuuggcaagauggcacucugcugugagguccugggcucugcaggcucuagagcaaccuucaggggcucugcuccauccucugcauccuccucuccaccgcugagcgcugggccaucuggcucuugggagaugucaaguacaggaacaggacucccguuccuagacacuuccuugggcugcucgucagcguccucgggaucuuucuggcuccuggacaugggguauggcuccaccggcaccacaggcaccacgggcaccacagguuucacaggacacauucccacuggaucuaacauaaagcagccucagggguuaggaauacacguguucauccugaaauccuuccggcuggccaagacgucacccugacagcuauacaaggggccgcuguucuuuuccgcuucaucaggggccaccagggccaugggcaguagggguaugauaaacggcucaccggaugccugaucauuuuucagauccacauuagccagggagucggggaagucguccagugacaggaacucauucucuguuucacagggagucgcugaguugacagucuucuuucucccaucauccugaacuaaggagagcuauuuggcccgccucuugccagaaauaaaaucgagagccugguagaccagcgaguagagguacuccaccuucuuacuguagacacaggcugagcccuggaucaacagugcugccucaaugaaguucauugugguuuugccuucaucaaaagaaaugcagaucugguccagccagcugugcugccacguccaccucccaguucuuagugagaucccugaugggcugcaagaggugagcaaagcgcaccuccacauccuccaugucuagaacgggacuagaagcccggaaccauggcucaaccugcuacugguucuggcaccauuuuggugcucccgccccggaaguc

SEQ ID NO: 8410 - RNA, 34170 nt, Mus musculus
uaccccggaucugaccgcgaaugcugaaugcacuccugcgcagcgacccggaagcgguuuugcucugcauaaauuuuguagcugggugaguuuucccagauucuuuaggccgguugcuggcacucagaacccggaccucugcccuggaguccccaucuugugugcaaagcuccacucggugacgcggagagcugcgagacugaggaaguaggaacgugggagagagagauggcagcggagccaggggaggggauggagccaggaaggagcgggggcacggauucaaaagcuucagcggucggggaggagacaugacuaucguuugugcgggcagugccaggugaugcgguacuagagagugccgcgggugacagaauagcagaggagcagcuugccgcggcgccugguggaaaggaaaaagaaagcagggucuggagaugcuggcaagaguggagaggagggugagagaacagcuaaacugccauaaugugugacagaaagaaaagcaggcgauggaagcgaaagggaaaguaucuggggagaacuuccaagaccaaguucucagaccaaguucucagcacaaagauuuauuugucuuagagguacagaaggcccggauaaaggucagagacaggagauagaggaagaaggggaagggaacaaagaagagggcagaaaggggcaagagagagggguuaggaguauuuguccagaagugggacaaaugacuguuucuagauagagaggagacagaugugacccauaggcaaauggcggcuuauagagguaaaaugagaauccccuuauuaggacgagguguuuagcuggcacauuaauuaggugagccagaggugccuuucgguugccagacuucaaugcuuugauagcugggccuucauaguaagugucaggaggaggaauuggccaaauaaaggaauagacuuuggguguagcuuuaggaauguaaucugagaguuuuuagcaaggcagagagaggaaaggggcaaggccuaccagagucauggucaccaugcuggagcuggcaaagucccuucagaaagugugaauaagauagugcagaaugagggaggggcaggcuggauaaagcagaaguugauggaauaguaagguuauuauuacugagcuugucuuuguuguugaaauaaaaaaacccuuaauuuuuguuugaauuuuagugguauggaagagaguugcaaaacuugaucugaugggcauuaacugguauuguguuaggcaugguggcacagaucaguaaugccagcaugugggaagaaagcugggguaggaaaauggagacuuuaaagguggcguggaauacuaagacaaauaacuaagacacuuucucaaugaauaaauacuguugguguuuacugauccuuuauaguccuuauacagccagaacuaaugugagauuuuuuagacagugucacccuucuuugacagggguaauguguggaggagcugugggauucuucuaacccccuaacacuuaacuuuuagcauagaauguguugccuccggucacaguaaaugugugauguuuuuucuccuucaggcaccaacuuaaguacuuuaacucauaucuuuuuuauuauuauuauuuuauagacauuuuuaugagauauuuucuuuauuuacauuucaaauguuauccccuuucuuaguuuccccuccgaaaauccccuaucuccucuccccuucccuugcuccccaacccaccuacuccugcuuccugucccuggcauuccccuauacuguggcauagaagcuucccaggaccaagggccucuucuucacacauggugggacucauggcucuagcuauuuauuuaacucauaucuugcucacuucaaacgccaccguuucucaccacuguacccuuucacuuccaagucccauguccugaauauaacuugcuaucacaagugcuguuaaucuacucacucagcaacagauugucagggaaauccuuugguuagguuugcucauuaugagaaacaagacaaagggaacaggugaccuuuucagaagaaucuccuguacguuucaacaugucauguagggaagcuguccacuucugaaguguuggcugaagguucugcuuauauugauuuugucuauuugguuauauguguuuguauguacacaugugugcauucugagugugugcaguggcauuccuuguauuccugaucuuucugagaagggaucaaguuuuagagaaaagugccaagucaccuguugucccuccugcaguaguuuguuguugcuauauccucuugauauagugggcuacagaugcccuuauuucuacauggugaaugaaguccugccuguggcuguggcuguggcuguggcucuggacacaggaagugggugucuugcugggcugguucccaugcaccuguaaucccagcucucagagacugaagcagcaggaucaugcauucaaggccugcccaggcuauauaguagauucuugucucaaaaggggaugauaagugaaugcauguauccuggauauuauacuuuugcuauuuugagagacgguuccguuaguuccauauggccugaaaaucacuauguugucuagacuuucaguugacaauccucugcuuugaacgaugugauuguauguauaucccacaauauccaggcuuuauuauuuauucauucauucccagaauaagaguuuuuacuauaucaccuugcaagcaugugauauacuuaauuguaugcuuuugguauucaggauugacuucuaaacauuaauguugcacaaggaagaaccugggagaaggagaagaaagaggaaauaaaaaaaaaagccagggauggcugucacucagguacaguaaguacgccccuuccccauugauucucugcucucugaaguguuaggcauggaaacugcugaccuucacuggguauaggcuagacuuguucacuugcucuugcucauauuuccuuuacccacuaaauuuuauaaugcaaugauccugucauauagaacaugggagaagcuucccuugaguguccaaggagcagccauuaugccguugggcaggaagguuugucuagguucauauccaagugaacuguuagcacucuagauguagguuaaagaaacuacacauggaagucauauguuaaugagcacagaucucuuuugaguuaugaagggaaaugagaccuucaugggaaaucauauucugccuaauucaguacguuacggauaguaaaguugauggucaguauuuccaagagaacaucucaacaacaagaaaauggaaugagggauagagggugcuguauuuuaucaucaagauacuauaguuuuggggucuuuuguauauuuguuucuccuauuuauuuauuuauuuauuuacacuuauuuauucaguuuauauccuaaucccagguuccccugcccugucccacccuuacaaauccccuuuccucauuaucaccuccccuucucagagaaauggauucuucuugcacuuggguaccacucaggccugggacaucaagucccagcagggcuaagcaccuccugucccacugaagcacagccaggcaguccagcuccgggaaaggaaucugauggcaggcaauagagucagagacagccccugcuccaauuauuaggggacccaaacaaaaacuaagcuguacaucugcuacaaauguguagggggccuagggccagccccugcauggucuuugguuggugauucagucucuuugaguccccaugggccuagguuagaugucuuuguaggucuccuugugaugaccuuguccccuugggcucacucaguucuaucuuccacucuuucccaagacucugccagcugcaucugauguuuggcugugggucucugccucuguuuccauuccacugcugaaugaagcuucucaggagacaguuaugcuauguuccugucugcaagcauaucagaguauuuugcuuguuugguuaguuagauucaguuuuguuuuguccuuguuuuuagagagacuguuuuccuguugcacucaggcuaucuuccugagugcugauauagugaugcacaugaggcuuucaucucuguguauauguaaaguauguacauguucaugcgagucucuacuguagguauauuuggaggucagagauuaaaacaagcguuuuccuuagugacuuaccacuuuuauuuugauacaguaucucucauggaaucuggaguuccuuaauuggcuaagcuccauggaucuguguguauccauccauguagcacugaguuuacauaaugagaugcacucaaguuuuaccuaaugcuggggaugaaaauuucaguccucaugcuuuccaggcaaguacuuuacuuccuaugcugucaauaggaaaugaguugucaauaggaauuauagcugagugcucaacaguaggggcuucuguaaacaacucauccugcagacccugcuguucccaugggacgcuugugaagcuggcauuugggguaaaagcaguuauauuuuucagcuaucuaugaacauguccuuguaauuaaaaaaaauacaguaacauuucccuucauuugauuaauauugaauauucaggaauaaaauuuugagggcuggagagaugguucagugguuaaaagcacugauugcucuuccagagguccugaguucaauucccagcaaccacaugguggcucacagccaucugcaguggggucugaugcccucuucuggugugucugaagagagaaaugaugaauacauaaaauaaauaaaucuuuuaaaaaaacacaggaaauauuauuuaaaaagaagaagaaggaauaaaaauuugaguguguguucuaacaugacucuuccaucguaaaucuggaagcgguccugaguucuaggcagugaaacucaucauuuucuuuguugcuuagacuuccaguuucucacauagcaauaaaccauagcugcaguucuggcaagcggucaugcaauuuuuaaaaauuuuauuaaaauuuuaauuuuaaaaauuuuauuaaaauuuaaaaaaaauauuaaaauauuaaagauuuuauuaaaaauuuauuuuuuaaaaauuuauuuugccuguuuuucuuuuagagaaaaaaaggacuagcuuccuuauuuccuuuacgacagccuuuaacucuguuccauggaccccuguauaguucaggcuguccuugacuucauaguaaaagcuuuugccucaauuucaagaggucugugaguuacuauccccaucucuucacuguuuguagaaauauucuauaaauuaauauacaucgcucuuccacagucuucagugagugaggcuuucaucacuaugaacucaucuugugguagaauauggguucugaugaguaguuacucacauagcaccacuagauugcuacagauuauaacaugaaagauuguuucaucuucugauagcuucuucuauuuuauccuccaaagaauugaaguuuuuaucauacaggucuuuuauuugcuuaguuagaguuacuccaagauauuuuauuuugaauguuuuuuuuucacaugauauuuuucucaguuuuuuauuuguauauaggagggcuacuucuucuuucuucuuucuucuuccuccuccuccuccuccuucuccuccuccucguugagacaggguuucucuguagcccagacuggccucgaacucagaaauccgccugccucugccucacaagugcugggauuaaaggcgugcgccaccacgccuauuauuauuauuauuauuauuauuauuauuauuauuuugagauccaucuguaagucauuuucucaauuagugaucaagggggagggccccuuguggguggggccaucucugggcugguagucuugguucuauaagagagcaggcugagcaagccagaggaagcaagccaguaaagaacaucucuccauggccucugcaucagccccugcuuucugaccugcuuaaguuccagucuugacuuccuucagugaugaacagcaguguggaaguguaagcugaauaaacccuuuccuccccaacugcuucuuggucaugauguuugugcaggaauagaaauccugacuaagacaauugguauuaggucuucuuugaauaucugauuuaaauuuuguccugaaccucucuggcccugugcuuuucuugguugggagacuuuuaaggacugcuucuauuugcuuaguguuuauaccucuauuuaaauuguuuguuugaguugaaguuuuauauguagauucuguugagaaaauagucccuugcuuuuagauuuuuccaauuuuguggaguacauguuuuucacuaugaucuaauuauucuuugcauuuccuuaguauuguuaugcccugcuuuuuauuucugguuuugugaauuuggauauuaucucuguccuuuagugaguuuggaucauggucugucaauuuugcugauuuuaucaaagaaccaacuguuuguucauuuauccuuuccauuuuucuuuuuaguucuauuuuauugauuucaguccugaguuugauuauuuccugccauguacuccuuuuuauucuagagcuuuuagguguccugauaagucacuagugugcucuuucuucucucucucucucucucucucucucuccuuccuuccuuccuuccuuccuuccuuccuuccuuccuuccuucuuucuuucuuucauuuuuuuaauuggauauuuuauuuauuuacaguucacauguuauccccuuucccgauuugcccuccagaacccccccuaucccauccccccuccuccugcuucuaugagggugugccuccacgcacccacccacucccgccuccccgcccucgaauuccccuacacccgggcaucgagccuucaugccuucuggcuaagaucaaguguaguauauuucuacuuucuuaaugaaggcauauagugcugugaauguaacucuuaucaccacuuccuucuauaacaaaggcuucaguguguuguucauucauuuucauuggauucuaggaagucuuuacugucuuuauuucuccugacacugaauucguucaguagggaguuguucaguguccaugaguuuguaggcuugcuguuguguuuaaaugcagcuuuacuccacgguggucaaggaagcuagaagggguuauuuucguuuuacucaguugggccagguugcuuugugacccaguauguggccaguuuuugagaauauuccaugaguugcugagaagcuauauucuuuuguauuuuggugaaauuuucuguauauauauauaagguucauuaaauucauaaugucugcuuucuguuuaauuuuugucuggauuaccuauccauuggugagucggauacugaagucucccacuauuaauagcugagguucagugugugauuuauguuuuaguaagguuucuuuuuuuuaaguuagauauuuucuuuauuuccauuucaaauguuacucuuuccuagcuuccccuccccaaauccccugcuuucuaacccacugacuccugcuuccuggcccaggcacuccccuacuuuuuuuuuuuuuucuuuuuuuuuucuuuuucuuuuuuguuuuuuuuuuucgagacaggguuucucuauauagcccugguuguccuggaacucacucuguagaccaggcuggccuugaacucagaaaucugccugccucugccuccuaagugcugggauuaaaggcuugcaccaccaccacccggcugguuugguuuuuuucauaguguuccaaauuuccugcauguuuuguaucacaaauuuaguagauuuaacauuuucuuugaucaaugaaucuauuacuucucaguagcuucaaccccugagagucuuucuuccaucuccaguagucuauugcugauguuuguaucugcaguuccuguucacuuaccuagauuuucgagcauuucucuugagguuugaccuuugcuaugcuaacuucuagucacuucuagaaacuacaaaaagaccaagugaugcuaugugaccuuguuccccaaguuauccuuuauuggugaauaaauaggcugauagccaguagacauaggugggauuuaggaugcuuaggcuuaggguuggaggagaaccacaaggugaaaaaaggagaaaaaaaaaaaagaagaagaaaagaaaagaaagaaagacaaugaagagaggagaagcccuuguugggguaagaaucuuaaaauaauggccaugugcauuggcauggcaaauuauauaaugggauuauuggguggaaaauagacaaaauagcauagaauauagauaucugcucagcucuugugcugacuaaggcugauuacaaauauaaagguuguguauaucuuuuaucugggaaggucaaaggcaggguagaaacgcugaauugagaguaaauguuucuacaccauauuucuagaauucccuccauuuuuguugucuuuauugcuucuauuucaauuuuuaggucaugaccaguuuucuucaucugcuuguuuguuuccuuggcagucuuuaaggaauuuauugauuuccuccaauguuuuguuugucucuuccucaguuucuuuaagagauuucuuguuuaaggacaucuacuaucucuauaauguuaguuuuaagguugguuucuugagguucagcugcauugaaauauauucagucuugcuuucauaggguagcugggcuccagagauacuguaucucccuggcuguuauugcuuauauuuuuacacuggaauuuaugcaucuggauuugauuauaggucuagaugcuuauuuuugagguuguauuuguuggaugugguauucuuugguuucuguuuucuguuuggucuuauguuccuuauggccugaauuucugucugcccaacuuggccuuugaucaacuaaagagccuuugacuagguuaguggcuagacuuugaaugacuagcuuggccuuugguucaggagggaaggugaugaagugggaagggggagguguaauaguaccuucuauucaccugauguaauugucaacugaggcuuacuuucuagauuguuuuuagcaucucacaauuacugcugaaucagcucagcccuuccuacuucuuucugaacucuggcuguucugacucaaacuccucuucaagcuuagugauuugauuuaccuucuaucuacuucuccuuauuuauucugcuuguccucauacaaacuuuggcaauauguucuaaucuucugucuccuaauucucugucuugucuucuuuuaacuugugucuggcuuguucuauuuugguaaaacugcccuccccccucugcauugcucucucauaagucaauuuucuuuugauucuuuuuuucaugggagaugauuugucacuuuuucugccacucaauuagauaccaguuucaaaacauaggugauuccuucuaaaagcuaacuuuacuuuuuugaauuaaaaauguguaguaagggugugucuguauuccagccagagggauuaaaggugugugcuaaggcagaaccaccucacaacuagaaaaaagaauuuuuuugccaguaaaaaagauaaucuuggacuucacaguguaaugaaauaaccuguaacaggcaggcauugaaauguguauucuaagccaaaucuagagaguaggacaguuuaucuggcagccaagacacuccccuguucuucugacugauguguccugaaccugcauggugggauuguguggaauuguggaaaugugcuggaaauggcaguaggggccuguaaggggagcagugagguaggagggcagaaauaauagaauaugccuuuagaaaccaagucgagggaguaagaguuaacuggugggcaggcuacucaccugcucuuguuuuuguuuuucuuaaagccucaugacuuuaucucugaagacacugcccauggaauagcucagcuagaaacugaacagggugugucagucaucuuaucuaccaguacaauugagauaagccuaugggauuuucuuuuuuucuuuaaugggauaagaaauaagugauaauuauuaguuacaguuacugggcaaaagggcauagaaaaaugccugggugaacagagugaauguaugggaacaggagguaaaugaaaggggcacacccuguuggcuuucauuuguuugcuauuucuauuauucacaaacaugagaaaugcacugugacauaccauaauaucucacagaaaaggaaaauaauuuuagagagaagcuauauuccucuguuacaucuuaauuugggaacauaggagaaacaaggucuguuacucccuguaugcucucauucaucagaaagccuaggcuaguccacauaugaaguuuuccccacaucccaggcaaguaauucuccagugaaccccagcacagugucaacuaauucuguugcauucugacacuagacagcuagaagcaucaguuccguagacugcucucccucucuucaguuuuauguuucauuuucuaaggcagcucacaguacucagcaaaaccccaaccuuucgccauuuauugugaaggacauuccaaagacuauagaugaaugguuagacaagacacaaaaugugagguacaggagauaggcuguggcuuuuacccccuucuuggguaagccacucuguaggacuuuugaccauggcagaauguaaggaaagaacuuuaaacucuguccuuugaggauuuacagagguuccaucaaucacaugauuacuuaauaccauucaucauugcuguucacuuaagacuucagccccucuacucucccuagaggauggggaguaaggccuaaaguucagaccuauuccugccuuggccaucuugguucccagcaaccuuccuaaaacacaggacccucaaaaccuuauuucaacugucaacaucaucauaggagaugaauccauucuuaucaguccagagaugacaagugaauuacacaucugagaacuaaacaaagacauguauuuuguaauguuacagcauggaggugguuuuuuuuuuuuuuucucuuuaaauuaguuuaucuuuuugguuuugguuuuucccuugccucaccucuuuguaaagauccuaaauguccacaugguaaaauguguuuguucccuuuuagggacaguugucauucagugauguagccauagaguucucucaagaggaaugggaaugccuagaccaugcacagagagcuuugcacagggaugucauguuggagaauuacagcaaccugcucucccuggguaaggauggcuuccuuuguaauuuuacauuuuccuucugugccuuuggggagccauuuaacuuuucuaccuuucuccuuuccucucucccuucuuucuucccucccguuguacacugggaauagaacccaagacuuaagcauucuaccacugggcugugucccaggcccuuauuauaaacuuugguuguucuuuauuuuuuauuuauuuacuuucuuugagccuaguacuggaguuauaagcauuugccaccacgcauggcuauggccccuaggcacguguucaaaguaucucaauccuugcuuucuuucccuacgcuuuucagucaguaguccuugguagguaacuaguuaucuguccauuaagcucccagaaggaggcauucagugaugauuuugugaaguaguuuuccagauuuguauguaacauguucucuccucacauuagcacaguauggaauuucucuaaaauccucaguaccugauguuaccaucuuuuuauaaacaggagucacacuuccaaauuugaaugcuaugucuaaguuggaacaauacaaagggcccuggacuguggagagugaggcaauaagaaccagaaaaucaaauggaaaggaauauaucagagcuaugagugcagguaagcucuaaaagggcagaguagaugcuaccucacuguguaauggcaagugcaagggcucagugagaaauaagucugccacuauucuuuacagguacaaaaauuuagccauucacccucauguggugccagguaauuuugucugguuuuaaucuuguuuguguauuugagguagugucucacuuuuuuguucagucugaucugaaacucacuguguagcccagagugaccauaacaucugaguaagccuccugccucagccuuccaagugcuaggauugugugcguaagcuaccauauccauuuauguacagauaauuaaguuuugacaaaggugcuauguguguuuacuaaaaacuucaugaugaaauauuugacucucugugccaguguaauauguuccagaacuguaggcaggagaauggguuauaagauauugcuguucaaaccaggcuggcaugaaaaaucucaguucuuuugccucagucuggcaaaugaugauauuacauaugacauuacauauuacuuccaugcuugccugacauagaacuuugaaaaggugagucuaguugaaaauacuaacuggauaugccacccucaaaaggaauaauacugaauauaaugcuauauuaguaauagagaucaguuaugaaauaaucaggcuaaaccaggcaugguagugcauaucuuaaucuguggacuugagaaucugaggcagguggguauuuauaaguuugagaaaagccugaugcacauauuaaauuccagacaaaucagggcuauguagugagacccugucccaaaggaaaucaaaauuaaaaaugaauagccuaacaagcaaaacagcacauaauaguucuuuacuugguucauuuugcucaauaacauacuuuucagacugauagacauuguugcaauuagaacuuucuuugucugaaaaacaaguaaaacaaauauaauacauauagagucaacugguugcauaggaaggcuaauuaaauaauuaacuacuaggaacaacacugagaauuguauaaacaucccauagacacaucagucuucuagaucuacagaagcugaguugcuggaugauacaauaccagcauccuuucuggaucaucugucucaguacaacaccucguccauacuuauuuucauuacugcaaaacuucacaugagugacugagaagaacuuugguacugugugcuaaaugaccagguuuuggguuuuuugguuuuuuuuuuuuguuuguuuguuuguuuuuaauuuaccaucagguauuucccucuggguuuggagaaagaauuugcauaucauauauccaacagagaaagccaaagcaggaagccugaaacaagucaguuugaaaacagcacacuuaaagauggggauggacuuaacaugugcacgcacaguguagaagagguuaagcucagggccuagcugagauaguauucuaccaucuuccacucaccauuagaaauguugguauuucccuucuuuuuauuuauucuuuuuugagcacugcagaggccacucagccuccucuguagauggauuauaaguguacauugccauggccagcguaauagaaauuuacugaacagcaauggcauacaaaaauacuauuauugcagaaauaccaauuuucacccaaaugagccauuaccuucacuugcaaaaauugcuacuuuggaaaagcugagccuugguuuggaugugagggaaaggagaaucuuauuauguguugguuaaaauauagauuaggauucauugagaccuuuuuacagagacaucaaaaaaaaaaauaagaguuauuguauaaucaagcaacugagcuuuugaguguagaucuugaaaccucaagaugauguuucugugggaugucuguauuguucuugugacauuauucacaaguaaccaaguuauguaauagaccauguguccaucaccagcagucucucucucucucucucucucucucucucucucccccucccucccuuccucccuuccucccuuccucccucccucucuuguguguguguauguguguguguauguguuuuauaugaauuuuguccugcaaaaaacauucuacuuauuacaaugucuaucagccuggacaaucuauacacaaaauaaauccgcaguuaacugucacguuuuguuuuauuggacacccacuccaguucugacaauuuuucuguggauaagaggaauucauucggggaucauagucuucauuauauauuaucuacauauuuuccguauccauuauuuaucuguuaacauacauauagguaaacgccauuuguguaucucucuacccauauauaugaguuuuauauauauaaaauuuaacucaauucaccuagaagcaggggaacagaaagauagucagcagguauagaggauauuaaucaguuaguggucagugagaccagaguuuuaaugaaacaacagggucaauaagugcauuuuuaaaugguggguaugaucauauguuuccaucuuguuaucacuuuguuacacacacacauacacacacugaaauaucauguuucugucuuaaaucauuuuguuauauacauguacauauauauguauauauagaaugacuuuaauauaaucauuaacauauuacuuguuuaaauuagugagauacaucauuccauacauguguauuuuauugccuugaucauguucacucuccaauuuuuguuuuacuauauccucuuauucuccuuccccuucccuuauagacuugguucuuuauaauucuuuguucaaacuuaaaaaagaguuuccacauguaagagaaaauaugcuauauuuuccuuucucuuuuguuuauuugcuuagcacaaugccguauauuucugucaguuucucuaaugaaugacagaaucccauguauucuuugugacugaauaauaacauaaaauguaggugcaugcauaauuuucuuggguuuuuuuuucccauuuuuguuuguauguuuuguuuggucacuuuauuuguuuuuugcuuuucaugacaugguuucucugcagcuacggcugucugggaacucauucuguacaccaggcuggucucaaauugagagaugcaccuggugcugccucuacugacaucacauuauuuucuuuauucauuugccggcauacaugaaacugauuccauaucuaggcuccugugagccuuacugucauaauuaugguuaugcagucagucguguccuccuaagagugacuucauuucauacaaaugcaaacacaguaguggaauggcugaaugccauguuccuuuuauuguuugcuguuucugcuuagaaaacccuguuuucuccuuaguaagaaagugugucauuuuacaacauacagaauuuuauuuucaauguaucuuauuguuuaauaauuuguauauauguguguauacaugugagagcagaugcucucagaguccagauaaaaguuuuggaaaccuggaguaggugauguacaggcaauugugaguuguccagugugggugcugggaacagaacucagcuguucugcaagggugguacauguucuuaaugccucagccaucucucuagcuccuacauuuagcaauuuaugauauauauauauauauauauauauauguauguauguauguauuauuugccugauugcuuuaucauggaauucuagaguuguuuuguaauauuuauuaggaccuacaggugccugauuuuuguguguucugugcaguauaacagauuuguacuguugguucauguuaaaaaugccuuucaugaguuggucuagguaaguuuuuaagagguucuuguuuuugcuaauacaguuuuugugaguuuuuucaugucuuuuugcuauuguuuuguauuucaaaauugcaauuuaacugauuauauaaaguaucuauuauuaaauucuauuaucauauucuaugguauuuuauauacauuuaugcagaauauacuguuaauaucacuuuuuuuccauucacuugugaugcagccauauacuuuuggucaauaauauauacauuuaugaugugauggaaaaaugaucuuuucuuggauuauauaucuuaauaugaauaauuuggucauaaguuauuugaaaugaguccuuucuucuagugauuaaaauuauauacaauuacccguacauaauuaugaaaucacuguuuugugauaauuaaauuggcuuuuagguuucaaaauuuuaauaaaugaacucaguaaaauuuauuuuugcuguaaauauuuuuauuguacaauaucuugucuauacuuaaucagaaaacuguuauaucuucuaguuaacucuccugaauauauaauuaaagggaguagagauucaggggaaauaguccagacaaagguggcagaaagauauaaaagcaauggcauugaagaguuuuccuucagagaaauccagcagaacauucagaauuuugaguuucaguggaaagagcaugaaaggaauuauaaacccauuuguagaagagaucaagauaguggaaaggagacaggaagaaaccuuaggaaaaaucagcaucuguuaggcuuuacuuuacaucugucugaacugcaccccuuuccaucugcagaaaauauuaaugguaaugaagcuaaguccaucagcagugguucuucaauuuugucaucugacaaaauucuugcuaguggugacaaagcaccuguuguucaugaauaugauguuuauucuucacuacguauaaaaggacagaaagccaccauuaaggggaaaccuuaucaauguaaagagugugacaaagucuucaguuauacuucuucuuuagcauaucaucggcagauucauacuggagaaaaacuuuacaagugucuugagugugguaaggcuuuuuuucgacguucuuaucuuuugguacaugagaggcaucauacuggagcgaaaccuuacaaauguaaugaauguggcaagguguucagucagaauucacaccuuaagagucaucgaagaauccauacuggugagaaaccauucaagugcaaucauuguggcaaagccuuuaguguucguucaaaccuaacucaccaucagguaauccauacuggagauaaaccuuauaaauguaaugaguguggcaaggucuucagucaaaccucaagccucacaauucaucguagaacucacacuggagagaaaccuuacaggugcaaugagugugggaaaguauucaguucacauucaaaccuaaauacccaucaggcaauccauacuggagaaaaacccuacaaauguucagaguguggcaaggucuuuacucagaauucacaccuugcaaaucauuggagaauacauacuggagagaaaccuuacaaguguaaugaguguggcaaagccuuuaguguauacucuagccucacuacccaucaggcaauccauacaggagaaaaaccuuacaaguguaaugaauguggcaaggucuucacucaaaauucacaccuagcuagucaccguggaguucacaguggggaaaagccuuacaagugugaagaauguggcaaacucuucagccaaacuucaaaucuugcaagacauuggagaguucacacuggagagaagccuuacaaaugcagugaauguggcaaagcuuuuagugugcguucuagccugauugcccaucaaguaauccauacuggagaaaagccuuauaaauguacugaauguggcaaggucuucagucagacuucaagccuuucaauccaucaaagaauucacacuggagagaaaccuuacagaugcaaugaguguggaaaagccuuuaauucacauuccaaccuaaauacccaucaaguaauccauacuggacaaaaacccuauaaauguaugcaauguggcaaggucuuuacucaaaauucacaucuugcaaaucaucaaagaacccauacaggagagaaaccuuacaaauguaaugaguguggcaaagccuucaguguguacucaaguuugacuacucaucaggcaauccauacuggagaaaaaccuuauaaguguaaugaaugugguaaagucuucacgcaaaauucacaccuagcuagucaccggaggacucauacuggagaaaaaccuuaccaguguaauaagugugauaaagccuuuagugugcguucaagcuugacuacccaucaggcaauccauacuggagaaaaaccuuacacauguagugaguguggcaaagucuuuagucgaaguuccaaccuuacaagucaucagagacuucauguuggacagaagcauaugugaauauagcaaggucuuugggcauaauucacuucuugcauaauauccaggaauacaauccuaauaaaauguuaguauuguguugacgauaaacacccaucaugaguucaaauaugucacuagauguagugguaugcauguacaaccacccuuuucaggguguugugggagcauugucugcuuggcauauguaggaagaacuugaccuaaauuuaaaaauauaucaagcuuuuguagacauauaacauauuaagaagacauuucauacauguagagaagaugcuucaggauaugauuuccaccucuauaaacccaaaaaugcacauuguugaugaaauaauccaauuggcacuuauugaggauguuacuuaaugacuauuuacaguggaaggugaauagaaggaguuauucagccucuuguuuuucauggcuaaucuucaauguuacauuccacagaauaauugauaauuacugaacaauuaaaagucaaaauagcuaaaacgugauauauuugaaagguugaagaugguugauacuugccuuuaauauucguguacucauuuauuuaugguuccuugaaaaaucugcuuugccauuuguaauuguuaucugaaacuuucugaugauacaauaccugccucaggggccuuuuauugcagccuuugggaaaaauaggguaaaaagucacauuaauagaaaagggucauguaugucugguuuuugagaaugacuccauuccaccuuuugaauuaaguauuggcuaagauauguuccuaauuuguguuuagauucuguauuaaaugccaugacuaaagcuaacuuggugagaaagugguuuauuucaucuuauagguuauaauugaucaagagaagccaggauaaaggcuagacuaggaaccuggaagcagggacuaaggaagaaaauggagaaaugauaccuggugaauugcuuuucuuggcuuagcuuccuucauacaaccuaggaccauguuccaagggguggcacugcccaaaguggucuauguccucauauaucaguaauuaauaaagaaaauacuugacagaaauggccagaguccaaccugaugaaugugaagggucucucuucucaggaaacucuaguuugugucaaguuaaaagaucuauccauaucauuugucaucugaaagggacaagauauuguaaaauuacagcauaaauuuaucguuuauuguauaugauggagcauucugugggguaaaagcaauuaaguuggaaagaaaugaucuaccaucugaucauuggauacagaaacugccacaaaauuaggauacugcacuuuuugugaaauaagaacaguaggcuauuagggaugugguguuugucaaauaaacugcagaagacuuagugaacuucuuugaguaacaacagguuucauauuaggaaauaauaauuuuucuuacuuuuaaaauuaaagugaaaaacauuauuagaauggaacuuaucucaaagaaauuuuaggggcuguguauguagcuagaaaagaaacacuugugucaugcaugugaggcccuaaguucaauguucagcagcaccaaaaguaaaaaaaaauacacaaaacguuucuuaagagugacaucauuuaacuauuguuguuaaguuuguccacugucuuauucaaaauauaucauuaauugaacuuguaacuaaugaaaguaaagcuuuuauuuuccuauaaaugaauuuguuuuucuuuuguuuguauacuuuuugcauaugcguacacaugggaaaugagaaaauggagugaagcucuucuggcugaagguuuucugcucuuugaaugauuucaaagaccauaaaguuuuaggaccuuauaauuguuuuucagugaacuuggucuaugucucuaggauacuuucauagguauaguguacaucaacaaagacacauggagcagacuaucaaaguaaagguuccaggguuucucuauucauauauauacuuggguauucuuuucauagcuguguaacacuucagacauuccacugauagguaugaacugugcagugcucauucuucuugacuuuugugaaaaaacaaaaacuaacuugaagcauguugccugugcccuggacagcucuccaccugacccuaccugcccuuggggguuggguugagauggcucagagucaccgacacagacuccaggaguaggugagaaaugcugcaccaagcucaacuaugcacugcuacaagcuacuuuaauacucucuacccauguccccauuggucccaagaaagcaucucuucuaaacaguaguuccuguuuggcuagcauuauuugcacuaaaaauccuuauucucucaugcaguucuuaauuagguccuccuguaggugaugcuuuuguggcugugcagcccccaguguuuacauagaggcagucgcccacacccccacccccaccccaauccugcuacauauccacccuuuuguuuuuagauuuuugaccgccuagugggaacucgggugccauugccucaacauuguugacccaccccucaggggauucccaguuuacuggauugugccuaucuuagguuguccugucuucuagaaucuuaccugucauugacuaccagcccacaaagagauaucacuccagggggaugucacacaaggggagaugaggaacacucuacaugguggucucacugaucucugccauccaugcuuugaucacuuccuugggagggggugcuauugggauuuuugaaagcuaacagcaccuggaagguucuuauuuauggaaugcuaccuggagauauacucuggggaacacuuuaauuauuauuaguaugacaauuucucccaucagagcauaaguggcuauccacaaggggugaaagagccucuuaauauugucccauuaaagagagggccacacuuuaggagaguaaggggguauaaaucaagacaguucgaacggccacauaaaucccaauuguucauaauggguuaauauuagaaucuaaugggauccuuguuaacauagggaguaauauuggaagcaucaugagagguaaaucuccccauaccaaguaugagguuagaugauaauaucagguagucccuaguuaauuuuaccccuaguacaggguagcuggcagugcuccgaagggacaggaagucucacagaagugggcauuugagggacuuuuguacaucaaggcaggaguggacaugauaugcuugggggauccuuuggggauuuauaaucaguaaggggaacaugauguucuucuaugccuaacaugguacccauaaguuagauuaccaugaaagucccccauggucauacuguguaaccacacuacaagggcuguuggaguggauauuggugguaaagcagaguuuuuccuccaugggccaggugucucuaaccauucuguaguagugacuuagucuaugaagggcaaacccaaacuagcauuggaagagaaaagaucaggguaggccagggaguuaacugccacaggcaagaaaauggggguggaggugucaaagcccagagcucaucggaccucccuggcugaagaaaaauuaauaaacuauguacauuaauccauaucagcaaaaauguccaaugucuguaagcagggcucagcccuuucuaucuaaggagaaaaaguucacauggaacagggccuccaccaagacuagguguggaucuauuuuggauucuggagaggugaccagagcaagugcucuuauaaaggagcgauuugcuuacuaccauugcuugaccuagaggauuauaggguaucccaaaggagugacugauccuccaugaggauaggaaggcuuugaacuacuaagaagaauaagccaguacauuguuagucuugagugcccaaagcacuuccauuaccaaccuugcugauuucauggccuuaaugucaugagaggccuuuucaccugucauggauaccacauauacuaaggccgagcaaguacccacuacaacauguacauacuuaagauuccaaagguuggguaauggguaacccagagcuaauuguuccaggaccaguuucuugagugcaaaaagcuuagguuccaaaaugggccacugguccacccucagguaccuuagugucaguugacacugggugggcaguagccauuagaauuggcgaugaucccccacuuucugacauauguagucuaguugguguaaaccugugaguugguggagcugaggcuuacaggcauuugguuguuaugagaggucuuagggggacuugccgaguuugaggcuggaacaucacuggaauaaguucaaagaaaaacaauacguagcucuucauuuguguacaugaacacaaugugacuucagaguuuggguaugugaacacaguauauggcucuuuuuggguacauguaauaagaauuggaaugucuguacucugcuccuggaccaauaaaaucuguugugaaagaguaaaaauaaaauuaaauauauccuaauauuaaugucauagcauaggauauauuaacauguuuuuauaauuaauuuucaaaagugaagugaacaugacauaaucuuucugaaagccagguuuauuaucagauugaggaacauaagcacaagagugcugaacacagacaguucugugacaccgagugcucagcuuuuuugugcacuauauuuucuucgaagugggggagaacucaugacaagaaccaguuucaggguuacacuggaaguugcuaagcaaggcaccaucuaucacagccuggccaaccuccuuaaccaacuguccccgugaugcagagaaguaagaacuagagacucaggccaggauagcuauccuauacugauucuauacugggaugugacuccucuuggaaguuaucaaaagcuggggcuggaaagaugguucaguacuucacagcacuuauguuagcugacaacugucuguaauucccauuucaggggauucaauacucucuucuaacuucuuugagcaccaguaaggcaugcacuuguacacacacuguaaaaacacucauacacacaaaauaaauuauuuuuaaaaagagggucaucaaaaucccauguagaaguugcuacuacagcuguuuuccagcucuaccagugaaaaguuaguugagaaugagugaagaaugcugagaaauacuacucgguuucuauucagaucaucccuaauggggcagcuugcuagauauauuaaaagucuguuaaguguagucuugugagcccucuucuccccugagucagcuuugaaucauguacacccuagcaccugaccuuuguagcuacauuauccacaaccauaacaguaucugacagcuuagaguucccagugcgggaagcuggcuucuuguccaucuuugucucuggcucugugguagacauacugccagcaguguaaugaugcauaugguguggcuccugccuauaaagggauguuguuaaguguauuuuacuuguuauuuaaugggaaacuuguuuguuguuuuguuuuugguuugguuuggguuuuuuuuuguuuguuuguuuuguuuuuguuuuuuuuuuuuuacaguuuucagcagaucagccuccuagccuuggagggaagggucuauauacaucugaaacagcagcuaagauaacaucugucuccacuggaaaccucuggacugaggugugagauaagcuggaacacuuucuuacuugugaaauaucugaguugucugauacacuucucaacaaauuaccuuaacuuaccuuauuccugaauuuuguucuuuuacuuuuuaaauuuuuaucauauuauucaaauaaauuaacauuaaauuaauaaaucuagggaaaugcaaauuacuuuaaauaagcaaaccuguaaaauuaaauuguuucucaucauucaaaggauagugucagauuuucaauuuuuagcauagcauuuauuugauaugcuucuuaaaaacaauacuuacuuauauauucccuuuauaauccaauguuaggcuagggaaaugcaaauuacuuuaaaugagcaaaccuguaaaauuaaauuguuucucauuauucaaagcauagugucaauuuuucaauuuuuagcauagcauuuauuugauaugcuucuuaaaaacaacacuuacuuauuuauucccuuuauaauccaauguuaggccauccucuccucccaguaccuccucaugcaagucccucccaccacccccuucuugagacagggaagauucccuuuuggugucaccuucccauauaugcuuuuaaaaaggauuguaaaacagaucacugagaauuaaguuaugcaauuuuaagcaucucuuucuuugcauuugacaagaccagaccuguccaccuagaccugaagccuaaccuaucacuacucagacacauaccacagagauuuuaccuuuccaguucagagucacaggaucagauuggcuccaucucagaaccaguauccaaaacaugaggaaaagccacaugugcacacagaaaguaaccauuccaguuuugcaauccagguuaggaauaaggaacucacaaauauuucucaugccucagaggagugugguaaaauaguuuggcaggauaaagauuggugguugucuuuuucuuuaaaaauauuuacuuguauuuauuuagugugugaguguauguggcacacuaacagaggucagaggacaguuugcaauaaucgacugucacuuucaaugauauggguuccugggaucagacuagaucaucaggcuuugacagcauccauccucuugguaguccaagaguguuugaguuuugagacacaauuuuaaacaucagauugcuagguuaucaccuuauuuuuguaugcguguuuuaaagucugagguaaaaagaacuaugcuaaaauacagaacaccuuaaacaaguugugggcaauauuuguguaaugaaauguugguaauguaaggcauaguuauagcauugaagaaaagcauacugauuauaggcaugaaagaugaaguuugugacuggcauagcuugcacugagucugucucugcccguggaucuugagguagggcugacaugugagacauacagaaaacauacaguguacuuagaguugcugaaaagguggauauuaccagacauaucaacugggaaagaaucuagccucuuuggauuccaucccuggugcuuguguagugucucccucuggcuuuggcuuucuggcugaaagaaaagaucuggacuucaaagggcaagacuggagucugaagacaagcagguucauuagaagaguugugguugcuagcuaaggaguuuggacuucuguccaaaucacuaaagauagagaugucagucuagggcuuuaaacuagaaagcacuaucagaugugacuggaagaagaaaccagcagugugcuuuaaagagaaaacccaucuaggacacauaaaacagauacauguccuggaaagaaagugauaugggguccugaacagucauuccuccuuagagcagucacagaagacaugggacuagaucacuauaguggucaccaaagacaugggaauugaggaugagaaaaauagacaugcaaauagcagaaggggguguucucaacaggagacugugcaccaagguaagaggaaacuuuguuuaggcaaaaaauaauccucugcugugugcccugccuuacucccuucuugugaguggacuucaugaccaguaucagcugaguuuucuaagccuuagauguuuuccuccucugcccauaccaugucuuuucuaggaauaaccaguaacacacuagacagaaguugcagaauuggguuuagagcagggccaggucucuguuccacauaaauucaugauguucuugugugguuuguagauuguuugccaccaugaugaggaaccugcucaaaguuaagcuauaacuaaauauugagaguuaauguuaaacuuucuuuuauggucaguuuuuuaaaguggcaauucuuguuuuugcuuuuuaaaggaaaaaauaguuuauuuuuagguuuccaucuucaauugauguucacuaucaaagugccauaaggauaauugauucgagggcuccgcggagggcaggcugcacgggugaugguguggaauacagaggccagcuguuucugggaaaggcgagagccagggagcuucugagguggcgccaucuucggcuccagacaaccggccaccuuccuggcgagagccacagagcuucugagguggcgccaucuucggcuccagacagccggccaccuuccuggcgagagccacagagcuucugaggcggcgccaucuucggcuccagaaaaccggccaccuuccugaugagcgcacagggaucugccugcccgagagguuugugccucaggcccugguggcgggagucuccuuggcuccaggacucugcggagggcaggcugcacgggugacgguguggaauacagaggccagccguuucugggaaaggcgagagccagggagcuucugaggcggcgccaucuucggcuccagacaaccggccaccuuucuggcgagagccacagagauccugaggcggcgccaucuucagcuccagacaaccggccaccuuccuggcgagagccacagagcuucugaggcggcgccaucuucggcuccagacaaccggccaccuuccuggcgagagccacagagcuucugaggcggcgccaucuucggcuccagaaaaccggccaccuuccuggugagcgcacagggaucugccugcccgagagguuugugccucaggcccuggcggcgggagucuccuuggcuccaggacuccgcggagggcaggcugcacgggugacgguguggaauacagaggccagccguuucugggaaaggcgagagccagggagcuucugaggcggcgccaucuucggcuccagacaaccggccaccuuccuggugagugcacagggauccgccagccugagagguuugugccucaggcccuggcggcgggagucuccuuggcuccaggacucugcggagggcaggcugcacgggugacgguguggaauacagaggccagccguuucugggaaaggcgagaaccagagagcuucugaggcggcgccaucuucggcuccagacaaccggccaccuuccuggcgagagccacagagcuucugaggcggcgccaucuucggcuccagacaaccggccaccuuccuggcgagagccacagagcuucugaggcggcgccaucuucggcuccagaaaaccggccaccuuccuggugagcgcacagggaucugccuuccaagcaaauggucugaagaaacaagcuggaguagccauuuuaauaucggauaaaaucgacuuccaacccaaaguuaucaaaaaagacaaggagggacacuucauacucaucaaagguaaaauccuccaagagaaacucacaauucugaauaucuacgcuccaaaugcaagggcagccacauucauuaaagacaccuuaguaaagcucaaagcacacguugcaccucacacaauaauagugggagacuucaacacaccacuuucaucaauggacagaucguggaaacagaaacuaaacagagacacagugaaacuaacagaaguuaugaaacaaauggaccugacagauaucuacagaacauuuuauccuaaaacaaaaggauauaccuucuucucagcaccacacgggaccuucuccaaaauugaccauauaauuggucacaaaacaggccucaauagauacaaaaauauugaaauugucccauguauccuaucagaccaccauggccuaagacugaucuucaauaacaacauaaauaauggaaagccaacauucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcucugagugccuccaagaagaaacgggagagagcacauacuagcagcuugacaacacaucuaaaagcccuagaaaaaaaggaagcaaauucacccaagaggaguagacggcaggaaauaaucaaacucaggggugaaaucaaccaaguggaaucaagaagaaauauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguuaaaucaggaucaaguugaccaucuaaacagucccauaucaccuaaagaaauagaaguaguuauuaauagucucccagccaaaaaaagcccaggaccagauggguuuacugcagaguucuaucagaccuucaaagaagaucuaauuccaguucugcacaaacuauuucacaaaauagaaguagaagguacucuacccaacucauuuuaugaagccacuauuacucugauaccuaaaccacagaaagacccaacagauagagaacuucagaccaauuucucuuaugaauaucgaugcaaaaauccucaauaaaauucucacuaaccgaauccaagaacauauuaaagcaaucauccauccugaccaaguagguuuuauuccagggaugcagggaugguuuaauauacgaaaauccaucaauguaauccauuauauaaacaaacucaaagacaaaaaccacaugaucauaucguuagaugcagaaaaagcauuugacaagauccaacauccauucaugauaaaaguuuuggaaagaucaggaauucaaggcccauaccuaaacaugauaaaagcaaucuacagcaaaccaggagccaacaucaaaguaaauggagagaagcuggaagcaaucccacuaaaaucagggacuagacaaggcugccaacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaauaaauuagggaaacaacacccuucucaauagucacaaauaauauaaaauaccuuggcgugacucuaacuaaggaagugaaagaucuguaugauaaaaacuucaaaucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaagucuucucaaggauaaaagaaccucugguggaaucaccaugccugaccuaaagcuuuacuacagagcaauugugauaaaaacugcaugguacugguauagagacagacaaguagaccaauggaauagaauugaagacccagaaaugaacccacacaccuauggucacuugaucuucgacaagggagauaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagggacacugaaacuuauagaggagaaaguggggaaaagccuugaagauauugacacaggggaaaaauuccugaacagaaaaguaauggcuuguacuguaagaucgagaauugacaaaugggacguaaugaaacuacaaaguuucugcaaggcaaaagacaccaucaguaagacaaaaagaccaccaacagauugggaaaggaucauuaccuauccuaaaucagauaggggacuaauauccaacauauauaaagaacucaagaagguggacuucagaaaaucaaauaaccccauuaaaaaauggggcucagaacugaacaaagaauucucacccgaggaauaccgaauggcagagaaacaccugaaaaaauguucaacauacuuaaucaucagggaaaugcaaaucaaaacaacccugagauuccaucucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaauuggacauaguacuaccggaggauccagcaauaccucucuugggcauauauccagaagaugccccaauggguaagaaggacacaugcuccacuauguucauagcagccuuauuuauaauagaagcucgaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaacucacacaauauguacucacugauaaguggauauuagccccaaaccuaggauacccaagauauaagauacaauuugcuaaacacaugaaacucaagaagaaugaagacugaaguguggacacuaugccccuccuuagaagugggaacaaaacacccuuggaaggaguuacagagacaaaguuuggagcugagaugaaaggauggacuauguagagacugccauauccagggaaccaccccuuaaucagcauccaaacgcugacaccauugcauacacuagcaagauuuuauugaaaggacccagauguagcugucucuugugagacuauaccggggccuagcaaacacagaaguggaugcucacagucagcuaauggauggaucacagugcucccaauggaggagcuagagaaaguauccaaggagcuaaagggaucugcaacccuauaggugaaacaacauuaugaacuaaccaguaccccggagcucuugacucuagcugcauauauaucaaaagauggccuagucggccaucacuggaaagagaggcccauuggacuugcaaucuuuauaugccccaguacaggggaacgccagggccaaaaagggguagugggugggcaggggaguggggguggguggguaugggggacuuuugggauagcauuggaaauguaaaugagcuaaauaccuaauaaaaaaugggaaaaaaaaggauaauugauucacauguuauagucaucaucuucaucaggacaaacuguuucuauaaaugccguuugucagccuugcaggggaaaagaauacuuguuugaaucuccuuccccauaaaggcaaaaggcuuuauuuccauuaaaguaugcuauugccuucuuucucugguaacaguggagcuaaaacaucuuugaugaauggaacuuguccuuauagccuugucuuauugagagaaaacaaagguaguccugaucuuuguaacucacucagaaucaagccauagaugcaugcaaugaguauucuguaauagacuaacuuaacagaaaguuuuguugcucuucuuggaucacacuguucucacuuaccuaugggagucaugugugccuggagccugagcauguaccuucaccugcuaggcaggagugacagugccagaaauagcaugcaucaguauauagaaaaccuuuuuuauucuuuuguggauagauuuacagcugacuacuuggccagugagcaguaacgcaguuucagcuucugguuauacacccauuccacagguuuuguugucuccucuuugaggaugaagcauguguaauauucagguaaugugucuggugagucucugaaguaugagaacuucuuuucuuuucucagcguguuacccauucccaggaagagcuucgggaagaaaagguuuaccaacuugagcgguaucgaguagaggcaggcauggaucgaaagugugacagugauauguggaucaaucagagcuccucaguggaauccagcacauccagccaggaacaccugaaccauucuuccaagucaguuaccucagcuuccacucugaccaagaguggccguggccguuggaaaacaccagcagagguacuacccaccccuguggcugucucucagcccauuugaacagaccgcccuccaccaccaccuccaccaucaguccacuacaccagugaguuugaugguauuccaguggauuugccccucccaccuccucgugccaaccaggcaggaccccagucuguucagguggcugcugcagagcagaaaaagagagaggagcaccagaggugguaugagaaagagaagggccuggaggaaguacaagagaggaagcgcagggagcaggagagggaguuggagcagaugcacacucagacccugaacccugcuuccuucucaccuuuggccacauaggccaagccagaaaagccuuccacacugcagaggccccaagaaacagucauucgggagcuucagccccagcagcagccccgcaugauugagcgcagggaucugcaguauauaaccaucaguaaagaggagcuguccucuggugauagucuccagaccccuggaaacgagaugccagggagaagcuggagaagcaacagcaaaugcacauuguggacaugcuaagcaaggagauccacgagcugcaaaacaagguggaccguacugcggaggagagugaccgcuugcggaagcuuaugcuggaguggcaguuccagaagagacuacaggaguccaaacagaaggaugaggaugaugacgaagaggaagaugaugauguggauaccaugcugaucaugcagcgucuggaggccgagcggagagccaggggaaaggggaaaggccucgguugugcguaucuguguucccuaugcuaucuucuggguguuucuaugcagacagcuauauucacaaucacaaagaggaguuuaaagaccccucccugauuucuucugcucacucuuggcugacaacuugcaggaaugagccaggcccuuugggcuucaguguuuuaauuagcagccauauaguuauccuugcuacacuuaaguugcaaaaacagguacuuaguaaugaccacuaacaguuggcacagggccagaugguaaaucccugagauuuggugggcuaugucaaguguaauggucacauggcucugcugugagcagaacagucagaguuguuuacaaacccuggauaacucaccaaggacaucacacagaaagcuuuggguccugauucucaugaugagcagaggacuuuaggacaucaauuuuaaagugcagggucauuaccaguaguaggacuuguguaucuauuuuacuguuauuacuuuaaauauuuauuaguuauuaauuguaguuguagcauaaggauucugacaaauuuugauagaauuuaaucucuccauguuaaaaaauaacuuuuauuaucuuuguuucaaauaaaaauuuaaauuagccuaaugcacauaaguucuuaaaauagca

SEQ ID NO: 8411 - RNA, 1405 nt, Mus musculus
caaguccaggcguggacaagugugcuuagagauacuggugucuucuuuuucucuguugcuaucuuguuuuuguuugugguuuuugucaugagacacagacacuguacgucagagguaaagugagaucccucccugucuguaugucugugugucugugugucuuguucacuuguguguccaucauuggaccaccuucugauucuguuuuguuuuugguuugucugguuucaggucuggucuuggucccaaggaguugacugauuaucuugguuugguuuuaggccggucucagguucuggggccuucccauggagacagguccauuuggguuggucauagugacaguaagcuucucuggaaaucgcauguaagaugcccuguauuggucuugcuuguguuugucauuucugugguacugugauucuauagugguugccugaaaaacgguuucugugugugucuuuugugucucuuuguguucggacuuggacuaaugacugacgacuguuuuuuaguuaugccuucugaaauaagccuaagaauccugucagaucccuaugcugaccacuuccuuucagauccucagcugcccugccucccacuccaacuccagagagcagccagcgggucacaguggucccgcccauggaccuggagccuagagagaaaugagcucggaaauccggagcaaaugaggaguggucccugaaacgucaguggcccuggaugucgugacugcuaaagagaaaaagaggaggaggcugugggaguggcuggccaagagcucagcagguuucccugauugcuucucauuccccugucccuuacauccccgucucuuauaaacagaaaaacugcuuucacuuugagauaugaguggcccgauacagccagcugugagagcugcacucccuucccugccccacguguuuucucuucucaggcgaccccucccugagcugcugacagugagucuguuccaagcuccagugagggaggcauccgcccacuuggggcuucuguccaagguaaggagcaccugugagucuaacugccagacucugaugggggucucgucucugugggacuagaaagugucccaacaaucugaacaagguaacagaaaguuacaaaaguuaagagaagaacaggguaaguugguaagaaaguuaguguaaguagauaagaaagugcagaggaggagaaacaaaggaaagauagaggucugcaaagaagugagcuaaaagcaaaucuucagcagacccagaagagauagguuaacagugaagagagguaaaaauaaagaugaaagagauuagagaggucugaaaugagagagauacucuaaaugagaaauauuuaaaagaggaaccaguaaauaagagucagacaagaaaaagagaua

SEQ ID NO: 8412 - RNA, 7685 nt, Mus musculus
aggguauaugauuuauucauuccauuucucauucuagaggaaucaugcaaccuuuauuugguuuucacaaugcauuaagaaacauacuaucauauaauauuuaacuccauguuuuacagcuccauguccauaauuguaauuacaggauuuuaauugugagaagaaaaacucaucauauaaacacuuaaaagucuccccaagaaaacuuaagauugugacaggaaauagaauugggaaaucauuccuggaugucucuacuugguguugucuucauggacugagcauaguguuguguuagacaucuguauucuuuaaaaaaaaaaaucauugcaugggucacagaauauauguggauuuuuguauacaagguagaccugguuaccugucuggaccaauugaguuuaccauggaauguggagaggagagagagaguagccucaucugguucacuacuagggugagcuagugaaugaguaggacaauaguaaagguuucaggugaaggagaaagcaaaagcugaaaauauguuugcuacauugaauuccaccugaaaugauucccaaucauuuagcuuaauauugugccuccaggauguauccugcuuguuguaacuaguugaagauauugugccuuauugcaccugaauuaucaacuuaacacuaguacaaaauggaauuuuccuugauuaugaugacaucagauuggaauaauuuacaaaauuaugagucugacaugaagccacaaaguaacauucuguaauuauaugaguauacuauagcugucuucagacuuaugagaaggcaucauaucccauuacagaugguuguaagccaccauguaguugcugggaauugaacgcaggaccuuugggagagaagucagcgcucuuaaccacugagccaucucuccagcccccaugauuuacuuuuuuugcaugcaugucuucauauuacauccuucauuuucuuucuaguggagaauacaccaacacccuucuggaaaauaaucucaagaauuauuguacagaguaagcuugagaauaaccauauaagaaaaauaaagauaucuggcaauauauguaauucagacaguguaggaaagaaauaagcaaucgcuacaccugacagcccucccucaaauaaucuaggcucuguauucuaaagucucugauaucugaaaaauacuugcuuugcuuccauuacuuuucaauaauauaguguguuuuuuaaagaaaaaacaaaacaaaacaaaacaaaacauccaggugugguggcacacgccuuuaaucccagcacuugggaggcagaggcagguggauuucugaguucaaggccagccuggucuacagagugaguuccaggaaagccagggcuauacagagaaacccugucucaaaaaaccaaaaaccaaaccaaaccaaagcaaaacaaaaacaaaaacaaaacaauaaaaaaaaaaccaaacagacaaauguguugaugcuuuuaaguaaguaguagaaagauuuagauuucuugaacaguaauuuuuuuuuaauuuuuuuuuuuuugguuuuuccagacaggguuucucuguguagcccuggcuauccuggaacucacuuuguagaccaggcuggccuugaacucagagauccaccugccucugccucccgagugcugggauuaaaggcgugcgccaccacgcccggcucggacaguaaucuuuguuacuguguauuauugaguacaaacacugugaaccugggauuucauuaaauuugucaccaguuucugaauagaaacauguauucuaaguacaaucagccauuugagcuccaccccaaaaccaguuacuaacuccucaauuauuugguccaucuugagccaguauacauuuucuauaaugaugagauaucuauuguaaaucacagacccuugaaggcugucaggccauuguugugggaauacauaaaauuacaguaaaagaaacacaucuaaguaguugcugguugacuuauuguaagaaagagcuuauggagacaaccauuuaucaaauguuuaauuuuggaacaaacccuauuaaucugauuuguuuuuaaaggacuguacaugggauacugucccucaacaugugaacaccgaaaaggagucuugucaguguagugagcuuggugaaaugcuucaugaacccccaaacuguguacuuuauaaaagaagugacacuacagaaaccuccaauaacuacagaugcuguagugacaaggaagccucuguugacucaucaaacccacauagacauaaaagcaggcacacuggagaagaaccuucugaaucuaaagacugugagaaauccuuaacuuugucuuccaacauuccucaagaucagagaugcuacccugaagagaaagagcacagguaaagagagugugauggugacuucaucucuacauacagucucaugcaacaaacaaucuucauuggagagacaccacaucagaguggaaaaugcaggaaaugcuucaguaaccccucaagccucgcuguccaucagagaauucauacuggacagaaaaccuucaagugcaauguuugugacaaauccucgauuucucugcugagucaggguagcaccagaguuagccaugugaagaaagaccagguguuuguuuugggggaaccucugauacagaggcuaccacccacaaacacacuuuugguuugaucccagacuaucaauugggaaggcaauucuagaguguugggaucucuggcaaacgcugggaagaugggugccauggaaucuaaaacaaaaauuuguucaaauuugucugaacucccuguguucucccagggagagcuggguucccuacucucccuucacugcacugaccauagggcuccacgugccucccuauccuuacccucccucccccuucaccucccuccuguugcagcagcaauggugguuaccauagugauggugaaggaucaggcugcucauuuuaaauuacccccuuaaaccagcaggaguaaaguuugcaugcuggguaagaagcacuugacuuugggacagauaauaagggucgaauuauggcuucaccaccaucuuucuuaagaacaacaacacaggacuugaguagaccaggaaagucuccaaaagauacuuuucauuugagguaauguuuuuguuucuagugaaaggccaaaccuacucuaucuugggaccggccuccaacauaaagauaaaaaagccugagaacuugaccugcagcagaacccaagcugcauccaaguaccaggaaggaccccaugguuuguccuuggccagaguuacuuucuagcaacaguuaaucaaagauuagucugauuuuuucagacguacuuucagacccuuugggauuguucaugaucuugcuucagagcacccaccugucagcuuacaauagacauucaguuagauauuuguuaggcuggacgcccccucacuuacucccauuccuuauaaaaccuuguccugcugaggguuugagucugcucuggccgggugugguggcgcacgcugcucugccuuccuuucugguccugcuuugucaggguuggguuggaggagagcccaaauccaaacuugaaauaaagagacccaacagaaacagcuccuugguggccauuugggguucaugaacucuuccuggcacaacauuuuggugcauuggccuggaacuccaaggccaccaggacccaacccuggagaaucucggcacugguuaucucugagucugugagucuauccaugugugcuugugugauacuguaauaauccuguucugaauaauucuguaauucuguucugaagaggccuaaaaagcuguauuaccuggcaagaaacagcaaaagaggauguagaauccggcugcgguggucacccugguacauccuagccaagggggcuuaggcgucguuccaaagauucugggguacagagugccccugguguuaaugucagugaaggacagagcggaaguguccuguuuguuuuagcugcuguauaguugucuguucugugugugucacuuuaaggaauguugagggacugacgcuguagcgauuugaagacccacccagccucucggcuuaacucuuucuuuuccagaccgauucgcuacuuuagggagccugagagucccgggccuaggugcuggugucccgcagcugcggcgggaagucgcgcggggcugagcccaccucgggcggaaggccguggggccucgccggggcgggggcccagucacuccgcuggggagccuaccggccaccgcggcgcccugggcagcggggaaaaccugggacccgaguggcaccgcuccgcuuugcgcaggcagaggagaggagcccaguuacucggcgccagccaacaagaugcuguggugcgcccgggcuccucggggauucaaaccccaguguggggcucucccugcaggcggcggggcacaaagaaucugacccgaccccucgauuagccgcggcucacccaggcgcguuucucuccccuuccgccgagcggcgcacacaaggguccacggccccuagaauggucuaagacucccgcggcccuaaccuagaucuccauaagugaggacaugaguucccaaagagcagagcuucaagcuuggacaaaagcaggagaggccgaugucucccuuuaccagaucguagaauggccuccuggucacucauuuugcucaguaaauggcuacccuuccugccagaagugcucgcucccgaucugaacugauguagucuaaguuguaaagagaguggacaccauccugccacacucagcccacugagaagaacaaccaccggggcagucaccuucccagagcuacaauaagacaauauacuauguuaagauggcaggcaacccaggagggcuucagacuaaauuuuuccagccucugccucuccaugcccucugcccaaagauuaaaauaaagauaagauuggccuucagagccugagucuuucauccuguccuugugucuuuccuuguugauaagguccugauaguuacccaagguaaaggcacaauuuacuugauagaaaugaguuaacaaguggaucuucuaucuacugacacugaagacaucuauuguacuagagaggauauucuaguugagguguaugaguuuucaggcacauauaacauaccaaauauaaaugacaugaaacaaauauuauaaacaagacuaagaggagcaauaugacugaaucaauuauaaaaugacaucuucaaaacaaagcccaggaccaaauugacagaauucuaucaggacuuugaagagcagcaaauagacuaauauuuaauacuucuugacacacacaaaaauaucaagacuuccugacucuauuaucugauacuaagccagauaaugaauaaaccugacauguuggagcaugccuuuaauccuagcauuccagagucaggaacugcugaucucagugaauucaaggccaucuuggcccucaaaacugaaaaaaaaaaaaaaaaaaaaaauccaucagauacuguuagaacuaagaagaaauuacacacugauuuuuuuuuaauugaucuagguauguuaucacgggccuuuaagcacagguucacacagagaaaccuugucuaccaugaaugaaugccccgauuuuuuuauuauuaguuauuucacacauacacacacacaaagauaaaaugcauguauaucacagcauuguguguuucugugcccacuucaaauacugcccauucucacuccuaccucucugcuauccugguccacaguuccaacagucacuuuguucaugucuauucauauugccuggcacccacuaagaugaaccagagccauuugugagacuguggguuugaagcuauguucaggagccugaugugcucagcacaggaugacaacuaaagccagugauucuucuucuacagucuauccauugccaaugccugagagguaaagccuuuucccuuuccuagauugaccguggucuuguguggggccagugcaggcaaggacagcugcucuugguuacugauugcaguaguuguauggagucuagagaacucuagacuuggaauucuuagccuuucccccucucucccuucuuauuuccuaaccaucucuucuuccuccaugcuucucagagcuagacauuggauuguaaaacugacuuuucuaggguugggaccacaaaccuuacuuauuuucugcaucugggacgugcaagauucucugcguacaccacuguacuagagagagagagagagagagagagagagagagagagagagagagagagagaguuaguucuagguuuuaucucaaagcacuuuuggaaucaugaagacaaacuuguuucugcuuuacuaaaaugacauguccgccaucuaguggugaaagaaguucaaugaaguaugaauucaguccugacuguugaggucugucccuguaacauagcuguagccauuuuguuccaugccugccagcuauuucacauuguuucuguaauaugccaguuagucauugacacagaaaaauaauuugacucagagcagggucguguuccacauacccuguuaucuucuguguguucugaaguugguuaaucuuaagaacuuugaaaauuauaugcuccacuuaggaccaaucagaauaaaggucagauagaacugcucugucuggcuagcaaaaauagcuugggucagagaaaaccacaggucagcacuuccugcaccugcauaugagcgcauugugauuuuuuucauucuuaaaccaguccugagaaguguuugugguuguagcucagcccccaaauucugaucagucuuaggguaugcauccaauuaucuguccuugucugacugagaucaggguuuguguggcauguagggcuacugcuggaccccaacacugaccacugaguucuugagacaaccuccccccucccccaaauccacguuccugaaaagucucucuccaaaucaaaauugaaguauuugguuuugguuucucauguuuguguuuuggggaugggacucuggcauccgaauuuagccuguuguuugguaugcaguaugugguggagaggaugauagugagauggggaucuuagguugucuguuuugcaucugaaagauucagaauucacuauggggaucagauaucggggugcaggguccuaccagauauaguucuggucuagacuggcugcaagaguguggggagacugugcagagcaaccugaagggaagagcuguggcagaaagaagccugagacagagugggaggggccggucuccgcugggcgggcccacucgcccagaaauagaggauggaagaugugguacauuggcuggguguagaggaaggguguagugugggugggauuagaagacugaggccagggaagcuaggaagcaagguguguuagcuugggaagugggacuaaaaagucaaagucuggagugucaagaauccgguacaagacugagcugggguugggguugagggguagagcggcugcacaguguggaaucgcgugguggagaccugaguauggaggaaacggcggggcucgcagaaccggaaaacuuaccuauaccgcagguaccuuuugagcauccugggagagucagcaguuuagcagcuggca

SEQ ID NO: 8413 - RNA, 29622 nt, Mus musculus
cggucuccgcugggcgggcccacucgcccagaaauagaggauggaagaugugguacauuggcuggguguagaggaaggguguagugugggugggauuagaagacugaggccagggaagcuaggaagcaagguguguuagcuugggaagugggacuaaaaagucaaagucuggagugucaagaauccgguacaagacugagcugggguugggguugagggguagagcggcugcacaguguggaaucgcgugguggagaccugaguauggaggaaacggcggggcucgcagaaccggaaaacuuaccuauaccgcagguaccuuuugagcauccugggagagucagcaguuuagcagcuggcagaggcagcagcgggggaugggggagaggaagugggaguggggguggggacaagggagggaggcgcucgaaccuuccagguccgaggagcugaggcggggcuggggaaugggcaggagugggaggggagcagagcgggaucaauuuccccucugaucauaaggauaacgacucucaaaauugugcuguggaugucagacccucgucgauaaauuuucaguaauauuaacuggaauaauacuauuucuuuuuauugaccuucuggcugaucuaguagaauauuugaauuuaucaguuaauauuugaaaacgcagcucucuuugcuaugacggaaaggacaaagcuauugaaauuuacaaucauccauacuaacuuccguauucuaccacuucucuauuuaagaaaguggcaugugguggauuccccaugagcuuuuagucacgaaaggaacuccugcaaacuuaaaugaauuugauuguacuguuuguugugaguuuuacugguauggauguaaaaauuaaguuuuaaaaguaaacugucuaucuacuauuaauuuuccaucgggaacguaugcaaucugugaugcaaauugugaaaagaguggcgccaggcuuggugacacucacguuuuaucucagcacucaggagcaaaggcuauauagugaguuccaggacagccagagcuauauggugagacacugucucaaaaaacaaaacaauaaaaauaauuacaaaaaaaaaaaaaaaaaagaggaggagagaauaaauaaugaaggaaggaaagaagaaaggaagaaagcaaacaaucaaggaaggaaagccagcuaagaaaaagaaaaaaaaaugugucuucuuguugaggucugccccaucucagaauagcuguagccauuuuguuccaugcaugccagcuauuucagauuguugcuguaacaugccugccagucacugacacagaaaaauaacuugacucagagcaaggucaugcugaucacguauccuguuauguucuguuugagguuuguuaaucuuaagaauuuccacaaagccuuacguaggaccuaucaaauuaaaggucaacaugaacuguuagucuaaaauggcuugagucagagcagagcccuuccugcaccugaaugugaucucauugugcuuucuguucuuuggguuuuuuuccuccuuuuauaagcuuacaggaaaagauauuuguguaguugcucagccccugaagucuacuaccugacuuaugagucuuagguugugccuucaaaaaaccaucaaggaucagauggcuuacagagaucaggauuuguuugugugguuuguugggcaacucuuggaccccaacacuuuugcugaguuuuuuuuuuuuuuaauauuuuuuuauucuauauaugugaguacacuguugcaggcuucagacacaccagaagaggccauuggauucccauuacagaugguugugagccaccaugugguugcuggaaauugaacucaggaccucuggaagagcagucagugcucuuaacugcugagccaucucuccaaccccucugcugaauucuuaauguuguaaauuagagucuggaaaucagaguauucucuuugagggaauccggucacaguauuuucacagcuagacagggcauuuuauaaaccaguuugugguggcauauaccuuuaauccuagcacuccugaggcagaggcagguagaucuuggaauucuuugccagccuggucuacacagugaguuuaaggauagccagggcuacacagagaaacucuguuuggggggaagggggauaaagagacaaaaacaaaguuaagagguauuauaauauaggauaauauuagaaacaaucuugugaauaauuaugaucaucuacaucagaaaaaaaaaucucugcaauccucuuguuuuucuugguucaaaaaaaaaaaauucugcccauggauacaugaccaaauugcuauguagaagucaucauauagaccaggcuggacuggaauucacagauuuccacccaccucuaucuccucagugcucacauuaaaguugugcaccagcaggaauguucaaaccauugucuuuuauuuuauggucuguugacaaucaguggugugacuguggacuucucccaggaggaggggcaaugccuggucucugcucagagggcucuguacagacugcauguugcagaauuggaacucucugauuucugugggugaaaauaguuuucuugcuaucucccuugcuccuccuuaggguucuuggcaaauuagacugcagguaugugagauuuguguggaugagucucacauucuacagagaaaggugaaauccucacaggaacaaagacagauuucaggaaauucuuucucuucucugugugaguuccuuuguaaguaaaaggcuuccaucauuuuuaguccaugagaaguucaucacugauguauuguauucucauuccaaucauucagcuccauuucugcaccugagaguugauugagcugugaauggaagugugguucaaguuaugcuaacugaaaaugcuucuaaauguuuucaguauuaugacauugccugacacuugcagggucacuguagagucuucauuucuuuucucuuuaucuacugagcacaguacuuuguuagaacaggggcuuucucuuuaaacucuuucucaugugcagggcucacugaacacccagaccucagaccugcucaccugugaaacauaacaaagagcccuagaagguggagagggaggagacaguaccuaaggauccagguauguuggaggauuggugaagggauggcaagggauucaagugaauguggaagugggacaugaagucacuuuugccgaauucugucucacuagaaauaauucuggagacuuccacggacaaaaaacuccucaagauuauccuauuguagagaugagaagacuuucugcagaaaauugauacuaggaggcaauaaacuuuugcuugacuaugagugcgagugaugcuguccuuacacugaucaccuaggccuacauaccaauauuaaaugacguucauuuuagugguuuuauuguauuauaaaauaauaauuaauaacuuuaggcacauuuauuguuuucugaaaauuuguauucuagcauauuuucuacccucagcguuaauuuuucucuuccuaaaaauaaugccaacagacuuuggauaagaucaggaacuauauuugcagacaugauaggcaguuucccaugaauaucuccuacugucuguugucaugacaauuccaugugguuccauugcugugguuguaauauacugugagaucaccucuucaugugguccucuuaguguuuuccaccucuuugcuguucuuugguacuuccagcauuacuuuuuuaaaaauaugcaaguaggauuuuaauaggaauugaguggcuucuaggaagacaaaccuucuucuagguuguccucccagguuuguaaagcacauggucaaugcgccuguucucacguguuuuauguagucuccuguuuaugucugcuggggaugucuacauucuggguuuugugacaugcagccauguuuaucaaggaauuucugucuaaugguccauuuuaucauuugcuaaugcucuuuauuuuguaauuuuguauuuuaauacuuuugucuuggauuuucuaucacuaguauaauugugaucaucagucuucuuacugcugucuauagucauuacauuaaaaaaaaaaauuaggccagauggugucagugcaagccuugaaucccagcucuuuggaggaagaggcaggcagauaucuauaaguucaagggcagccuagacuacagagugaguuccaggacagcuaagacuacuguuucaaaaaauauauaucuugugucauuaaauauuguugagaccugccccccuaacauagcuguggccauuuuauugcauacaugccagguauuucauauuguugcuguaauaugccugccagccaaugauguagaaaauaacuugacuccaaguagggucaugcugaccagaaagccugauguguucuguauuuuaugagguuuguuaaucuuaagaaauuccacaacuauaauguuucauguaggacccaucaaauuaaagguuaauacgaacucuuauguacaaaauggcuugagucagggcuaacaaccagguagcacuuccaccauccauuccaaguguaugagcucaaugugaugcuugcaguuuuauucuuuauaaacugguccugagaaauguccagugcacagcuuugaacuauuacccugguugaucagucuuggagugugcguucaauaaccaucccuguuuaacugagaucaguauuagacuguuuugugggguaacuccuggaucccaacaauaugaaauggauuuuuuuuauaaaaaauugucaaaaaaaugucuaggaugugaaagaccagcuuucacauucauagggcauaaacugaggcaggcauccaggagugacaugggugggguucagcacuaggaggggcugacagaggguugagguguugguccugauaccgacagggcugcuguucauggcagccaaaaauuagagaacuuacucaguagacuuuucucucgggguacacagcuauauuaacuggagcuggcacuccuugugccaaagaaaaaacucugaacucuuuaacucuuaggggccagcgagaaagaaaaggaaagagaaaauucacagagguguacacacaugcacacacgcgcaugcacacacacacacacacacacacacacacaugcauauacacacacauuuaguggaugaagcaaagguggguggguggauggacagacauaaauauucacacauugaauggcuggggcaaagcuacaggaagcagguucuaagcauuucacacauacacauauaugcacauauacauauauguaaacaguugauggguggaacaaaugauguuccaacaagcaggcuccaagcauuucacacgugcagauauauagauaauauacacauacaccuuccaacaaucacucaccgaagcuuuacauaauuuacauacauacagcuuugauggauggaauaaaguuccaacauauucccauacaaacuuuacacaugcauacuuacaauuuugauggcuagaacaagguuccaauauacucucacacaaacuuuacacauauacauguauauagauuugagggauggaauaaggucccaauuacuuuauuuuuuuucucccauaguuuacauaucccagcaaaaucuuccaagcaguagaaaauuacaauaugauugcguucuaauuuucuucuagggagugauuauucucaagaaccaguguuuguuccauaacuaagcaacuuguuauagaugaacaaagugugagcaugcaagaaaguuuucucagccagugucuuuuagggguaggcagcaauuuacaguuacaaagaaaggauuaauuguuuucuuaucuuuaaaauuaauuguuuuaucuuuaaaaguaaucuuauaagaaucuuuaaaaaaucacaaaucuuuuauuuuuaauuuuauuuaauccuuuuuuacaguccagauuuuuccccccuccaaguucacccucugacuguuccucuucccauaccuccuuccaccuuccacccccauucucuacgaggaugucaccacaccucuaccccaacagaccuccccauucccuggaacauccagucucuugaagguuaggugcaccuucucugacugagcucagacccugcgguccucuguuguauauguguugggggucucauauaagcugguauaugcugccugguugguggcccauugucugagaggucuccaggauccugguuagcugagacugcugguccuccuacagagucacccuccuccucagcuucuuccagcuuuucccuaauucagccacaggggucagcagcuucuguccauugguuggguauaaauaucugcaugugauucuuucagcugguuguugggucuuucggagagcagucaugauaggccccuuuuugggagcucuccauagacccaguaacaguaucaggccuuggggccuccccuugagcuggaucccaauuuggcccugucacuggaccucauuuuccucaggcuccucuccauuuuugucccugcaguucuuucagucaggaacacuuacaggucagaguuuuugacugugggauggcaaccucauccuucacuugaugcccugucuuccugcuggagguagucuguacaaguucccacuccccacuguagggcauuucaucuaaggucccucccuuuuaguccugagagucucucacuacccaggucucugauacauucuggagcccccccccccccaccucccgagguugccugcuuccauuuuuucugcuggcucucagugcuucagugcuguucccccccaccugaucaaauuccccucuuccccucccuguccccuuucucacccaagucccucccucccccuccugugauugcuuucuucuccuucucaagugggauugagccauccucacuugugcccuuuagcuuguuaaccuuuuugaguucugugcauuguauccugaguauucuguacuuuuuuuuuuguaauauccacuuauuagugaguacauaccaugccugucuuuuggggucugaguuaccucacucaggauguuauuuucuaguuccauccauuugccugcaaaacucaggauguccuuguucuuaauaguugacuaauauuccacuguguaaaugaaccauauuuucuguauccauucuucuguugggggacaucuggguucuuuccagcuucuggaaacaaagccucuaugaacauaauggaacaagugcccuguagcauuguggagcaucuuuuggguauaugcccaagagugguagagcuggaucuucagguagaucuauuuccaguuuucugaggaaccuccagacugauuuccagagugguuguaccaguuugcaaucccaccagcaauugaacaguguuccucuuucuccacauccucaccaacauuugcugcuaccuauguuuucgaucugagcuauucugauugguguaagguggaaucucagagucauuuugauuugcauuucucugaccacuauggacuuugaacauuucuuuaaauguucuucucagccauucgagaauccucuguuguagauuuucuguuuaauucuauaccccauuuuugguuugaguuguuugauuuuuuggugguuagcuucucaaguucuuuuuauauauuggauauuagcccucuaucagacguggguuuaguacagauuuuuuuuuuccaauuuguagguugccgauuugucuuauugacuaugaucuuugccuuacagaaacuuuccaguuucaugaggucccauuuaucaauucuugaucuuagaauaugagccauuggaauucuguuuaagaaauuaggcaagaccaaggagauuacauuugaggaaagauuccugcuauuaauaugcuuuucuuuuuuuuuuuuuuuuuuuuuuuuguguguaaucguuuuauugaaaagauggaucaaauagcccaaaauagaccucagccacaucugagcaaugauagauggaaacaagaagaaggggccacugcauacuccacaugagcuuaaguuguaaagacuaacaaaagugacugcuggcaaagauuaagggcgauggcaucauuuaccaaaauuauuuccuuuguucugacaauaucacucauguauacagauaugcacauauguguaccuuuacauacauacuaaacuaacaaugcauaugcaugcuuuuuuuaucuucuuugauuauuguggaggugguggugguggugguuugaugguguccugcacuguggcaaucuucuugccuaggccuccugaaagcugguauuacagagcuugcacuagccuacuccucuucucuuagaaaauguuuauuaaaaagacauaagaaugcuuauggcaacacugucuguaagaaccuacagauaacccaaaccuuagauaccaggaaaaaauaacuggugcauuuguaaaauggcaugcaggaguguaacaaucaagagugauuauagagggcuggcgagauggcucaguggguaagagcacugacuacucuuccgaagguccugaguucaaaucccagcaaccgcaggguggcucacaaccacccguaaugagaucuuuuggugugucugaagacagcuacaguguaccuauguauaauaguaaauaaaucuuugggccagagugagcaggggcugagcaagcuacaguguacucacauacguaaaauaaauaaauuaaaaaaaaaaaagagugauuauagaggcagacaacaacucggauggauagaugucagaacacacgagugaauaaaagaagguguacagagguguuguccuguguguucauuuuugugcuucuggaagaaacuggguauagggaaaugaaauucaacugcucacuuuucuucagucaaggagccuccaggaggguaggagggcgaagcacguucuagaagggaagucacuugguuucaauguuucuccuacuccucuuuucucccugcccagcugacccuacaaaauaucuuauucuguugugcugaaguccccuggacagugaccauggguggggguggcaggagacaccaccuucuacuuuuuuuuuuuuuuuuuuuuuuacagagcuuuugcuauguuuccuuauuggccaacuucugucuugauuauauucuuuuuuuuuuuuuccauuuuuuauuagguauuuagcucauuuacauuuccaaugcuauaccaaaagucccccuuacccacccacccccacuccccuacccacccacucccccccuuuggcccuggcgucccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauauguaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguuuaggaaauuguaucuuauaucguggguauccuagguuuugggcuaguauccacuuaucagugaguacauauugugugaguuccuuugugauuguguuaccucacucaggaugaugcucuccagguccauccauuuggcuaggaauuucauaaauucauucuuuuuaauagcugaguaguacuccauuguguagauguaccacauuuucuguauccauuccucuguugaggggcaucuggguucuuuccaguuucuggcuauuauaaauaaggcugcuaugaacauaguggagcauguguccuucuuaccaguuggggcuucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccucgccagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccauuuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauugguccacuugucugucucuauaccaguaccaugcaguuuuuaucacaauugcucuguaguaaagcuuuaggucaggcauggugauuccaccagagguucuuuuauccuugagaagaguuuuugcuauccucgguuuuuuguuauuccagaugaauuugcaaauugcuccuucuaauucguugaagaauugaguuggaauuuuaauggggauugcauugaaucuguagauugcuuuuggcaagauagccauuuuuacaauguugguccugccaauccaugagcaugggagaucuuuccaucuucugagaucuucuuuaauuucuuucuucagggacuugaaguuuuuaucauacagaucuuucacuuccuucguuagagucacgccgagauauuuuauauuauuuguggcuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucuguuggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguauuggccuugaauuccugaucuuuccagaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauuaaggauuuuugcaucgauguucauaagagaaauuggucugaaguucucuaucuuuguuggaucuuucugugguuuagguaucagaguaauaguggcuucauaaaaugaguuggguagaauaccuucuacuucuaucuugugaaaaaguuugugcagaacuggaguuagaucuucuuugaaggucugauagaacucugcacuaaacccgucugguccugggcuuuuuuuggcugggagacuauuaauaacugcuucuauuucuuuaggggauaugggacuguuuagaaggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagagcuuuuagauguguugucaagcugcuaguaugugcucucucccguuuuuucuugaaggcacucauagcuaugaguuucccucuuagaaaugcuuucauugugucccaaagguuuggguacguuguggcuucauuuucauuaaacucuaaaaagucuuuaauuucuuucuuuauuccuuccuugaccaagguaucauugagaagaguguuguucaguuuccaugugaauguuggcuuucuguuauuuauuuuguuauugaagaucagccuuagugcauggugaucugauaggauacaugggacaauuucaauauuuuugaaucuguugaggccugauuugugaccuauuauguggucaauuuuggagaagguaccaugaggugcugagaagaagguauauccuuuuguuuuagggaaaaauguucuguagauaucugucagauccauuuguuucaucacuucuguuaguuucagugugucccuguuuaguuucuguuuccaugaucuguccauuggugaaagugguguguugaagucucccacuauuauugugugaggcgcaaugugugcuuugagcuuuacuaaaguuucuuuagugaauguggcugcucuuguauuuggagcauagauauucagaauugagaguuccucuuggaggauuuuaccuuugaugagaaugaagugucccuccuugucuuuuuugaugacuuuggguuggaagucaaucuuaucagauauuaggauggcuacuccugcuuguuucuucauaccauuugcuuggaaaauuguuuuccagccuuucauucugagguagugucuaucuuuuucucugagaugaguuuccuguaagcagcaaaauguugggucuuguuuguguagccaguuuguuagucuaugucuuuuuauuggcgaguugagaccauugauguuaagagauauuaaggaaaaguaauuguugcuuccuguuauuuuaguuguuaaagguggcauucuguucuuguggcugucuucuuuuagguuuguugagggauuaccuucuuguuuuuucuagggcguuguucccguucuuguauugguuuuuuucuguuauuauccuuugaagggcuggauucguggagagauaaugcgugaauuugguuuugucguggaauacuuugguuucucccucuaugauaauugagaguuuggcuggguauaguagccugggcugcaguuuguguucucuuagugucuguauaacaucuguccaggcucuucuggcuuucauagucucuggugaaaaaucugguguaauucugauaggcuugccuuuauauguuacuugaccuuuuucccuuacugcuuuuaguauucuaucuuuauuuagugcauuugauguucugauuauuaugugucgggaggaauuucuuuucugguccagucuauuuggaguucuguaggcuucuuguauguucauaugcaucucauucuuuagauuugggaaguuuucuucaauaauuuuguugaagauguuugcuggaccuuugaguugaaaaucuucauucucauccacuccuauuauccguacguuuggucuucuuauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucucuaguguugccucgcuuugaguuuucuuuauugugucuacuucccuuuuuaggucuaguaugguuuuguucauuuccaucaccuguuuguauguuuuuuccucuuuuucuguaaggacuucuaccuguuugauuguguuuuccuguuuuucuuuaaggacuuguaacucuuuagcaguguucuccuguauuucuuuaagugauuuauuaaaguccuucuugauguccucuaccaucaucaugagauaugcuuuuaaaucuaggucuagguucucagguguguugggguucccuggacugggcgaagugggugugcuggguucuggugauggugaguggucuugguuccuguuaguaagauuccuccguuuaccuuucgccaucugguaaucucuggaguuaguaguuauaguugacucuguuuagagauuguucuucuggugauucuguuaccgucuaucagcagaccugggagacagauucucuccucugaguuucagugcucagagcacucucugcuggcaagcucucuuacagggaaggugcgcagauaucuuguauuuggaccuccuccuggccgaagaagaaggcccaaaacaggaccuuucucagacacuguguugcuuuggcaguucccaggugguacagacucucaccuaagcagacuaaauuccuaaguuccuuggagucccgggaccaagauggcgaccgcugcugcuguggcuuaggucgccuccccagccgggcgggcaccuguccucugguccggaagguggccggcuguccccggcccacacagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggccgccuccccagccgggugggcaccuguccucugguccggaagguggccggcuguccccggcccacgcagggugcugccucagcgccucugugcuucugccuguuccagaagcugucagguucucuggcgcacccucucaccuguucagacuaauuuccuaaguucggcgggucccggaccaagauggcgaccgcugcugcuguggcuuaggucgccuccccagccgggcgggcaccuguccuccgguccggaagguggccggcuguccccggcccacacagggugcugccucagccccucugugcuucugccuguuccagaggcugucagguucucuggcgcacccucucaccuguucagacuaauuuccuaaguucggcgggucccggaccaagauggcgaccgcugcugcuguggcuuaggccgccuccccagccgggcgggcaccuguccuccgguccagacgguggcuggcuguccccggcccacaaagggugcugccucagcgccucugugcuuccgccuguuccagaagcugucagguucucuggcgcacccucucaccuguucagacuaauuuccuaaguucggcaggucccggaccaagauggcgaccgcugcugcuguggcuuaggucgccuccccagccgggcgggcaccuguccucugguccggaagguggccggcuguccccggcccacacagggugcugccucagcgccucugugcuuccgccuguuccagaagcugucagguucucuggcgcacccucucaccuguucagacucuuaauaugcuuuucuuguuauuauuaaaucuguauaaaaaccacuagguauuagcucacccuuuugaauagauuucuucagaauaauaaaaaugaccugucuuguacugaugcaacauagacaaauagauaauuucucaauucuuaauuaugauucuacaagaauuccuaaaauuauauuaguaauuaucaagcccuuucauaauaggacugcuauuaaguccuuucugaugucaaaacuacaaugagaacucugccagucuucaagugucaccaguuaauugcuucugagaaagaaagcaggcauuuacaaauuagagcuuguuccaagaaguuguaaaacaaguaaccaaaggucauaaaaaagggaacuaacuuauugugggugcaaggucagaagauaaaauauugacuagguuuaucuauacaaaacuucuaugcuaacuuaguauagucuuuaagucuccaagaaccuuagcacuagugacagauaaugaauguuuagucagauaauuccucuuaauggauaagcauguaaacaucucuguuguaaacuucuuauuuaguuuaugauuugaauuuaugauugauguucuagugaacguuuguaaaaugggaugccuggaaaauccauguuaucuauucuccuagaauaaguauuaggacuaggaauggauuacaugcagggcauaguuacaucagagcagaaggagagaaaaagauuagaaggagaauguacaguggaauaacuuagaaauuauaagucaaauuuaaaaauuaagaaaucaauaugcagaaugcagagggaaagaggaaaaaagaagaauuugcccagagagcagaaagagcaagcaggcuucuccucaccaugggacagaacaggucuuuucaugauagcaaggcagacuuagucuuacuaaagaggacaaagcuuucuucuuacagacuugggcuuaauucauuuagcaauaaaacaguagaagcguuuucuuucucuaugcaguaaagauuggagcucauuuuucauccagaaugagugaguucuuucugcacuggugauuugucuuuugcuucauaugcauauauaaguauggaucuggguguguaaguauguaauuaagagauaaguaugggguacuggagcgauggcucagugguuaagagcauugacugcuauuccugagauccugaguucaauucccagcaaccacaugguggcucacaacuaucuguaauagaaucugaugcccucuucuggugugucugaaaacagcuacaguguacucauauaaauauuauaaauaaauauuuuuuuaaaagacauuaaaaagagagagagauaaggauguagauggucccagcuggugugcauggagguguauaaauuuguaucugaauuuaugcauauuuguuuguaugaaaguuuuuccuuuugguagcaugacucucuucuccugguacaauaaaaguuuauugacccaaaccucucucccuucugggcaagagagaaaaaaaugcccuagcaauuaauccuuuacuuaauccccugcuguuaggcuacagguguuaauugcccaagccagugguuuuuaacccucaguaugagcaaagcuuuuaggauuuuuuuuuuuuuuagaaguuaucaucaagccuucaguguaguuagagagcuaaaaagccggagcucaucaguccuuaaagcucccucugagaccaucagucuuaaaaagcuggagaccaucagucuuuaaagcugcuucuacaacugaagcuguuucccacuucaacucauuccaggcccagcaggauccuugcacuucuucgagguuuuguuagaaaauauauggcccuuguagagagcauuaucagcccaauggggaaguuuucacuuaaacuccaaguauauaugcauucacauacuuaaauuguagguauuuuaugguagauggauagcauuaugaugucuagacaucuuuauuguuacuuuucuccuucuuauguguuuauauuuauccauucucuauaauaaaaccccucuccuauauuuucccuuaagaugacuuguucucuguuaucuccuauuacaccuucacaucccaccguggucugguuuuacuuuucugucuacugcagugacuccagguugugaacucacaucugaagauuuggaccuaggaccuuccuaugagagagaacaugcaaugccugucuuucugggccuguguuacuccacucaggaugaucucuucuagguucauccauuaccugaaaaaucuuaugauuucauuuuucucuacagcucaauaauacuuuauacugcauauauacauuuauauuuguuaguugaaggacguuuauguugcuuccauuuuguagcuguuaugaauauagcagcaaugggcaugguuaaacacauaucuguggcguaggauguugaguccuuugagcauauucuaacaggaguggaauagcugggucacaugauauauuuguuuaacuugaggauauuuuuuuuuagauuuauuuauuuauuuuuauguaaguacacuguagcugucuucagacacuccagaagagggagucagaucuuguuacagaugguugugagccaccaugugguugcugggauuugaacuccagaccuuuggaagagcagucggguacucuuacccacugagccaucucaccagccccgaggauauuuuuuuaauugcagauuauauugauuuccagaauggcuauguuuuuuggccaugcauuuuuauucccuaugauuuuguuuuuuauaauguuguugaccggauuauucauaguauucuucuuuuuuuacugugagagugguuugccgucuugagcauggaugauuacuucccaguuuuccuguacuuaccucuuuuucacaugaaauguauucuuuccuauguucucauagauaauuucucuaauuguucuguguauguuuugccucuaauuuauuauagguuaugcuguuuuaguaaaaugaauugugauaauucaugacuguccucaaauguacauaugucuccauuaguuuugaaagaguauuuuucugauguaacaguauauauaguuaauggugauuuuucucuccaaguuuuaaaugucuuuccauccucuccuggcuuugggucauugaccagagucgagguuuuuuucuauugcuugggucuuuucuuguggugugacauuguucuuuaaaagaauucaguauuaauuuuacuuuuucucuuugaccccuugguacuaaagaccacaaucuggcuauucauuguuauucaaagagaaaaucaaagaagagaaacaggaagaaauggccaauucuccaguaaacacaucccaggucaguggucauguccacuuucauucugaaaauauuauaguuugauauauugcaaaccuuaaauuuucugcuucugaugauguuuuaaaaauuuaucuuuaugaacugauucaccaccaaaccccaaaaaccugugaaggaauuagaacaagaaaagcaauuaccuuuauguccuuuuucauaaugaguggucauuacauccaugaaacggaugaucuugaguguagacugagauuauauucuacuugucuuucucuucgguauuuaaaucaugaugguggugaugugucuacauguguguuggcacuucauaucucuuuaucccaggagaauuacaaucuugguuauuucugaaaguagagagaucaguauuuuuacuccuuuucauuuacucuuuuuugugucccacaugcauacacuugggcuuggacucauuguguagaauuauguggaauucauccauacaaaugucuugugggcauugacugacaugugcauaagcuguuauuugaugcagagaaacuauccccucauuauggccuugcucuagacacuuugaaugucagcacuccaugccuacccugcaguugcaguguacugaaauugauauuguucuauguuggcucuucuauaugcuuagaacaaguuuagauuuuauuaaguguaucuuaugcagauuuucuuaucugcuuguuaguggcccaaauagucuuauaaaaauuaauuugguaggcuacuugauuuuuauguuacaauuaaacuugugaguauguagcauuacuacaauccuuguuacuguggcaaaauaucaaaaugcuuugcuuaaaagucaauggguucugccuuccauaucuaccccuuugcuauuuaaugguguagcauugcauguugaguuuaaaaaucauaccugagccuguuagaauaggauuagguaagacccaauagagauaggauugacucaaugucuggauuuuagcaugaucuucaggcagaaaauuuaagaacacauguccucaucaugacugugcuucugagacaugcacauugugauccuuugggacaugaauauuguagcauguaauuauuaaaaacaacuaaugccagcuacucgccagcaucgcgggcuagccacgcccauggcuauccccaugcagcagucagcccaguuucccaccauucacugcugccuaaccgcuuguauuuucccaggccaucuugggccugguggccgcuggcucuaaaccccuaacccguuauaauuaagacuccagaggcuuguaauuuauuagucagauuuauaacaguaaauucucaaccaccaaaaugcccacucaaagaauucaaaacucaagugauauugauaaaagcugcccaccuagacuggacaugggcccuaaauuauuuuauugcucuucuaugauauccauagcuaccuauggcuauuucaggaucugguugucuucuuccaucuuucucugcccuuccucugucuccuucucucuaaaacuuuuagccccaccuucuuuuuucauugcccaaucacaggcucuagccuuauauuucacuugaucucaccugcauacagacagcaaucuacagaauaugacacccguaacagauagauaaccaugcccauaucuuaaguaugugucuuguuucauggauaugcuugugagacuauugugucauccuguuuucccacaguuugaucauuuauuauacaauaugacuauauuggaaaucaucguuuuuauuuuuuaauuuuuuauuuuuuuuauuuuuuugguuuuuugagauagaguuucucuguguagcccuggcuauccuggaacccacucaguagaccaggcuggccucgaacucagaaauccaccuuccucugccucccaagugcugggauuaaaggcaugugccaccacgcccggcuacguuuugauuuuuuuuaauuuuuugauuauuuugaugauaauagucuucccucaucuacauccugucuccuuauauccagaaaagcauccuacccuguagcacaccguugaacaauaauuuuuuauuucagggucuguugacauuccgagauguggcuguggacuucucccaagaggaaugggaaugccuggacucugcucagagggcuuuguacauugaugugaugguagagaauuauagcaaccuggucucugugggugagaacauuuugguuguacaauucuuaacucauucuuuguaaguacuggcccuauaggcuguaaacucuauuaagcugucauggaaaaaaacaagccuagacaaaguucaauaauuaaaaagaaauuuuccaagagguucagcugccaacgcuagcagaagacagccagagggugugacuacuaugagcuaguaagcaugugauggagacaccggacacaaagagaagcauagugauucgugcucucggaagaagaacuggaacugaagauggaagcucagugaggaacagccugaugugagaggccugugcugccacaugaggccauggugaugucugggccauacugccacugccgagggccaugucugggucaguggcccuacugguaccaugggucugugucauuaucuguaguccauguuaccaaaggccaugcgaaugacuguggucugggcugcugccugagcacauguugaugacugaggggcucccugagcugguccugccucucgucagcuacugcaugguugugcaagcugugacuugaggaugggagagaugauccugauaguauaggugcaagagggcugaugggcagaccaccucagcuaccacccaggaucagguucagggcuuuaaguuagcccaccaaaauauguaccccaccuaugaacugcuggagcacgugaaggggccaguccugcugaaucaaagcugcaggauuuccaugacucagggcaacagcagguuacucaagaggagccuuggcgaggguccaguauugaugguguagcagaagccagaaaccuagaaccagaccaaugacucauugcaacaaacauuuuccugggaaaacuguuugugcaaaaguguguacagugugacauaccacagcuucaaaugccacuaugcugaauagguaauggcagaguggacuuguaaauggacagguacaguacuuguauagcacuggugcagcaacaacugaacuaggugugagagaaggcugcaguauauacaagagcaggccguugucccaaggcauggccagacuauuuuauuuuaaauuuuauguuuuauuucauuugaggaggugcuuacaaggguagaaagcagauauggaaggacugguaaaugaggggaacuggggugcaugauaugaaauucacaaagaaucaggaaaaauuauguuaagaaaaaaaagaacauuuugaugguauuuagcuuuuucuuuucauuuucauuauuagaggugucaugcacccuugauauuaguucgaggaugcacuaagauauucaguagcauauacuauuuccaccaauaccuuaaagcuccauaaccaucauugcaauugacauuuuuaaaaagauuuauuauuuuauguguaugaguacacuguagcucaucuucagcauguagcugucuucagacucagcagaagagggcauuggauuccauuacagaugguugugagccaccaugugguugcugggaauugaacucaggaccucuaaaggaauaaucagugcucuuaaccacugagccaugccuccagccuccuugacauuguuuuaauuguacgaaaaccucaagauaugcaaacugaaaauucuccuagaauaugcuggagauucugacuggaaauaauaauugggaauucauuaguagauuccucuaauuuauaugcuucucauguucuuugcacaguucuguguuagaugucuguauuguugcuaaaaguuauagcaugcauuguggacaaccucacagaguaauuggauaaauuguaugcagaguaggcuugaucaucuaucuggggcaaaugagauuguccuggaagguugagaaaauguaguagccaaaaucugggagggcaagugaaugagcaggacaacagugaaggauucaagugaaagagaaagcaagagcugaaacugccuuuacuguacuuaauucucuucaaaggacuccugauccuugcacuuacuacagucuccuguccucaacaugcauccugcccacuguaacucuuagaagacauugugacucauuagaccugaauauggggaguuaauacuaguacaaugcacaauuuuacuugacuauguuggcaucagauuggaauaauuuuacaaauuauaagucuaauguaaguccaugaaguaggauuauucuguaauugccuugcuagcuuauaugucuucauauuacauguuugauuuucauuccaguggaggauacagagauauccuucuggaaaauaaucuuaagaguugguagagauuagacuugagaauaaccauauaaggaaaguuaagaaauacagcaggguguggaacccagacaauggaggaaaagacaugcgcaauagcugcccaugaaagcccucaaaagaucuauagcauugaauaucuggcaaaauauuugcuuuauauucauuacucuugaguaaucuaaugccuuucauuuuuuuaaaguaaaaaaccaaaaccuuugaugcuauuuaauaacuuucaaucuuaaaaguaauugugacuccggaacaguaaucuuuguugcuguacauuagaaaguacaaacacuaugacccuaagauucgaugaaagucuucauccauuucugaggaaaaaagauuaaaaauagagacacauguacuagauauauguagugagugaguuccauuccaaagcuaauuucuuacccucacuuauaaagacagucauuuaucacaaaugucaucuagaaacaagcccuauuaaucugaguuguacuuauuuucagagaacuacugcauaugugauacuguccaucaaccugugaggacugaaaaggagucuuguccauguaaugagcucaacgaaaugcuucaugaacccuccaacugugcacuuuauaauagaagugacacuacagaagccucuaacaacuacagaugcuguaaugagaaggaugccucuguugacucaucaaacgcagauagacacaaaaguaugcacaucggagaagaagacacuugccaaucuaaagacugugagaaaucuuucaauuuguguuccaacauucggcaauaucaaagacucaacacugaaaagaaagagcacaagcaggaugaacaugaugaccauuucagcucucuauauagucucaugcaagaaacaguugacauggaagaaaagccauaucaaugugggcacugcaggaaauacuucaguaccaccucaagccucaguauccaucagagaauucauacuggagagaaaccuuacaaaugcaauauuuguggcaaauccuuuaaucaguggucaagccuuaaaacagaucaaacacugcauacggcaaagaaaccauacaaaugcaaagaagguggaaaguuacuugugcaguuaucugcacuuaaaagccaucagagaaggcauacuggagagaagccuuacaaaugucagcagugugacagauccuuugcccacugugcaucauuaagauggcaucagaaaauucauucuccugagauacauuaugaaugcaaagaaugugguaaguccuguuuugaauuaucacaucuuaaaaggcauugcagaauccauacugccgaaaagccuuacagauaugagguaugugauacaucuauuacugugaauucaacucuuaaaacucaucauaaaauucauaccagagagaaaccuuacagauauagggaaugugacaaaucuauuaccaagugcucauaucuuagaacauaucagagaguucauacuggaaagagaccguauagauguacagaaugugacaaauuuuuuacuaagcacucaaaucuuagacaacaucagaaaauucauacuggagagaaaccucccaagugcaaagauugugauaaauccuuucuccggauuucuaguguuagaauacgucagaaaauucaugcuggagagagacguuaucgauguaaggaauguggcagaucuuuuaccugguucucaaaucuuagaguccaucagcgaguucauacuggagagagaccuuacagauguaaggaauguggcaaaucuuuuacuacgggcucaaaucuuagaguccaucagaaaauucauacuggagagaaaccuuacaaaugcaaagacugugacauauccuuucuguggauuucaaaucuuagaacacaucaaaaaauucauacuggugagaaaccuuacaaaugccaggaauguaacaaaucuuucacaaggugcucauaucuuagagaccaucagaaaauucauacuggagagaaacuuuacaaaugcaaagacugugacauaucauuuauguggauaucaagucuuagaagacaucagaaaauucauacuggagagaaaccuuacaaauguagaggaugugagaaauccuuuacucaguguucaacucuaagagaccaucagaaaauucauacuggagagaaaccuuacaaaugcaaagacuguggcauauccuuuuuguggauuucaagucuuagaagacaucagaaaauucacacuggagagaaaccuuacaaaugcaaagacugugacauauccuuucuguggauuucgaaucuuagaacacaucagaaaauucauacuggagagaaaccuuacaaaugucaagaauguaacaaaucuuuuacuaggugcuccuaucuuagaguccaucagagaacucauucuggagagaaacuuuacaaaugcgaaaacugugacguauccuuuauguggauuucgaaucugagaagacaucagaaaauucauacaggaggaaaacauucccuuguaaauaaugugacauaacauauaucugguauucucugcuugcaaaucaaaugagauaagugauugcaacauaaagauaacauaacuagaugguuaaagccuuuaaugaggauugaaaucuuacaaaaugaaucagaguuuauauuaaaauaaaauucugcaaauguaacuguggggaaagcuuuuuauuucuuuuaauauguaugccuggccuguaaguauuucuguguacuacauguaugccuggcgcacguauaagccaaaagagagcaucagauccccugaaguuggcauuauauacaguuguguguagcuguuuauauguugggaauugaacucuuauccucuggaauugcagccagugcucuuaacuacugagccuucucugccaucccugagaaaagcuauaacaaaaacauauagcuuauucaacauccaaccauucauaauaaugacagguaaaaugguacaugccuuuaaucacagcacacagaagacagagaucacugugaauccaguuccaggacuucccgaacuacauagacccuuucucagaaaaaaaaaaaaaucauaguaaggacaacaugcaauaauguuaaaauuuugacaaagauaugcaauuguacuauacaucauauaguucauacuucugauaaaccauguaaagguuucuuucucucuuuuccuuccuuccuuucuuucucuuucucccuuccuuccuuucuuuuuuucccuucccuccuucuuucugccugcucucucucuuugaauauagacacugauuuuucaaaguugauuuguugguuuucauucccucagcaguauuugaccacuuguuuuaugccaacaggaauuaucauuucuaguccugaugauggauggccacuguagcuauggcagcaugguagcuuauaggaguucuuuuauauauuucacugauaaguuuacaaacuguuuuguuuauuuuaguuuuucuuuagguuuguugaaauauuuuuccuucauuuauuuuaucuuuucugcuuuuuuuguacuguaaaauuuuaagauauuaguguaaauacaaaauguuuccauucccuuuccuacugacaaauuuucccauauauucuucccugcuuucuuuuaaggucauggcuucucguuuuauuaauugugauuguaugcauaauauguauguauguauguauaagauauguauugcugggguucaggaguugucccacaaaccacaugaacaccaaucucagucagacauguacaguuuauuguacacaauuaaacugaucaucguggcaaaaguuucagacuggagagcugaaaucugcgugucuguacauuauccaggcucacuuuauauaaagaaaaaaacauaaugagcucauaagcagauacaggguaucuguagggugaucagucuuuuuucugcuugucuuuaguaacucaggcauaacaguucaaguugaccuuuuuuuucuugacccugagugaaggcuccaugcagcuguggaaccuuccaaggagagcaguucucaaaauaugaugacaaaccucugaccauagcaggauguauggucaacuugaccucacucagagccaaauuaucuguucugugucuuauagucaggcugcucucuuuuuuagucuuaggaauauggcaggccugaagcaaaaugccuauaguuauuuauaagaaguaaugccagggaaccaguuuagagaaacagacuucaacauguauaauuaauauacauauauauucuuaaaucugaccucuucugucugucuuaugcuacuuguguauauguuuccaaugcugaccauuugguuuggauaacuaguugguaugcucuccccgagggagacuccuguucccagcauugucaguugccuguaguacacucuguagaaauugagcucagccuugugggcuuuucccauccaccuuggcauguccauuguuguugugcuuguucggcucuuguuuggacaguuguguggcugagauuuuauggauaagcuccuggcauuacuaggagaaacagccucacagcaaacuuccuggucuucugccucgugauuauugauacccaucuucaaaaauauuccuugagccuuagaugcauaaguguuuuguagauguauccauuaggcaugggcuucacaacucuacauuuugauuuguuguggauuuuuuuuuuguaguggucucuguugaaagagaaguuucuuugaugagggaagaagccuacauuuauuuguugguacaaggaaaagauguuuagauuuuuauuagggauuaugcugcuuuaguaaaguggugguuguuggucuccuguaagauuccugauuucaccagcacugaguagguagcuauguuuccaguaccagucaugguuuucuuuuguuaagaguguuuuaaauccaacuagagagcuguuguuuaccaccaacaugaguuuguuguuacugcacccuuagaguuguccugccaagaugauuguugauuugguuuaucggcaucauaacugaguaagacuguugguuagauucuugcuuuggaagcuugcaggcugauucuggguucauacaagcuccuccucagggaagagucuguuuuauuuugaggcaggaucucucuguguauugcaagauguccuagauucucuauuuagacgaggggggccuugaacacagaguuccccuguuccugccuucugagugcuugguuugaaggcuuacaagaccuugccugacuauacauacuguuuucuuauguguuugauuggcuuguugguuuguuuguuuguagagacaggguuucaauuguguaacuuuggcugauguggaacucacagagaccuccugagugccugaauuaaaggcauaugccaccacugcccagcucauaagguucugauaguuacgcaagguaaaggcucaacuaacuugauagaaaugugcuaauaagaucuucuguuuacugauauuaaagacuucuauuuuacuaaauagaauacucuaauugaaaugauguauauaacaugccaaauauaaacaaugugaaauaaauaauauaaauaaaacuaaga

SEQ ID NO: 8414 - RNA, 1351 nt, Mus musculus
cacuuaucuauuggaagcuuacaagauaccucggugcugccgcuuaucuacgucggacugaccacaccucaaauuucaacaccagccucgauggacaaaauaagaauuuuuuagcaccagccucaauggacagaaaauuuuagcaccagccucgauggacagaaaauuuuagcaccagccucgauggauagcaauuuucagcaccagccucgauggauaacaaauuucagcaccauccucaauggacagcaaccaagacuagcgcuucuaccgccccuucugagggugaaaaccaaaaucaaaagggauaagagguucacgagcagauauaucucuccgaacucaccuuuucccugcaguucugaauccgccccgucuccggggguuuuccccaacgccggcgauguuaauucccgggauuccggcaaccagaugacccacgcuaccaucucgccagcaaaacgcacacaggccacucggauccuucugcaguacagcuuuaauacaucucgagagauagaugaucagcuucaggagaggagacccagagagcagaaaacccuucccuuuuauaggcugcgaaaaaaacgguuggagaugugcaccacugggauuggcugcccacuaucagucaguuaacgccacgagaaaggcagagcucagguaauggaaugauacccugacgccugcgcacauuuuacuaugagcaacggaugucagcgccaucuuguaacggcgacugugagggcggcuccucacaacuaaccaugaccucaucucugggaaaacaagcgcaucacuuuauaagucauguauaagauaguauugauaguauuuaucaaaauaacuuuccaaaaauaauauuuuauauggcugcauaugugucaucggaaguagguuuugguauauuguuuaagaaaacuuuaaauagaaaggaaacaguguaaauguacgcuuugaagaguuacagaagaacaggaacuagauguuaaauaguaaccgauaaugaaaauucauuagcuuguucuuggaaauuugccacuagccuuagaugauuuuuguaguuugauuuaucgaaugaucauaauaauauccauucuaccugacugcuucauugaauauaucuuuuugaaguuguaauacuugaaugauuuuguauuuugcugugccaaaugauuauuauaaugucuguucuauuguacuucuuuauugaauagagcuuuucaguguuguaauaccuguuucucuaugcauaaaaacccuugcuugagagcugcaaaauacacucagauuaaaacugccucuguauuuguuucuguuugucaccaccaaauccuuacccaccuggccu

SEQ ID NO: 8415 - RNA, 2354 nt, Mus musculus
ugaggcuuaccuguaucacuguauauuuguuucauacaguucugucauugcuuguuuuauauauuuggaaacuuuugugaaaugcauuccuguugaucauauaguuuucuggaaauguaccauuugaucauuuguuaauauucuuucuuuuguaaguugauagauucugcuuuuucucuuaccugccauaauuguuuucaaucuuccuuauaaauuuccuugagucuuagcaauuuuuaacuuuuuuaaauuucugcaaaaauuuauuugaccaaaauguagaaaaagugauacuauuacguaugauacaauagcaagaacguaaagaacagaguagauuuuaucaauugcacaguuuacucaaaguucaucucccugguaguguuauacuuaauaaauaggagugaggggcagggguucagauaagcuagaagcagggugacuuucagucaggacuguaaacuugaguuggcccugcacugcuggggaauguggaauguuucaaugugagguguuaacugagaaaggaaaacuacaaagccaaaaaaaaaaaaaaaaaugugcagccuacagagcacuccacauccaguucaaucaggaggucuuggucuuuuaugagugucauuccugaaggaauucaagucuuggcaaagucaagcuuccauuuguuguucccugaacaauggagaugaaguuaagccaauuuuuuuuucuaucacuacuuugcugcuggcgagaccuuuuguugcccaacaguugguauuagaaugaugcucaauguauugaaggcugguagccuuuuuauuauuugaggcagaguuucgcuguguagcccuggcugaaaaggguuggacucugccauauucccugcugaguauaucauuagaccacagcagaaaaguccuggaauaagaugcuugcuccucagagaauaauucuggagugaaggaaagauguaacauggaacagcauuaaagcucaaucagaaggcacaugggcaacaaugaucaccccagcauucucgcuuggaaugcuuaaagacaaucuuuucuguacgugggaguguggagcagacucaguaugaucaggcuaaucuaguugugcuuuauaacuucccauagaagacuguuaauuuuugcucuggguggaaaauuucuacauaauuucuugugacaaccccuagccucacaaaacuuccccaacagcauccagcuacgauuggauacuugaaccugugcuucaaaguguggagcugacuaauucccaagaaccaaaugcccucagccuuaagcaacuauacucaguguaaaauucccugccuauuuuaggaauaaaugcaauuuaagaauaagaauaaucagaggagcugguaccauuugaauggaaaaggaaagaauuaaacauaauugguguucaaagcuugucuaacaaaauauuuggucaugaauuaauuaucugcuuggcauuuccugcaagguggagaccugguaauaagcagaacuucuuacaaaagaggaagacagggcacacucccuggaguggaguugguguuaaaacagacuuuucugguuuaguuuauauacaguuaaguucguuuagugucugguccagugucugauguaagcccacauucucuucuuuggccugggcaaguuuuucuuccaggucaucgauugucuucuccaguuuagaaacuguccuuucugcaaacucagcucgggucucagccuccuucagcuugucagacagaagcuugauuucuucuucauauuuauccuccuuuucagaauacuuuucagaagcagccuccagugauuucagauuguuaguuacauacuugagcucuucuuccaggucaccacacuuuaguucagauaccuccgcccgcuccucugcucucuucagcucacccuccaggaugaccaacuuaugagcgaccuccucguacuugcggucggccuccucagugaugugcuuggcuucuuugagcugcaucuccaggaucuccaucuuuuccucaucuuucauggcucgguucucuauuaccuucacgccucucucacucucaucagcagccuucucugccucuuccagauucugcagggcuauggccagcugcuccugagccagguccaguuccuccuccagcaguuggaugcagcgguugagagcggcugcaucuccuucagauuucucccgccgcucgugcucgccuuccaguuccgcaaugcaggcccugcgcacuauucucugcaucgucugccugcugcugcagggccuggaucuugugcuucacugccuccagugaguugaggccggccauagccccaucguucugcuggucucuggcgacc

SEQ ID NO: 8416 - RNA, 21644 nt, Mus musculus
cuaagauccaguccugggugacaggaacuuccaccgauugucuuucuaccuuccgguuucugcauucuagcucucucuggacccggaaaagucuccuccgaagcauuuucuuggcugcggaccugggagagucagcaguucagcugccagcacugcagcucggcggccccggaaggucccaggucagaggagcugcggggcugggaaacgggagggagcagagcaggggggaguuuuccgcagcugcucuuaaggacgccacucucacaguucuguuguagaugucucaccacugauuagaaguuugagauccugugaccugggauuuaucgugauucuuuaaaaauguauuuuacaauuacuggaauauucagucauaaaaucacugguaaaccagaacacccuccccgccccaaccuaagcucccugggacaaaaccaccaaccaaagaguagacaugcagggacccauggcuccagcugcacacuuagcaggaaauggccuuauuggucaucacugggaggggagccccuugguccugugcaggcucaaugacccaggguaggggaaugcuagggcgcugagguagaaguggguggguaggugggggagcacacucauagaggcagggggaggggauaguggguuuguggaaaggggauaacauuugaaauguaaaaaaaauaaccaauaaaaacaugaagaaaaaaaaaaccuuguaaaagagcgguugcauuaucuauuuccuaaugagccaauuacaaagauaguggaaaguaaauuuguucuugcuuucuugccuuguuuuacuaauugcuuauucaagagaaugccuuuggcccgguuaauaggcauccccagagagcuuuguauauaauauuauaugaggaauagugcagauuuauugaaccaaaaauuauacuuuaucgagcccuacuguuauggguguaaacacuaauauuuacuaagcaaacuuuuuaguggccaugaacuuuuuaaucagaauuguaugcaguuuaggauguaaguaaaacauucagaaauaugucuucauaugcugaguucuuauguuacuccuuggguccaagcaagcccaauauugcagaucuuagaccagacuauugauuaaaaauaaaguuuuagaaaacaucuuuuuacugaaggggucugcaacccuauagguagaacaacaauaugaacuaaccaguacccacagagcucauaucucuagcugcauauguagcagaagauggccuagucggccaucacugggaagagaggccucuugguauugcaaacuuuauaugccccaauacaggggaaugccagggccaagaagccggaauggguggguaggggagcagggcagagggaggguauagggaacuuucgggauaucauuugaaauguagauaaagaaaauaucuaauaagaaagaaagaaagaaagaaagaaagaaagaaagaaagaaagaaagaaagaaagaaaacaagaacuggauuuuucauaagaaaagggaauucauuagcucagauuuggggagaaaaauguuaaaacagcauggcacuauaaugugcacuguuauaauaugcacucuagcaaauggcaccauugcaagggucaugugaauuaaagagagcucaugugaaaagacagaacucuaaggauggggauaucacaaucagauacucagaaagcuagcacaggcuacaaugagagcugcauaguucuuucuaauggccacugaucaaugauaugucauuaauucuaugucuucaaagucucaagucucuucgggaugcauuuucuaauacuuacugaguuuuucaauucauccucauuucaucuugaauucccuucaauauuacuaucuuuuuagugaauuuacuuucaagcuucuuuguuauuuaauugagcuguuuaucuucucucaggcuucauucauaucuagucuuaauacugugacccuuuacuacuguuccuuauguugugaugaccuccaacuauaacauuauuuucauugguacuuaauaacuguaacuuugcuacugugaugaauuguaauguaaauaucuuuguuuucugaugguccauugaaccucaaagggguggcaauccacagguugagaacuacugcucuauaugugcaguagucuuuugauucauguuuucuuuaaacuucaaugaucuucgaugaagaccaugauucuucuuuggguuauguguucugguauucaucuagauaauucucauaaaagaaugauucuauuuaaaaaaaaaaaagaaaagaaaacaucuuuuuauacuuaugaucacuccccuguaucagaaaauuauuucuuugguugaagaaaagcacucugcccuuacauagguggccaagcuguuguuuuagaguuuguuaucauucagugcugugacuguagacuucuguaggagaaaugggaauuccuagacaugcagauggggcuuuuggcagagaucucuuuuggacagugcagcagucugguuucugucagugacaauaguuuucuugaagucucccuagcuccucuucaggguucaagggagaaugacugugcaugugucuaagccuacacgcuuagaggaaaagggacacuuuuauuucugauuuucacucuccuucauguuuauccuuuuuuaggcaucauucauuuuuguuccaugaaaaguucugggugcuuucugaagacucuuucccaugugcaggagucacacuccucagguaguucagcucaccugugaaacugagagcccuggauggugaagagaggaaacuagcaaaggauccagguauguuagagagaaugaagaagguauagggagaggcuccaaucccaguagaaaaagaacaugagauuuguuuugccagauucuauuucauucaaaauauuucuagauaauugcagugagaauaacaucagaauauacccauuguagguuuuagaagacuuuuuuuuuuuuucgagacagguuuucucuauguagccuucgcuguccuggaacucacucuguagaccaggcugauuaagugcaccaccaccaccuggcaucaauugauucuuacauagaaagucuuuuaaagagccagguguugguagcacaggccuuuaaucccagcacucaggaggcagaggcagguggauuucuguguuagaggccagccuggucuacagauugaguuccaggacagccagggcuacauagagaaacccugucucaaaaaccaaaaaaaaaaaaaaaaguauuaauucacaagggcaaaugcaauuucauugguuuguaugugagggauauugucccccucccauucacaccccugaucauaucuucauaccaauauuaaacauuuucauuguuauaauuuuaauguauuguuuagucagaacacuugaugccuguuaguuuuuuucugcucauagaguuuuggagcauuguguaguuccuuuaacuugucuuuuaucuuuuaccauuaguuucucaguucccuaaaauaaagccagcaagauuuugauaagauuuguuuagaaacuuugcauaguauuaaacucugucuauauuaccuucccacugauacccgcuguugucugucuucuugucaguuuugcaagauuugcacugcuauaauuuuaauauacuuugaaaucagccuugguuuugauccuucucucauauauuuuaaaauuuuuugugguuucucauuuauacauuuuuggaaugauuuaucuauauuuaaaaaaugucucugugauuuugguauuuucaauuuuaaaaacauccuuuuauauuuuuucacauuugacggagaagaugcuaacagugacucagaauacaaguguuuguguguucgugugucuucuacugaugucaacauuccagguuuuaaaaagaaaauguuuucaauuauuuuuauuaugauuauucuuuaauuguuuuucacaguccugucaccacucccgucuccccaucuccaagacgacauccccaccucucauccccacccacuagaccuacccacucccugaggccucaagucucuugaggguuagguguggagaagacauuuuucgacucuguaaucuuuaguagguuugaagaauuuuuuucuuuguuguuauuuuuguuuuuuugaaacacuuugucuagguaguccuggaaguucugaaacucagaaaauaaaccaaugcuugaacugagaccuccgcugccccagccucuccagugcugggguaaaaggcuugcaccaccuggccuuucugacuuguucugacaugaccacacuugagacuucugcaugagguuugagaagauuguucuucuccugucguguggaugauuuuccaaggugugcuacucauuacagguuuucagugcuguucaugguugucuuucuaaaugguagauauugaagcuuaucugcaucaccaucuaucugcuuccuacaaucaugucaugauuguuuaauacauuuggaaaguuuugugaaaugcauucauguugaucauagaguuuuuuggaaauauaccauuugaucuuuuguuaauauacuuuguuuauaaguugauugauuuugcuuuucgucuuaccuaccauaauuguuuccaacccuccuaacagcaaguccuuaaaaaacuucguugagucuuaccaauuaguagucuucuuuauuuuuuuaauaaaguuagugacguuguaauggugcauagugauagccucagaggcauugguggcacauuuuucuuuuucuuuuaaauagcagaguaauucuccuuugaguaaauguaucauguguucuuuauuuauucuucugcagagggucauguagauugauuucaauuucuggcuauuauagauaaagaugcagugagcauguuugagcaaggguccuuggguagguuggaguguacuuuggguauacauccuagagcgcuauggguggaucuugaaguaguuugauucccaucaauuuaaggaauugccacacugauuuccuugguggcugugcauguuugcacucccucuagcaauggaagaauguuucuauugcuccacauccucuccaccaugagcugucacuucuuuuauugauuuuuagcuauucugacaaggauaagaugggaaugucaaaguaguuuuaauuugcauuucccugaaggcuaagggugaugaauauuuuuuaugcguuucuuggccacuugaguuuucuccauuuagaacccucuguuuuuauuucaaacccauuuuuaauuuggauuauuggguuauuuuuuucacaucuaguuucuucaguucuugcuguauuuuggauauuaguucucuauuggaaguagaauugguacaaucuuuuccuauucuauaggcuucugcuuugucccagugaugguguccuuugucuuauugaagcuuuucaguuuccugugaucccauuuauuaauuguugaucucagugccuaugcuauugguguuuugucuuuugcuucuuuguuuugauuuuuuuuguuuuuuaaaauaaugucuucucugacaauauguucacuuuuccuccucacucuaucuucugucagauucaguguguuugguuuuacauuaugguguuugacccacuuguacuugugguuugugcuggguuauaagugaauggcucugcuuagcugcacaaagccaaugcuacuuuuagacuccauuuuauauuuaacuugcccuuagauagaacuuagcuacugaaaaaaacgucaacuagcucuaggaucugagacauccauagcauccacuacuccuucccuauugauagccaauuagcucuuaggagcaaaguuccaaaauguccagaugucucaaaagagauugcuuaagcuagcaaccacuguuuaucuagccgaaauaauuagccaauacaaaugugucaagcugcaauuuucacaagucaaucaaucauguaacuguaaaguuggaaauucuccuacucugcucuaagggugacgauaaggcaaggcuuuagcacccuucugcugcaugggagagguuggaggguccaaguucaagcuuaaauaaaaauacuuuggcuuuguaugugaguuggauuccuggcugucucuggugaucucugaggaccuugagaucugggcauaagaauaaguauggauccauuaccaaucuuuguugaagaugcuauauuuuuuucaguuuguauuucuaucuuuuuuaucaagaauaagguagccaaauauauuuacauauaggucuucaaugcauauucauuaaucacuguggcuauuucugccaauauuuuugagguuuuuauccuauaguucuguaauaaucuugaaauuggaaauguugagagaaauguagaaguucuauuauuguucaggauuauuuuagcuauuguacauuuuuuguuuauauauauuaaagugcaguuucccauuuaauauccaugaagacguguguuggaauuuggaugagaaaugccuugaaucuaaagauugcuuuuaguaggguggcuuuuuaguauuuuaauccucuugcuccaugagcauggggcaucuuucuauuucuuaauauugucuucaauuucuucaaagaauugaaguuuuuauuaugcaagucuuucacuugcucucagaaauauuuaucuugguauuuuucucuuuccuuuguguuuaucuuuguguuaccugcuuuguguguucagguaacaccagcuuuguucgaugacuuucuaauauuccucuucuuuguguuuauggcaauauucuacuuuuguguuagguauaagcuuugucuacggaaaggagaauucugugcuauucuguccagucgucagaccccauuagaggaaccccuuccugguucagucugugcgcuugcuugaugcggguuccaguuuuauaauguaggagguugacuuauucacuuauuucuaggaacucuucaauucugauucacuuguguaagaccuuccucagcccugcauauaguaacacugaugucauugucauacauuucaguguaccauuuuauuaaauuuuauuuauuuauuuuuuacuuuccauauuccaucccccacccuuucccccauccacccucugucugcuccacaucccacaccuccuccccaccacaccccaucucccuguggaugcccccaccccaaaccccuccugaccucuaaacucccugggccuccagucucuugaggguuuggugcaucaucucugaaugaacagagacccagaaguccucuacuguguguguguguugggggccuuauaucagcugguguauggugucuauuugaugguccagugugugagagaucucagagguccagauuaacugagaaugcugguccuucuacaggaucgcucuucuccucagcuucuuuuugccuucucuaauucaacaacaggggucagcugcuucuguccauugguugggugcaaauaucugcauuugauucuuucagcugcuuguuggggucuuucggaggacagucaugauaggucccuuuuugugagcauucugaagccucaguaauagugucaggcuuugggacuucuccaugagcuggaucccacuuugggccugucgcuggaccuucuuuccucaggcuccucucccuuuccauuucuguaauucuuucagacaggaacaguuaugggucagaguugugacuguggguuggccacuccaucccucccuugauguccuguuuuccugcugggcaugugcucuaguucccucucccuguuggguguuucaucuaagguccaucccuuugaguccugggagucucucaccucccaggucucugaugcauucugggguauccccccaaccuuguauuuccugagguugccugcuuaaauucuuuuugcugguccucaggccuuuucucucauccaauaucagaucagguuucccucucccucacacuccccuucccacacuguccaccuucucucccagguccccuucuuagcacuaauucuaguacagagagucacucuuuuccuuccuuccuucauugcuuucuuucuuucuuucuuucuuucuuucuuucuuucuuucuuucuuucuuucuuucuuuggguuuuugggguuuuuuuuguuuguuuguuuguuuuguuuuuuucaagacaggguuucucuguguagcccuggcugucuuggaccucacucuuuagaccaagcuggccuggaacucagaaaucugccugcuucugccuuucaagugcugggauuaaaggcaugugcggccacugccuggaacucuuuuaguuuugaguaggugagcauugcuuugccaguaccuaaucucugcagagagacaugucuguuauauugaacuauacgguuuuauaaucuuugaaucaauuucauuaauuucuauauaacccccaaaauaccucuuuaaauucuacuuguauuuuuacauuuuaaaaaagguuuauuuauuuucuguauaugauuacucucucugaguguacaccuucacaugugccugccagaagagggcaucagaucacauugugcaugguugugaucuaccaaguagauacagcagugaugugagcacacuagauacagugcugagagcaguggagacagcucaggugaaguagcaccccuccaauggucuaugugucaucuccugauuccaagauccuugcagaucauuuuuaguauuaauaaaguacagcacaguuggagaaucauuuauagaauccucuuugucuacuggcacuguaacauguuagaaaaccagauggagaauguuuuucucauauguugaucuaauugauuagccaaaccuguucucacugugaagcagaacaaagacuccuauaagguauagagaaagacuguagcaaagggaucauggauauuuuggagguauugggguagaaucaguggggagcucaagugacaguggaaaugggaugggaggagcacugcagagaugucucaguagugaccagcauuuccucaucuuauacagccauggguauaguucucagcauccccaugauguccagaaacauuuuaugcauuccguuccaagagaucuggugccuucauugaaccucaccagccaccauguacaaacacagagcucauacauacauggugcaaaacacuccuacucauaagcuagaauagaaacauuauaaacauuuuuuagagcagugagaucacccauucuguuuauauagaaaugguuuuggaauauucuacugugaaucaucucaugauuagccuauuacacacauuacugacuuucuguguaauaauuaauacuaacagaaaguauacuuuauuugacugcauguguaugaugauauccuuauuccauuuguaucacuuuuuugguguacauaucaauaauaucuaaauuuaauuaccuucauuuaagcauuauuuccucaaguuuucuuuccugaucuuuuaacuuugaaggguucaguagcuccuuuauaaucauuuccuuuuguggucaguuucccuuuuacugauacaaugcuagcaggaccuugauaaggauuguuuaguauaucuacagagugggaaacugugugucuuaucuuaccauugauuucuccuguuguuucuuaaugguuucaacugaaauaauuuugauuuugaaaucuugguuuaauauuuugaaggucuagaauggucugugcuuucucaaaauucuaccuguagucggauuuaccuuguucauaaacacauugcuuugaaucuucacaaaucagaaacuuucuuguugcguguuccuguguuugaaagagaacugcuacccuuuugucaugucaugucuguaauuuguuuugauaugcuguuacuguuaaguauaugcugaucacugaguauuuaucaguucaggaauguacaggaagaaguuauuucauacaaaaccgccugugauaguugaaacuuaugugaauucuuugcuguuuccuuauugaagaaucuguacacugacuugcuaggugaaugcaggaaguuugaucccuacugacucuauguuccucagcuuuuucuguuucuuuuccugaaagauaaauuacuagagaaccuugagugcagacauugacuaucagaaaugagauucuucaugcacauuaauugagaauguuguuuauuauuaaagauguguaacguggagauuccacacagaagauugguuucagaaugaaucacaaaauaugagccaacuaugaugaguagugcucacauacgagcuauaacauguucuugacugucagauaucguucaucagcaucugucauuucauuauguuucuuguaaaagaaaaacguagguugauauugagcaaauguggagacaaaugcauuaaacaggagaaagaauuucccaucugugauuugaagggugaauguucagacuuuaacucuaaugugugugugugggugcagcaggugcauagacagcaucaggaaaccugauaucaaugggguaccugugagauccuggaacucuggacccucucccaauucgguuaacaguuuuugaacagauaauacagaaggaaacugcagaaaugaagucaauuguacuccuuucuucuauuuuuuuuuaauuuaacuaaguauauguauuuuaaaaaauuuauaugucugaccaugguugaacauuucauuacuggauccuuuuagcuuguaaaugguaucacagcugaaggauagacuccuucccuuuuuuaaaacaaauucaaaggaaaaaaaaaaaccccacaugaucaucucauuagaugcugaaaaaagcauuuaacaaaaugcaauaccccauucauguuaaaaguuuuggaaagcucaguaauucaaggcccauuccuaaaaauaauaaaagcaauauacagcaaaguaauagccaacaucagacuaaauggagagaaacuugaaggugccaaacuugauuuuuuuucccauuuuuuauuagguauuuaucucauuuacauuuccaaugcuauaccaaaagucccccauacccacccccccacuccccuacccacccacucccccuuuuugacccuggcauuccccuguacuggggcauauaaaguuugcaaguccaaugggcuucucuuugcagugauggccgacuaggccaucuuuugauacauaugcagcuagagacaagagcuccgggguacugcuuaguucauauuguuguuccaccuauaggguugcaguucccuuuaguuccuuggguacuuucucuaguuccuccauugggggcccugugguccauucaauagcugacugugagcauccacuucuguguuugcuaggcccuggcauagucucacaagagacagcuauaucuggguacuuucagcaaauucuugcuaguguaugcaauggugucagcguuuggaagcugaucaugggauggaucucuggauauggcaaucacuagaugguccauccuuuugucacacuuccaaauuuugucucuguaacuccuuccauggguguuuuguuuccuauucuaagaaggagcugccaaacuuuuuaaugugucucugucacaucacuucugugugauugucuuuccugagcuggcacucacccuggcacuguaagaaauuguccuuggugcuccaugaauucuaucucacuguucuuugauuuaagucucuacagcagguaauuaaggaauaauuaagagcaggugacguggcuuggcuguuaagagugcuuguucuuccaguuuccagguucuguucccuguguuugccuggaaacuuuauaucuauucagaauucagacuccaucucucuucugccgccuggaggcugugugcaugaacugcacagagcaacgaggaggcaaaaauacucaacuuaaaauaauaaaccuuauuuaagaaaagaaacagcaagcaaucuggagguauugaacacugucaagauaacaguaaagaaaggaacauagaguugucacuccucuugugggacugaauauggagccuggauacggaacaggauugcugucagacccccucaugucagcauuggaauuguuaagaauggucccucugugugauaaauaaaguuguuuuuguaccuggacuccagagaggggaauaucucaugucgauuguaauguggcaaagcuuuaucauaugaaugauauagauagguacguagcaguaaguuuuauuaggauccauccuauuuucaggguaauuuaucaaaccagaaagucuucucuuacuuaaaaguugucuugggacuguuauacuggugagccuacuuuacuggacauguuuguuuugcagcacuaacuagcauucagcaucugaggacaguaccugaugauuuguuugcccaguagcuuacagagcccuguuagcaauuugaauucuacaccagaguguccauaacuuucuuagacaaugaaugcaggaaaaugcaucugcauuaguagaauauguugaauuaaggguucuguuuuaauucuguccuacccagcaacgucuuccauguuguucauaugcaaagugcauugaaaccaaacacauugagugaaauucucacugucacucucauucacgugugugugggaccuagguagcuccauuguucugaacagaggaggaugugggcaugugucucauagguuugugaaaagucccaacagucccacauagugccccugggcaagacccucucuuaaucaucuuucccaucccuuguuacucacauuuugauccuauucaucccacucauguuucauguauguuuugaagcaguuuuguauugguaucaaggcugucauguguccauaauuccaacugugcugguauaugacaauauggauuuccauaacccuuccuccagcuuuuaccaccuuugcccucccuucaccucauuuauuauacucaguagucucucaaaugacaauuuuuuuguugcaaacuaugacuguaugauuuauuaggcuuucaagcagcaccaggcuaugguauaaguagaaucauuucaaggaaauuccaguauuccuauauagcaguacaucaggcauagguucugucuugggccugugaucuuuccagucauugccuuuuggcuggcuucuaguaccagcuauauauuuccuuuguggcugaccucagaccaaaccagaaagucuucucuuaacguaaaaguugucuugggacuauuaugcuguugagcauacuuugcuggacauguuuguuuugcagcacuagcuagcauucagcaucugaggacaguagcugaugaguucuuugcccaguagcuuacaaggcccuguuggcaauuuggauucuacaccaguguauccaugacauuuuuaaacaaugaguggucugcugauuucucagcauauucuccagcaauguauaaaaccaagugauauuuucuuguaguuuuauauagcuuauuaagaguauuaucagaauggagcuuucuuaugaaauguuuauaguuuuugaauugaauaaucaugauucccaaauuauguaauuugggaaaaacugcauccuuguuuucuuuuuugguucauggaaaauguucuaaguguuaacuugcuguuuguuagcacugauacacuguuaugaguuagugugaagccauugcacguccuuuucuuucuucugaauacaguggaaugauggaggcuguguucaaauuauguaacgaugaguuagauuguugacuauaucuugauuauccugagguauauuccuucuguucucauauucuucagugcuuucauagugaacccgugugacauuuugccccagacguuuuauggauauguugacaggguggugugucuucccucacugguuuacauauuuugugcuuugaauuguuuguguuguggaucuugaaacagucuuacauuguugguaugaaaucaacucguucccuuucuguauccauuauagagaaucuguuuguuaauguaaauccuugcaacuacucuauaauuuuuuuuccuuuguaauuuuuuuguucaucuguuuuuuuaagucaagguaaagucagcuuugugugaugacugucuaacacccucauucuuucauuauucugcauauucuggaauauccgcuguuuaagauuauuacaggguuucuaaaagaauuggagauuucauugcugagucuguguaguccgcagacauuguuaguggagauacugugucaggacuugcucauugccugaccuaguuuuaugacauaaacgguugauagucacuuguuucuagaaaaaucaaucuuucccccuuugauucucauuaguuuuguaugacuuuccacagcauuccauccaucuguuucccauugucacacuaaacuacuugggcaguggcauagaaagagaccauccaagucgcuguuaaaugucuggagaaguauuugauaugagagaaauguagggucaauauaauacauaaaaaguuacauauaugcuaauaucaacaaaauuuuguguaguaauacuaugucaacauucagaaugaguucuuauuuuuagacauauauaauuuguauuccugugugugaauguacauauguauaaguauauauaagaggagacccaugucacacguuuuuacuuucauguggaauuacaaggguuaucauaauaggggaaauccguagcagccaggaacuguuucaauuuacaacugcacuaucauaauggguauuauagcucugaaaauuauguuuucucguggaaccaugaagauuaaauaagauauggaauaaaauauacucagacaaaagaugauauagaaugaguccuuuauaaaucugcguguacuguggaaaugauucacuuuaucuucaugcauauccucuuaugaguagcagcccucagagaguuucugucauacuugcaucuugaugauucugccuuggcauugccuagaacaguucucaaccugagggucaugaugccuuggggcauagacucuuucacaggagucaccuaaugcuaucguaaaugauauauuucugauugucuuagggacugauacacccguauuauaucaaucuacagauaggccuacuacauguucauacauuaauucaugaguuccuuguacuguauuaaaagguuucagcuuuagaaaggccuagaaacaugucuuagaacauuuagcacauggacauuccaauuaaagacaugugugcccugcuuuguaauauccuucuuauaaaugcuuuuacaugcauuuuaguggucaauauuuccccacaaaggugugcaugcaauuuagaaaagaauuccacauugaaaggaagaguuauuggaaagauacauuuuaccucaggaacaauauaaaaccuucauagaugaugauggaaguggcuguaacucgacccgaugaugauuuaucaguuuggaaaaaaaacacaaaacaugauauuugauggauugaaucugugucuguacaucaggacaguaggacacacauggaaaauagauguacuguaucugcaagguagaaugacaugaaaugugaccaaauggucagauauuguguccuagugugaugacucuauuuaaugcucggcauucauuuaguccccacuggucuuuagccuauggcucuaguccuugaaaaguuuccagcaauaacucugaguaguaguguuuuacagcagguguguaugugcucuguuugugccugcugccugccgagguuagaaaaaggccucagauuguagucauuuuacuugucacauuaaauauaucauccauguucuccuuucuguaggaauguugacaaguuuucugguaucauuuucauuuuuauguuuuuuuuauaugguuuagcauuguucauaaaggagguguauuuauuuucacuuuuaauuuuucaggugagaguaacaagaagaaugaaugcuucucuccuaaaugcuccucaggucagugucuagucuaccuuucuuagaaauuccucuuauuauuuaagccauuugaaacuuuaguucucuaccucugguaauguuaccaaaaguguuuugcuucuuuaauuuaucuuguucuucgccaauggucaaaauuaagccuuuagaucuuucacuucaaaugggacaagcacagccuugugcuguucuauuuucacuggauuuuauacuaugagaacauacauuuccaaggagugaagaacugcaguucugguagagaaaauauuguagaugaugcucaaauaauauuuuaaugacuaauuuuuacauuggugcccuuuuauauuccuggggaagggaggucucaggugcuacauaaguugcauuuuaggaauaguaagguuucuagaaacaucuuucugaauguagcuuuucaaauacauggucacugacaucacggagcaauauauggaugaguagaguuuauggggaaguagaauuagaauauauucacugucuuaaauccuaauaguaaauauuucaacuccauagaggaacagaugauggaaggaauauguagcuuucucugaccguaacauugauguguuugugaggacaugcagauugcaguauucuggcaucucuuuuuggccuuuuguguuacacagugaacaugaguguguugacaaaugaaauuuguuugucucuaaguggcugcgcaguguucaguguggucaguucucaauauacagaugauuauuuucuuuuacuccuuuguuucauuuuuuagaaguaguguaagcacuacucuguguaccuuuuuauuuauggaauauauuaguaggguuuuucugaggaguauuaccuuauuacuuccuauaagccauguaauuucagucaugaaugaauguuccucuucauuuguucucuuuuuuucuuuaaugggaagaauucuccguccaccauauggauauguuuucccucucuuccaagcuauguauugcauagagaaaaacucugaggaguuguggcacugcuucuuuacaaaaacauuuuauuuaacuguuuaaguauauaagcggucgucuguauguuuuuauguauagugagugacaugcaugugaaucccugaauucagaaucagucuccugagacugaagacagccaugcuaguucucagcaauguguguagaaagaaaggaaaagaaaguuaaaacuagaugauguaaguuuucauuuaagucaaucucacaagcaauaauguauuuaaaagaauguaauucaauuucaaaacacaauuucaacaaagaaaauuauucuacuucaucugagagcaucaucacauauaccauuuauauauauauauauacaugucuaauuauucuguaguaaaagaccauauggacuguaucaaauuguuauuaucuguauuacauaugucaacuuugagaaaguuuuagauaauuuuaaugcuguccaaaucucuauuucuuuuauaucuuuuauuguggcgaauauagccucauaaaauaccuuuacaaaguacuugaaucuguguguccuuuggaauguugaauguguucacugauauuacacucuucuguuuaaagaaaaaacugugguuuauaauuuaucugacaauucugcauucacauucuaccucuuuguucuagaaagaguacagcauugcacauaggcugcaggaugucgacuaagcauuuuagaauagagucaggugagaccccgcugaagauaagauuaauauaguguucauaguugagcaaggcugacagcuguagaauuuagaagcacaguuuuacuccuuguaacuugaccaucugugaugugacacugggauucuguuugauagaaacccguacuucauaaugguacauucuuccauguggaccucacauguguauguuauauuaccuaaaagcuugcuguuuaugacuccauuauguaauccuguuccagagaaaaguagaguacaauaaagacuaugacucuuuuaaguaacauccuuuuuaaaaauuaaauuucaguuuucuuuuauguauguugguacauuugccugauguaugcauauguugcuauauuuuacuacguccgguugaguucagaagacaguauugguuuuugaaggauuagaaauaaaaguuugcuguauaguucauguguaugcuuggaagcaauuuagaauuauagaaucccaacuggacacaaauuuccaaaugaagugauaguggcaucuucaucuguugcuaaguucuuagaaaacacaagaaaauucaugaaggagagagaccuuaggaauggacucaguauaguaugucauccuaugcaucgucuuauaagagcaacaaugcuuaacuucugauacauuuauauagcacuucuagaagauguuguuuguccucaaauauuuccuaugacucauuuuuaucauaaugugccucuuauucuuuuggucguuuugauccaggaaaacacuuuuguccagcagcauaugaugaacagguaauuuucuauuacagagucagauaacauucaaggacguggcuaugcacuucucacaggaggaaugggaaugucuugacugugcucagagggcauuguacauggaugugauguuggagaauuacaauaaucuguuuuuuguggguaagaauacucuucuuguagaauuccugacucauucuuugaauuuaccuacuauuugcuuauauaaacccucugacauaucuaaagacucccagaauaaaggaaaucgugguuaccaacauaaguucuuuacuguguuuccuuuacaauucucuucauucuuuguaagaguauccaguauuguauucuauguaaucucucaaaacauguuauguacuuuuaaucaaaacuucaaaauuaaaaaaccacugaauagucagagcaagaaaauauauugcuacaacuguaguaauuuuacuguugcauuaaagucuucaauuguuuaugaauuuuaaauaucgggaagguucugaauagagaaagaacuacuucuugugugaauuuggguguuacuuauuuauuucguuuuuuuaccugugguuucuauguuuaguccugguacagcauggcuuuuauaucaugaguuccaugccaaugaauucauagcuggcccaagcuagacuuuguuacucugucacgaaacauuaacaaaaaauagagaaacuuuuuuuacauggucauucagggagauccauucucaaaguccuuuacuucuacaucaucuauucuuuuuacuuucugccaagcacagugguaaauaaaaaauagaggcuauuguuuccugucauuuguuaugcaugaauuuugagauuguucuaagcauccauguaaugauugugaaacaagaaagaucacuuuugagaguuccauccuugagaaucacuaauuuacauuagacaauuucaggaaacaugggauauugucuuauucauccacuaaucccugucaucucuaaaugcauuccuuuuuuucagagaaucauugcauguguccuaaauuugagaacauguuggaucaagaccuacagcauauuauccacaagcaugcaaauauccaagugaaaucuuaugaaugucaugagcuuggcaaagucauccaugaguucaccggaaguauaccuuauaaaacuaaccucaggucuacaucuguugaaucaucaaaccuaagcagacaugaaacuaaaaacaacagagaaccuugcaaauauaaaaaccauguaaacuguuucaauuugugcucuaccauuagucgaaaucaaggaaucaagauaggaaggaaagaauacaauagugcaaaacuugauaauguuuuugacucuaaagaaacccucauguugaaacaaaccaaaaguggaaagacaccuuacaaauguagugaaugugccaaauguuuugccaagaaaugcugguuuagaaaacaucagauaacucauacaggagagaaacccuacaaauguagugaaugugauaaauccuuuacccagaaaggcagucuuaguauucaucagaugcgucauucaggcaaagaaccuuacaaauguagugaauguaccaaauguuuugcccagaaaugcugguuuagaaaacaucagagaauucauacaggagagaaaccuuacaaauguagugaauguggcaaauccuuuacccaaaaaagcagucuuaguauucaucagauguaucauacaggcaagaaaccuuacaaauguagugaaugugagaaauguuucauucaaguuggugaucuuagaagacaugagagaauucauacaggagagaaaccuuacaaauguaaugaaugugacaaaugcuuuagguauaaaagcagccuuagaagucaucagagaguucauaaaggggagaagccuuacaaauguagugaaugugacaaauacuuuucccacaaaggcagucuuaguauucaucagagaauucauacaggagagaaaccuuacaaaugcaaugaaugugacaauuucuuuacccgaaaagacagucuuaauguccaccagagaguucauacaggagagaaaccuuauaaauguagugaaugugacaaaugcuuuuccuauaaaggcgaucuuagaaaacaucagagaauucauacaggagaaagaaccuuacaaaugugaaugugacguguguuuuacccuaaaauucaaucgccaucuucauuugagaauucauacaagagagaagccuuacaaauauaaugaaugugacaaaugcuucagccaaaaacaaucucagcucuuaucagagaaugccuacaguagacacuuucacaaaugaagugaaugagaaaaacccguuuccaaggaagaucaucuuagaauucaucagagacuauauauaggagaaggaaauuauaaauguacuaaauguucaaauccuucaguguugguucaccauuuaaaauacaucaaagaaugcauucaggauuaaaaaaaaacuuaugaauuugauauaugaggaaaggucuuuacccaaaucucagaccuaagaaaauaccugguuauuuauauucagaaaaaaguguccacuggaaaacuauggcaugugcuuuauuccagcaguauuguuggcaacacuugaagcuccacgcuagagaauauuauauauucgaggaaguuggaaaaacauugaaauaauccucaaaucuuaggagcgacccaggguuuaugcucagagaaacugaaaaugcagcaaugaaggaaaucuuucauuaaaaguuuuuacuuguucacuuuuaaauaugucaugauggagaagcuaaaagaauauggaguuguauaauuuuuccuggagacugaaaugaucuauuucaaagagaagcugugaaauacaugccucaaaacagcuaaugaaacugacagcauucuguauuuuuaacucaaaugaacauacuccaauuauacuucuuaaaagaagauuugacaaacugagccacauauauaagaugcugcuuauccuguucagaugccuacagauaaucgguuugcuuccaauguccacuacuuauuaucuguuucuuaugcugguuuuaaguuucaggauagcaauugucuuucagucccuugugcucucauuuacuaacugcuuccccuaagugcuguauguaacuacaauaaaucucacugguuuaacaaguug

SEQ ID NO: 8417 - RNA, 1960 nt, Mus musculus
ugggcuccagacaucugggcaccuucccugccagaggagagguguccacuucacccaggagggcuuugucagaucaccuggggaagccaucuggguucccagaucccucagagacuagucugcgcaugugagaguguggacuacagaagcuacacagcuuuugggacaggcccuguuucaggccuucaucuucugccaggaggcagguucgaacaccagauaucuguacaucuucccugcaagaggagagcuuaccugcagagaguacucugaccacugaaacucaggagagagcuagucucccaggucuacugauauaguuagcuaccauuaugagugagaaaagguucaucuggaaggguccagacugaacuuauccauaagaggagcagaauggguccugguauugaggaagaggagagaaaauaaaggaguuggccuagaaagugaacaggacccaaaagagcaccuagccaaaaauguccacauugauauauuaauaggcaccucaauucuuccauaguuccuuugagaacuuacaaguuccagccaguacuuucuguaugcugugagaggcaaauauaaggguacacugguuuuuuguuuuuguuuugauagaaaacucauuauagauuaauacaaguuuagaaagcaccuuuugaauaauuaugauuauucauuuucaucagaaaaauaucuucucgguucaagaaagacauuggacccaugcaucuguagaaaacuguuauuuuuuauuucauuguuuguugauauuugaguucuaugacuauggacaucuugcaguaggaaugccuagauccgguucucagggcuuuuuuuuuuuuggagaacuccugguggagauauacagcagucucaauucugugggucaggauaguuugugguuguuguuguuauuguuguuguuuucugucuuccuugacccuccucagauuuccugugaaaacaacuuuucaugugucuuagcugugugugaaugagucucacaucucgcaaagcaaugugaaauucuuagaggaaaagagacauucuuauuugugguauuuucuuuccuucauguuauuccuuuggaaaggucauuuauuuuugguucaugaaaaguucuaaggaagacucuuuccauauuauggugaaaugauguuggauuuugucaaaagcuuuuucugcauguaaugcaaugauuaugucuuuuuuccaguuuguuucauuaaguggauuauauuuauugauuuuuguauaaugaacuaucuuuucaacucugauacaaaaccugcuuuaucaugguuguugaucuuccucguguguuucuguuugcaaguguuuuaugaguauccgugccuguauguucauagagaaaguucuguaauucuccuuuuuaguugcaucuuaauuugcauugagugucaggguaacuguggccucacaaaauaaauugggugaugucauucuguuucuuguggaauaauuugagaacucuuaauuuaucuguucuuuaaaagucauagaauucugagcaggccaugugcuuuuuuguuguuauuguuuuuuguuuguuuuauguuuuaguuugguuugguuuauuugcuaguuuuguuguuguuguugggaguguuuuaaugagugcuuuuauuuaacuaggaguuaaauaaggcuauuuuuuaaucugauguugauuucccuuuggaguuugguaccuauugauaaaauuauccauuucauuuauuuuucuucaguuugguggaguagacggcuuuaauuuguguuaugagucucuggauuuccucugggcuugucauuauguccccauuuuguuucugacuuuguucauuuggauauuuucucuuggucuuauaguuauuuuggauaaggguuuguaugucuaguugauuuuaucaaagaaccaacucuuuguuucuuugauuccuuguaucguuaucua

SEQ ID NO: 8418 - RNA, 20869 nt, Mus musculus
gaugaauccagcacugaguaggcuggaugcaauaaguacccccaccguugcucagacagguaagcuauuuugacucauggggucccacucaaagaaaagauaugaaaggaguagaccugauacauucauuuuuacaacugccuuuugcauuaucucuguagaaacucuuaauugagucaggauagcuuccagcaucacugggucacaccucugccucuuuacaccagguuccaugaugcuacuccauagaauuaacacccaaaacaauuuccuuuccaauaacagacagaacacccuuuuaccugauuaguguauuugucucuaugugugcucaauaauccuccaaauuucuuuuuacaagaaacauaaugaaaugagagaugcucaagaacuauacuggauacuccaggaccuguaacuucuggucagggagcaucacucaucauaguucacacacaucuuauauuuccuacugauugacucugaaaacaaucugucuggacucuuucugucacauauuguuauccaagaagaaaacucucaauuaaugugcaugaagaaucuuacuucucccuagucaguguccacacucaaggcccucuagugacgaauguuuuagaaaaagcagcagaaagacguaaugucuuugggaauccaucuuaccacagucaucauacaagugaauauucaguuucccuacaacuaaacaagcuaaaauucacuaaaaguucagguacaucacccaugugguucuguacaaaauggcuaauuauaguccauuuuuuucaacauugaacuaacaaccguaaucaacaugcauacaaaccagaacagcaaauagaaucauaaaguguaugcaugacaugugauuauacagcuagcuguucucauuacaauaugguaacacaauugagguugcuguuuccuaaagauucugaacaauauguuuaugaacaaaguaauccuaaguauauauggcauucuaagaaagaacagauaguuugaaacccuugaaaagauucagccaggauuucaaaaucaacuaaaguuuugcuguagauagacuaguauugguggcccacuuugucacuguuggccccaauguucccagguuaguugguucuauaugcuuucuugugguauccuugaccucucuggcuccuuugauucuuccccuuuuccauggaauuccccaaguucuacguaguguuuggcucuaggucucauccuuugcugccaucaguugcuggguaaagccucucagaugacaguuauguaaggcucaugucugcaagaauagcagaaaaauccuuaacagugucggggauaaauucacauggcauaggucucaaacugggccaguacuuguuuaaccuuucccucaauuucugaguugaugugggagaaaccugucuugguggauaagagauacucucaggaggacuaggagagugacugggaaaguaaaaagugguggacacuccaaaacuaauuaaggaagagaaagggcuagguuugaaaggguuuaugggaaccacgugaccagaaacacaugugcagugagugggucuauaggaaaauucaccuuucccuuccuuuccuggcggcauaucugggcuuaguucuucugggaaaccuagaaauucucagacugcuuccuggcugcaguucugggaaagugauucaccaacauagauggaagaaccgcagccugguggcccuggaaucucucaggucugaagaacuugggggcugggaaaugagcuugaucugggguguguuuuccacauggugaggauacucccaagaucuggagagugacagaguguggaaccaugaaaagcagucuguuuugguugagcaaggcuugcucuguauacccaguagaaaacucuacuagggauagaagagugagccauguucccagagacaguugccuuacaccacagagcccccaacuccauaauucagugacugucagucacgcagacaaagccccaagcuccuggcauucuagaugcuccuccccaaagccacacugcaagauagcccagcccacucuaaaaggggcugcuuggccccuccucucucucuuaaggucucuucuuucuuucuuucuuucuuucuuucuuucuuucuuucuuucuuucuuucuuucuuucuuucuuucuuucuuucuuccuuccuuccuuccuuccuuccuuccuuccuuccuuccuuccucccucccucccucccucccucccucccucccucccucccucccucccuccuuucuuucuuucuuucuuucuuucuuucuuucuuucuuucuuucuuucuugacaucucuagccuuucuucucucucucccuuccccccucuguccacauggcuauggcugggcucucucuuucuuuuaucuucucucuuucucucugccuuucuacaauaaagcucuagaaucauagaccaucucugcucauaaaggcuugaacuacuuggaugaugggauaggcuuucccuuaaaggccucccugcgcuccacccauggacuggucagaagacucuugccaguguggcaaccaccuagcgcacccucucuccuuguccucuccucucuucggccccaaggcuagcugagccacucaccggguccccacuuuguucucagcucuucuguaguguccaauggugucugggaugcccaagacugagaaccuguuaacucuugccuccaugaggcccagagaccucagacugccccuugcccacccccugcagccuggggucuguagcuucccacagccagacacccaccagggccucugcaucugccugcccagagcaccaaaacucuggcgggaugccaguuuucucccacucucuuuauucccccacaccugcugcccuacaauagagaaaagaaaaaagcuugauggacucuacagagaaauuaaggaauggaaaguuccuguuuugaaaguguuuagagaaaccacaugaccagaacugggcuagguguagugggagggucuaggagagcuguucuaaugauccaggccagacagaaauauccaccauucccuuuuguaccagagcagccaugugaucccuggcagguguugguuacccuggcauuguucuuuauaaaacacugauaauucuccucagaagaacuuuccagccugguauccugagaaaaucagcagucagcagugcaguggcuggaaccacaaccuagcagcccuacaacuuccaaggucagagaugcuucagggcugguauaaucauggucaaugauucauugaagaaugacaccccaaacucaaauauuauguaaaugcaaagaguguuuuguucugcagaauuuuauaacaucccacuugggggggggguccaccuggaaggaugccaaaggaaaugauauguuggaaccaguauguuggauggcaagcuuggggucaggugaaugaaggagagcaagaaaaauaaaggcucccccuguggcuggaagaugucuuccaaauaaggguacaggacaguuugacauaacuagaaaugagugacugagagaaacaccccugaauauguaacugaguagugcagucugguaaugcugggccccucuccugacaauaaauaaacaaguaaaggugcagacuuuuauaaaaucccacuugggggguuccaccuugguaggaugucaaagaaauguuauguuggaaccaguauguugggugaccagaaggaggaaagggcuagcaaguuuggggucaggugaaugaaggaaagcaagagaaauagaggcucccucuguggcugaaaacccagcacucaggaggcagaggcaggcggauuucugaguucgaggccagccuggucuacagagugaguuccaggauggccagggcuauucagagaaacccugucuugaaaacaacaacaacaaaaaacaaacaaacaaacaaacaaacaaaaucucuuuaaggauacaggacagguugacacaccagaaaagaaugacugagagaagcaccucugaauauguaacugaguaguggggucugguaaugcuaugccccucucccgacaauagguaaacaaguaaaggugcaucugcucuuuuuuuucccuugaucuguguuuucuuuuuguaguccugucugucuuugaacuguagaauuuccaaucucugauuggaagggugaguauaugggguguuaauacuacggagcaggagcaggaaaccugcuaaagaaggcagaaauguaacucuaugauacuggaccugauauuaacucaauuaaaaagguauauagacauaaugcagcauacaauugcagacaugaaauguauccagucuucuuuaauaucuuuucuuugagugagauccucugcaucaaucuaaaguuaccuaucugaaugugggugggagguuacuuauugaauucugggcaacuccuuauugguucuaucacuggaaaaauguuaccuuccacauuuugcucugaacugucaguagacauuuagggaagguccaaaacucagaggccccuuuucucacucagacuugauaaacuguuguucuucccauguggggcauugggcuauacacggacagucugguguccaguugagcugaggucugaaccccagaguggugauaauucaccuacauggcacuguaggcauucccuugugucuccuggaacucuggcuccaguugaaauuagugccccuacagcccccacaggagaaguauggcuuuuagucacguaggcaaugucccaagcuucugaccuucaggcuaaacucauccuaguuaccuagcaacaguaaagauaacagcccaccauaagaggggcuccuuggccccaccuagcucucuuacuccccuuacucuucuuacucuccucacuccacuucucuccucucacucucuuacucucucucccucuugcucucucucuuuuacuccagccuuucuucucucucuccuuuucugacuucucuccucuuggccauggccggccuaucucucucucucuuucucuaccuucucuccuuccucccugccuuucuacaauaaagcucuaaaaccauagacugucucuguuuaucaaggcccgcugcgcuuggaugaugggauaggcuuucuccuaaugagccauaucuaaucucccgauagaaggcuuuccugugauccagucaaggccuggacuaaggacucuugcaugcaugagaaccucucucccucugcccucucuccuauaacccuggggcccgaggguguugccccagggccccugguuugaggggcugccccuuguucaucccccgucgaguggggucaguggcuuagauguccaccugguuuccagucgaggcuagaucuugaaccccgggagaaccugacuggugguaauucucaccuacaugggacggcaggcuuucgaucaugucuccuggacaucaggcuccugugcauagccuguugccccacagucccaaucucaucaggaauuaguugugcagaugaacacaaaugcauauucagcccaaaaguauguucacugcauucuucuccauucucuggcucuggccuuucuauuuuuccgugaaacaucaacaagaaaaggagcuuuaauucaggcaauaacuaauccugacaucaggagucuguacagauguuuggaguucccuggugguuagugaauacucaccaauaaccuaaauuaccuuugcuucaucaucauugauauaccaaugccacaguugaggcacauuaacauuuaauccuuuguaaacuauaaaacaagacucuauuauaggcuguaauugcuauuuuugguugucaagaugaguacuacuggaauuaacucuaaccuaaaugacugcacacuuaugugaggaauuuuucuugauucaacuaugcauagaauauuaauucaguucuuuugaugugggaauauccacuucuuccuauuugucuuucuguggcugaaaaguuuguucauucacuggcauuagagccagguucuuugggauuguaauacauacuacagcuauuggaacauccagccucacagacugaacaauuacagcauucucugacuuugcauugguagacauagaucuuuuacacugguuagucagaauauuguaagacacuguaauaacugcucuucuugugugugugcauuuauguacugaaaucuaaaccagauucaugcauuccuuuuguuuucuucauuuaacgacacuggguugacuaaugucugaaaauuuucuuguuauuuucauaugacccaaaauaaacugcuauguucuuuccuaugcaguuguaauuagacuagguauaccuauacaauacaggagaaacuucuaauuuccacuucugucaucuauucauaucuguaaagucacuacuguuuuuaauuuucacuuuacuaaaucuacauucucaucucauacaauaaaauccgaauauauuuuuccaucccacauggaggcugacagacauccauaacuuaauuuccagagagcuguugcuaaccucaauuuacagcaugugcaaauacagaguacuucaaacauguugaaaaacacugguuccuaucaugugaaauucaaacuccaaagaaaaaacuuaauaauaaugaaagugugaaggagacauaagaaugcuuuugccauauucuguuucucuagaaaugauucuccagccaucauucucaaucuuucuaaggcuguaccacuuuaguccugcaaccuuuauuucaguuccagguauguauauguguauaugucugcaugugagcagaccauacuggaaaugaacagaggagcgauguuucaguucuuaacaccacuggaaauguguguuuuccaauggucuuagaaaauccuugugaaagcgucauucagcccacaacucgcuccgaggaucaaaccccacagguugggaacagcuguucuagagucuucuaaaauguauuauuuauuacuguucaugauaauaaugacacucccauucuuuucaucucuuuauuuugucuucacaucaauacaaaugauuuucauuauguuuagccucuuguaaaaucaggaaaauuuguaucucuagguuuauuuucuggaacuucuaccuuugagaguuuuuguaguuucuauagguucuauucuuuaaugaucacauuugcccuuuccuaaaaugauguucucaggacuuagaaucucagaaguguuuuaagucuguuuuuaaugauuucccauugauaucacccguggccuuucuucaagccaauucucuuguuuucauugcuauaauuucaauggauuucaaaaccuugguuuguucuucagaaaaaauuuuuuuuaauucaguaguuccucaaaaucucauacagacucagcauuuuguuauguuaugcagaaaugcuccauuccuggugaaauggcuuguuuagaauuccuaccucagagaaagucuguuuuugcuuguuuugcuuuaucugaaugagaacaugaaagcugucaguguuuagaugucacaugcauuuuucaauaucccauuuacuuuucuguucacaugcauguuggucaaugauuaauucccuuuuuauaagaauguacuauaauuacucauuucauacugaaccacauauguaauauaguugaaucucauauagauuguuacuucugugguuguugaaaauagcugugcacuggucaucaugguggcagaaguaacuuggauuaaacugacauauuuucucuauuuccuaucuuuagucucuaggaauuguuguagagaaccuugaauguggacacugacauagcagagaggggauuucagugcauauuaggugggcauuuuuuucaugcuguacaguaucgagcauuuuuaauauaugcuuauuauccaucggaacugucuucuagcacaagcuuuucaaaucauaugcuucuucauugaacucauuuauuugcaucaugcccccuuuguuuauguuuuacacauucuguauuguaucauuccaugaauagcagcauaguauaucugcucuaugggguuuuuuucauaauuuugauuuuuacucuucuguauguuuuaagcugcucauucuuuuuaucagcuaacucuucuaggaaucaaagauugugaaucauuagauacugggaaagaauuaaguccuguucauauuuuuuuuaucugaauauauacuuuuccugugaccuuugguugacgagauugccuguuagguaacauacuugugguaguuuagugauauucacauggucauuacuaugcuugucuuucuggaucggcagcucuauugccuguauaucuaccaugcugagagguccauguucuggugaucauuugguucuauauauaucucaagucacaguugggauaaucuagucucugcccuauguaacuggggaugcucuguguacuccauguucuuucuuauaaaauuaguuuucuccugaguauuuauagucuguaguguauuguguguuccauagauaaccucccuauuguucugcuaacccaaucuuugggcccacuuguguuguuucuugggguuuaagccagccuauauagauuucuucuucaugcuaauacagggagcacuuaccuauucuccaugugucucuagucaugagucccugaauuaacuguuacacauugcauggaaauguucucugagacaggaugaaagcagcuccagguuauguuuugaacagaacuaaguaaaccaacugugaguauuuguacaaguagcaaaggguugugaguuaauggccuacucugaccuguuuaaccuguuagccaggauuccugugaauuguacauauuuugucugcuguaguuugcugaaauuuuaaacagaaagcauuccauuauauagaaaacugauuuuauacuacuacaguaguuuuggaaacugggaaaguaaacauccagcugugguccaagaaagaacuuuuuugugcaaggcugaaacacaggaucagccaauguauauauaaaaucuguucaguuaaacagaguguuuuauauacuucugucaccacuuccaaaccuuccccacuuucuagcaaucaaaagugacauacauucugacuaucuuaaguucguguaauacauuuuacugaaaaauuucauaugcagaaaguuuuuuuuuucucgugaacaaaauauaccagaggccacuuaugcucuugagaguauuaguuuuagugaagacaaagugggacaccaaccaacuuguuacuguucuuuccugguaccugucacgguccaaugcuacauuaguuuacagauauaccauaccaggcagcaugguaauuugguucuggagguccacauuuggcuaaggucauuggugacuuuucucccuuuguaccuggcacagcauuuuuugcucuagcgaugcuaugaacaaugcauuugugauacuuaaaaauacuauggagaguuuuaguagucuacuguguauucauccucauuuuguugauauguaaaacaccaaguuauuuagaguuuggcauuuauggcuuaugucaaggauuaucagacuugaccuuucuuauggaauuuuuauaauuuuugaaguugagaauuauauuaauuauaauuuggaauaaguugcucucaugaaucuacuuauccuuuugcauuaagacuuuuugcuuugcugcuaaaccuggguaaguaucgguccacuauacgaaguuaucguggacauaguggacacccaugucucuuuccugaggagauuggauuccucccaauuuugcuuauuuuguaaaauguuaagauuuggcauucuaguuucuccuuagguauauauguuccuccuauucugagauuugggaaaacaacaauaacaauagcaaauguugauuuuuuuccauaggccuuucaugguuguaugcauagguaacuguucacuuugcacuaguuucuauucccacaaggaguuaaaauaaggauguacuuugccuuuccugcacuuugcuuuugguuugugauuauuuuuuuauucuuaucagaaacaccagaauuacuuauuuacacaaguauaagaacaaauaacagucauucccagcuuggauccagaauaauguguuuaaaauaauccaccaccaccccauacuuggcuauuuuuguuuuuguuuuguuauuuucuuuucuuuuaugugaauggcucuuuugacuuaauguauuucuauugaaaacaugugucugcuuccugugagaucacauggagcauuagauuaucuuacaguaaaaugaaaaaugguugugagccaggauauugaugcuaguauucaaacccagguacucuagaauaucuguaacugcucuuccccacugcaucaucuuuccagccacuacuuugcuuucuuuauguuagguacucuagucagguagugugagauugaauauauuuugaauucuaguuggugagucccucaaaaccaagaaauauggacauauuuaugaacauuuuggugggcucuugaagacuuuuaagcuauauagucacugggauauuauccuaauuuacauagaaaucugaugaaucaaguuuuugaauccuguguucaucaguauuaagaaggcauuuuucaaucacaaaggauucugcugguguuuucuggacauguauuaaaucacaccaucauugaaagguagaguugaguauuuugcuuuauuaaguaucucugugcuucgccuauuuuuacaccuauuuuguagugaguucauuuauuguuauuguuguuguucuuguuguuguuacauggguaugaauauuuguucuucauggacguuuguguaccacccauguacuauguauauagaugguagaagaggucauggaauaucuuggaaguagaguuauguuuugagcugccgucuguuuguugguauagaaagcccuguaaucuggaagaacagcuuguccuccuaaucauuaauuauuauaccaccgcccuguagcuaaauuaaagcuauauaaaauacaguugagaagaaugugagcuuuuguauugauacagugucaauuaaauaauguacauuuuuucuucuuucugaacuagaaaccaagauugagaaauacacucuuuauuuuggagaccuguguuuaaucuguuaaaacuccuacuagggauuuuguggcacagucuuuuugaauauuggugggugaaaugcuguucuuacugaaguuauauuccuuaggcuuuuuaauccagaagguuuuuagucauuguggcugcugaauuaugguucauauuguucuacuuuucuuauuugggauagugcuuccuucuguuugacuugaugauuccuucccaguucucucauauucauuauugaucacaugaaauauacuacuaccuuuguccucauggauaauucaugucugauuuuuggugcauauuuucaucuguuuagaguguagguagauccuuguaugaaaaacauuucuuauuuuuuuacuacauuccaauacacuuccuaaaaaucaauuuuaccagucaccuuuucugaauguacugugacaguugaaaauuacuuucuuucagggcuuuaaaauguaucacucuauucucugcugacuucaaaauguggggaaauaucuguaacuacuguauuuucuaaaccccugcucauguuaaaaaauagaagacaguuggaagauauauguauguuguuacagcacuuagaugugagaacagcagaaucugucuggcaaauuaucccaggaaauagaagaagagacugccauggucuccuaccaaucaggagucccagugccugagcaauauacauagguauuugaagcagaucuugauaaaguaagugauagugaccuuugaguggaagucucaauagugcagaaagaugucuauucagaaguagcucaguauuuuaggaacugucacuucuggauuuuaauauagaagcccuggacuuaauaguggaugcauguaaaaaaagguuauuguuuacaugccagaauauccuguuguucaacauccaugaaaugagaaauauaccuuuccaguuaaagacagggucaaaauuaagucagggaacacauuuuguuccuacauuuaguaugucugaaauuaaaacacagcaucacuggaguaggaaguauugauggguuugcuacuaaauuugacguuacucagcuuguauguugcaagcaaggaucaugaagacauaugcccuguaaaaugucaugauuauuucccuugaaauuuuauguaaugccaugcuaauaauuucuuaacauccugaugcuuaccacaauucuccucugcauggaauuauauauacuguaaauuugugacagcauuauauuuauuccuggcucucaaaggucuuuuuguauaucuuacaguugugagugaauuuucaaacacauucacuaguaauuuuccugauuuuuuucacucaucaugguuguuagaauccugaugguauaauauuccaauacaguauuugcuuuuuuguuuucuuugcuauaauggccauuacaaagcuccuggaguuuacuuucauccaucuuuguaccucccucguucuaccacuuauaauuugaagaguggacuuuccaccuuuaacucccaagagagcuugcaugguuacccucauuauuuccuauucucucccuccuuuugcaaaauuuuaucccaauccucccuguuauauuuccuguauaucuugaggcagguuuuuuuguggguagacugggugucauuuauucauaauuaaaacugcccuuauauauuccacacaaaacauaucauuccaggcucuccugccugugacaauguugaaaagauuccugaucauuuuaguuuccgggacaauauuuuggcauuguucauggggaguuuuauuaauuuugacucugugaaauuuugucaggaauuccaguguuuguuccuaagacagaaacucagagcagagcaacaagaagaaugacugcuucuuugguaaauacaccccagguuaguugcauguccacaugucuuugaaaauuguaugucuuauugaacccauucaaaacuuuaauuaucuacaucguaauguuaucuaaaguauuuauguucugugauuuaucuucauuuucauuucugauaaucaaaaugauuauagcuuccuuguucuaguauacuuucccucgauauuagagcaugaggacauaaauuuccuuagacugaaggcacgcaacucuggaagggaaucuauuguaguugacacucaaugaauauaauguccgauuuugacaucagacaggcauguguucuuuuauaugagugaagaagaaaggucgugucuaccauuuaaauuauauuucaggagugaucaguuacuuagaaaaaagcuugugaauuugcaucugcauauacauggaauguggcaucacugagcaauauauggaagaauagaauuuucgauagauuaguauuagaauuuugcauccuuguuuuacuuuuuacuuauuuuuuuuuguagaacauuugcaccauuguacuuagaccccaagauaucaacugagaagguuagaacaaacugcugcaaagauugagcuagugucaacaucugagcauuguagaauuuugaagcauaguguugcucaucauuacuugaccaugugugaugugacacuuagauuuuguuaauucaucaaguaauauuccugcaccuaaaccucaaauguguauaauacauucuuuaaaacuuugcugauugugagacuauuuugcuauccuguuucacagagugaaaauucacaaaagacuaugacuagauuaggaagcuucucuuaauagaauuaaauuucaauuuuguuuuauguauuuugguacauuuuccugacucuauccauuugcucuuuguauucuucucgcauguugagauaagaagagagcauuagaucucauagaaccagguuucauauucuguuguauacuuucauuaugguucuggcaaacaaauuacauauuagaggacuuuaaaagacaucauagaaucuaaucuguaaacagaauuuucaaaugcauugauggaggcaaaucuguucuuuguuacucaguuuuagaaaauaucagcaaagucauaaagaacagagaugugacuauguacacuguaguaugucauucuguauauuaucuauagaaaacgcuuaacuucugacacaucuauggcccuacuagaaaacuguuaucuuuaaauauuugccauaacuaaucuaugucacaaauuauaucuuauucuuugggucuucguuaaguaggaaacauuuuuguccgacaucacaugguuaauugguaauuuuuuauuacagggucuguuaacauucagagauguggcuguggaauucucaguggacgaaugggaaugucucaacuguuuucagagggcacuguaugcagaugugaugaaggagaauuacaguaaucuauuguuuuugggugagaauacuuuucuuguggaauuccaaauuaauccuuucaauuuacaucuuuuguagauggaaacuuugaacaucuagagauuuacagaauaaugaauaguaacaaguacuuuauccuguauaguaucucuaacccuuaccuaguuuucagucagaacucuaaaguucucagaauauugcagcuuuauagaaaggaaguauauuguuuuauauaucauaacuggaauuuuaaaauuuugccauugcuuuucaguguucacccauuucugaauuuuaaaaugcaaaauuuuuauauauaacaguauuuguuuuucugagaauuuuguuuuuauguauuuuuggcaugugcucucuuaucuuuacuacuguuacaccauguccguuuuccuagcacuuuggaagcagaaggaaguauauauggugauuuccaugucaaugugaauuacauaauaaauucauaguugaccuuguuaauaugaucauucauauaguuucuaucucaaaauuauuuuucuugaucaccucuuuuuccuaacuucugcaaaggacaguguuuaaaugagaauuagaagguucuuauuuuucagucauuugauauagaucaaauuugaguuucuucugaucauccauuuaaugacuaugaaacauaaaagacauuuuuccuuuagaauugcuaauuuacuuuucuuugugaacuuaaagaaacauccauuauugaaucucuuacuuauguauuaaucucuuucugcccuaacuacacuuuuuuuuucuuuuuuuuuuugaccagagaauuuucuuaaaugugagaagguguuggaucaagguacaaagcacauuguccacaagcaugugauuauccaagaaaagucuuacaaauguaaugagccugucaaagugauucaugaauccucacaaauuacacauuccagaaccaaacauaaacaugagucugucaaaguaucgaaccuaaacaaaaacaaaauugggaagacuggaguugaaccuugcaaauuccaagacugugugaacuguuugaauguguguuccaucauuagucaaaauggaagaauccauauaggagagaaagaaccuaacacuacagagcaugaaaaucuguuugauucaaaacauaaacucaugcugaaacaaaguaacaguaguggaaaaaagacacacaauuucaggaaauauaggaaaugcuucaacauguacucaggugacaguagacaucagagagcacauacuagagagaaauccuauaaauguacacacugcagugaauccuuucugcauuugucacagcucaaacaacauuacaaaauucauuacggacaauguccuugcaaaugugguaaaugcuuuuauaauauaucaggcuuuaaaaaacaugagaggauccacccucguggcaauacuuacaaaugcagucauuguggcaaaucuuuuaucuacuacucgcaaauuagaaaacaucagagaagucacacaggagagaaaccuuacaaauguaaugaaugugagaaaugcuuuccccagaaauaccaacuuacaguucaucagagaauucacacaggagacaaaccuuacaaauguagugaaugugacaugucuuuuaucaagaauuccaaucuuagaagucaucaacgaauucauacgggagagaaaccuuaugaauguagugagugucacaaaugcuuuacucaaaaaugcagucuuguuauucauaugagaauucauacaggagacaaaccuuacaaauguauugaaugugacaaaugcuuuacugcaaaaagcagucuuagaagucaucagagaauucaugcaggacggaaaccuuauaaauguauugaaugugacaaaugcuuuaaccacaaaagcagucuuaguauucaucugagaauucauacaggagagaaaccuuaccaauguagugcaugugacaaaugguuuacucggaaaagaagucuugucauucaucaaagaauucacacagaugaaaaaccuuaccaauguagugaaugugaaaaguguuuuacugagaaaggcagucuuagaagucaucagagaacucauacuggagagaaaccuuauaaauguaaugaaugugacaaaugcuuugcccagaaauaccaacuuacaauucaucagagaaugcauacaggagagaaaccuuacaaauguagugaaugcaaaaaaugcuuuacugaaagaggaagucucagaagucaucaaauaauucauacaggagagaaaccuuucaaauguagugaauguggcaaaaccuuuacccugaaaugccuucuuacagugcaucagagaauucauacaggagagaagccuuacaaauguaaugaauguggaaaaugguuuacugagaaaggcagucuuagaagacaucaaacaauucacacaggagagaaaccuuacaaauguagugaaugugacaaaugcuuuacccaaaaaaguagucucagaagucaucagagaauucacacaggagagaaaccuuacaaauguaguaaaugugacaaaugcuuuaccaagaaaucccaacuuacgguucaucaaagaauccauacaggagagaaaccuuacaaauguagugaaugugagaaaugcuucagcuacaaacgugcccuuauaugucaucagagaauucauacaugaaauaaaccuuacaaaugcagugaaugccacaagugcuuuacugaaaagggcaguguuagaagccaugaaagaauucauacacagaagaaaccuuacaaaaguagugaauguggcaaaugcuuuauugauaaagucacuuuuagaagucaucaaggacuugaugcaggaaaaauaccuuacaaauguaguaaauguagcaaauauguuacccagaaauaugaucuuaugauucauggaagaauucauacaacagagaaaccuuauaaauauagugagugugacaaguaaaaagcuucaaguaaaagcucucuuagaaaacaccagaaaaaucacacaggcgagaaacauuacuggugaggugaaugggacaaauucuuaacccagaaagaggcuuagauaucaucaaaguguucauacaugagagaaacgcuaugugauuguuuguauaugcuugacccggggagaggcacuauuaggauguguggacauguuggaguauuuguggccuucuggagcaguucugucacuuugggcaugaccuuuaacacacucaucauagcggccuggaagccagucuucuccuguuugccuuuagaacaagaaguagaacucucagcuccuuaagcuccaggucugcugauauacugccuagcucucuccuugaugauaagggacugaaccucugaacuuguuggccagccccaauuaaaucuugucuuuucuaagaguugccuugguuauggaguguguuucacaguaguaagacccuaacuaagauacauugcaaaugcugugaaugugucaguugcuuuaccuagaaaagucaucucacaguucaccagagaauucauacaggaaagaaaacuuacaaauuaaugaauguggcaaauguuuuaccuuuaaagauagucuuagaaaauaucagauaauacauaaagaagagaaaccucaggaaugaaaggaauauugaacacucuuuaucaggaaagacucuauuagaacucagcagagaaccguagggggaaccuuacaaauguaaugaauaugacaaaucuuuauuuuaaaaggugucuucaaauucaucugagaauugauacaggaaagaaauuuuacaaauucugugaguaugacaaguccauuccugagaaaaacuaucuaaaaggcaucagagcauacauauagaagagccuuacaaauguaguuaaugugacaaaucuuuugcccuuaaaccuaucuuagaauuccuuagagaaaucauacaggaggcaaaccuuacaaaugaacugaacaaucuauugaaaauaaagacaauuuuagaacuugucagaaauaaauacaggagagaagaucaacaaauugagugacugugaagaauuuguaaaccaagaaagaccaucucagaacucaucugagaauacauacacaagagaaaccuuguaaauguaaugaacagugaaaaucuuuggugcuggcuaaucucuuagaauaugucagagaucauauuaaaaugaaauguaugaagauuauuugugucuguauuucagaacuaagaaugcauuaaaaaaauaguaaugggcccuuccagucugagccagugcccugagcagaacuugggcacuagcucugcacccaguccuacaacauccagaaacuucauucccagguacucuaacaugcccaggauuauaagugaggaggccacaacuucugccccaacaccgggaguaacugggacccucgggguucagggacacaggaauacccucucaccucaccccacccagauacuggcacagguucuuucuggucugagcugcugcccugagcaggccuugguugcuagcucugcacccagucccacaacaccuagagaaugcuugacucucaggugcucuaacaugcacaggaccauagaaccucagaagcuugaucaggaccccagaggcagcuugacuuccaggagcuaugacaaacccaggaucacagaaucacaggaucagagacagcuggacucugaggaguuuugacacaacccggaucgcuggagggauaggcuucaguaagagauagcaagggcauguagcacaagagauaaccagauggcuagagguucaagaacauaagcaacagaaaccaagucuauauggcaucaccagaacccaguucucccaccauagcaaguccuggaugcccuaccacacaggaaaagcaagauucagauuuaaaaucacaucucaugaugaugauagaggucuuuaagauggacauaaauagcucccuuaaauauagggaacaagccaguaaguggcacucuuguuccuucaggcuccugcucucuuuaaguuugggcccucacugcuuuugauaaugaucugugacauggaaguguaaaugaaauaaacucauuccuccuaaguugcagcaauaccaacccuaaugaaaacaaauuaguaccaggauugugagauauuguggugauagauuucaccauguuuuggggaggaguauagaagaacuuuggacaguuguaugaagaaccuauggugucugguuagcuggagcugaggaaucagguauggucaguaggaaaccagaaccacuaaagugaaagcguugcuuugcuggaacaauugaugcugaguagcuggagcugcaaauuuagcugugauugaaguguaagaggucaacaucaaggggguaaacacuucuaggaaguauuuucucaacaucaguacaugcaauuuguauucagagguagccaagguuguaucucaagcugccagccaaacaugguacuguaagagucacccaugugguuuugaagacauaaaaggauugugcagagcaucuaaggcugagcacugagaagccagcagaggccauuggugaaagugcaucaagaguaccaauggauugaagggguccuggagaaaaugugagaguuugccacaugaaaagagccuaugagaggauacuggugugagcacaaaccaguugcaguagaagaccccaaaauuuuggagauguaccauagaaugacuaccaaguacagcaguagcuguagaguggagccccccaaauuguaagagacaagcuuugugugcuguagaaggcagaacaggauaagugacccaagccacuuggaggaaacaaaaaaaucccuguggaccuggguaaaaucuugugaaacuuccagggaguaaagccugccuagcagaaauaggccccuuggaguguuccuuuaagaagcauaauaauucaaaccaguauuuucacucaaauauacuuuuacaccuuaucuucaauaauggacucaguugauggcuucgcauagaccuccaauaucgguacuuuggauuugucaggaacaguagaaucaaacagccuuggugaagacccuagaugaaaacaauguugaaaggugggaagaacaucuucagagaaaaauaaaguagcauguagggguggaaggaccacacugaauaagagcagauagaguaagaacucuucugauguuccauuuuuuguaugaaauacucucaggaucuuccccauuuagcauuauguuggcuauugguuugucauauauaguuuauauuguucugagauauguucuuucuauaacucauuacuuaagugauuuuauuaugaucauguugaacuuugucaaaugccuuuuacaucuauuaaaugaucauauaauuucu

SEQ ID NO: 8419 - RNA, 420 nt, Mus musculus
caugucccagaaacaagaagaaaacccugcggaggagaccggggaggagaagcaagauacacaagagaaagaagggauucucccugagaaagcugaggaggcaaagcuaacggccaaauauucaagccuaggacaaaagccuggaggcuccaacuuccucaugaagagacuccagagagagguaugggacacccuuauacuguggcaccauggaugaagucuauagagggucuacugcauguuuuucuccaaaguacuuugacucaggagacuacaacauggccaaagccaagaugaagaacaagcagcugccgagugcaggagcagauaaaaaccuggugacuggugaccacagccccaacccacaggacuugccccagagaaaguccucacuuguuaccagcaagcuugcgggguaac

SEQ ID NO: 8420 - RNA, 87311 nt, Mus musculus
aggaaauuccaccuuucccugaagaacucagggagccgcacggucuggaagugggguuggaagaacccggccguguauuaggguacccgaaaacuuccuuaagacucaggugccucugggagcauuuuggaagcgucagcagcccggcagcgggaaccucccaggucagaggggcuggggggcugggaaaagggugggagcggagaagcagggguguguuuuccuccgcggcucuuaaggacgccgcuuucauaauucugccaugguuaucuuagcguugucgggaaguuugagauccuaugaacuggggguuuaucgugauguuuucguuuaucuuaugguugccagaauauuuuccgaaaauaaucucguagagcauuugcagaaucugcaguucgcacgcagagcucucuuugcuccagcaguuacaaagcuccucgaauucaaauucacucaugcuuucuuaacaccccuguuccaccauuuccuauucaagagaguggccauuggcccggagaaugggcauccucggagaguuuugcagauauuagucaucugaagaaccaguugagauuugauugagucagaaaauauacaugacuaagcaccauaguuagagcugugaacuuuaaauauuacugggcaaagcuuuacuccccguuuugcuuugguuuugguuuugguuuccaucuuagaugugcacacucugugauguaaauacugcagucagaaaugugucuuuauauguugaguuacaacugaaaacugaggacgugacugcucuaagguaugguugaggagaaaauuuauuguaaguuauguuaauccugagauuugccugagacaaaucaguaccaccauuugggcaaguauuauuaaauauuaaauacugaccaagcuauggacuuuggccucaugcuacaggaguuuauaaagacaaaccugcauacauucccaugagaguuuguuacuuuuccaagaacuacaacucccagcauuuuaggaaguuauuugguucuuggguagguagugcuuacauguuaauuuugggcuucacaguaugagagaacagagguaucuggaaggguccaaacuuaaccuggccgugacuugggggguugaaagggggaguuagggaauaggaggcucccaagagaggaaacaggugccaaggaaacaguuauccaaagauguccacuaugauauauuaauaggcaccucaguuagccauuuuuccuaagcuccuuugauaucuaacaaggccagaccagcaugcaugcuguggaagggcaaugucaagccaccuuauuguuauagauagaaaacucacucuaaauuaaauaaaauuagaaagcccuuuuugaauaauuaugauugcucacuuacaucagaaacgugucuccuuaguucaagaaaagcacauguggccaaacuguucauuauuucauggucuguugauauugaauucugugacuauggacuucuuaccuagacccugcagucagggcuuuuuuucagagaccuccuuuuggaaaagugcaucaguuuggauucugugagucacaguaguuuucuuggagucuuccuugggguuccugggaaaaggacucuucggcauaugugugaacugugugugaaugagucucacaccucauagaacagaguaaaauccucagagaaaagagacauuuuuucauguuauuuucucuuuccuucauguuuauccucuugggaggugucagcaucuuucauuuuuguggcaugaaaaguuccaggugcuuucugaagacucucuucuccacaugcagguccccacugcucagccagaucugcucaccagugaaucaacuaagaacccuggauggugaagagagaggagacuauaguaaagaauccagguauguuagaggaacugaacaaggggugaggugggccuuaagugacaauaaaaagagaaugugacauugguuuuuccagauucuauuucauuaagcauucaggaaauuuucauugagaauaauauuagauguuuuaaaauggauuuuuccuuauagguuguacagugaacaguuuuuuucaguauuuaauuagcuauggaucucugaauuaacuguugcccauuaacaaguuucucugacauagacugaaagcagcaccaagcuaucuaugugaccaagcuauuugaacauguagcaaaugucagaagugaauuuucuucuagggccugagguuuccacuauaacccauguauuucacacacauacacuccaucccccauauggaguuggccucagauugaaccagaaagccuucuguacccacaaguuaucuuagcacuaugguaccaguggacauggccuugcauggcagauugagauuggagcacacaggaucuauagcuggguauggacauugauaccucuguccccagccccagucugcagagcaguuuuugacaccaugaaugcaaccaccaggcuguccaagacauuuguagacagugugaauagucuaaucugagguguuuguuuguuuuguuuuuuucucucaagaaggucgacuuuuuucugccuaucuuauauuguccucuuuaagcaugucuccgaccuugaauuguguacugaguaugcucugaguuaguucugauuagagcacaguaauuccacuuguccuuuguuuuauacucuuugcauuagcugugccucuguuccugacguauguuucaucuguucucacauucuugagggcuuuuauauucagcaaaugucgcauuauuacagagcuuucaugugucucuugacauagucauuuuucuuuucucacugacuuuacaucuuuagagucugacauugauuaguucguagguguuaaaauagucuugcauucuugaugcgaacucaccuuugcuuccauuucuguguaauauagagaccaugucuauguagauccuaaaagcuggucugucuuuuuuuuuuuuuuuugcauacagugguuugagcuccuccgcuuugggcauugaaguaaagccagcuuuguaugaugacuuucuaguguuccucuucuuuguguuuuagguaauaaucuccuuuaggcagaucuccuaagguuugcuuuaggaaaggagaauuccguauagucccguccucagaugcuguuagagaaaacucccugcuucaguaucagcaccugcuugaugcggguucuaguuauaugauguaggagguugauuuauucacuuguuucuaggaacucaucauuucuucuucaauucugauucauucauguaugacuuuccauagcccugcauaagguaacacugacauccccacauauguugugucauguggauuauauuaguacaaauuuucuagagauacugcuugauauagugcacaagccauccauuugaaagcauuaauuaaugucucuucuaauuacuuuguucucuucuuaucuuucggagguggaaggcuacccuacuccauguuuuuccuuucccuguagcuauguuuuauauagguagagaauuucaagagagguuuuauuagacagacuuccaguuauuucuuuaaaauauuauuuaagugugggaguauacaucugcauuuuuuaugugcacuguauuuauuuaugaagcccauugagcccugauauaguuauuaaacccauggcacaggagacacacacaaucauaaguugccuuguguguagagagaauuagauuauuucuauucagaaacagugaguacccuuuugcccuagagagauuacuccagccccuacauuuaaauuucuggugcucuuucacaauggagccagaauuuaacacugaguucuauuuuauugaaaaaugaaggaagagucaucaaugauauuuaccuaugcaaccuaaaaucauguuagaugauugagcucaaaaggugaagaaaaaauuagagcuugaaaucaaaagauucagauuuccaauugagcaauaauauucauaauuaaugaagaguuaguauaauuccuacacaacuuaguacauuuguuucaaucauagaaacucuccuucaucugaaugcauugucauauaugcauuuauuuagauagauauuucuaacuauuuuguagugaaaucucauggaauuacugaaauuuuuaucuaucuguaguggcucugucaccuuuuagaaaacuuagauaauauuaaugcuaacuuuucuguuuacuucaugguuguuagauauuguuauaaaaugauggcauaauguauuucauucuauguguuguuugucauguucuauguaugcacugauguuauacuccuuacuguuucaaggaaaaaaaaaaaaacaaggcugacagcuguagaauuuggaagcacaguuuuaaucacuguaauuuaccaucugagaugugacacugguauccuauuugagaucaacauagaguucuuagauguacauuccugcaucuagaacucaaguguuuaccuuauauucccugaaccuuugcugauuaugagacuaucauaucauccugcuuuagagagaaaagaagaugcaauauauaacuauuuuuaaaaagauaaauuuuauuaaaauuauauuuuccuuuuauuuauguguguuaguauauuugccuaaauauaugcaugugugcuauguaguccucaugccuguagaguucagaguagaggacuggaucccauggaacuagacuuaaaaucuguuguguagcugggaauggaggugcacacgcacugaggaggcugaggcaguuggaucucugagcuccaugccagcuugauccaaaaaaaccucuggcuugcaugcacucuucauuucagacucuaccuccuuuuuucuagaaaagguacagcauuguaucuaggccucaggagcucaacugagcauauuagaauaguuaagcagugagaccuaacugcagacaguugaacaggauuuuaggugaucaauauucucacacaaagaugugcguguaacuuagaaaacagguucacauggauuggaugaauaaauuugaaagauacauuuuuaccucgguaugaauguaaagccuuuguaggugaugauguuccuguaacuugauauuaugacaauuauuuugacaaaaaaauaccaugguauuuggcaaauaaaggaucuguuucuuauucaagacaacagggcacacauggaaaagaaauguacuauaucuacaagguaaaaugaaauuuuaugaaaugugacugaaaaaucagauacuguuuucuaguaugaugacuaaugaaauuacguuuuaaccuagguacccaccagccauuuggcuaugacuccagucccugcaagagaagcuuccaguaauaacucagaguaauaguguuucgcgccacauaugcguguucuauauuauccugguggcagcugagguuagaaaaaaaaaaaaaacccucaaguuguagucaaguuuucuguuaucauuuugguucuugcaucuaugcuuggcauuguuuguagaagaguuacauuaauuuuagcuuuguaguuuuggcaccuugauaagaaauuuuaagaauuccuauguuuguuccugagacagaaacuuggaaaagagcaauaagaagaaugacagcuucuuugguaaaugcuccccaggucaguguccuauucaccuuucuuugaaagucauuuuuauuauugaacucauucaagacuuuaauucuuuacaucugguaauguuaucuaaaguguauuuucaaugauuuauucucccuuuuuccugauagucaaaauuaugucuuuagaucuuucacuuauauagcacagccuuuucccauuguauuuaagcuggauuuuauacugugaggacauaaauuuccauggacuuuagaccuggaauucugaaaauugucuauucuaaaugaugcucaaagaauauauugauggggauuucuacauaugauacacuuguauccuuguauauuguugaggaaggaaagucucuugugccacauaaauuucuuuucaggaauggucauguuucuagaaauagguuuaugaaugaugcacaaauauauagacaucauugaacaauauauggaagaguagaauuauaaguaugacgaucugucuuuaauccuaauaguaaacauugcagcucccuagaggaacagaugauggaaggaauauuuugauuacucuuccauaacauugauuuaucugugaggugaugaagguugcaguauuauggugucuuucuuaggcaucuuaugcuuguuacacagugaucauggguggguugaugcuagaaaucuauuuauuucaagaaagguccugcucuaugcucaaugguaaguuuuaauuuuuuuauuucuuuaauauuuuuuauuacguauuuuccucaauuacauuuccaaugcuaucccaaaagucccccacauccuuccccccacuucccuacccacccauucccauuuuucggcccuggcguuccccuguacuggggcauauacaguuugcgugucgaaugggccucucuuuccagugauggccgacuaggccaucuuuugauacauaugcagcuagagucaagagcuccgggguacugguuaguucauaauguugcgccuacaggguugcagaucucuuuagcuccuuggauacuuucucuagcuccuccauugggggcccugugauccauccaauagcugacugugagcauccacuucuguguuugcuaggccccagccuagucucacaagagacagcuauaucacgguccuugcagcaaacgcuugcuaguguaugcaauggugucaucguuuggaggcuaauuaugggauggaucccuggauauggcagucuauagaugauccauccuuuugucucagcuccaaacuuugucucuaacuccuuccuugggugauuguuuccaauucuaagaaggggcaaaguguccacacuuuggucuucguucuucuucaguuucauguguuuugcaaauuguaucuuauaucucaaguauacuaaguuucugggcuaauauccacuuaucagugaguacauaucauuugaguucuuuugugauuguguuaccucacucaggaugaugcccuccagguccaaccauuugccuaggaauuucauaaauucauucuuuuuaauagcugaguaguacuccauuguguaaauguaccacauuuuuuguauccauuccucuguugaggggcaucuggguucuuuccagcuucuggcuauuauaaacaaggcugcuaugaacauaguggagcauguguccuucuuaccgguugggacaucuucuggauauaugcccaggagagguauugcaggauccuccgguaguacuauguccaauuuucugaggaaccgccaaacugauauccagagugguuguacaagcuugcaaucccaccaacaauguaggaguguuccucuuucucuacauccucgccagcaucugcugucaccucaauuuuugaucuuagccauucugacuggugugagauggaaucucaggguuguuuugauuugcauuucucugaugauuaaggacagaugauuauuuucucuauuuaacuuuauuucauuuuuuagauuuggcauaagcacuauugucuccaacuuuacaucauguggacucuauuaguaaaaaucgucuagagaguauugcugugcauacgccaucaauuuucaaccauaaauagauguucuucuuaauuuauucucuuaauuucuuuaagaggaagaauacucacuucaccuguauuuuuccucuuuuagaaucuauauauuauauaggggaaaauucaaagcaauauaaugagguuucuauuuuccuuuauaauaauauuuuauuuaaguauaagacuguucaucuguauuuuuuauguauacugcaugagcuauuauaccccuaggucccuguauucagcaccaaaccacuggagcugaagucaagcauuguagugacuugccauguguguagaaagaauugaaucaggauucuauggagaaauaguaagauccuuugccucuaagucauuucuccaggcuguaguuuuacauuccaaugcacauuugucacagagguacuauauaacuuuguguggucuaguuuuugaaaagcaaaggaagaauuauaguuaauauuuaucuauguaacugacaauuauguuagacaaaugagcucaaauacugaaggaaagaaaauaaaguugaauuggaagugucuuagucaggguuucuauuccugcacaaacaucaugaccaagaagcaguuggagaggaaaggguuuauucggcuuacacuuccauacugcuguucgucaccaaaggaagucaggacuggaacucaagcagaucaggaagcaggagcugaugcagaggccauggagggauguuccuuacugguuugcguccucugccuugcucagccugcucucuuauagaaccaagacuaccagcccagggauggucccacccacaaggggaccuccccccuugaucacuaauugagaaaaugccuuacaguuggaucucauggaggcauuuccucaacugaagcuccuuucucugugauaacuccagcugugucaaguugacacaaaaccagccaguacaggaagauucaaauuucaauucagucaaucucaugagcaaaaaaaaaauguauuaaaaauucauacaagauucucaguuuaaaacuuaauuugaucaaaaauagcuuaucuacaucuauugucacauauaccauuuauuuacagauaauagcuaauaauucuguagugaaagaucauggaacuuaugaaauuguuaauaucuguauuuuuuaugucaucguuuagaaaaaugugaaugauuucacuguugucuagugcugauuuuucuauuuauguuguaguugugauauauucccagaaaauaaauucguaaaguaguugacugaauguguuguuuggaauauuggauauguauccugauguuacauucucuacugcuuaaaaagaaaacucugacuuaauucaccaaacauucugcauuccauauucagucuuuuuuuguucuugaaagguuguagcauugugccuaggccucaagaugucaacagagcauuuuagaauagagucaggugagauccagcugcaaacaguauuguucuaguguccauauuugaccaaaauugacacugguagaauuuggaaacauaguuuuucucaccauaacuuuaccauuuaugacauuaauaacugacauaauaaugcuguuugauaucagcauauacuucauaaagguacauucuugcaucuagaccucaaauguguuucuuauauucccuaaacauuugcugacuuuaaggcuaucaugcccuuccuguuuucaaugagauagaaaaauacaauaaagacuaugaguauuuuaaaaacuaucuuuuauugcauauaaauuguaauuuaauuuaauguauuucagcauauauguccaaauaugugcauguauguuaugauggccuccagccuguagaguucagaaaagaggacuggaucacauggaaugugaacaauaauaaaucauuccauauauugucuauagaagaguagcaauguuuaaguucugacauaucugcaggauuucuagaaaagguuuguucuuaaaugcuugccaugacucaucgauaucacaaaauaucuuguucuuuauaucuuuuuuaccuagaaaagcauuuuugucuagcaccacaugguaaauagguaauuuuuuauuauaggaacuguuaacauucaaggaaguggcuguugacuucucacaggaggaaugggaaugucuugacugugcucagagggcauuguacauggaugugaugcuagagaauuacaacaaucuacucuuuguggguaagaauacucuuccuguagaauuccaauuucauccuuugaauuuaccuacuuugugauaauguaaacucucugaaaugucuagagacucccagaauaagagaaauucuacuuaccaacauaacuuuuucaugguguuuccuuuacauuucucuccauucucuggaagaguaaccaguaguauguucuuuguaaucuguuaucuagcuuuuaaucaaaacuucaaaauucaaagaaaauugaauguucaaugcauagaaauauauuacuauauacauaauaauggaacuauuuuaaacuuacuauuacguuaacguuuucauuuauuuaaaguuuuucuaauuuauguuuuaaguuuuuuauuugcuuuacaucccgaucacagacuuuucuccacccauugccuccuucacacgguacccuguccucugagaagaagaagguaccccccugguuaccaacccacccugacauaucaaauaacuacaggacagcauauccucucccagacagugcagcacaguuaggagaaaccggauccacguggagauaacaaagucagggucagccccccuucuaguuguuggagugcccuggcaugaagaccaggcuucauaucugcuacauauggagggagcauuguccagcccacauaugcucauuggauggugguuuuucaucucugggagcucccaacguuccagaauaguugacuguguugauauguauauggagucucuauccucucugggucccucaguccuucccccaacucuccacaauccuccuucagcuccaucuaauguuuggcuaugauucucugccucaguuuccaucaguugcuagguggaagccucucagaggaccgucaugacaggcucgugucugcaaguauaacagaguuaucaauaguguuaggauuacuuuuucccuguaggaugggucucaccuugggucagaaugguugaccauucuccuagacucugcuuccucuuugucccuacauuucuuguagacaggacagauuuuuggucaaagguuuuauggguguguuaguguuuuagacuucuucuuuuccaauauguauuucuucaaucuucuuuaguugucuuacuacuuuaacuagaacuucaaauacauauugaauagauagggaaagaauggacagccuugucuugucccuggaauuaaugggauugcuuuaaguuucucuccauuuaauuugauauuugcuguugguuugcauuuauuguguguggguuuuuguuuuuguuuuuguuuuuuuuguaucuaccuuauauccuuuaucucuccaagccuuuuaacgugaggggugauggaguuugucaaaggcucuuucagcaucuaauuaugauuauguggcuuuuuucuuauguugguggauuuacauauugaaccaccccuuuaucccugaggugaagccuacuugaucaugguggauaauguuuuuaauguguucuuggauuuacuuugcaaguauuuuaucaaguaguuuugcaucaguguucauaaggaaaauaaguaugaaauuuucuuucuucuuugagucuuugugaaguuuagguaucaaagugacuuuggcaucauagaaucaguugggaaacauugccucgguuuuuuguuuuuguuuuuuuuuuuuuuuuuuuuuguagaauaguuugaggaguauuggagacaucuuuaaaagucugguagacugccacuuuuauuucauuuugaauuaaugauuauugaguaaagaguuguucaguuuucuugaguuuguuggcuuucuguuguuguagaaauccggucuuaauccaugguauuccaauaagauggcaaagguuauuuccauuuucuuuuaucuguugagguuuguguuauggcugaguauaugaucaguuuuggagaagguucugugagguacugagaagguauauucuuuuuuguuugggugaaguguucuauaccuauguuagguaaauuucauucauaacauuuguuuguuucauuauuuuucucuuuuguuucuguuucaaugaccuuccuuugaugagauuggggcauugaaaucucccaauauuaaucugugagguucgcuguacaauuuaagcuuuacuaaugucucuuuuaugaauaugggugcccugggauuugggucauagauguuuaaaauuaaugucaucuuagugacuuuucuguuuaaucaguaugaaguggacuucuccaucuuuuucguuacuuuugauugaaagucuauuuuauuaaauauuagaauggcuuccucugcuuguuucuuggggcuguuugcuugaaaaaccuuuuucuagaacuuuacucugagguaauugcuaccuuuguugcugagguguguuucuuuuaugcagcagaauaauggauccuguuuucauauccauggugucagucugugucuuuuuauuggggaagugauuccauugauauugagagauacaaaugaccagugaauguuaauuucuguuauuuugauguauaugguaguaguaguaguaguaguaguaguaguaguaguaguaguaguaugugugugugugugugugugugugugugugagugaguguguguguaugcguguguuucucuuguuuugguuuugcuggugugcaauuacuuauuucuuuucuuggguguaguuacccucuguaugguagaguuuucauucuguauccucaauagaacugaauuauuagaaagacacuguuuaaauuuucuuuuuccuuguauuccuuauauuuuuagguuuggucuuuucauaguaucccagauuucuugaauguuuugugucauacuuuuauauuuaucguucucuuugaucaacauaucaauuuugucuauuauaucuucuacaccugaguuuuucucuucaguuucuuauaugcuuguguccuuaguuccuguucucuuuccuagguuuuccaucuccuagauucccucauaugguguuuucuuuauugcuuuuauuuuuguugucaacucuugaucaaguuuuauucauuuuucaccuuuuuauuguauuuccuguauuucuuuguacuuauucauuucuucucuaaaagccucuacuguuugauuguauuuuccugaauuucuuggaaggauuuauuuauuuccucuuuaaaguccucuguuaucuuuauacgauuagauuuaaggucauuucuugcacuuuaggugugauaugauauccagggcuugcucuacuagauagcuggguucuggugguaccauauagccccaacauaccaaaacacuguaugaugaagcuuuucucucuaaauauaaacucaugcuaaaaggaaacaauaguggaaugaaaccacacaagugcaggaagucuggaaaauucuucacgaugaccuucauguccuuacacuagcuuuucaccaucauauugucccugguguugacagcccuaguagguccugguugcagcagaaucuggacugcagauaggacucuuagacccagguggcaacacaccuuuggggaugaagacagagaugguagucucagauaacagcuggccuucuuggguugcagguauuccugcuugucccagaugguaguaggccuucaugaaugcagacagagcuguuccuccaugauguuauaggccucuggaguugcagauagaaguauggacuggaggauagaacacaguggagguagggagguucucaccacugcuugggauugcuggggaucgcagugggcagagacuugggacauggggaucugaccuggcugucccagguuccaggagacccccagagagaggcagaacuguggcucagagaauagaggacagggaagggacaggacaagacucacuguugcuggucccugauggcugcuagucucuaagauucuuauuugugguuuuuggaaaugcagauuuuaaguagagaaagaacuguugguugggagaauuucguuuuugcuaauguauuuacuuuuuccauauggacuguauguuuaguaccgguacaguauguucuucaucccaauacuucagauacagaagcaaggauagagguugaguaccaugacacugugaguuauauagugaauuccuaagugaccaaagcuauacucugucuuaaagcauaaacaagaaaguagagaaacauugcuuauaugauacuuccaaaagcuccuuucacaaaguucuucacuacaugaucacuuauuugucauaucuucuguaggauacacuauuuaaauaagaauuaucaucuccauucauuugauauagaucagauuugaguuucuucugagcauccaguuaaugauuuugaaacacaaaagaacucuguugagaccuuuauccuggagacuugcuaauuuagcuuuuuuagaaaauguacaagaagcauccacuauugaaucucuuauucaugcauuaaucacugucaucccuaauugcacauuuuuuuuucagagaauaaucaucaugugugugucaaacaugaugaagucuugggccaaggcucaaaguauagugccccugagcaugugaauauucaagagaagucuaauaaauggaaggaauguggcaaaaugauucaugaauccuccaaaaguacaccuuaucaaaccaacaacagagaugccuccauugaaucaucaaacagacacaaaacugagaaugccagggaaccaugcaaguauaaggacugugugaauggcuuaaauuuguaucccaucacuugucacaaucaaacaguguaccuagaaauaaaagaacauaccaaaacacuguaugaugaagcuuuucucucuaaauauaaacucaugcuaaaaggaaacaauaguggaaugaaaucacacaagugcaggaagucuggaaaauucuucacgaugaccucaagccugagugggcauccgagagaucaugcuagagagaagcccuaucaauguacaaaguguaguaaauccuuucugcauuugucacaccuccaacugcauuacaaaauccauuuuggaggauaucccuacaaauguacagaaugcgguaagugcuuuuaucaugcaucaggcuuugaaagacauugcagaauccaugcuacaaagaauacuuacaaauguaguuuuuguagcaaauccuuuaucugcugcucaggucuuagaaaacaucagaaaauucaugaagaaaacaggcuuuuugaauguaaccaagauacuagaucauucuguacauuuuccuaccgugaaugccauuaccgugcugauauaagaaagaaauguuacagauguaaagaauguggcaaaucccuuucuacauccucaggacuuaaaauacaucagagaauucauacuggagagagaccuuacaaauguggugacugugacaaaucuuuuacccagaagagcaaucuuagaaugcaucagaaaauucauacaggagagaauacuuacaaaugcagugaaugugacaaaugcuuuacccagagaugccuucuuagaacucaucagagaauucauucaggagaaaaaccuuacaaauguagugaauguggcaaggccuuugcugguggcucauaucuuagaagucaucagagaauucauucagaaaagaagccuuacaaaugcagugacugugacaaauccuuccaccggaaagaccaccuuagaauucaucagagaauucauacaggagagaaaccuuauaaauguagugaaugugacaaaugcuuuacccagaaaggcaguguuagaauucaucagagaauucauacaggagagaaaccuuacaaauguaguaaaugugauaaaucuuuuaccaagaaagacugucuuaaaauucaucagauaauucauacaggcgaagaaccuuacaaauguagugaaugugacacauccuuuaaccggaaagaccaucuuagaacucaucagagauuucacacaggagagagaauuuacaaauguagugaaugugaugaauccuuuacccagaaaauuaaucuaagaauucaucagaaaauucauacaggagacaacucuuacaaauguaguggaugugacaaauccuuuaaccggagaaaccaucuuagaacucaugagagaauucaugccggagaaaagccuuacaauuguagggaauuugaaaauuccuuuauccagacuggcucucuuagaauucaucagagacuucauucaagaaagaaacuuuacaaaugcagggaaugugacaaauccuuuacuagcagcucauaugucagaauacaucagagaauucauucaggagagaaaccuuacaaauguagugaguguggcaaaugcuucacuaguggcucauaucuuagaaugcaccaaagaauucauacaggagacaaaccuuacaaauguagugacugugauaaaugcuuuacucagaaaugcagucuuagaauucaccagagaagucauacaggagagaaaccuuacaaaugugguaauugcgacagaucuuuuacaaguggcucauaucuuagaauucaucagagaauucauagaggugagaaaccucauaaauguagugaaugugacaaauccuuuacccagaaaggcuaucuuagaauucaucagagaauucauaaaggagaaaaaucucacaaagguaguuagugugaaaaauccuuuacccagaaacccuaacuuguggaacuuuucaaagaauucauauaggaaaaaaaacuuaaauauagggaauauagcaaaucccuucacaggaaaacugucuuagaacuuaucagaaauuucauacaguaaauaaaacauacaaauguauagaaucugauaaaucuuuuacccagaaaggcugucuuagaauucaugagacuucauucaagaaagaagcuuuauaaaugugacaaaucuuuuaccaggacaaacuaucuuagaacuugacagagauaacaggagagaaacuuuacaaauuuggugaauauacaaauccuuaacuauuggcacaccucuuagaauaucccucaugacacauaaguuuccacacuagagaauaauuaugaucaaaagaaacuugugaaaaccuugaguaauguucaaaucuuagaaaauaccaagaguuuaugcugagggaaaaucugaaaaugugacaauguaggaaauuuuuucuucaaccuuuuuacuuguuaaacuuaauacuuuguuugacuuuuagucagucuuucagcuuugcucaaacuuuauuaaacuuguucauccucaaauaauucauaaugaggacaaaauggagaagccagaagaaugugauauuguguaacaguuuucugcagacugaaaugacccauucugaagggauugugauuaagacagcaaauacauaccucaaaauagcuucaagaaaucccugaaagugacagcauugucugcuuaagucaaaugaugaaacccagaaaagaauauaccucuuaaaagaggauuuuacaaagugucaacaaaauaggaugcauuacuaaaugaauuauuacacauuaauuuuuccaucugagagguauaaaugguagaauguaaauacuguuuucagaaauguauaauuauaugcuaaacuguuaauguuaacccuuaugguguaaaauaacugcacuauguaugcugugagaauaucaggcuauacuacauuuauagauggaaaauucaguguacauuaggacaaaauucaaaaccaucuuuuaaauaauuaugauucaucaauuauguuagaaaaauuuacucuaauuuucuuaugucuccugcguucaucaaaagcacuauucacauugaugaauuguuagauuaccuuggucuuguuucuuuuugcuggguauauauuucagugugcuacccugucugugucagaacacccaauguagaccaagccuggacucugccuccuggaugcuagaauuaaagcacuguacagaauuugaugauaguucuuaucauuaugcacuucauucaggaggaauuguaauguccaggcccuaauuacugugcuuuguacauagauuugauauugaagaauugcaguagucauguuugugugaaugcaaauagcaugcugcacucuguaucgagccuugggguucuagugaaaacaucaaaugugugauuucucugggaaugauucauacaucucacagaaaaaaaaggaagaacuucagaguagaaauaaacauugcaugguauuuucaauucuucacauugguccuuugggcaguuguaaggcuucuuuuauuucuguuuugugauaaauuaagaaacucaggaguguaaaauagucaucccaauuauucugcuccaugcuagugauggaguuucaaucgaucuuugaguaggagugguggagaucaaguuaugcuaccuaaaaccuuucucuaaggaguuauuacugugacauuacaugauaguugagucuuguagaauaucuucuauguagucuucccuuuauuuucagagcauagcacuguguuagaaauccuagauguuuugaaaaagucacuuucccauagcuugggcugaaugaaacagaccagagaccuggaauguauacugaacuuaaaaugaauaaaugauaccagauauucugcaggaaauugagguaggaguaauggaagauucaaaugacauuggaaauagaaugaagaaagaaguuggcucagcagcagguaacacuugauuuucuugaagaggacaugaguacauuucccaccaccagcacaguggcugacaaaauucauaauuuuaauuacaguagaucaggugcuuucuggccucagcaccuaccagccacaagcaagcuacaugcauacauguuguaaaacauugauacauagaagcuaaaguaaauaaucuaaugaacauuuuaaagacaaacguguaaaugggaaaugaaauauugauuuucuauauucuguuucucuagaaauuaaucuagaauauacuguaaugucaagauuauccuauuguguauguuacugacauuuuauguaagcauaauagggaaaaauauaauuuguuugacuguguacgugucccaggugugcacauauaucuauuauaugaaugucauugcuuucauuuuaggauacuuguaaaacuagaaauauuucugccucuuaacuuuucccccuaaucuaauguuaauuguuucuguuguuccuuuaaugucuuucuuuuguggucaguuuuggguuuuuguuguuguuguuguuguuguuguuguuguuguuauuuguuuuuuguuuuuccauuuccuaauauaauaccagcaggacuuugguuaaaauugcuuaguauguuuacacaguauuauacuuugucuauauugucuucuucuugacaucucuuguuuucucucuucacaccauuacucuaugauauccuuugcaauaauuauaagagauuuuggaucuugguucaaccuucugaauaguuuuuuaauucuuucagcuuucuugaauguugauaucuuuuuaauauugauuuguucacuuugcaguaauuguccauuccucuugaaacaauuugauugcaaacuuuaggaaagugaaaauucuugcugaugguguucccauaugaugagaauuggauagggguuccuuaguguugacauguuguacauuuauuuuucuuguuguguugcuauuuaugugcaugucaucagugcguaacgacucauugcaagaaucuacuacaauuagucauaucauaaaaaaagcauaugugugauaaaguuaauuuuaugugaacuuuugccuguuugaugauugaaguuacacacugacuuauauguugacugcaguaaguugguagagugugucuccguucuuucauuuacauuuucugcagaauugauuauuuuuuuaguauaguuaguaugcccagugacaaggcagagagggauuuugaguuacacucucuuguguggccaaaagcuauugacuuguggcaauuaacuccuauuuuagcagcaaggaauuuaguaaagaagucaguuacuuggguucuuuguucuuugacuuguggaccccucucuacucacuugagaggcgcagacuuuaacucuuugugagccagaaaaaaaaggaagaaagucacacauacaagaaacacauucacucuauauggagcagaaaaagaggcucucaaaaaccuuuguugcugagauaaagaaaagcuccaaccucuccuuuuauuucuguucucaguaugucuacugucucuaaagaauuaccucauacaauucaaguaaaacuauuacaacaggauaauugauuaugacuuucuaaaaacguuuacauucuaauaaguucauaguaaguuuaaggcaauaauucuugucauaaguugauaagacguccugaagauagagaugauacccacccaucuucaaauuuuuugacccauaauuguucuuguuuaaaggaaaugcaggcaaaaacauggagcagagacugaaggauaggucauaaagugaccaacccaccuugggacccauucuaugugcacacaauaaacccugacauuauuacuaacguuauguugugcuugcaaacaggagccuugcauggcuguccucugagaggcuuuacuagccucuaggguguggagacagaugcugauacuuauagccaaccauuggacuaagguccgggccccuuuggaagaauuaagggaugaacuuaaggagcugcaggggauaggaacuauaaaggaagaacaauaguaucaaauaaccugguccccucagcgcuucuagaaacuaagccaccacccaaagugcaugcaugagcugucccauggccccuucuacauauguagcagaggacugcagugucuagucucagugggagagaauacauuucauccuguaaagacuugaugccccagggaagguggacgcuggcaggcggugggagauuggggggauugcccuuucagaagcaaaggggagggggcuggugaggaacucauggagggaggaccaggaaggggugcaacauuuggaauguguauaaaauauauuuauaaaauguuuuuuauuguguuaauaugaaaggcuauguggacuuuugagguuccacugaaugcauuauucauuugacuugcauauaggccuaugugucucaggguguugaauguaauaguuuaaaggauaaagaccucuaugugcaaauauuugaguauuugguccccaguaagaggaacuauuuaaggauuaggaacaguguguuuuaaauuuucagccagaugcccgccaccaugcaucccacucauaaacuaagccuugaagcuauaagcaagccccugauuuaguguuucuuuuuguaugagagguuuuauucauggugucucuucauagcaacaaaauaguugcuuuuaauaaguagccuuuguugacuucaguucugaaaaccucccuccuauucugccuaccaagugcugaauuuuauauugaaccaauccacaccuagcuucuaaaauauuuuguuuguucauuuuguuuuuuaguuguuuguaugcauuuauucaggguaacucaauuuuguuuguccagcacacauaaaauuuaaguuccuuccacucuaaaaggaacguacucugcauuuguauuauggaaauaaaucgucuuuguaugugucccuuauuaacugagaguggauuuguaagacaacgggcagcaagcagcaauggcugucuguguaaguuacucucauucuagaaucuugcucauugacaaucaaaacugaaagauaacucuuacagcuguaggagcaauucucaauauaugggggucaagcagugcuuucacagagaccaucaaagaccaccugcauaucaaauauuuacuuaaaauucauaaccauagcaaaugauacuuaugaaguagcaacaaaaagaauuaauuccuuaguuggggguggcaggagccauuaggaacuugccaacaggagucuguacagauguuuggaguccccaggugauuaaugcccauucucaaacugcguaaauucucugacauugcucuuaggaucaucaccccugauguacuaacauuuuaugcacauuaacauguaaucauuuguaaaguagacaacaggacucucauuguagcuuaugauggcuauuuuugguggucaacuuuuacuaccaauuaucugugagggauacacuagaccugugaagcaggaaaaaaaaaaaaaaaaaagaggcuaggaugguauugagaaagaaaacaguagcaaauauaccagguauuuugcagagauugauguaggaguggugagggguucaguauacauuggaaaugggauaggagcugaagagauguugucgcauuuaacacuuauuacuauuaaagaggauguagauuccauucccagcauugguauugguaucauaucagacaaucauccaaaaccugaauuccggaagauuagauggcuccuccugaccucagcagguaccaucuucaaauauacugcauacacacacaaaugcauauaugcuacaaaaauacuaauacauaucagcuauaauguuaauuggaaaugucuuuggguuuuccauaaucuguuucucuagaaaugauagugaaauaaucuacuguaaauaaucucaagacuaucuuaauauacauuacugauuuuaacauaaguauuaauacuauaggaaaaauauauaucauuguacaaauaugaauuucaugacauuuauuuuaggauacuguaauauuuggaauauacuugcuuuuaaugccauuuccuaaucuacuaacuuggaugguuucaguauguuuucucucucucucucucucucccucucucucucucuguguguguguauguguguguguguguguguguguggucaauuuuccccuuugcuaauauaauaucagcagaauuuugauaaaaauuucuuaguaucucuacagaguauuaaacucuauuuuguuuucuagcugauuuuccuguugucugucuuaucccguuaugccguagauuuuauugcaauaacuuuaauagauguuuaaucaugguuuaauauuuugaaggauuuugaacucuuggagcuuucucaaauuuuuacaucuuaucaccauuacuuuguuucuucugcagaaauugcacauuccuccugggaaaaaauugcuuccaaucuuuaggaaagaaaaaccucuugucuucccauauucgaaugagaauaugcuagcuaugugucaaagucacgucacauaugcagcuuuccguuuucuguugcuauuuauacucacaguauuaagugaguaauuauuaauuauuaaaauaacauaccaucuuauuaaucauuuuagauuaaagcacaugugcuauaccugagccuuauaugaauauuuuuggguuuuggucuuuaaagaagcagcauacccacuuuuguggugguuagagcaaguuggauuuccaccgauacugucaguucuguuguguuacuuauaugauuuagugguuuugaauauuacuaguguagacacuaaauaaccaaaaagugaaucuugguacacauuaguuggaauuuuguucaugacaaaugguguguaacaaggaaauuccaggaaaaagauuguuuuucaggaagacucucuauaaaacacaagauauuugcaauuaugagagcuacacacugacuggcaggaacccugaauggcagacaguaggacagcaucucucauuucacagauuaucauaaaaaagauauaaguuguaguuacugagcaaaagugguaacacauauuaaacagauggaaaaaaauccccauaauuuauaggaaggguaaauguguggggcguuaacucuauggagcagcauuagggaacuuaguuuagaaaggacagagguguuucccuguguuguuggccaugauccugauucaacuaagaguuuugauagagauaaugcaaugguuauucuaccuggggcaggggaaaucaugaaggguauggacccagaucuggaaauccaucauuugaaucuugugcaccagcaccacaauuacucaaaagucguauacuugcacacucuuaacuccuuuguuuccagaucacucuucuguuucguguauguguguguguguguguguguguguguguguguguguacuugguguauuuucuccucucccuguuagaauccuaaagagagcuuguggccugggaaggacuuggggagccagaacugggagauauaguggaucuaagagaggagggaaaaccugaaagccuggauuaacuggaaguccugaaggcacuuguagaccugaaaguaaugaagggcuuugaggcaauuggagacaauggggcauuaggggggcuagaggcauauggagacuaagggucauuggaguuccagaaagccaauguguacuugaaaucauugugagaacuuccuucauuggaaagccugggagaagaaguaaaauagauuggaguuuccccacaguccccaauggcugaucauuaauccuuccuaucaauuauuccuggcuuuauaugcagcagaggauuuaggguuguaucucugcagaagagcaaagcacagagcauagccuaagaaccagcaccauugcucacaccaugacuucaacaugucugucccagucucaguauacacaaaaucuucaguguugacauuuuaaaaaugaaccaacaaacauuuucuguuuuaauucaggacccuuaaccaugagagacuguggcuggggaaauaucuuacuccagaacugucaggcugcugccaaaaaucuguucucccucucccagcucccuuccuccccaagcgaggacaaagugucccacaccacucauaguauccaucagcuucuccaggccucaccucaccuggaaaauacagaggccccugcaucuugacacccucuguucuguaauuuuaauuuuucaaaccuuauuuuuaaugaugcuucuuaaacacuuuaacuuugcuuguagcucacccaccagagguaguggaaaagaaaggaugccaaggaaggagaccuguuuaaaaaguuucuguagagaccugcccaucuggguuaucuggaaauugguaguucaguucacugguuagcucaauccacuugcaaacauauuauggaugcaccagcaguccagcucaguagagacaggauagcagauaugaaucagaagcaguggcaccuuccuagcagaggcagccaggccucagccucaguugugccucucucagugaagacaugaaaccaacaaacauuguauagcuaacucuauauacaagccuaacuccauccaucacuguccaucuaguccuauuuauacccucuaaucauugaauguccuccacugcucuugccucagcaugugucuugccucagcugauaucacuuugacaaucagcccaagucugaggaagcaacaagaaacuguagugcaccaccagaagguuuuguuguuguuguuguuguuuggggguuuuuguuuguuuguuuuuuggugcaaauaucauguucccuuccauguacuugcuuuagcagaacauccucucuacugugucugcuucagcuaaacaucccuucacaagucugacuuagucuuucaccuguuuccccaucagcuaaacauuccuucaugugugugccccauccaaccgacuuuccaaaggacccuuaaguuuccacuucacugguacuugaacuuaaaccaccucugauaguugggccuucucuaccuacucugaagcuuucccacccugaaguuccagccacaguuucucaguuccacucugaauauagccuucuccuacuacucacucuucagacacacccccugaagguggagucauuauggcugcaacuucucuuucguauuuuugagacagggucccucaagcuccagauuaccuacauguaagccccuauguaaccugaacgauucccuagacuuccagaaaucugccugacugaauccuucccaagacuugggauuaaaggugugagggaccaugcccaucaauccaucuuuucugauugggcagauucugagugcugcuuugugcugaaaacuuggaaauuggcagccccugguuccccccuacugaggcauauaaaguuugcaagaccaaggggccucucuucccaaagauggcagacuaggccaucuucugauacauaugcagcuagagacaugagcuccggggguacuggcuaguucauauuguuguuccaccuacaggauugcagaucccuucagcuccuuggguacuuucucuagcucuuccauuggggcccuguguuccauccaauagcugacugugagcauccacuucuguguuugcuaggccccggcauagccucacaagagauagcuauaucaggguccuugcagcaaaaucuugcugguguaugcaauggugucagcguuuggaggcugauuaugggauggaucccugaauauggcagucucuagaugguccauccuuucaucucagcuccaaacuuugucucuguaacuccuuccauggguguuuuguucccaauucuaagaagggucaaaguguccauacuuuggucuucauucuucuugaguuucauguguuuugcaaauuguaucuuguaucuuggguauucuaaguuucugggcuaauauccacuuaacagugaauacauaucaugugaguucuuuugugauuggguuaccucacucaggaugauguccuccagguccauccauuugccuaggaauuucaugaauucauucuuuuuaauagcugaguaguacuccauuguaagaaucucugguggaaucaccaugccugaccuaaagcuguacuacagaacaauugucauaaaaaaacuucaugguagugguauagagacagucaaguagaccaauggaauagaauugaagacccagaaaugaacacacacaccuauggccacuugaucuuugacaaaggagcuaaccauccaguggaaaaaagacagcauuuucaacaauuggugcuggcacaacuggaaguuaucauguagaagaaugcgaauugauccauuccuaucgccuuguacuagggucaaaucuaaguggaucaaggagcuccacauaaaccacagacaguuaagcuuauagaggagaaagugggaaaaagucuugaagauaugggcacaagggaaaaauuccugaauagaacagcaauggcuugugcuguaaggucaagaaucgacaaaugggaccucauaaaauuacaaagcuucuacaaggcaaaagacaccgucaauaagacaaaaaggccaccaacagauugggaaaggauuuuuacuaauccuaaaucagauaggggacuaauauccaauauauauaaagaacucaagaagguggacuccagaaaaucaaauaaccccauuaaaaaauggggcucagagcugaacaaagaauucucaccuuaggaauaccgaauggcugagaagcaccugaaaaaauguucaacauccuuaaucaucagagaaauccaaaucaaaacaacccugagauuccaccucacaccauucagaauggcuaagauaaaaaauucaugugacagcagaugcuagcgaggauguggagaaagagaaauacuccuccacuguuggugggauugcaaucuuguacaaccacucuggaaaucagucuggugguuccucagaaaauuggacauaguacugcuggaggaucccacaauaccucuccugggcauauauccagaugauguuccaacugguaagaaggagacaagcuccacuauguccauagcagccuuauuuauaauagcaagaagcuggaaagaacccagaugucccucaucagaggaauggauacuuuccccuaucuuaucaacccccuacaagaucuagccuacagcucaccaucuuuuugaaacccuacaugcaucagaggaucugguauuauaacccccccccccccgccucaccuuuucucagacccuuuuucuggggugacaugucuuucuguccauguucccuuacacacacuuucugacaaucaguaccucuaugucuguggugguaugaauaugcuuggcccaggaaguggcacuguuaggaaguguggccuuguuggaauaaguggggccuugugggaaauaugucccuggggaugggcuuugcgacccuccuccuuguugccuggaagagaguccucccgacuuucuucagaucuagauguagaacuuucaguaccaguaccauguccacuuggacugugccaugcuuccugccaugaauauaagggacugaaccucugaaaguguaaaccagucucgauuacucaauuaaauguuguucauauaagaguugcccuugguuauggugucuuuucaaaucaauaaaacccaagcuaagauaagguuacuuucuccuauauagauaucugcagcaccaaucucagcacuaauucagauuccuuaauuccucuaauugauucuaauguuuaaaaucauuuccucaugugggagcaacuaucagcagauucucuguacucucuuccuuaucaaagaaagggaacagauucuugcaaaagcaauugaaagacucccuguaagagcuugagucacuuauugccagagaauagaggcaauugauugcacucugccaagaucgagaccacaaaugggacuacaacacagaaagagguagaagaucacacaguaaggagcaccagguucuguuagaagggauggaauaggcagccugaaaacccacuaacauaucuaagguggcaggugggaaacagggcccagauaaauuuccuucagcuuuucugaagcaccuccuggaccccuaucaguuacauauacuuaugcuuuacuaacuugaucauccaucacaaaaacaaaaacaaacaaaaucuagaaacagugaugcucaaugauauuaaagauggucccuuaucaaaaauuagacagaaacacacaagucaauuugaggaauaaggaacaugacaaauucaauucugaagguaggagucauauuguguuguuaaaaaauaaguuuucauuaacuguaaguucuuuguugcucuugauaagucuguuuucuggggccuguucugccccaagugaugaacaugacuugauuuugaaaagacucuauccuagugacauucugaccuaguggauuaccuuuuccuuucuggaaaccuugucuuguaaguagaaaauuuacccugcuucuucaguagcuuggaaaucauuggucaugcagcugucaguccagugagaagaaggcaagaaagcaauuucacuugaaccuuuucuucaccuuugcguaguuuuuuuuuuuuauuuaaaaauuuuuuaugcaauguacucugaguauaguucucauuccuaacccauauuccccauuuccuuucaaaauuucuuaaucauuacauguauuggugguuugucugcauguguuccugugcaccaugugcaggcugggugcuuguaaaagccaaaagggugugccagacucccugagacugcaguuacagauuguugugaguugacguguggguacugguauuuuuuuauuagauguuuucuucuuuuacauuuaaaauauuaucccuuuuccuaguuuccucuccgaaaauacacgauauccucccccugcuccccaaaccagccucucccacaccuggcccuggcauuccccuauaauggggccuagaaucuucacaagaacaagggccucuccuacugauggccaacuaggccauccucugcuacauaugcaucuaaagacacgagcucuggagguacugguuaguucauauuguuguuucuccuauagggcuacagaccccuucagcuccuuggguacuuucucuagcuccuucguugggggcccuguguuccaucuuauagaugacugagagcauccacuucuguauuugccaggcaauggcauagccucacaggagacagcuauaucagggaccuuucaucaaaauguuguuggcauaugcaauagugucuggguuuggugguuguuuaugggggugaauccccagauggggcagugucuggauaguccuuccuucagucucagcuccaaauguugucucuguaacucuccuuucaugguuauuuuguucccccuucuaagaaggaaugaaguauccacaauuuggucuuccuucuucuugaguuucaugaguauugcaaauuguaucuuggguauucuaaguuucugggcuaauauccacuuaccagugagugcauaucaucuguguucuuuugugauuggguuaccucaaucaggaugauauccuccagauacauucaucggccuaggaauuucauaaauucauuguuuuuaauagcucaguaguauuccauuguguaaauguaccacauuuccauauccauuccucuguugagggauaucuggguucuuuccagcuucuggcuauuauaaauaaugcugcuaugaacauaguggagcgugaauucuuauuacuaguuguagcaucuucuggguauauguccaggacaguauugcuggauuuuccaguaguauauguccaauuuucugaggaacugcuaaucugauuuccagagugguuguaccagcuuacaaucccaccagcaauggagaaguguuccuuuuucuccacauccucuccagcaucugcuguaaccugaauuuuugaucuuagccauucugauuggugugagguggaaucucaggauuauuuugauuuucgucucccugaugauuaaggauguuuaacauuuucuucaggugcuucucacccauucaguauuccucaguugagaauucuuuauuagcucuguaccccauuuuuaauaggguuauuuguuuuucuggaauccaauuucuugaguucuuuauauauauuggauauuaguccccugucaauuuuggauugguaaagauauuuuuccaaucuguugguggccuuuuugucuuauugacagugucuuuugccuuacagaagcuuugcaauuuuaugaguuaccauuugucgauucuugaucuuacagcacaagccauugguguucuguucaaggauuuuuuuuucccuaugcccauaucuucgaggcucuuccccacuuucuccgcuaaaaguuucagugucucugguuuuauguggcauuccuugauccacuuagacuugagcuuuguacaaggagauaagaauggaucaauucacauucuucuacaugagagccgcuagaugagccaacaccauuuguugaaaaugcugucuuauuuccacuggauggauuuagcucuuuuguaaaaggucaagugaccaagggugucaugaauuuguggaucaucaguucuauuccauugaucuaccugucugucgcuguaccaguaccaugcaguuuuuugaucagaauugcucuguaguacagcuugaggucaggcauggugauuccaccagagguucuuuuauuguugagaagagauuuugcuauccuagguuuuuuuuuuauuccagauaaauuugcaaauugcccuuucuaccucggugaagaauugagucggaaauugauggggauugcauugaaucgcuagauugcuuuuggcaagauagccauuuugacuauauuaauccugccuauccaugaccauaagagaucuuuccaucuucugagaucuccuuugauuucuuucuucugagacuugaaguucuuaucauacagaucuuucacuuacuuagagucacaccaagguauuuuauauuauuugugacuauugugaggguguuguuucccuaauuucuuuuucagccuguuuauccuuuguguagagaaaggccacugauuuguuugaguuaauuuuauauccagcuacuucacugaaguuguuuaucagguuuaagaguucucuggugauaucuuuagggucacauauauacuaucauaucaucugcaaaaagugauauuuugacuucuuccuuuccaauuuguauccccaugaucuccuuuuguugucuaguugcucuggcuaagacuucaaguacuauauuuaauagguagggagaaagugagcaaccuugucuagucccugauuuuggugggauugcuuccagcuucucuccauuuacuuugauguuggcuacugguuuucuguuuauugcauuuauuauguuuagguaugggccuugaauuccugaucuuuccaagacuuuuaucgaaaaugaguguuggacuuugucaaucguuuucucagcauguaacaagguauucaugugguuuuugucuuagaguuuguuuauauaguggauuacuuugauggauucccauauauuaaaccauccuugcaucccugggaugaagccuacgugaucacuauggaugaucguuuugauguguucuuggauuugguuugugagaauuuuauugaguauuuuugcauugguauucauaaggaaaauuggucugaaguucucuaucuuuguugagucuuugugugguuuaggugucagaguaauuguggcuucauagaaugaauugcguagaguaucuucuguuucuguuuuguggaauacuuugaggaguauugaauuaggucuucuuugaaggucugauagaauucugcacuacccuuccgcuccacucgagcaccgggguaccuugccagcagaguugcccgacacccgcgagugcccacaaaggauuccccacgggauccuaagaccucuagugaguggaacaccacuuccuucaggaggcaaguucgaacaccagauaucuggguaccuucccugcaagaagagagcuugccugcagagaauacucugcccacugaaacuuaggagagagcuagccucccaggucugcuuauagaggcuaagagagucaccugaagaacaagcucuuaccagagacaacuauaacagcuagcuucagagauuaccagauggcgaaaggcaaacguaagaauccuacuaacagaaaucaagaccacucaccaucaucagaacgcaccacucccaccccaccuaguccuggacaccccaauacaaccgaaaaucuagacccagauuuaaaaacauuucucaugaugaugauagaggacaucaagaaggacuuucauaagucacuuaaagaauuacaggagagcacugcuaaagaguuacaggcccuuaaaaaaagcaggaaaacacaaccaaacagguagaaguccuuaaagaaaaacaggaaaacacauccaaacaggugauggaaauaaacaaaacuauacuagaacuaaaaagggaaguagacacaauaaagaaaacccaaagcgaggcaacgcuggagauagaaacccuaggaaagagaucuggaaccauagaugugagcaucagcaacagaauacaagaaauggaagagagaaucucaggugcagaagauuacauagagaacaucgacacaacagucaaagaaaauacaaaaugcaaaaggauccuaacucaaaacauccaggaaauccaggacacaaugagaagaccaaaccuacagauaauaggaguugaugagaaugaagauuuucaacuuaaagggccagcuaauaucuucaacaaaauaauagaagaaaacuucccaaacauaaagaaagagaugcccaugaucauacaagaagucuacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggccuaucagaauuacaccagacuuuucaccagagacuaugaaaaccagaagagccuggacagauguuauacagacacuaagagaacacaaaugccagcccaggcuacuauaccuggccaaacucucaauuaccauagauggagaaaccaaaguauuccacgacaaaaccaaauucauacauuaucuuuccacgaauccagcccuucaaaggauaauaacagaaaagaagcaauacaaggacggaaaucacgcccuagaacaagcaagaaaguaaucccucaacaaaccaaaaagaagacagccacaagaacagaaugccaacucuaacaacaaaaauaaaaggaagcaacaauuacuuuuccuuaauaucucuuaauaucaauguacucaauuccccaauaaaaagacauagacuaacagacuggcuacacaaacaggacccaacauucugcugguuacaggaaacccaucucagggaaaaagacagacacuaccucagagugaaaggcuggaaaacaauuuuccaagcaaauggucugaagaaacaacauggaguagccauucuaauaucggauaaaagcgacuuccaacccaaaguuaucaaaaaagacaaggagggacacuucauacacaucaaagguaaaauccuccaagaggaacucucaauucugaauaucuaugcuccaaaugcaagggcagccacauucauuaaagacacuuuaguaaagcucaaagcacacauugcaccucacacaauaauagugggagauuucaacacaccacuuucccuuuuuuuuuccauuuuuauuagguauuuagcucauuuacauuuccaaugcuauaccaaaaguucccgauacccacccacccccacuccccuacccgcccacucccccuuuuuggcccuggcauuccccuguacuggggcauauaaaguuugcguguccaaugggccucucuuuccagugauggccgaauaggccaucuuuugauacauaugcagcuagagucaagagcuccgggguacugguuaguucauaauggugauccaccuguaggguugcagaucccuuuagcuccuuggguacuuucucuagcuccuccauugggagcccugugauccauccauuagcugacugugagcauccacuucuguguuugcuaggccccggcauagucucacaagagacagcuacaucuggguccuuuagauaaaaucuugcuaguguaugaaauggugucagcguuuggaugcugauuaugggguggaucccuggauauggcagucucuacaugguccauccuuuugucucagcuccaaacuuugucucuguaacuccuuccaaggguguuuuguucccacuucuaaggaggggcauaguguccacacuucagucuucauuuuucuugaguuucauauguuuaggaaauuguaucuuauaucuuggguauccuagguuuugggcuaauauccaauuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcaugugcccuccuuaccaguuggggcaucuucuggauauaugcccaggagagguauugcuggauccuccgguaguacuauguccaauuuucugaggaaccgccagacugauuuccagagugguuguacaagccugcaaucccaccaacacuggaggaguguuccucuuucucuacauccacgccagcaucugcugucaccugaauuuuugaucuuagccauucugacuggugugagguggaaucucaguguuguuuugauuugcauuucccugaugauuaaggauguugaacauuuuuucaggugcuucucugccauucgguauuccucaggugagaauucuuuguuccguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuaccccacuuucuccucuaaauguuucagugucucugguuuuaugugaaguucuuugauccauuuagauuugaccuuaguacaaggagauaaauauggaucgguucgaauucuucuacaugauaacaaccaguugugccagcaccaauuguugaaaaugcugucuuucuuccacuggaugguuuuagcucccuugacgaagaucaagugacccuagguguguggguucauuucugggucuucaauucuauuccauuggucuacuugucugucucuauaccaguaccaugcaguuuuuaaucacaauugcucuguaguaaagcuuuaggucaggcauugugaucccaccagagguucuuuuauccuugugaagaguuuuugcuauccuagguuuuuuguuauuccagaugaauuugcaaauugcuccuucuaauucguugaagaauugaguuggaaauuugauggggauugcauugaaucuauagauugcuuuuggcaagauagccauuuuuacaauguugauccugccaauccaugagcaugggagaucuuuccaucuucugagaucuucuuuaauuucuuucuucagagacuugaaguuuuuaucauacagaucuuucacuuccuuaguuagagucacuccgagauauuuuauauuauuugugacuauugagaaggguguuguuucccuaauuucuuucucagccuguuuauucuuuguguagagaaaggccauugacauguuugaguuaauuuuauauccagcuacuucaccccgaagcuguuuaucagguuuaggaguucucugguggaauuuuuagggucacuuauauauacuaucauaucaucugcaaaaagcgauauuuugacuuccuccuuuacaauuuguauccccuugaucuccuuuuguugucgaauugcucuggcuaauacuucaaguacuauguugaaaagguagggagaaagugggcagccuugucuagucccugauuuaagugggauugcuuccagcuucucuccauuuacuuugauguuugcuacugguuugcuguagauugcuuuuaucauguuuauguaugggccuugaauuccugaucuuuccaaaacuuuuaucaugaauguguguuggaucuugucaaaugcuuuuucugcaucuaaggagaugaucaugugguuuuugucuuugaguuuguuuauauaauggauuacauugauggauuuucguauauuaaaccaucccugcaucccuggaauaaaacccugcaucccuggaauaaaaccaggauggaugauugcuuauuguguucuuggauuugguuaucgagaauuuuauugaggauuuuugcaucaauauucauaagagaaauuggucugaaguucucuaucuuuguugggucuuucugugguuuagguaucagaguaauaguggcuucauauaaugaguuggguagaguaccuucuacuucuaucuugugaaaaaguuugugcagaacuggaauuagaucuucuuugaaggucugauagaacucugcacuaaacccgucugguccugggcuuuuuuuuggcugggagacuauuuauaacugcuucuauuucuuuaggggauaugugacuguuuagauggucaacuugauccugauucaacuuugguaccuaguaucugucuagaaauuuguccauuucguccagguuuuccaauuuuguugaguauagccuuuuguagaaggaucugaugguguuuuggauuucuucaggaucuguuguuaugucucccuuuucaguucugauuuuguuaauuaggauuuugucccugugcccuuuagugagucuagcuaaggguuuaucuaucuuguugauuuucucaaagaaccaacuccuaguuugguuaauucuuugaauaguucuucuuguuuccacuugguugguuucaccccugaguuugauuauuuccugcuuucuacuccucuugggugaauuugcuuccuuuuuuucuagagcuuuuagauguguugucaagcugcuaguaugugcucucucccguuucuucuuggaggcacucagagcuaugaguuuuccucuuagaaaugcuuucauugugucccaaagguuuggguacguuguggcuucauuuucauuaaacucuaaaaagucuuuaauuucuuucuuuauuccuuccuugaccaagguaucauugagaagaguguuguuccguuuccacgugaguguuggcuuucuguuauuuuuuuuuuuuuuguuauugaagaucagccuuagugcauggugaucugauaggauacaugggacaauuucaauauuuuugaaucuguugaggccuguuuugugaccuauuauguggucaguuuuggagaagguaccaugaggugcugagaagaagguauauccuuuuguuuuaggauaaaauguucuguagauaucugucagauccauuuguuucaucauuucuguuaguuucagugugucccuguuuaguuucuguuuccaugaucuguccauuggugaaagugguguguugaagucucccacuauuauugugugaggugcaaugugugcuuugagcuuuacuaaaguuucuuuaaugaauguggcugcccuuguauuuggagcauagauauucagaauugagaguuccucuuggaggauuuuaccuuugaugagaacgaagugccccuccuugucuuuuuugaugacuuuggguuggaagucaaucuuaucagauauuaggauggcuacuccagcuuguuucuucauaccauuugcuuggaaaauuguuuuccagccuuuuauucugagguagugucuaucuuuuucucugagaugugucuccuguaagcagcaaaauguugggucuuguuuguguagccaguuuguuagccuaugucuuuuuauuggggaguugagaccauugauguuaagagauauuaaggaaaaguaauuguugcuuccuguuauuuuuguuguuaaaguuggcauucuauucuugugacugucuucuuuuagguguugaggaauuaccuucuuguuuuuucuagggcguuguucccauucuuguauugguuuuuuucuguuauuauccuuugaagggcuggauucguggagagauaauaugugaauuugguuuugucguggaauacuuugguuucuccaucuaugguaauugagaguuuggcuggguauaguagccugggcuggcauuuguguucucuuagugucuguauaacaucuguccaggcucuucuggcuuucauagucucuggugacaaaucugguguaauucugauaggcuugccuuuguauguuacuugaccuuuuucccuuacugcuuuuaguauucuaucuuuauuuagugcauuuguuguucugauuauuaugugucgggaggaauuucuuuucugguccagucuauuuggaguucuguaggcuucuuguauguucauagauaucucuuucuuuauauuugggaaguuuucuucaauaaauuuguugaagauguuugcugguccuuugaguugaaaaucuucauucucauccacuccuauuauacguagguuuggucuucucauuguguccuggauuuccuggauauuuugaguuaggaucuuuuugcauuuuccauuuucuuugauuguugugccgauguucucuauggaaucuucugcaccugagauucucucuuccaucucuuguauucuguugcugaugcucaaaucuaugguuccagauuucuuuccuaggguuucuaucuccaguguugccucacuuugaguuuucuuuauugugucuacuucccuuuuuaggucuaguauuguuuuguucauuuccaucaccuguuuguauguuuuuuccucuuuuucuguaaggacuucuaccuguuugauuguguuuuccuguuuuucuuuaagaacuuguaacucuuuagcaguguucuccuguauuucuuuaagugaguuauuaaauuccuucuugauauccucuaccaucaucaugagauaugcuuuuaaaucuaggucuagguuuucggguguguuggggugcccuggacugggcgaagugggagugcuggguucugaugauggugaguggucuugguuccuguuaguaggauuccuacguuuaccuuucgccaucugguaaucucuggaguuaguaguuauaguugacucuguuuagagauuguucuucuggugauucuguuaccgucucucagcagaccugggagacagauucucuccucugaguuucagugcucagagcacucucugcuggcaagcucucuuacagggaaggugcgcagauaucuuguuuuuggaccuccuccuggucgaagaagaaggcccaaaacagggccuuucucagcagcuguguugcuuuggcaguucccagaagcugucagcuucuguggugcagacucucaccugugcagacuaaauuccuaaguuccagggaguccuggaaccaagauggcgaccucuguuccugaggcugaggccgccucccgagccaggcggacaccuguccucugguccggaugguggccggcugucugcagccugcaaaggguacuuacugccucagcggcucugugcuuccgccugucccagaagcuguccgguucucuggcacacccucuaaccuguucagacuaauuuccuaaguucugcggagucccggaacccagauggcgaccgcugcugcugaggcugaggccuccucccaagccaggcagacaccuguccucugguccggacaguggccggcugucugcggcccgccaagggugcugccucugcggcucugugcuuccgccugucccagaagcuguccaguucucucaacacaccacuuucaucaauggacagaucguggaaacagaaacuaaacagggaaacagugaaacuaacaaaaguuaugaaacaaauggaccugacagauaucuacagaacauuuuauccuaaaacaaaaggauauaccuucuucucagcaccucacgggaccuucuccaaaauugaccauauaauuggucacaaaacaggccucaacagauacaaaaauauugaaauugucccauguauccuaucagaccaccauggccuaagacugaucuucaauaucaacauaaauaauggaaagccaacauucacguggaaacugaacaacacucuucucaaugauaccuuggucacgaaggaauaaagaaagaaauuaaagacuuuuuagaguuuaaugaaaaugaagucacaacguacccaaaccuaugggacacaaugaaagcauuucuaagagggaaacucauagcucugagugccuccaagaagaaacaggagagagcauauacuagcagcuugacaguacaucuaaaagcucuagaaaaaagggaugaaaauucacccaagaggaguaaacggcaggaaauaaucaaacucaggggugaaaucaaccaaguggaaacaagaagaacuauucaaagaauuaaccaaacgaggaguugguucuuugagaaaaucaacaagauagauaaacccuuaacuagacucacuagagggcacagagacaaaauccuaauuaacaaaaucagaacugaaaagggagacauaacaacacauccugaagaaauccaaaacaccaucagauccuucuacaaaaggcuauacucaacaaaacuggaaaaccuggacgaaauggacaaauuucucgacagauaucagguaccaaaguugaaucaggaucaaguugaccaucuaaacagucacauauccccuaaagaaauagaagcaguuauuaauagugucccagccaaaaaaaaaaaaaaaaaaaaaaaaaaaaaaccccaggaccagauggguuuagugaagauuucuaucagaccuucaaagaagaucuaauuccaguucugucaaacuauuucacaaaauagaaguagaagguacucuacccaacucauuuuaugaagccacuauuacucugauaccuaaaccacagaaagacccaacaaagauagagaacuucagaccaauuucucuuaugaauaucgaugcaaaaauccucaauaaaauucucgauaaccaaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucuccuuagaugcagaaaaagcauuugacaagauccaacacccauuuaugauaaaagucuuggaaagaucaggaauucaaggcccauaccuaaacaugauaaaagcaaucuaccccaaaccaguagccaacaucaaaguaaauggagagaagcuggaagcaaucccaguaaaaucagggucuagacaaggcugcccacucucucccuaccuuuucaacauaguauuugaaguauuagccagagcaauucaacaacaaaaggagaucaaggggauacaaaguggaaaagaggaagucaaaauaucacuuuuugcagauaauaugauaguauauauaagugacccuaaaaauuccaccagagaacuccuaaaccugauaagcugcuucggugaauuagcuggauauaaaauuaacucaaacaugucaauggccuuucuuuacacaaagaauaaacaggcugagaaagaaauuagggaaacaacacccuucucaauagucacaaauaauauaaaauaucuaggugugacucuaacuaaggaagugaaagaucuguaugauaaaaacuucaagucucugaagaaagaaauuaaagaagaucucagaagauggaaagaucucccaugcucauggauuggcaggaucaacauuguaaaaauggcuaucuugccaaaagcaaucuauagauucaaugcaauccccaucaaaauuccaacucaauucuucaacgaauuagaaggagcaauuugcaaauucaucuggaauaacaaaaaaccuaggauagcaaaaacucuucucaaggauaaaagaaccucugguagaaucaccaugccugaccuaaagcuuuacuacagagcaauugugauuaaaaacugcaugguacugguauagagacagacaaguagaccaauggaauagaauugaagacccagaaaugaacccacacaccuagggucacuugaucuucgucaagggagcuaaaaccauccaguggaagaaagacagcauuuucaacaaucggugcuggcaaaacugguuguuaucauguagaagaaugcaaaucuauccauacuuaucuccuuguacuaaggucaaaucuaaguggaucaaggaacuucacauaaaaccagagacacuuaaacuuauagaggagaaaggguaaaaaagccuugaagauaugggcacaggggaaaaauuccugagcagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaugugacagcagaugcuggcguggauguggagaaagaggaacacuccuccaucguuggugggauugcaggcuuguacaaccacucuggaaaucagucuggcgguuccucagaaaauuggacauaguacuaccggaggauccagcaauaccucuccugggcauauauccagaagaugcccaaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaaguaugaauuuaugaaauuccuaggcaaauggauggaccuggagggcaucauccugagugagguaacccaaucacaaaggaacucacacaauauguacucacugauaauuggauauuagcccaaaaccuaggauacccaagauauaagauacaauuugcuaaacacaugaaacucaagaaaaaugaagacugaaguguggacacuaugccccuccuucgaagugggaacaaaacacccauggaaggaguuacagagacaaaguuuggagcugagacgaaaggauggaccauguagagacugccauauccagggauccaccccauaaucagcauccaaacgcugacaccauuucauacacuagcaagauuuuaucuaaaggacccagauguagcugucucuugugagacuaugccggggccuagcaaacacagaaguggaugcucacagucagcuaauggauggaucacagggcucccaauggaggagcuagagaaaguacccaaggagccaaagggaucugcaacccuauagguggaacaacauuaugaacuaaccaguaccccggagcucuugacucuagcugcauauguaucaaaagauggccuagucggccaucacuggaaagagaggcccauuggacaagcaaacuuuauaugccccaguacaggggaacgccaaggccaaaacgggggaguggguggguaggggaguggggguggguggguaugggggacuuuugguauagcauuggaaauguaaaugagauaaauaccuaauaaaaaauggaaaaaaaaauaaauuaugaacaaaaaaaagaaaaaagaauaugaauaaauaaaauaauauacuccaugcauguagcacuacuuaaagguaaaaaugcaauuccaugugguggcgcacgccuuuaaucccagcucuuaggaggcaaaggcagggugauuuuugaguucgaggcgagccuggucuacacagugaguuccaggacagccaaggcuauacagagaaacccugucucaaaaaacaaaacaaaacaaaacaaaacaaaacaaaacaaacaaacaaacaaaccaaaacaaaacaaaaagcaauuccagcaacauguucuacauuuacauuaaauaccuuaaauuuuugacaguauaagucacucuggaggagagcuuuacugggaagcugaauaaaauaacuuucuacacugugaaaauuaagugacacuaaacaaaaaaagaaaaaaaagaaaaagaaagaaggaaagaaagaaagaaagaaagaaagaaaggaaagaaagagaaaagaaaaaaaaaagaaauaaaaguuccuucuccuucccucacagaccucuacuauuuuaagucaaauaugaagaauuauacauuagcaauuugaaaacauuuagguauuucaggaagucagugguaagucaaauaugaaggauuaaagcauuugaaaggauuuagguguuucaggaagucacggaucugucagcccauugcugccaaccuagugcugaauuuauccugccuuguucuacuuucacugccagauguugauauugugauuuuccugagucagaaauaagauugcuaucuuggaaguaugccaaaggacuucacauacgacgaacagaacauuccuguuaaaaacucugugguuuguagagaagcuuguggcuuucuaagauguggaaauaagcaguguauuuuuuuugguacagcguuaaugaaugcaguuacaaacuaugcucacaaacacauagaaaaugaacacuucuauguagaauuaaaacaggucaauacaaaagugaaaaaauaaacuaaaacuggagagaugucauaguagcaauggagcagcacaacugaaaacuccucacaaaaaaguaaccagggccaagaagaguagacagcaaaaaauaaucuuacucaggguugaaauauaaggaaucaaugaaauaaagaguuggauuuuugacaaaauuaacaagauagauaaaccuguaaccaaacuaacuaaaaguugaagagaggguauccaaauuaacuaaaucagaaauaaaaauggggacguaauaacagacacucagaaaagccagagaaucuuaagacauacuuuaaaaaccucuacuccacagaauuggagaaaucaagaggaaauggauaauuuuaucgauagguaucacauuccaaauugaaaucaacaucagauaaauauauagauauauuuaaccaccaguggaauuaaaacagucauuaauuaucugcaaacuacaaaaagcccagugccagaugguuuuagagaaaauucuacaacuuucuaagaacaguuaaaauuaauacacgccaauuauuccacaaaagauaaaaggaaggaaugucgccugucuuaggguuuuacugcugugaacaaacaccaugaucaaugcaagucuuauaaaggaaaacauuuauuuggggcuggcuuacagguucagagguucaguccauuaucaucaaugcaggagcauggcaggauccuugcaggcauggugcaggcugagcugagaguuccauaucuucaucugaaggcugcuaguggaagacugacuuccaggaagcuagaaagagggucuuaagcccaugcccacagugacacaccugcucuaacaaggccaaaccaccuaauaauacgauucccuggguuaaguaaauacaaacccuaauaaaaccuaauaaaauucauuuuauuaggcaacaguuauccuaauacccaaccauaaaaacauacaaaaaagaguauuauagaucaaauguccuuaugaguauacauggaaaauacucauaaaauauuugcaaagagaauccaagaacacauggaaaagaucagcaaacaugaucaaguaggcuuuggcucagagaugaaaggaucauucaagauacaaaaaucaauaaauacaaucuaccacacaauaaacugaaaacaaggcaugaucaucucauuacaugcugaauaggccuucgacaauacugaacauuccuucccuauaaaaguccuauacagauaaaagauaugagguaaauacauaaacauaauacaggcaucuugcagcaggccuagaaucaagaucaaauucaauguugagaaacucaaagcaauuccacuaaaaucaggaacaagcugaugguauccacucucuccauaccuauuuaauaaaauaauugaagucuugguuaaaguuguaagauaaccguaggagaucaagaagauacauauuggauuggaaagaagaagucaauauccuaauuuguaauugauuagauaguauacauaagugauccaaaauuuuccaccagggaacuucaauaucucuuaaacacuuuccccaaaguagcuaaauaacaaauuaaugcacaaugagauuuuucuauauacagaaggaugaagggggaaaaaaaucaggaaaacaacacuuuucacaauugccucaaaaauauauugguauuaucuguaugcucuugagguuuccuuuuuuguuuuuauuuuaaugcuaaauaguggccccaaggccuaguugcuucuagggaucagagcaccugcaggcacccaagugaagcucuuuaaccuugcuucccaagauaucccaaauuggccaaucaacaugcuuacagccaauagcuggcagaagagagauaagcuugggagagggaaacaaagaauagcuguggagacugaggaaaacauauggacuaagagucuuagaauaauggccacguuggcuggcuaauuggaguuaaaagcagcccagauaaaacaugggaaaauauaacaagauuaauaucugugaaauagacuuaauaauaucauagagaauagauaacuucccagcucuggugcugauaaugcuuauuauaaagauuaugaguucuuuuauccaggaaguuuauccagaaagugaauaaucaaaggcuggguagaaacuaagguugggauuaaauauuuugcacaacacuaugcaagcaacugaaagacuuucaugauaaaacccccagucuuugaagaaauaaauugaagaagauauuuaaacuugaagggaucuuccgugcucaugaaucaggaggauuaacacaguaaaaauguccauccuacccaaagaaauuuauacauucaacacauucuuuauccaaauuccagccuguauguuauaggcaagagggauaaagugaugugccaggcacaaaugcccuuucccuugaaaauucaugcagcucuaugcccauuuucuuuaccauccugauccugacugugaauccccugugcguagaacuuuauauguuguaaacucauggcauaaucuuauuuuucuggcuaucaaaauuucugugcuaucauuguauuuucucuuacaugaauugggacuuaugcuggugcucucuuccauauuaugauugauagacuauuuacacaaaaauauucuugaaaaacuauuaucuauucuaucuaacauuaucuauucucuuugcuaugguggccaggacaaugcugcugaguuugacuuuauccaugcuuuccccacugcccuguucuacucguugcacuuucuauagucaccuuugucccggagcuccacaucuccccucucaucauucucugucccaaaucuuuuaauccacauuuacuuaugauuaguccuucucauacuucauguauauuuugagucagguuuucggagggagccaggcuuuuuuaaauuuauuuuuaguauuuuguguugggaauggaagaaaggaaaacggaauuuaggguguugguuauauuuugcugugcgguuuuuagcccaggaagcuuguauuucaagcuaaaaagugaggcugccuaucuauuaucugagagguuuagaacuaucagauauuagggugcagcauccuuccaggacaaccugacagcugaagcagcguggcuggaagccugagacgaaguggaaggaaccagaauccccgaggcagggguaggggaguccgggugggggggggggguguuacuggaacgaccgggaaagugacagcgaaaagaaagaaucuggguggacucuacaaaaacaauuaagugcugauagucuucaaaggaguuacgucaccggaacccggguauggugggcgggucuaagagagcugcuccaaagacugacaaagauuuccugccaggagugacaggaaaauccucaauucacuuccuacgugaaugcauuacgcgguaaccguaaccgugggcugguuucccagagagaacccguguccuagaucucucuggaccccgggaaacucuccucagaccggguuuccuagcugugggccugggagagucggcagugagcagcccagcggugggcaccgcagcccggcgucccuggaacuucccaggucagaggagcugcggggcaggagcggagaggggugugugcagcugcuuaaggaagcagcucucagugauucuauuguggauaucuuacaguuguggggcaguuugagaucuuaugaacugcaguuuauaguguucuuuuuauuuaucuuacacuuaccggaauaaucagucauaaaguaacacguuaaaaaucugguaauuuagaucugcuguuuguuuucgugucaguuauaaagcuccaagacaauaaauucauucaugcuuucuuacuccuuucuuuuacuaacugguuauucaagagaaugccuuuggcuccuguuaacagguauccacauagauaacuuuguguacaauaauuauaugaggaaauagugcaguuuuuauugaaccagaaaauuuacuucagugagcaaaacuguuauugcuguaaacauuaacauucauaggcagaauuuuuuuuaguggccaugauuuuuuucaucuggguuguaugcaguuuagauguaaguaaagccuuuagaaaugcaucuucauauggugaguuuuuaauguuauaccuuaguuccaggcaagcccaguauugcuaugugaguauaucagaccacaccauuuaaguagaaaacccucuauagauuaaaauaaaguguuagaaagcaucuuuugaauaauuaugauauuucaccuuuauaggaaauuugucuccuugguugaagaaaagcauucugcccuaacauauguggccaaacaauuguuuggguuuuuuguuuguuuguuugguugguugguuuuuuaauuucaugguuuguuaacauuuagugcugugacuguacacuucucguaggaggagugggaaugccuagacccugcugacagggcuuuuugcagagaucucccuuuggacaagugcagcagucugguuucugugggugacaaugguuuucuugcagucuccccagcuccuccccaggauuccugauagaaugacucugcuugugucugagcugugugugagugagccucacaucuuacagaguacauucaaauccuuacaggaaaggagacauuuuuaguugugauauuuucucuuuccuuuauauuuaucuuuggaagugucauguauuuuccuucuaugaaaaguucugggugcuuuuugaagaaucucuuucccauacacaggugucccacuccucagccaguucugcucaccugugagucugaaccaagagcccuggauggugaagagaagaagcuguagcaaaggauccagguaugguagaggaauuaaggaaggaauguugaggggcucaauucacaguagaaagaaagaggacaugaaauugguuuggccagauucuauuucauuccaaauguuucuagauaauuguacgagaauaaugucagaauguucccuugauagguauuagaagacucucuuugugagaauuaauacacagaggcaaauguaauuuaauuugguuuuguaugugagggaugcugucuaccucccacucacauccacugaucacaucuucuuaccaauauuaaauauuuucauuauuauauuuuuaauauacuguuuugucagaacaauugaugccuccuaguuuuuccugcucuuagacuuuuagagcaguuugcauuuccuuuguguucucuaucagucgugcuuaauuucuccauuuccuaauauaaugcucacagaauguugauauuuguuugcuuaauaucucugcauaguauuaaacucugucuauauuaccuucccauugauaucuacucuuagucuuccuauccucaaugcuuugcacugcuauaguuuuaauaucuuuugaagucacccuuccauuugacgcuuuuguccuaguuuuuaaaauucuuuuugguuucucaauguuucaaaauguuaguaugauuuugguauuuugaaucuuaaaaacauucuguaauauuucuucacauguuugaaugagaacaugcuugcagugacucaauauucaugucuuuuaugugcucuucugucuuguauuaaugucagaauuccagguucuuagagaagacauuuuuuaaacuguaaucuuuacuaggcuugaagacuuuuacauuguuguuacuacugauuuuuuagacauauuguuuagguagucuuggcaguucugaaacucuuuguagauaaggcuucucuugaacauagagaucugcugcccuagucuguugagugcugcuggaauagaaggcuugcaucaccaacccaaggugacguuuuucauggccacauuggagaguaguguaugacauuugagaauauugugcuucuucugcuguuauaugccugguuuucuguuggcaucuuacucauuacugccucuuugugcuauucauggucgccuuucucaaagguggacuuuguuuauuuaguuauuuucuuucuuuuauucuauuuucccuuuuuuuaauuagauauuuuauuuguuuagauuucaaauguuauccccuuucccuguuuccccucugcaaacccuguauucuaucccccuuacccugcuucuaugagggugcucccauacccacauacccacccacuccugccucaccauccuaacaugccuguacauuggggcauccagccuucacaggaccaagggacuccccucccauugaugcuaaacaaggcccuuucagcuccuucaguccuuccccuaacuccuggggucccugcacacagucuaauaguuggcugcaagcauccacaucuguauuggucaggaucuggcagagccugucaggagacagcuguauuaggcuccugucagcaagcacuucuuggcaucugcagguggaauggauccccaggugggucagucucuggauggcuuuucuuuccgucucuguuccacucuuugucccuuuauuuccuuuagacaggaguaauucugggugaaaauuuugcagguggguagguggccccaucccucaaccgaggugggagggcaugacuaaccacuggauauggucucuacaggucagcuaauaucauccccaugggguccugggaaguccuugcuguccuggcuuuugagacuuuuuggugcuacuccuaguuccccaucccccauugcuacauaccucuguucaauuuccucuacacuggggcacccagccaucacagguccaagggccucccucccauugaugcuaaauaaggcccuuucagcuccuucagaccuuccccuaacuccuggggucccugugcacagucuaaugguuggcugcaagcauccacaucuguauuggucaggaucuggcagagccugucuguacaucucuuccaucuccucccauaccugauucuuccccucuuuuccccucccccuucucuuuuccucccaagucccuccaaccuucuacuucccuugaucauauuguucccccuucuaaguagaacugaaauauccauucuuuggucuuccuuccucuugagcuucaugugguccaugucuaguggguauuccaugcucuuugccuaauuuacacuuauuagugaguacauaccauguguguuuuuugugacugaguuaccucacucaaggugauauuuucuagauccauccauuugccugcgaauuucaugaagucauuguuuuuuaauagcuaaguaguacuccauuguguaaauguaccacauuuucuguauccaucccucuggugaggggcaugugggcuguuucaugcuucuggcuauuauaaauauggcugcuaugaacacaguggagcaugugcccuuauuacauguuggagaaucuucuggauauaugcccaagagugguauagcuggguccucagguaauaauacuguguccaauuuucugaggaacugccagacugauuuccacagugguuguaccagcuugcaaucccacgagcaauggaggaguguuccucuuucuccacauccuugccagcaucugcugucaccugagguuuugaucuuagccauucugacuggugugagguggaaucucaggguuguuuugauuugcauuuccaugaugacuaaggaugaugaacauuuccuuaggugcuucuauuaaggaauagugacuguugcuuccuguuauuuuuguuguuagagguggaacuauguguggcuaucuucuuuuggguuuguuaaaagaagauuacuuucuugcuuuuucuagugccaagauucccuccuuauguuggaauuuuccaucuauuauccuuuauagggcuggauuugugaaaagauacuguguaaauuuuuuucuuuugucauggaaucuauugguuucuccauuuaugguaacugaguuuugcuggguauaguagccugggcuggcauuuguguucucuuauggucuguacaaaaucugcucaggaucuucuaguuucauaaucucuggugagaagucugguguaguucugauaggucugccuuuauauguuacuugaccuuuuucccuuacugcuuuuaauauucuuucuuuguuuugugcauuuaguguuuugauuauuaugugacgagaggaauuucuuuucugguccaaucuauuuggaguucuguaggcuucucauguguuuaugggcaucucuuacuuuagguuagggaguuuuuuugcuuauaauuuuguugcccuuuaaguuggaauucuucucucucuucuauaccuauuauccuuagguuucaucuucucauuguguccuggauuaccugaauguuuggguuaggagcuuuuugcaguuugccuuuucuuugacuguugugucaauguuuucugugguaucuucugcacugagauucucucuucuaucuccugcauucuguuggugaugcuuacaucuaugacuccugaucucuuuccuagguuuucuaucuccaggguugucucccuuugugauuucuuuguuguuuuuauuuccauuuuuacauccugaaugguuuuguucaauuccuucaccuguuuggauguguuuuacuguaauucuuuaagggauuuuuguguuuccucuuuaaggacuucuaccuguuuuaccuguguucgccuguauuucuuuaagggaguuauuuauguccuucuuaaaguccucuaucaucauucugagaugugauuuaaaaaucagagucuugcuuuucuguuguguuggaguauccagugcuugcuguagugggagaacuggguucugaugaugccaaguagccuugguuucuguugcuuauguucuuguacuugccucucgucaucugguuaucugugguguuagcuggucuugcuaucucugacuguggcuugugccuccugcaagccucuaugucaguacuccugggagaucagcucucuccauguggaauuuggauauggauagcuguggcacagggucaacuccaggauauagauggaaaccagaagcauucuaucccuggcuauuccuugguuccuguguccugaagacucugggugggucccuuuugugccaggaauuugagcagaaagaguggucucaccugugcuaucaggugugucagcacuccugggagaccagcucucuccuggcuggauuuggguauggagagcuguggcacagggucagcucugggggugcagaaggaaaccagaaggauccugucccuggcuauuccuccauuccuauguccuuauggcucuggauggguuccucuugggccuggacuuugagaagaagugguggucuuaccuguucucucaggugacacacagucucugccagagaagagccagguagucaaaggagugucccaugagcaaacugcauuuagaggcacccuugaacaagagguuaggguuuguuucucucuuggucaaucuggcucucaaccaggcugauccugaagcaaauaucucagggaacugaucagggaugauuuaaagagccugguaacaacagugagauuccaggauucccuucaguugacuccccccgcccccgccccaguuucugagguuuaguccauuaucaucauggcagaaaguauggcggcauucaggcugacagggcaguugaggacagcaaagacucucaaugguggacuuucaagcuuaccuguaucaccaucuaucugcuuucuaaacuucugucauugauugcuucaugugcuugaaaacauguauaaugcauguuuugugaaaugcauucauguucaucauauaguuuucuggaauuguaccauuugaucauuuguuaauagucuuugcuuuauaaguugauagguuuuucuuuuucucuuaccugcugaaauugugaccaaccaucuuggcaggaaaucuuuaaacaauuucuuugagucuuagcaguuuuuauucuuuuuuuauauuuuuaauaaaguugguggcauuguaaugggccagcuuaagaggcauugguggcucugaagacaugaaccauuaugucagguuuuuaaaauaacugaguaguauuccauuguguaaagguaccacauuuucuuuauucuucccuugagggucaucuagguucauucuaauuccuguauauuuugcacaaaguugcaaugaacaagcaagggcccuugggguagguuggaguguucuuugggguagauacuguagagugguauggguggaucuugaaguaguuugauucccaucaauuugaggaaugaccacaaugauucucuuaguggcuauacaaguuugcacucccugcagcaauggaggaauauuucuguugcuccacauccucuccagcaugagcucucacuuguauuauugauuuuagcuauucugacaaguauaagaugggcucucaaaguaguuuugauucgcauuucccugaaggauaaggguguugaaaauuuuuuagauguuucuugacuauuuugaaguuucuccauuuaaaauuuucugcuuaauugaauuauuuguuuauuuuuaacauccaguuuauugaguuauuuuauauuuuggauauuaggucucuauuggaugugaaauguuuaagaucuuuucccacacuguaggcuacugcuuuguccaaaugauagugucauuugccuuauagaagcuuuucgguuuccugaggucccauuuauuaguuguuguucuguauaccugugcuaauuuucuuuuccuuuaaagaaagucaucuccugugacaauauguucacuuuucuuuccuacucuauuuucuguuagauucauagugcuugauuuuauacugagguccuuauuccauuugcacuugaauuuugugcugggugauaagauuggauucacuuucauuauucuagaugcagacacccaguuagaccagcacuauuuguugaagaugguaucuuuuuucaguuuguauuccuggcuucuuuaucaaaaauuagauggccauauguauuuaugccuaggucuucaguucauuuucagugaucaaugugucugcuuuucugccaauauuuugaggauuuuagacuaguuuugaagaaaacuugaaauugggaguggugagaacaccagaaguucucuuauuguucaugauuguuugagcuauuuuacuuuuuuuuuuuuuuugcuuauuuauauaagugugaauuuaccaauuuaaaaugugugaaaaguuguguuggaauuuggaugaggaaauccuugaaucuguagaucucuuguuguagucuuaguaucuuaauccucuugauccacaagcguggaagucuuuccaucuuuuaauaucuucuucaauuuuuucaaagucuugaagcuuuuauuguacaaguuuuucacuuguuugcacaguuaccaucaacauuuguauauuauuuuaggccauuguauaauguguuauuuucuugauuuuuauuuuuaaaaucaguuuguaucucuuauauaugaagguuauugauuuuugugcauugauuuucuuucagcuauuuucaugucuuuuuuuccaguuuguuuuguauggugaauuauauuuauugauuuuuguauacuguaguauucuuucaucucuauuacaaugccugguugaucaucuuuggugaucuuccugauguguucuuagauucucuuugcaaguauuuugugaguauuuuugcauguauguucauagaggaaacuggucuguaauuccccuuuuuaguugcaucuuuaugugguuuuuguuguaucuguauguaguuuggguaucaggauaauguggcuugauaaaauauccacuguucuuaugaaauaauuugaggaguauuaauuuuagcucuucuuuguucuuugaaaguaguaucauucugggcuaaaaccaucucuuccuugguggugguggugguggugguuggggacuuuuaaugaccccuauuuuacuagggguuagauaauucuauuugcuuauaugauguugauaucacuuuggaaugugguaccuacugauaaaauuauccauuucuuuuacaucuuucaguuugcugaguagaaguuuuuaauauuuuaugagucucuggauuuccucaguuucuguuuuguuucugauuuugcuuauuuagauguuuucucucaaccuuuuaguuaguuugaauaaaguuuugucaauuuuguugacuaugucaaagaagcaacucuuuguuucauugauuccuguauuguuuucuauauuucuauuucauugauuuuagccuugacuuugauuuuuaaaauuuauuuauuuauuuauuuauuuauuuauuuaugcuaucuauacucuuucuugggcuugauuacuuuuuuguauguggaaguuuucaguugugcugcuuaguugcuaggaugacaucucugcagauuuaguuuguuccuuucuugucuuaacccauuuuuaaugcaauaagguugcucacuuuccauuuguuugugagcaugacauaacugaauucuucaagacaacuccaaaugcacugcuuauuucugcaccuuagauggccacaaacuucuccauaaacaacuacauuuucaaaauggauuuuugguuuggcauauuagagggccuuuagcauucuucccagaagacaaaauuauucaugacuuagcacuaucacaauaucaccaucuagugaggaaagcuacagcacaggaugaauucagcaguaggauugaauuggcugagagaccacugacuuccugauauagagguacagugucccacuguuagacucagcuuaggucuaggcugucaggaaacauauguggaugcuguacagagcauguccaaggcagcauagcagcuugagcuaugagguuguacaugagugggagggaccagucuuuauggggcagggauaguaugaagacuaggagugugagguggggggaacuaguggaauagacucuacaaagguaauuaaggaagaaaaggcaccugaccugaaaggguuuaagguaccaggaauaggaacagagcugugauggacugcuggaaaagccgaagguacucuuaaccagugaaccaucucucuagccccaacugcacuugaaaagauauuacauaaucugaacuggagagaaaucuaaacuguagugauaauggcaaauccuuuaucugcuacucaaaaaauuugugguggaaaaagaccagaauguaugucauguaauaagccauuguguacauuguauauugaaggacugcagugccuaacugcugagaauccuuuauagcacuuuuggaaaacuuuagucuuugaaauacugcaauaccucaccuauaucacaaaagugucacuaauaucuuuggucuuuuuaccucagcaaacauuuugucccgcagcauauaauaaaugaguaauugucaauugcagggucuguuaauggucaugaauguggcuguggaauacccagaggaggaaugggaguauuuagacugugcucagaggauauuguacauauaugugaugcuggagaauuauagccaccuauuuuuuguagcuaaggaugcucuucuuauagacugccugauacauccuuuguauuuacuugcuuuguauauguaaacucucuguauugucuaaagauccucagaaauaagggguaaucugguuuucaacauaacccuaucauggugcuuccuuuaccugugugugugugugugugugugucugucugucugucugucugucuguaugugucuguguguguguuucugugugugucugugugucuguguguguguucucuagaaguaugacaaguguuauauucugaauguucucuccaucucucuuauuuucucuuuaaguaaaaggcagcaauacuuuguaagcauacuagauacagcagugauaugagcaauggagagagcucagguggugugcugguacaagccaugcgaagcaggccaaucaagaagaccccuccaagaccugugugucauuuaccaccuccaggauccuuacagagcauuuucaguauuuuuacacuacaagacaguuagggaaucauuuguagaauucucuuugcccacugacacuguaaugucuuagaaauucagaugaauucugaagaauuuuuuuucuuaauauugaagucuaagucauaagccaaacuuguuccacugugaagcagaagaaagaauccaguaagggggagagaaaaucuauagcaaugagaucauugaauauuuuggaggaauggaaguaagauuagugaggauuuuaagugagaguggaaaugagauggagaggggaauggaagagaugucccaguagugaauagcacuugcuugucuuaaaaacauguggauuauuucuuagcaccucauaauuuuuuagguucuaggaaaucugaugacuucuuucgagcucaguaggcaccaugcacaaacacagaacuuguauauaccucguguauaacacuacuacccauacacuaaaauaaaaauguaauaaaagguuuugaaagcaaugagacuaaaugggacaugagauugauuuugucccguuugauuuauauagaaaugguucuagaauauucuaccauaugucaucuccugauuaaccuauuacacucaauccugccuuccuugguaaugauaaauaauaguagaagaccuaauuuauuugacuaugcauguguaugaugcuauuccauuaguaucacuuuuuuguguacauagcaauaauggcuaaauuucauuaucuucauuuaaacauuauugccucaaaguuuguuugcuaaucuuuugacugugaagacuucaguaguuucuuuauauucuuuuccuuuuguggucauuuucccuugauauaaugacagcaggaccuugauaagaauuauuuaauaucucugaagacuuuuaaagugucuauauugucuaaccacugauuucuccuguguuuuuuaaaaaauaauuuccacuguaauaauuuuaguugcuuuggaaaucacgguuuaauguuuggcaggucuugaaugcucugugcuuucucaaaacuccaaauguaguuaggguuacuuuguuaaaaaacaaauugcuuugaaucuuuagaaaacagaaaccuucuuguugauuguguaccuguguuugaaugagaacauguuaccuugugucacugaucaccugucauguguguaaguucuguuuugauuuccugcuacugaugaaugcuguugaucaaugaguauuaaucaauaaaugcaagauuguacaguaagaagccauuuuaugcaaaaccaccugugauauuugaagcuuacuugaauuccuugcuuguuucauuguagaagcuauacacugaccugcaugguaacuucaggaaguuggauccccacugacucugucccucacugcuuucuauuacuuugucugaaagaucaguuacuauagaaccuugaguaaagagaucaggcagaacggcaaucuaaugcacauuaguugagaauuuuguuuguuacuaaaaauguguggcaugaagauuccagacagaagauugguuucgggaugaagcacaagauagaugccagcuccgaugagugcugcucacugaccaccuguaacagguguccugagugucacauauaguucaucagcaucucucauuucauuauguuucuuguaaaaugaaauuuaugugguuauugagcaaauguagagacaaaugcauugaacaggugaaagaauuucccacauaugauuagaagggugaauaugugggcuguuaacuuuuuggagcagcaucagggagccugguaucaggagggcaccugugagacccuucaauccuagacccaauccugauucaaugaaucauuuucauacagguaaugcagaagacaggugcagaaaugaaauugguucuacuccuuucauuuccuuuuuuuguuguuguuguuaaauuuagcuaaauuuauacauuuaacuaaauauacaaaucugagcuuguuugggaaguugcuuacuuguuccuugaaacccuuaaaugacuccaccucugaaggagacaccccuucauugucugcuaugaacugccuauaaacacucaauuaagucccaacuugagggccccucucagccuugaugaaaugcugauggacucaaucuuuugagacucuuuccuaaugaacauagaggaauaagguuaaaaauuuuuuucacugcguauucuccauccucuggcucuaggucuuccauuuucccacuuucaucuagaauguucuuuuguccugugcuggauaucaguauauaaacugugcugucauugaaauuagagagcuaccugcuucugccaccacagugcaggcauuaaaagccugagcagucauucccaacucucccucacucuuccucuccuccugccuuccacagcuucagccuacagccuuuuuugcuauaaugccacacuuacuucucauacaaaacagcuauuagcauaguugcagagauuccuccgccaugguagauugcauuuuugaggggguggggcaagugaggacuggacaaacauuuacacauccugcuaggcuagcacccacaacacagcaauuaacaacugagaacacagugauacacuuucagagccaguugauaagaugcauggguuaucccaacauucuccuauuuguugaauaugacuguccucuugcacugaaaucccugaagcauugauauaaugguaugguuucauucacuguaguacacugccuugucuaaggucuaaaauuucugagucucacuauuuuuguauuacuugucaaauuugugaguugaauaaauacuuccugaacauuucucaguauuucacaaugaucuucaaugcaucuacaugagcuuguauacauugucuuguuccaaaauuaugucuuuaaaguuucaugauauuuguauggauuggcucacaugaaauuaagcugaagguauuucuuuucuuuuucuuuuuuuuuauuagauauuuucuuuauuuacauuucaaauguuauccccuuuccuaguuuucccucugaaaauauccuaugcccuuccccacucccccugucucccaacccaccuacucccacuuccugguccugacauuccccuauggggcauagaacccucacaggaccaagggccucuccucccauugauggcuaacagugccauccucugcuacaugugcaacuagagccaugagucccaccauguguuuucuuugauuggugauuuagucccagggagcucuugggguacugguuaguucauauuauuguuccuccuauggggcugcaaaccccuucagcuccuugaguacuuugucuagcuccuucauugcauacccaauggauggcugugaggauucacuucuguauuugucaggcacuggcagagccucucaggaaacagcuuuaucaggcuccugucagcuagcucuuguuggcauccucaauagugucuggguuuggugguuguuuaugggauggaucccuaggcaggguagucucuggguggucauuccuucagucucugcuccaaacauugucucuguaacuccuuccaugaguauuuuguuccggaagauccagcaauacccagaagauccuccaacuuauaauaagggcacaugcuccacuauguuuauaacagccuuauuuauaauagccagaagcuggaaagaacccagauguccuucaacagagaaauggaaacagaaagugugguacacaauggaguacuacaccccuauuaaaaacaaugaauuuaugaaauucuuaggcaaauagauggaucugauggauaucauccugauugagguaacccaaucacaaaagaacacacaugauaugcacgcacugauaaguggauauuagcccagaaacucaggauacccaagauacaauuugcaaaacacaugaaacucaagaagaagggagaccaaaauguggauauuucgauccgccuuagaaggcugaagguauuucuuaaaacauuugcuugaguuuuauuucaugaugaauuuucugauauaucuauaauacuagcauuguuuaaagaauuuaaccaugauuucaaacagaauuuuuauugagggacguuuagaguagaauuucugguguaaaauaagccauaaggacacuauaaaguguucaguauuugcccacgggcagcaguguucugagguucaauggaacaugacugcauaauuggauauaaaccuuuguucugagacauguguagacauagcccaguuugggugaugucucucauugacaguuuuguagacacaguuucauucaucucccuguggugcgcgcucucucucucucucucuccucccccuugaaugcagcagagaaugcaggcuccucuucaagguucccuaagccuaugaauucucuuguuuugagcccuuuuuacaagaccagguacuacuauggcaguaagccuggaacagugaaaaccaacaaucuucccuaauuuaauuaacuccuauuuucucuaauaccaauuuucugguguacaugaaauuuggaagaaauaaaugggguuaccacauguuguaugagagucauuuccugggagaugcaaaaugcauaugcauauacucauccaaaaugggaacugagaauagaaucaaauauggaugccauuaagucuaucuuguuaagcuaaugagcuuuauuggaguuaguuaacaguauuauggggaaggagccauguacaacaaugaaagggacucaaagauaauuacuaucaugaaacucuaacccagcaguggauauagcuuaugcauaguggacgccaggagcacacugcacaccugaagucauacccaguuucuaagcagcaugauggugugaguuucuucaugggaguuaaauacagugaauccugucagacugaggaauuuucuugauaguauuuuuagugguuuauuuccugucuuaaucagccuccugucaauauggaacguuucagucucuauaaaauggauacacaacagcacauucuugagcuucucccuuuuguagucaucaugaaauauuugacauugaaaaaauuaugacauuugucuugacaauauuguuuuaugaaaguucuccuucauacugaucuauaaaaacauuguucaauagagucagcugucuuccaagaagcucacuugcccacugaagugccuccucuaugguagcuuccauuuucagaacuuuucaaaguguaaacuauuaauauuuuauaagauuuaaucaguauuuaacagguuucacaaguuccuuauauucacaaugacacuguagugugaagccuuuaguugucauaaggacauaguucagauaaagcccaugccacauuauuuacuauggacucuucuccaugguguguguguguguuuuaauauuuuuauagauauggaugguagguaaagacuuaaucauaugccauacauuugaaagacuucucaccucuaugaauuuucggguacaaucuaagguauaaggcaaugggaaaggauuucucauauucucuuuaguuguaagguuucccuccuguaucaauuaucugaucuguuuuaagagauaagagauuaauaaagaauuucucauauuuaugcauuucuaagauuuuucuccugugugaauuuucucauggcuucuaaaaccuaaaacaacugaaaggacuucucacauucaguacauuuauaaggcuucucaccuguauaaauugucugauaucuccuaagcuuucuggauaaagcucuugccaaauuuauugcauuuauaagguuuauaauuuauaugaauguucugauguaaucuaagaacugaacuaaugguaaaggauuucucacauucacugcuuuuauaagacuucccuccuguguggauuaucuaaugucucuaaaguuuuuguuucuugauaaauccuuuggaauguuuauuacauuuaguauuuuucuccccugcauguauuccugauguuuucuaaaaccugagcagcaaaagaaggauuuacuguacucauuaaguuggccaguuuucuuucuagcauggauucuguauuguccuuuaacaucuaaugcauaauaugagcacuuaucacauucuguacauuugucagggcuuuucauaaugcauguuguuauuuaguugcaaguuucugaguuaugacaugcagaagggcuuaccacauucuguacacuuauauacuaagguuugauuauggcuuaaagucuuucccacauuuccagcagugguacaguuucuauccacugugaguucauuucaguguguguuuauguuuagaaucaaagcuuuuucagucucuguaauuuuauguauuuucuuucuaguguguauuuguagguuuugccuaauaauaguauuauuaucaaagcgauacaugccacaaaguuagcaugcaacagauuucauguugguaguuuacuggagagggcauaugcagaggcugccuuuuggugaagguggagaggagaagggagcagagagaggauggacuggccuuuuagaagcucaugugcaaggcagagauaagcaucuugugaugaccgugggaaugggucucaucuucacagauugugaugauaucucuugagcaggugguacagacaggccugguugcuaacuuuccucucuuuuguuuaguauaaaagaagaggaacuaagaggggguaauguugaguaugaaaugagggcuccaugaucuauaaacaacuugcuauugucuggagggauugucaucuauagggcccuguugguccuuugcaucaggucacacuugauuguugugaacuucagagacugugacuagugguuggcaguucuuuaacaauggauuguuggauuagagauuuuuuuuuuuuuugauuuguuguuggagaagugcagagaagcaauugauaaagcagagugugauuaggaaaaaaaaauggggagggucagaaagggugauaucuacuuccauaugggguuuucggaagcccagggguuggaguccuugaguuguuauauaaguuggguuuuuguuuucucuguaucugauagguugacauagaagcaguguuugucuuggaggaagacacaaagguuagcuuuuucagcuuuaagaggauauaguccagaucaguuuuggaguaccaccguagacagggagucaguuuguccuugaaaagcuaguauaguuugcgccaccugcuggagcuucuggauaaacugagaauuaaacugaugauacauaaucagggaaguggucuauccugcuguccuagugaggaugccugcagcuauugugaaagccaggagaggcuagguuugaauaauaauggacaggacagcuaguuaguccaugauuggaaucaguagggacucuucucauuuuaucacccccaacuucuagagugcaaccuccugaccaacuaaaagauagacaguagaagacuuuaguaucccaaaauaucaugcagucaguacaguggggcugagaugagagaucaaggauuaugguuuuguuacagaccccuacagaauguguaucagaugccuuaauauagucaugcaaacgagggugaagugaaaaagguagggacggagucauggcaacacuagggagcauggucuuguugggguugauagguacaaagggaaauuauguugagacaagggaguaaaaaacuugaggugacauagaugaauccugugauggagggcaucaagcauagcaguuguggauguuauaagaauuacauugaagguacccuaccacuuaagggauuaccuagaugguagggugagaacauugguugggaggagagagaaggaccugaucuccaauguugauuggggaugaacaggauuuaguauguggccgggguagaaggaggugaguaauguuucauaggagggagcagaagugacagagaaggggagugaguaggugacuggggagagguugggagucacaaccaugggaguccguuugugagcucaaugacaagacagaaagugguugcuugggaagagaccauagccugaaaagggccaauggcaagagcuuuagccauccgaggugaguucuugagacagauugaccaguguaauuuuuaagguaguuaguucauucuaccuuuccagaaaacugggagugggauauagaaauacuaagggauguugagggcuuuagguaggauuugagaaauacacagaugaauucaagaccauugucugacuggagggaggcacagacuucaaagccaggaaugaucccucugagggggagcucacagacuuagcccuuuugcugguggugggaaauggcucuacccacccugagaagguacaccaugaccaggagauaccugccauguuuaacaaugagaauaugauguaaagucaaguuaccagacuuuccugggaagaaagccuuuggcucccuggauugguaagauuaaagccuuagaauaacuuauauaugaaaauaugaaaaauacugucacacagucugaagaauuuagacaagccuuagaaagacuuauaaaugaaaauaacaauacugagacacagaggaauuuugacaagaaccuacugaacuacuguauguugaaacuaaaggggagcugucugagucauuuacuauauacaaagccuaaaauaagcuuucgcugauuuuuuuuuuuuuuugguaaaaauuaacuucagcugcaaauagaauaguaucagauucagaagucugacaaauaucacuugaaucuuuggcuuuugaaaaugccaauccaaaaugcaaaugggugauuagacuuuagagacaagaucaucaccaauagaugaauugauuagaaauacaaauaauguuggaucucauguuuaugauucuacugugauuggagaaguaauuucucaacguuuuaagaaaagucaaaauguuaaauguuuuaauuguggugagcaaguucauuugauaugggauuguaggcaaagcauuccuggauacaaugcuuuuccuagagagaaaaaaauuaaagaucuauauagaaaacguuucugaauugauucugcaaagaaaaaugagacuucagcaauuagcaggaauagacccagcagaaauuuaguacccuucacuaaugcugaaauugccucauuauguccagcaaaugaacacuggcauagagcuugcaguaauuuuuuggggggagagagguuaacaacaaauagcucaaaaacaagauacuuaaauuuauuuuaaaaaaaugaauugaauuaucagucauauaguuaaagggacagcaaauuuuggacccccuacauucuguacugauggaaauuaaucagggaaggcaggcuaucagucaagguaucccuagggcuucuaaagggacaaaucugccccaucuuuaauuguuguuuaacugauuguuguaaaguuguucauuuuucccuauuucaaggccacuuuucaacccagaugaaaucaucccugguccauuccaggcaaagaguaagguauuuaacagcagcccuuagaauugaugguucuuuugauauugauauuuuggguacugccucuuauuuggaggcauuuuccccauuuuccacuggcaaggaccauauuuaaaucuucaaauauaacucuauccagcaaaauuggggcuacauuagccacugggggugucuaauggucccuuuuguaccaucugggucuucacauuuauaaaaaucuugggcaaaaaaugcucaggagaaacuaccuacucucaucaggaaccucaucucaucuuaggauagucuuaucugccccugugucuguauauuagguauuuaaaacuuuuaauaucaauuuucauugaaaguugagaguuauuuuucucugguauguuagugaccuacuguuguugguuuuucugucuuacugcugggauugaguauugccaugcaaggaguuuaaagguggcagggguuugccuucuuuauucuuuuuagauuuucaguccuuuuuacaaugugagccuuucauguagcuggaacagauggauuuaugaaguuuaaggucagcugugucauuuguggggcgagggggaggaucuccuauccagugucuggucucuccauauuuaagacauguggaauuagacccuguugcagcuacaaaggcuugagugagagagacaaggccuugucugaggcagucccuauguugugggauccauuuauuguaauguucauuuuauagacuuugacaugccugugcuccagguucauuccaucccagauacaauuuuuuaagaccaucucuuuugcuucagggucuguauuuuucugucuaaacuggcuugcacccuuaguauaaaguccaagagaauuuugguugauguuugcuuuaggaaguuuagugacgaggccuguccagacccuauggaugaaggaguuaaauggucccaggagugcacaaaagugaaucugcucaaaguggauggcagggaguaaggccugcugaaucucuauggagaaguuacacagcugcucaugauuccaguuuauuaacugaagggggggagccuuuguugugguccuauuuguugauuauguaauucauuucucuuagccuguaucugacauucaucucuaaacaugguuucccaccucgaaaacagaggaccauggagaauagauaggcauacacuucucacggcuugggaggguaaaagguugguauugaaacucugcaaaauagaauuaguccaagaggcaugaauuccaugcuuguagaugacuuguaauaguucuuuuagucugauuuggagaggggauaucaaaccaucagauauuaucuggaugcauguagcauaaucacaaagguccaaauggguggagacucuggaugccugguacauugcaguugagagggcugggaauaauuguuccuaaccucucugagaucacaaaaaugcucacugaacauagggaguaguguuguagguaguggugcugaguguguuggaggguuuauuugggugucuuuaggaaccuuaguccuaauuugugguucuuugucuucuauagccaaugaagucucuuagauugaagagagggauacagugggaaggaaugucagggacuaacuucuuucuaaucagaucaauugguuuuucuaaagaguccaagucagcuaguggaaaauccucagagucuuccuucucauuugauuguuccccucuaucucccugaccuucuuccucuaauuuguuauccugaugcuugggauguuuucuuaaacacugcugaaugucagcuauuauguugaggaaggagagcaacaaaagauagccuuccuggacuuccuuuucauaaaucagguauucaaugaggaucaagacuuuuagguuggaaauauuacccacaggacucauugaagcaccucauucaagaauuccggacccuucuuuugugagacuuuaaaucuucuugauuuaaguaaggguuuaaaggaacuaauuuggaauuccccauuauaggaaagagaggaagugcccccgcuuguguucaauauucaugaggcaauucgcugcucaguuauugagaagaucuaucaagcaugagcuugcuggcagauuuaagaaacuggcagcaguucuaggaaguuuugaaugguugcuauguaaccagguuuuuuuaugagaggcuaaaagcuuauugccuacacucagucaggcuguugagucaaaaagagagcaggggaccuuuaggcaaugucaggaagucgcccggauugagagguguucaauuuuuucacaaacugugucugguccuuugaagguucaaacuaaagguaaagcggggguggggaggaggaguaagagggagagggaggaaagagguaauggcuggcugauccucaggagaaaaugcugacucuucggcagggggauacuccaaauuugcuuaauuucggggauuccuauuuaggugccagcugugggucuccucuuccuggggguuugagggaaaagggagcugaaguagcaagcaggguuuaaacagucaugaguacgguguaaagccuucucaaaaucaacuucagugaguaagguauauaacuucauauauaucaucagacauaugguacagaaagguuuuuggaguuacaggcugaaagggcuauaauuagguacugaucauaacauaauuuugauacagcaagaagggcuaagcuggacuuaagugcuaaaucauggagcacuuauaggaagcucuguguaucgucauccuccagaugaggucaggcaccugugcuuugagauacucucuauauaaguacaggcaaagaagaggaaacccugaugagaaagggaguccucaguuuugugcugcggauggagaguuuucaggacaugguguauggcaauguaacuagcaugcucuuccaacaucuaugaaguauagaauuuuuuuuuuuaaaaaaagaauguuacaaaauagccacccucauuaaccacauauaaaagaaugaaacuagguccaaagcaaugaauuacugaaauuuaacugugcaauuacaauauugcauagaaaugguaauaacugaaaguaugaagaaacagauuacagaauugagauguuuaacaguaucuauuucacaguagaauacauaaguacacagauuuuaccaagaagguaaaaaggaugcaagccaaauaauaguauaaccauuaaauaacaaaagaccaugcacaaaagcaggugagacagccaaaauauuaauaacacaugcuccuuguagugguuuaaauauucuuguuccagggaguggcaccauuaggagguguaaccauuuuggaguagaugugacccuguuggaguaggugcacuacugugggugugggcuuuaagacccuuuuccuagcugccuggaagccagucuucuccuggcagccuucagaugaagauguagaucucugagcaucuccugaaccaugccugccuggaugcugccaugcuccccacuucaugauaguggacugacccucugaaccucuaagccagcccugauuaaaugcuguccuuauaagaauugccuuuguucacagcaauaaaauccuaauuaagacacauacauuguaccauuucagaauuuugcucuucauaaacucuuaauguuuucaaagauuugagcauuacauaauggcuuuuucaaauuucucguauucaccaugaauucucuacuauggagccuugaguguugacaaggauagagaauggauaauaaggacagcuuugauaaagcacaugccacauuauuuccuauaaaauauuuucuccccaguauuaacacugagauguuuucuuagacaugaaaggaagguaaaaauuuguccuuagacauugcauuuauaagguuuuucuucugcaugaauucuuugauguguuucaaauuuggcuuucuggauaaaauauccucaccuugauuacauucauaagguuucuauucugacugaauuacuggaugaauucuaagagaagauccaauaguaaaggauuugucacauuugcuacauuauaugguuucucuccuauaaguauucuccaauauauguaaagagaucaggcacuuaugaaggacuuauguuuauaacauauguaaaaguuucucuccuuuugcuaauguuuucuuuuuuucuuuuuuuuuaaucauagaagaguuuauuuaaauacaguucuuuggcauacauauaauucugccauuuauuagugacaaaucaaacauacuaaugagaugucuguguacaauuauuuuuacauaaagaauuaaauugcagccaaauauuugauacuguagaacauacaccauccuuguaggcucucagaguuggucaauauuuugauuuuccuuuuuauuuauuuacaauugaaauguuuuccccuuuccaggucuccccuuugaaagucccccauuccaucucgccucucccugccucuaugagggugcuuacccacccacacacucucaacuucccucccugguauuccucuacacuggggcaucgaacacccucagguccaagggccuauccucccacugaugucuaaccaggccaugagucccuccauguguuaucuuugguugguaguccaggcacugggagcucugaggagucuggccuguugacauuguugaucccuccauggggcugcaaauccccucugcuccuucagucccuucuucaacuccuccaucggggaucucauacucaguccaaagguuggcugcgagcaucuaccucuguauucaucagauacucucagaguuucucaggagacagccauaucauguuucuaucagcaagcacuucccggcauccacaaaagcuuccagguuugguggcuguauaugggaugguucuguagucagggcagucucuggauggccuucccuucagucucugauccauauuuugucuacauauuucuuccugugagcauuuugaucacucuucuaagaagcacugaagcaucuacauuuuggacuuggcucuucuugggcuucauaugaucugugaauugaaucuuggguauuccgaaauuuugggcuaauauccacuuaucagugaguauauaccuuguguguucuuuugugauugaguuaccucucucaggaugauauuuucaaguuccauccauuugccuaugaauuucaugaagucauuauuuuuaauagcggaguaguauucuguuacauaaauguaccacauuuucuguauucauuccucuggugaggaaaaucuggcuuguuuccagcuucuggcuauuauaaauauggcugcuaugaacauaguggaccauguuuccuuauuacauauuggagcaucuucuggguauauaaccagggaugguauagcuggguccucaggcaguacuguguccaauuuucugaggaaacgccaaacugauuucuagaguacaaucccaccagcaguggaggaauguuccucuuucuccacauccuugccagcaucugcugucaccugauuuuuugaucuuagccauucugaugggugugagguggaaucucagaguuguuuugauuugcaauucccugaugacuaagaauguugaacauuucuuuagguguuucucagccauucgacauuccuugauugagaauucuuuguguagcucuguaccccauuuuuaauaggguuauuugguucucuggaguccaauuucuugaggucuuuguauauauuagguauuagaccucuaucagauguaggguugguaaagaucuuuucccaaucuguuggugguugccauuuuguccuauugacaguguccuuugccuuacagaagcuuuguaauuucaugagaucacauuugucaauucuugaucuuagagcauaggcuauugauauucuuuucaggaaaauuuccccugggcccauaugcucaaggcucuuccccacuuucuuuuuuauuaauuucaguguaucagguuuuauguggagauccuugauccacuuugucuugagauauguacaaggagauaagaauggaucgauuugcauucuucugcauacuaacugccaguugaaccagcaccauuuguugaaaaugcuguuggucccccccccacacacacacacacacuggaugguuuuagcgccuuuguaaccuuuagaccguaggugugugguuucauuucugggucuucaauucuauugcauugaucuacuugccuuucacuauaccaauaccaugcaguuuuaauuacuauugcucuguagcacagcuugaggucagggaugcugauucccccagagguucuuuuauuguugagaauaguuuuugcuauccugggcuuuuuguuauuccagaugaauuugagaauuguacuuuuuaacucuaugaagaagugaguggaauuuugauggggaauucauuuaaucaguauauugauuucagcaagaaggccauuuuuacuauauuaauucugccaaugcacagcaugggagaucuucccaucuucugaggucuucuucaauuucuuucuucagagacuugaaguuuuugucauacagaucuuucacuugugugguuaaagucacaccaagauacuuuauauuguuuguggcucuugugaagggugucauuucccuaauuucuuucucagcuuguuuuuccuuugaguauaggaagacuacuaacuuguuugaguuaaauauauauccagcuacuucacugaagcuguuuaucagcuuucagaguucucugauggaauuuuuggggucacuuauguaugcuaucguaucaucugcaaauagugauauuuugacuucuuccuuuccaauguuuauuccuuugaccuccuuuuguuuucaaguugcucuagcgagaucuucaaguauuauguugaauagauaaggagagagaaagggcagccuugucuagucccagauuuuagugggauugcuucaaguuucucuccauuuaguuugauguuggcuacugguuugcuguauauuacuuuuacuauuaggaaugagccuugaauucaugaucuuuccaagacuuuuaacaugaagagauggugaauuuugucaaaugcuuuucagcaucuaaugagaugaucaugugguuuuugucuuugaguuuguuuauauaguggauuauguugauggauuucuguauauugaaccaacccugcaucccugggaugaagccuacaugaucaugauggaugauccuuuuaaucuguucuugaauucaguucucaauaauuuuuauugaguauuuuuacuuugauguucauaagggauauuggucugaaguucucuguugggucuuugugugauuuaggcaucagaguaauucugacuucuuagaaugaauuggguaguguuccuucuguuucuauuuuguggaauaguuugaagaguauugguauuaggucuucuuugaaggucugaaagaauucugcacuaaaaccaucuggcccuggguugggagacuauuaaugacugcuucuaucucuuuaggggauauggcacuguuuagaugguuuaucugacucugccuuaacuuuuucauuuguccauuucauccagauuuuucaguuuuguugaguauaggcuuuuguaguaggaucuuaugcuuuuuuuuuuuuaacuuccucaauuucuguuguuauaucucccuauucauuucugauuuuuuuuuuuuaauuuggauacuuucucugugcccucugauuagucuggcuaaggguuuaucuaucuuguugauuuucuuaaugaaccagcucauaguuuuggugauucuuuguauaguucuuuuuguuucuauuugguugauuucaucccuguauuugacuauuuccugcugucugugccucuuguuguauuugcuucauuuuguucuagagcuuucagguguguucuuaaacugcuagcauaugcucuuuccaguuucuuuauggagucauucgcagcuaugaguuuuccucuucucacugcuuucauuuuguccuauaaguuugguauguuguauguucauuuucauuaaauucuaaaaagucuuuaauuucuuuacuucuuccuugaccaaguuaucauugaguagaccauugaucagcuuccauguguauguggcuuuuguuguuuuuguugcuauugaagaccagccuuaaucuguagugaucugauaggaggcaugggauuauuucaaucuucuuauaucuguugaggucugauuugugacagauuauauggucaauuuuggagaagguaccaugagaugcugagaagaagauauauucuuuuguuuuaggaugggauguucuauagauaucuguuaaauccauuugguccauaauuucuguuaguuucccugugucucuguuuaguuuguguuucugugauauguccauugaugagagugggguguugaagucccccacacuuauugugugaggugccauguaugcuuuuagcuuuaguaaagucucuuuuaugaaugugguuaccuuugcauuuggagcauagauuugcagaacugagaguucuucuugguagauuuuccuuuggugauuaugaaguuuccuuucuuaucuuuuuuugauaacguuuuguugaaagucaauuuuauuugauauuagaaugccuaacccaccuugcuucuucggaccauuuguuuggaaaauuguuuuccagcuuuuuagucugaaguauuguuugucuuuaacacuguggaacacuguggugcauuuccuguaugcaggaaaaagcuggguccuguuuacguauccagucuguuagucuaugccuuuuaguugggaaauugaaugcacugauguuaagagauaauaaggaaaagugauuauugcuuucuugaaugauuacuuucuugcuuuuucuaggguguuguuucccugcuuguguugaaguuuuccaucuauuauccauuguagggcuagauuugugaaaagauauuguguaaauuugguuuugucauggaauauauugguuucuccaucuaugguaauugaguuuuguuggguauaguagccugggcuggcauuuguuuucucuuagggucuauaugugaucugccugguaucuucuaagguccgugguuucuggugagaagucugguguaauccugauaguucugccuuuauauguuacuugaaauuuuucccuuacugcuuuuaauauucuuuccauuuugugcauuuuguguuuugauuauuuugugacaggaggaauuucuuuucugguccaaucuauuuggaguuuuguagaccucuuauguguucaugggcuucucuauguuuagguuagggaacuuuucuucuauaauuuuguugaagauuuuuacuggcccuuuaaguugggaaucuucaaucucuuauauaucuguuauccuuagauuuggucuucucauuguguccuggauuuccuggauguuuuggguuaggcgcuuuuugcaguuugcauuucuuuaacuguugugucaauguuuucuaugguaucuucugcaccugagauucucucuucuaucuugcauucuguuggugauucuugcaucuaugacuccugaucucuuuccuagguuuucuaucuccaggguugucuuccuuugugauuucuuuauuguuucuauuuccauuuuuacauccuggaugguuuuguucaauuccuucaccuguuugguuguguuuuccuguaauucuuaaagggauuuuuguguuuccuuuuuaaggucuucuaccucuuuaccuguguucucuuguauuucuuuaagggaguuauuuaugcccuucuuaaauuccucuaucaucaucaugauaugugauuuuaaaaucaaaggcuugcuuuucucgugugaggggguaaccagcauuugcuuuguuaggaaaacuaaguucugaugaugccaaguagccuugguuccuguugcuugccuuucaccaucugguuaucuaggguguuagcuagucuugcugucucugacugugacuuguccugcaagcuuguaugucaguacuccugguagaacaguucucucugagaagaauuuagguauggaaagcugucgugcagggucagcucaggggagcagggagagaccagaaggaaccugucuccaguugaucuuugguuccuguguccugauggaucugugggggucccucuuggaccagggauuugaagagaagugguuuucuuaccugugcucacagguauguaggcacuccugugaaaccagcucucuccuggcaguauuuguguauauagcucuguggcacaggauuagcucugggugcagaugggaaacuggaauauuccuguccuagguagcuacuuaguuccuguguccugaggguucuggguggguuccucugagcagcaguggugauccuaccugugcuuauaggccuguccauacuccuaggaggcucaaucccuccgggcgcuauuuugguaugaagcccuguggcagagggucugcuccagaugcugaugaaaauuggaagccauagauucuaauucuuugucuuuuaaauuuuuugugguuuguauauuaaguugacuguggcuucauaaaaugaauuuggcaguguuccuucuguuucuauuuuguaaaauaauuugaguaguauugaauaaaacuucuuaaaaaguaauagaacuguauacuaagacugucuggccuuugguuuguuuguuuguuugagauacuuuuagugacuauuucuauuucaucaggaauaaaggccacuuuaaauuguuuaucugauguugauuuaacuuuuauauauuguaucuauugaagaaauuauccucuucauuuagauuuuccaauuuuguggaguacaaguuuuuaagugaugaccuaaugauuucuuugguuucuucauuauuuauuuuuaugccuccuguuacauuucugauuuuguuaauuggguuauucuaucuccauuuucuuguuaauuuggauacugguuuauuuuguugauuuucucaaaugaacucuuauugauucguugaauugucuuuucucuuucuauuuuauugauuuuggaccucaauugauuguuccuugcaaccuauuccucuuguguguaauugcuucuuuuuuuuuuuuaauagagcuuauaggugugcuguuaaguugcuauuauaagauaucuacaacuacuugauguauccacugucugcuaugaacuguccucuuaccaccaccuacauugugucucauaaauuuggguguauuguguauuuucauugaauucuagaagacuuuauuuuuaaauauaugccuuagaaacaugaaaauacagaaccauucuauguaggaucucuaguaauaugagagaaaguggucccaauuagauuauagggaaugguacuuuuagaagaugugacauuguugaaauagguuuggcuuguucaaagcaauuuuucagagcagguggcuuugaaaugucaugagcucaggccaagccuaguggcuuaaugucucuuccuccugcuuauugauccaaauaucaaacucucagccaccuguccaguuuugcaucugccugcauacuaccaugcuuccuuccauguuaguaauugacuaaaccucugaauauguaaggcaauuccacuuaaauguuuuccuuuaucagaguugccauggacacagagucucuucacagcagucaacucuaacuaagacaacauucaucaaggagcuccuuucccaaaacacaguauuguuucaacaucuauuuaucuugccuucugcauggcacacaguuaagguauguauuagaaaguuuuuguuaauucuucugaucauccacaaaaggauauuucaucaacaacaacaagccucugcugagagugucauucuggagaauuguuaguuuaccaaugguaacaaauauaaccagaaauugauuauuggauauuuucaguagugcaacaaucucuauuagcuuuauuuguauucauuuuccagugaauguucacauaugugguaaaugugggcaagucuuaaauagaaggcccaaagcauuuugcccaucagugugugaauacccaagagaagucuuacacacauaaugaucuugggaaugauuuaugaauccucacaguguauacuuuuuuuaaacacaaaugauacuacagaaaauuguuauaaaugcugacauauuaacuauaaauauuauucuauugacacauuaaacaugaacuacagaaaauuguuauaaaugcugacauauuaacuauaaauauuauucuauugacacauuaagcaugaacagucauaaaaaguuugcauauuggagaaggacuuuaugaauauaaagacugacaaguguuuuaauuuguauucaaacaucaaaguccaauaauaaacccacccuagacaacagugcacaaaagaagagacugauaacuacuuugauacuaaguacaacuugugauaaaaacaaaucucuauuggaaaaaaaccuaccaaugcaggaaauucaacaacaauggacugccuuccagagagaacuugacagggauaagcucccagccuucuccaaagcugaaagccaacuacaauuaaauguuuuccuuuaugagauguguaguggucaugaagucucuucacauauacucuucuuuuagcugccuaugagacagucuucuguuugccuucagaacaagauguagaacucucagcuccuccagcaccaugccuggcuggaugcugcuaugcucccugccaugaugauaauggacugaaccuucgaaccuauaugacuacaccuauuaaauacccuuuauaaaaguugccuuguucuuggagucuuuucacagcaaugaaaacccugagucauacauguaccagugcaucagucauagauuuccuucuugagcuuauaauuuuuccagucauugacuuuuggccagcuuccaaugccagcuauguauuuccuuugugggaugaccucaguuaaaccagaaaugcuucaguuacuuacaaaauagucuuggaacuauuguguugguggacaugccuuaccuaauagguugauuuugcagcaauaggugucagcaucuauggacauccaauguugauucuuuuugcgcaguagccuuucaauuaguuagaaugcuauaccagcaucuccaagacauuuuuagacaaaacauagcugcugacuucucagcauauucccuagggauguauaaaaccaagugauauauucuuguauuuugauauagcuuauuaugaguauuaucagauugguccauucuuguagaauguaguguuuaaauugaagaauuauguuucccaaauuauguaauuugggaaaauaugccuuucucauuuucuuauuugacacauugaaaauguucuaagucuuauuacuagaccuuuguaagcacaugcacugugaugagguaauguggagacacugcacauccuuaucuugcuucugaguauaguagucuucaaauuuuguaucacaguuuuaggauguuggcuacuaucuugauuaugcugagguguguaacuucuguucucauauuccucagcacuuucacagugagccuaugugauaauuugcccaaggccuuucauggauauguugacaugguuaugugucucacucacugacuguauauauuuugugcuugaguucccugguuugcagguguugaaauagucuugcauccuugacaugaaaucaacuugaguucccuuucgauauccauuagagagaaucucuuugucaauguacaucuuugcaacuggucuauaauuguuuucuuuguaaauaauuuuuugcuuaucuacuuucuguaucaagguaaagccagauuucuguuugucuaccuaauaugccuuuucauugugcauucugcaguauucacuuugcaagauuauuacagguuuuucuaaaacaauugaagaauucauugcugaguauguccaaacuuuagacacugucaguggaaauacugugucagcacuucuucacugcuuggccuaguuuuauagcauaauuguuugauuuucacuuguuucuaggaaaucaucuuucauuuucaauucucaauaauuauguaugacuuuugucacccauguucuauuuuccauugucauaauaaacuacugggguaguggcauagaaagagaucauucaagcaucaguuaaaugucuggaaaauuaucugacaugagagaaauauacaucaauauaauacauaaaaagaguugcauguauacuaauaucaugguuaugacaacauuguguaguaauaguauuucaacacucagaaugaguccuuguuuuugagacaugcauaaacauauguauauauguauuaucuauucauauauuuuuaugccagucugugagcauauauauauguauauauacauauacauacauacacacacacacacacacacacacacacacacacauauauauauauauauauauauauauauauauauauauauauaugaaugaaugacaggagucccauguugcacauucuuccuuucauuggaacuacaaggguuauuaucuuagaggaaguccauaacagccagagacugaaggaucucauuggagucauauuacuuauuuggaaccugagaacuuccugaaauaauaccaagagacagacauaugcauguucaguaagauguuuucaauggugauaggauuuugacagauuugauguaaugagugaauaauuccaagggcauacucugagaugauucacuuuauaucuaugcacaaccucuuauguuuagcagccaucagagaaguucuaccaugcccaacucuugaugauuuuugccuugacauuaccuagaacaguuauucuuaaguugugggucaugaucucuugggggucaauugacccuuuuacagggaucaccuaacaguacuauaaaacauauuucugaugguuuuaggaacucuuguaucggucuacaggugggucugccacaucaacuuauuugaucuugcuacuguuuugaaaggucauagaauuaaaaauguggagaaccauuuagaacaauuagcauaaggacauuccauucaaagacagauauuggauucuagugugauggcuaaugaaacucuauuuacuuuuaggcauccaucuuaguacccacuagcuauuugucccugauucuggucuuugaaugauaaguucccaauaauaacccugaguacuaguguuuugcagcaguuauacuuauguuuugagccuguuacccacugagguuugaaaaaggcccgagacuguagucauuucccuugccauauuaaauauaguguuucaugcucuuuugucuguaagaauuuugacaaguuuucugguauuauuuucauuuuuguaucuuuucauauggauuagcauugucuauaauggaguuauauuaauuuuggcuuuuaauuuuugaauccuugaugugaaauuucaauaaggauuccagucuauauuccugagucagaaacuuaaagaagaacaagaagaaagaugaaugcuucucugguaagugcucccccagucaguguccuguccacauuucuuugaaaauuacuuuuauuauuuaagccauucaagacuuuaguucucucgcucuggcaaaccuaucuaaaguguuuucugugauuuaucuuuuuucuucuccaauaauaaaaauuaagucuuucgaucuuucacuuauaauggaauaagcguagccuugucccauuguauuuucacuggauuuaacacugugaggacauacauuuacaaggacugaagaccuguaguucugaaagagaauaaauguauuguaaaugaugcucaaagaauauauugaucacuaauuucuacauuggauagacuuguguccuuuaauauuaaugagaaaguacagucucaugugccacauaaaguauauuucaggauuaguuaaguuuccagaaacuaccuugugacuguggauuugcacauaucuagacacugauaucacugagcaauacaggaagagcagaauuuauggaagaguagaauuagaauacacucacuauuuugaaucuaucaguucacuaguggcagagaugauguaaggaauauguggcuuucuuuuccuauaaaacauauguguuucagaggagaugcagauuacaguauucugguauaucuuuuuggcauuuuaugucgcauagugaucauugguguucacacaugaaaucuuacaagagauucugcccagucucaguaugguaaguuuguuguuguacagaugaguauuuucuuuuucucuuuuguuucauuucauuuuuuagaacuauuguaaacacaacuaucucuacauuuguguguagcaacacauggaauguauuaguaagaacuuucuggagaguauuaccuugguaccaaagccaccaaauuucccccuuaauuuguucucuucuauuauuuaccaugaagaauguuccauccacacuguuuuuccucuaccccaagcuauguauuauguggguuaaaaacucugaaauguuggggauuuguuuccugacaauaauuuuuuucaauauguaaguguuaauuugcauauuuuuguacucugaaugauacauuuugccucugaaucccuaagugcagcauuaagucuuuggaaaugaaaucaggcaugguaaucagaugcaauggguguagaaagaaaagaaaagaaaaguuaaaauuacaagauucagauuuucaguuaacucaaccucauaaacaauaguguuuuaaaauuuucugaacaauuauuauaauucccucucaauuuaaaaagucaacuuggucuaagaaaaugguucuacuucaucugaaugcaccaucucuuauaccauuugcagauacauauccaauuauucugaagugaaagaccacauggaauuuaugaaaucguuauuauauauauuauauaugucaacucugagaaaacuaaauaauuuaaaugcuaguagucuuucuucuauuuacuuuaugguuuuaaauauagucucauaaaauaaccuuuacaaagaacuugauucuguaugucauuugaaaugaggaguguguucucugcuaauauacuucuuuuauguuuaaagaaaaaacugugauucuuaauucauccaacaguucugcaguucacauucaaacuuuuuguuauagaaacgguacugcauuguacuuaggccuuaggaagucagcugaggauuuuaggauugugucaagugagucucagcugcagacaggauuuauauaguguccauaguucagcaaggcugaaaguuguaguauuuagaagcccaguguuacucauuguaacuucaccauaugugauaugacacuggaauucuauuugauagcagcccauacuuuacaaagguacauuccugcaacugggccucaaauguguauguuguauccuguaaagguuuacugacuaugaaucuauuaugucauccuguuucagagacauagaaaauacaauaaagaauaagacuaucuuagauaggaucuuuucauacaauuaaauuucaauuuucuuuuauuuauguugguacauuucccugaauguaugcaugugugcuauguauuccuccagccuguagagcucagaagagaucauuggauuucaaaaauugggaugaaaaaucuguugugaaguuucaggcaggugcugggaaacaacuuuggauuauagaaucuaaacugcagacaaauuuucaaauaguguuacga

SEQ ID NO: 8421 - RNA, 5288 nt, Mus musculus
uggggaauaaaaugcaaacaagaaaagccuaaaauuuuauuuugacaggacaacaaaagcugaauguaacgguucaccaagcuaaaucucauacaggaguuugagaucaagcuaagccaaaugaguuccaggccagccugagcuaaaguuuaaaaccccuaucccaaaacacaagcaucacucuagcuccugaaauacagggucaugaugucaaaaggacaaagagaaggcucgguagcccagguugguaaagacaucuacucgacagcuguugcccgaugcagucaggaccuaaaggcaaagaagacaaagaagacauaccuggcuaagucgcccaucuacaggccuggagagacccccauggccauuccaagacccaccuugcacucuggggcugcuggcugcugguugaggcucaggcugagcagcccuggggaggagccaggcaccugggccuuaagcuccccgcucaguugccagugauugacacaacagcccuggccagcagacaggaucuguggaggacaaagaggaggugcaggggucaggucuaggugggggcacuggauagugggacaggaucaagacagggggucucaccagauccugguagaaggugacgugcuucuguggugcucgaauaggaaagacgguaguggguguggaagaccugaggugccagagggugagggcugggcccccuccacagaccugaacagagagguggcaggcuccggucacugugagccauggaccuucaguggccacucucacccgacacucugcccagcuuaccauccagucugagucaguggccaagcagccaauccagcgcccauuauggggccucgagcacuccugcaaaggaggaaagacgugagggcaucugagggcggaugaggaagagggcacgggcgcacucucuccucaccucaugcuuguagacuucgauggucuggaccucuuuggcuauacggagaucugugggaaaauaaaaccaccaaggcuccuggugagccacaagccugagacacccccacccccacuuucucauuuuuugucuuuuuuuuuuuuuaguuuuucuagacaaggucucuacauagcucaggcuguccuagaagucaguauguacaccagccugccucagaaucacagagauccaccugccucugccucccaagugcugggaugaaaggcuugagccacuaggccuggcuuacuuucguccccuguaauuggaauuuuccuuaccccaaagccguacagcuccauccucaccgccagacaauaccucagggcugcgcucccucagugccaggcaauggauguagucuguguggccccggagggcccgcugcagggaagagcgguggacggcucaggagaugcaggaaacacagggcaggcccagacuugcccuggccccagaccuccacucacugugaaggccccaguuuccagauccauacugugcagcugacaaucucccccagccaggaugagcgaauucuccuguggagggagacaagagggagcugaaaguccucguccaucaggguagggaacaaguucuugaauggucauaaagagcucagaccuuggggacaagcagcaaggcauugauuucggguacuuccagacugguccuagguggaggaagagaagggucaaaaucacagagaguguccgugaccucaccugccucccccaccgugguccuggcucaccuguauggaggcuggcgacgccacaguuccuuacagcccuucauggagaaacacaggaggaaacccugauccccacaccucugagguggggaaggucagcccugcccuaggcuccagacuucuuaccuucuugagaauuucugcccaaagccaacccuugaccucuccaucgccagcacugaguaggugucgaucuguggagaccaugcuguagacaggcccgucaugggcuagagagacacagaaaacucucauuagccccugugagcccuucucucuccugaggucaccugaaccacucucaacagcuauacccaccguggaagaccaccaccgguuuuuugcuuucuucuuuggccucugaacuuaaggcagcagacaaacugaaagagagguagggagccaagucaaagccaaggaggcucaagugccagggcuccugugugguaggaaucaggguugaggguaccugaagauggcaaucugcccguaauuguugccagcugccagaaacuucccgcagggggagacacucugggaaaagauggucaugugcagucgcugcagggccugaaauaccucagccuguggaaaagggugaucaagagagucuaagaagucuggggccaccuccuacagacuucugcuuacccaccccacccccacccccacccccgcccaggcuucucagcccaucucagccaggaugagaggcaucagcccauacaaagugacuccaggaagagaguggaaaaaagaaccgaggagccacagcuugccggcggugguggcgcaagccuuuaaucccagcacuugggaggcagaggcaggaggauuucugaguucgaggccagccuggucuacaaagugaguuccaggacagccagggcuauacagagaaacccugucucaaaaaaaaaaaaaaaaaccaaaaacaaaaccuaagacuuugagcaagaccaagccuccucccauuggcugaacagacagauggcacucacaagaaauucugucaugauuagguaaacuaacaaaucuugagagcacugaagccagagggaguuguauagaauguaaccccagcacaugagaguuggaggcagggaaacucacugguaacucaagguuaugcccagcuagacagugaauucaaaggcagccugggcuacaugagacagucucaaguacacacuaaggauggaauugaauugguagagugcuugcuuagcacagcacacugcauaaagcaagcacacacauguagccugugaucccagcacucugaagguacaagcagaaggacacauuccacuacgugacaaaccucaggccagccugaaauaucucagacccuaucucaaaaaucuaagugacucaaaauaaucuuuaaaaaaugggggugcgggggaggaggucuggaagauggcucagcagggaagugugcgccacucuugcagaggauccccaaagcacccacauggcagaucacaaccaccugcaccucaguuccaggagggcccagcccccucccucuacugcaccucucucuccuuucucccccucuccccuccccuuuucucucugucucucucuuucuacccccaccccucagaaaaagguucucaccaggaacccucucuggcccagaacucacuauguagauuaggcuggucccagagagaucuucuugcuucugucuugugcaugaguguacaugcaugugugugugugugcauguacaugcgugcgugugugcgaguguaugugcagugucgaguguuggaccuccuggaacuggauuacaagcagcuguaagcccacuccuauauggguacuaggagcugaacuugguuucuuuggaagaguagcaagugcugggccauuucuccacuccccugugauacccuuucuggccucuaaggguaccauagcacacauacaacauguaagcaaaacacuuacauacauaaaacaaugagaaaacuuuacaaggaaauaaguaagccaagugugguggcaugccuuuaaucuguuccgacaauugagaggaggcaguuagguaaaucucugaguuccuggccaguuugauguacauauaugggcaauggugacacaugccuuuaaucccagcacuugggaggcagaagcaggcagaucucuguaaauuugaggccaaacuggucuacagagcaaguuccaggacagccaaggccacacagagaaacccugucucaaaauguguguguguguguguguguguguguguguguguguguguacgagcaagcacagugguucuuggggcugaggguaacugcucaugguagaccaugcucuuuucuuccuuuuuaagauuuacuuuacugauuuuaauuauuuguauuuuguauaagugugugagggaaguauauacaaguacguccacaggggccagaggauuggcuccccuguagcuggaauuaacaggcaauuacaagcuuuggaacuugagugcuggcacccagcucagauccuccacucucucuccauacccaaaaaccuauucuuacucaaagcucagcguuugagcaccagcauuguagauauugggcuuugcagcacacccaauagccuggagcacucaguggaggugaaggcaggaagaacagaaguucaaggacauucuccaguauauaacaaaguucaagacuuacgagacugucucacaccaguaagcagugggcugagcuguaacuaaauaauagagcacauucuuaugaagaccaagacccuggguuuaaagggggaggggcaccucauuuacaauuacgaugaacuuuuuuuuuuuuuuuuugagucagggucuaacuauauagcauuggaugacauggaauucacuaaguagcaggcugguuucuaacucacaagagauaugucucccucugccuucccagugcuaggaucguaaaugugccaccaccuccaacggcgcaaauuuuuuuaaguggcucuauuaucccgcacaggaaaauguaccaacaucuaauccuucagucacuauuagaucucaagguuccggaucacuuuucgugggcucaggguacaagucccacaaaucaccuaugaacacuggguauccuggaacacuccagggguagaugucagagcaagacuacaaaccccagaaggcacugugcauacacucgacucaccugacccagaggcaccgcgagcggugcggcaugcuccaucuugagaacuacaagucccagagggcucuacgugugacacaaucucucgacgcacgacacaaccucucgauuccggacgugccugaugguggcucuucucguuacgccccaagaccuagcacugccugucgcccagcaacuaaggcggcagguccgugcugucucgaaccacagaaaccuaggagaacuacacgaagcacccuuaugcuaaaaagcgcccagaacuauccagccacgccggauccccucccccaccgcgccgaccugucccgccuucuaaccucuaaccugauuccugucuuccgcgccugcguaaaacgucuccagugcg

SEQ ID NO: 8422 - RNA, 5288 nt, Mus musculus
cgcacuggagacguuuuacgcaggcgcggaagacaggaaucagguuagagguuagaaggcgggacaggucggcgcggugggggaggggauccggcguggcuggauaguucugggcgcuuuuuagcauaagggugcuucguguaguucuccuagguuucugugguucgagacagcacggaccugccgccuuaguugcugggcgacaggcagugcuaggucuuggggcguaacgagaagagccaccaucaggcacguccggaaucgagagguugugucgugcgucgagagauugugucacacguagagcccucugggacuuguaguucucaagauggagcaugccgcaccgcucgcggugccucugggucaggugagucgaguguaugcacagugccuucugggguuuguagucuugcucugacaucuaccccuggaguguuccaggauacccaguguucauaggugauuugugggacuuguacccugagcccacgaaaagugauccggaaccuugagaucuaauagugacugaaggauuagauguugguacauuuuccugugcgggauaauagagccacuuaaaaaaauuugcgccguuggaggugguggcacauuuacgauccuagcacugggaaggcagagggagacauaucucuugugaguuagaaaccagccugcuacuuagugaauuccaugucauccaaugcuauauaguuagacccugacucaaaaaaaaaaaaaaaaaguucaucguaauuguaaaugaggugccccucccccuuuaaacccagggucuuggucuucauaagaaugugcucuauuauuuaguuacagcucagcccacugcuuacuggugugagacagucucguaagucuugaacuuuguuauauacuggagaauguccuugaacuucuguucuuccugccuucaccuccacugagugcuccaggcuauugggugugcugcaaagcccaauaucuacaaugcuggugcucaaacgcugagcuuugaguaagaauagguuuuuggguauggagagagaguggaggaucugagcugggugccagcacucaaguuccaaagcuuguaauugccuguuaauuccagcuacaggggagccaauccucuggccccuguggacguacuuguauauacuucccucacacacuuauacaaaauacaaauaauuaaaaucaguaaaguaaaucuuaaaaaggaagaaaagagcauggucuaccaugagcaguuacccucagccccaagaaccacugugcuugcucguacacacacacacacacacacacacacacacacacacacacauuuugagacaggguuucucuguguggccuuggcuguccuggaacuugcucuguagaccaguuuggccucaaauuuacagagaucugccugcuucugccucccaagugcugggauuaaaggcaugugucaccauugcccauauauguacaucaaacuggccaggaacucagagauuuaccuaacugccuccucucaauugucggaacagauuaaaggcaugccaccacacuuggcuuacuuauuuccuuguaaaguuuucucauuguuuuauguauguaaguguuuugcuuacauguuguaugugugcuaugguacccuuagaggccagaaaggguaucacaggggaguggagaaauggcccagcacuugcuacucuuccaaagaaaccaaguucagcuccuaguacccauauaggagugggcuuacagcugcuuguaauccaguuccaggagguccaacacucgacacugcacauacacucgcacacacgcacgcauguacaugcacacacacacacaugcauguacacucaugcacaagacagaagcaagaagaucucucugggaccagccuaaucuacauagugaguucugggccagagaggguuccuggugagaaccuuuuucugagggguggggguagaaagagagagacagagagaaaaggggaggggagagggggagaaaggagagagaggugcaguagagggagggggcugggcccuccuggaacugaggugcaggugguugugaucugccaugugggugcuuuggggauccucugcaagaguggcgcacacuucccugcugagccaucuuccagaccuccucccccgcacccccauuuuuuaaagauuauuuugagucacuuagauuuuugagauagggucugagauauuucaggcuggccugagguuugucacguaguggaauguguccuucugcuuguaccuucagagugcugggaucacaggcuacaugugugugcuugcuuuaugcagugugcugugcuaagcaagcacucuaccaauucaauuccauccuuaguguguacuugagacugucucauguagcccaggcugccuuugaauucacugucuagcugggcauaaccuugaguuaccagugaguuucccugccuccaacucucaugugcugggguuacauucuauacaacucccucuggcuucagugcucucaagauuuguuaguuuaccuaaucaugacagaauuucuugugagugccaucugucuguucagccaaugggaggaggcuuggucuugcucaaagucuuagguuuuguuuuugguuuuuuuuuuuuuuuuugagacaggguuucucuguauagcccuggcuguccuggaacucacuuuguagaccaggcuggccucgaacucagaaauccuccugccucugccucccaagugcugggauuaaaggcuugcgccaccaccgccggcaagcuguggcuccucgguucuuuuuuccacucucuuccuggagucacuuuguaugggcugaugccucucauccuggcugagaugggcugagaagccugggcgggggugggggugggggugggguggguaagcagaagucuguaggagguggccccagacuucuuagacucucuugaucacccuuuuccacaggcugagguauuucaggcccugcagcgacugcacaugaccaucuuuucccagagugucucccccugcgggaaguuucuggcagcuggcaacaauuacgggcagauugccaucuucagguacccucaacccugauuccuaccacacaggagcccuggcacuugagccuccuuggcuuugacuuggcucccuaccucucuuucaguuugucugcugccuuaaguucagaggccaaagaagaaagcaaaaaaccggugguggucuuccacgguggguauagcuguugagagugguucaggugaccucaggagagagaagggcucacaggggcuaaugagaguuuucugugucucucuagcccaugacgggccugucuacagcauggucuccacagaucgacaccuacucagugcuggcgauggagaggucaaggguuggcuuugggcagaaauucucaagaagguaagaagucuggagccuagggcagggcugaccuuccccaccucagagguguggggaucaggguuuccuccuguguuucuccaugaagggcuguaaggaacuguggcgucgccagccuccauacaggugagccaggaccacggugggggaggcaggugaggucacggacacucucugugauuuugacccuucucuuccuccaccuaggaccagucuggaaguacccgaaaucaaugccuugcugcuuguccccaaggucugagcucuuuaugaccauucaagaacuuguucccuacccugauggacgaggacuuucagcucccucuugucucccuccacaggagaauucgcucauccuggcugggggagauugucagcugcacaguauggaucuggaaacuggggccuucacagugaguggaggucuggggccagggcaagucugggccugcccuguguuuccugcaucuccugagccguccaccgcucuucccugcagcgggcccuccggggccacacagacuacauccauugccuggcacugagggagcgcagcccugagguauugucuggcggugaggauggagcuguacggcuuugggguaaggaaaauuccaauuacaggggacgaaaguaagccaggccuaguggcucaagccuuucaucccagcacuugggaggcagaggcagguggaucucugugauucugaggcaggcugguguacauacugacuucuaggacagccugagcuauguagagaccuugucuagaaaaacuaaaaaaaaaaaaagacaaaaaaugagaaagugggggugggggugucucaggcuuguggcucaccaggagccuuggugguuuuauuuucccacagaucuccguauagccaaagagguccagaccaucgaagucuacaagcaugaggugaggagagagugcgcccgugcccucuuccucauccgcccucagaugcccucacgucuuuccuccuuugcaggagugcucgaggccccauaaugggcgcuggauuggcugcuuggccacugacucagacuggaugguaagcugggcagagugucgggugagaguggccacugaagguccauggcucacagugaccggagccugccaccucucuguucaggucuguggagggggcccagcccucacccucuggcaccucaggucuuccacacccacuaccgucuuuccuauucgagcaccacagaagcacgucaccuucuaccaggaucuggugagacccccugucuugauccugucccacuauccagugcccccaccuagaccugaccccugcaccuccucuuuguccuccacagauccugucugcuggccagggcuguugugucaaucacuggcaacugagcggggagcuuaaggcccaggugccuggcuccuccccagggcugcucagccugagccucaaccagcagccagcagccccagagugcaaggugggucuuggaauggccaugggggucucuccaggccuguagaugggcgacuuagccagguaugucuucuuugucuucuuugccuuuagguccugacugcaucgggcaacagcugucgaguagaugucuuuaccaaccugggcuaccgagccuucucuuuguccuuuugacaucaugacccuguauuucaggagcuagagugaugcuuguguuuugggauagggguuuuaaacuuuagcucaggcuggccuggaacucauuuggcuuagcuugaucucaaacuccuguaugagauuuagcuuggugaaccguuacauucagcuuuuguuguccugucaaaauaaaauuuuaggcuuuucuuguuugcauuuuauucccca

SEQ ID NO: 8423 - RNA, 2836 nt, Mus musculus
ggauauaggaaaucagggaagacugacugaggaaggggcuucuaucaggguguguauuguguguguguguguguggggggguaagcuugagaccuccuugaggacagacuagacugcugucccaagggcaagaucugauuugaacccugaucacuaggcgccgcagcaccuccugcccacuucaggcuacuguggcccauucuggggggcgcucuuagucugguccugguuuuggcgcugguuucuaguuuccuggucuggagaagaugccgccggagagaaaaguuuacuaguaagugagcucuccacccucgcuccucccaccucccucaucacuucccuaauuguccccuaaccacaacaaccccacuuuuuauuuuccagcccccauagaggagacugguggagagggcugcccagguguggcacugauccagugaggagcacccgcgcuggggcccacucgucguccauucauucauucuggagucagccuggccuuccagacagaagccgagccagacucuuucaaccacaaggggguggggcgagguggugauucaccuccaaggacugggcuuagaguucagggagccuuccaagguguccaauugcccuaucucugggucuggggcagacagagagccucaaucugggucacaaagcgacccauacuaaggaacugcagcauuugcacaagggaaucucuuguuccccacaaguccuggcagucuggcugacuugaggggcagacacaacacugggucccacccacucggaggggcuauaaugccacucccugaguuuuagcccuaggagugggucagauugacagaccuguucuuaacacuaagggggcuggcccucugggagggcuggccccaguacacacggaaacaaccaucucccaaggggggugauauuuauuguggggauaauguuuggaggggagggagacuuauuaauaaaagaaucuuuaacuuuaagauauggccugaucccuaacuugacuccccagaacuggagggagggagccagucggccacugcgggggcgggggugaggcugugacucacacauucucaaugccuggagcucagccugccaggaccuggcuugcccucaccgauuuuccagggaagauuuugaggaggaaaccccagcauccaguaccccacccuccccaaaggcugcugagaaaucuucaacugcucacaggucuuuauucacuaaugggguaacauuuucccuuucccaggcugccuuucacugaggguuccaccgagcuaguguccucuugucagagggaagguccugguggccagguuugcagaaggacuucaucccuuucugggaguugcuggucuuuguugucagaaagaagauagggagggacacaggccaucaauacucagagcuccacgauauccccagcuggggacgcaggguaguagggacuggggguaucccccagccucagcagccugagggcuucaggaaucaggcucccgggauagcgccagagaagcagcucugggcaagggcuccuaaaagaagaaaaaaagauugaaagaacagggcagaaggcuggcuuggcagugccaccuccuaccagguccaggucgccuggagccaaagauggaaaacagcacaaguuggcuagaagcuaaaaauagcacgaugaggcagagagugaggaggggcucugaggaccgaaugugauccucuagaaggcccucaaggggaggugccuaccugagugguggcagggcuucgggaaaagucacaggggggcugcaguagggguggucauuauguaggcugagucgggagaaauggguggccauguucuccucagacaggaacugcuugugcaaagguucccugggggaaagacuggagaagaauagaggcagggauguugagaguggaggcaaacugaugaggaccaaaggugaaucuuggaagccccauccgccccuacacuuagaaguuccuucuccagggcucuccauggucacuggcacagcuccucugagaagggagcugggaaguagcgccagguguaguccacucucuuugccccuucccaaagaucuguccaccugagucuacaggguaaaccagguucccagaaucagccuugucuuguguggccuaagccaccuuccucucccaggcuauacacagguuaccuuggaaaucuugaccuuggcuucccugcuucaacacaagcucaagcaccacgguuuccugaaucgccuccccacuuuccaggaucccccuacugaccagcccuggaucccccagccaaaacuccugcccuccgcucguccagcccacucagggaccaauuacacaccuggcguuuaggccgcgaguuaccccagugguggcccgugggucccgacuugggggaccucgcuccaggggcuguugcaggaucauuacggcucaggguccugcagauagaggggugggauucaagcagcagaggcggagccuuugagggcgugguacagcgcgaggggcgggccuaccggcgugcgcacuggagacguuuuacgcaggcgcggaagacaggaaucagguuagagguuagaaggcgggacaggucggcgcggugggggaggggauccggcguggcuggauaguucugggcgcuuuuuagcauaagggugcuucguguaguucuccuagguuucugugguucgagacagcacggaccugccgccuuaguugcugggcgacaggcagugcuaggucuuggggcguaacgagaagagccaccaucaggcacguccggaaucgagagguugugucgugcgucgagaga

SEQ ID NO: 8424 - RNA, 2039 nt, Mus musculus
cagcccugagucuggcuugcggguggugggagcagacaguucuugccucgggaccggcaaucauggcuucggcuuggccgcggucucugccgcagauccucguguugggauucggcuugguguugaugcgcgccgcggccggggagcaagcaccagguaugcacggcucagacgacgguaaaccucggacuuuggggaggucagaaacggaauuugagugccuggagaacccggugaaaccagggaaccgggaagacacgaggauuugcgauuugugcucuucaggcagcaaguuccaagugggaaaggucucaaguuuuauccgcaguccgagcuucaguuucgcuaccuguccaauugaggugugggaggucuucugucucaaaagugagagccagaguagagagagaacguauauuugagggcaggagguuuguuuugggaagggggcacguccucaaacuggucuguaaugagaucuguccagucuugguaucuuugaaucgcgaaggggcaauggggacuuugcccucuauaccaugugggggugccccuuccauccggugacuucaaugcccaguuaugcggggggagggacuggggucgggcccggugcccaggagugagucacacuguggcgcgcggggggguacuguccccccccaagucccgcgccacucgaccccccucccgcacugccgcguuugggucaggcgaugcggucaccugcgaggaaugaguggggggcgggggggacacgcgauagugacucacguuauucgagccgacugacccugaccucagcccccagaauagccgcacccagccgcaagcuucugaccugcagcccccuccucaggcaccuccccaugcucuagcggcagcuccuggagcgcggaccucgacaagugcauggacugcgcuucuuguccagcgcgaccacacagcgacuucugccugggaugugagugggggcgggguggggcugguggcaagcggauccuagaccuggguaguggguuguuggggcagagaggaggguuguagacguaggauauaggaaaucagggaagacugacugaggaaggggcuucuaucaggguguguauuguguguguguguguguggggggguaagcuugagaccuccuugaggacagacuagacugcugucccaagggcaagaucugauuugaacccugaucacuaggcgccgcagcaccuccugcccacuucaggcuacuguggcccauucuggggggcgcucuuagucugguccugguuuuggcgcugguuucuaguuuccuggucuggagaagaugccgccggagagaaaaguuuacuaguaagugagcucuccacccucgcuccucccaccucccucaucacuucccuaauuguccccuaaccacaacaaccccacuuuuuauuuuccagcccccauagaggagacugguggagagggcugcccagguguggcacugauccagugaggagcacccgcgcuggggcccacucgucguccauucauucauucuggagucagccuggccuuccagacagaagccgagccagacucuuucaaccacaaggggguggggcgagguggugauucaccuccaaggacugggcuuagaguucagggagccuuccaagguguccaauugcccuaucucugggucuggggcagacagagagccucaaucugggucacaaagcgacccauacuaaggaacugcagcauuugcacaagggaaucucuuguuccccacaaguccuggcagucuggcugacuugaggggcagacacaacacugggucccacccacucggaggggcuauaaugccacucccugaguuuuagcccuaggagugggucagauugacagaccuguucuuaacacuaagggggcuggcccucugggagggcuggccccaguacacacggaaacaaccaucucccaaggggggugauauuuauuguggggauaauguuuggaggggagggagacuuauuaauaaaagaaucuuuaacuuuaag

SEQ ID NO: 8425 - RNA, 3084 nt, Mus musculus
cauuccuacuuucgaccuggaaaucuuagcagucucuuuugcaggugagccugggguauguguguaaauugcgggugugaaaauacgcaggcaggggauguggcagagugcgugcgggcgugaguuaaaugcuggagcuuugauccugguggcggccaccugcgguggccaccuaggcaggagaggguugcgucgggagaagcgcucggguccccucggccccagaaaaguuaaacaccccucccccuccccugggacaaaggcaccgaaaccugugacgccccuccuccaccugcuuggccacuuuggggcgggacucccuucccccucaccugcaggcgcggacccagcugcgggcgccgccauuaagccccuccuggucucgcacuccuaggcucggauaucagggguggccgaaccggacuggacguccgcagacaaagcugaccgagcacucgguaaguagagagggacagagaugagagggagagaaugguccccagcgugagccugcaagugagaggagucgaaaggggccuaugccauucuuaggggcaagguggacuuguagaaccgaggguuaugaagagccacagcagggcgccaagcagaacugauucccuucguaucaacaucaugaagagcaaaaugaaggacacaggugccugucacaaaaggcacugggaucuugaauuuuagcuccuuaaagcuguguggagaggggaaagaaagguagcacggccuuuggucuaaaacucaaaaggaugcucccagccucgaggcccgcaccuugacccuuagagguggaggugggucaagaaagagcugguagccuaggaaaaucuguuuuguggcaaaagggcuuguuuuuccuuaucucucucacccuauagggugggcuggacccggacuggcagggcuuccagcaacuuccagggauugggaggagcagaccuuggaacauagggagggcgagauuucaaggaauuauacccaccugaaacagagcuggggguuuccauuugaaccuugcuuggguggcaggaggaagcuucaggucuccucugagugcucacgggauaagggugggccugaaacuuguaucgagagcccgaccaauccaaaauuauacucccgacaugucauugucuuuguucugauaaaauguaccuaaggaugugacucagcuccuagaccgcuugccuggcgugcaaaaagccgaagcccugccuuaccccucuggugguaaacccugcaguccccgaauucagggaguggacacagaagguucaggaguucacagccagcaucagcuaugcagggaauuuauggccagccagccugggcuacauaagacccuuucucagcuaagauauaaaaaacaaaacuaaacuaaaaucuagacacaacugucgcuaugggcuguccugugcuucagguaugucuuauuuccugucccuugcaugaaaaucaacaggauuucauucuccaccugucacagucuaggaaagaaguaaaugcuuauuuugcucuugacugacccaggaaguguaucuaauccacacuacaggacauagcagccaacugucaaggugcuuggugcugguaucagcugucgaggugggauguccagacaugcugcucuuuaacaugacucuccuuuuaucuccuccacacuacacagcccccucaaccucaucauggccucuacuggucugcaaaucuuggggaucguccugacccugcuuggcugggucaacgcccugguguccugugcccugcccauguggaaggugaccgccuucaucggcaacagcaucgucguggcccagauggugugggaggggcuguggauguccugugugguucagagcacuggccagaugcagugcaagguguaugacucacuguuggcgcugccccaggaccugcaggcugccagagcccucuguguugucacccuccucauuguccugcuuggccugcucguguaccuggcuggagccaagugcacuaccuguguggaagauaggaacuccaagucucgucuggugcucaucucuggcaucaucuuugucauuucugggguccugacgcucauuccugucugcuggacugcccacucuaucauccaggacuucuacaaccccuugguggcugaugcucaaaagcgggagcugggggccucccucuaccugggcugggcagccucaggccuuuugcugcuggguggagggcuacuaugcugcgccugcucuucuggagggacccagggacccagacauuacauggccugcuauucuacaucugucccacauucucggggacccuccgaauaucccaccaagaauuaugugugaugcucacuggggagugaggcucugcuagccagggaaccugagcugagccaucaagaaagguuacggaguaguuuggggguugucuuauuucuuguuuuucuuuuguacuacuggguauugaaccuggggccccacgcauuugguaggcaagcacucaccagugagucauguggugcccugucugucccuaggguuuguuccaccuguuuuugagacaagcucuucucauggagcucugaucgaccuccagcuccaguuuuccugccucaaccugaguccaagcuccaccucucucucugcugcuggcauuucucacuuuuagcuacugaggcugggaggaugggacacuugaguuucugcgucauuauucauucuggggaucuucugugcaguguucuaaggcugccuggccuuuguuuuucucaaaauauccugucccagucccaagaguuccugcuguggccggagguaacucacaggacagacgcaccccuuccuggucagacuucucuccagcccuggaagggcaggugauaaguuaccaaggaauuuucuacccugagacuuccaaccuuuggccccugaaucccaucgccaagguuacuguguacucucccuacaaaaggucccagcugugcuguagacccuccucccccacaccuugcacacuucccugcucacacaaugcuuuacuaaauaaaacaugauuuuuuuuucuuacaau

SEQ ID NO: 8426 - RNA, 11653 nt, Mus musculus
cagaccguggcuucgcccagcugcccugauggguuacacugcacugucagguguagccggcuggagagcucucacugcccccuccaccagugcccggcuucgagccuuugguuggcaagcuggggcccgccugcugguguuuggggcccguggaguggggcugggcucaggggcuccaggcucucugcccugcuaccugcgcauggacgcacuggcucugcuuggagggcuggugaauguggcacgccugccagagcggugggggccuggucgcuucgacuacuggggcaacucccaccagaucaugcacuugcugagugugggcuccauccuccagcuccaugcugggguugugccugaccugcucugggcugcacaccaugccugucccccagacugagcugccuccuagcugccaaacuggcuugcccacagcuuccuggacaaauuccaccaccuuuccuccuacuggucugcaaggggcugguucccuggaagaaccagcacaugggacuuccuagcugggagaccauucuucauucuuccccauggauucacuucuugcauccaggccuucaaaccccagcuuccacuuuccuugccaucuucccuccugggcauuguuuugcugucauuagaaggaaaccauuuuuuuuuuucccaauuuacccuguuuaaccugugagagucucugacaguugaguccugccaacuuaccaagccuccagcccagaaccacuaccccuauguugcugcucccauacauaacuacaccuccugcuccuggauucuugagcuagccacucugacccugcuuccugaccuccaucucccugcucugcaugucaaaccucucagcagccagaauuuugcuguuccugucauuccugcagugaggaugcagaggagugggaccaggcuucucucagagccaaguggacauugguccugcuuguaucaucuggccaggagacaggaggggaacugcugcuuuuccuaggcaacaggcacagcuguggaauggagguguuggauucgggcuucacuggaccaaggacucagcucuucagugccauggucugacugaccugccuaccagagacuugucugcucaggaaaucucuauacaguggguggcuccagccugcuggcccaaggguacugacucgcagccagaucaucccaaaggcccaagacccuaggcaacaucaauaaagggacaagaagagcuaugcugccacaugagcaaccuuggguguucccaagacgcauuacuuuuuauuagacacggaaguuucaggggagaggugggcaagacggucagagguuuaaaagcaccaaggcuggcugggccugugcucaggcugggucuagggaguccucaaacaggcugaggagguuccuuggcucaaagguggggcagggaccucuuggaggcucugaguccacaucaguuagguccagggcaucccuugggggaggaagaagaagaagaagaaaaaaagaauaagacacuggauccuaaagaaaaccgugcccaagccuagaccccgggcuugcucaccuagguauguaccugccccgagggguagagguucuucuagugauccgggacaggacggucucuggggagagugagggacuacaagaaagaggacaagcaggguggugacgguugggcaaaguaggauauaaacagcccugcuccuccuuguuucaggccucugcuuggugaagggacaaggcacacuugaaauaaacacuggcagcugacaaguucucccgccugaccacauucauggguuaacucugucccuuuucagguccaacugagcuggguguggaguuuugguaaaugaagcuucucuagcauuuagaacgagccgucagagugaggggauauuucuauaaugggaggcauccugagagcauaagguuccuccuugcagccguuucuuaauuauacacucuuucccuuggcuagcagacaccugggagcaagggaauccucucaggacagggacuuaccaggugcugggagguguccacucaguggaagacagcacuuuaucucugaacagggacagccucuacagagguggggacugcaguugugcacugaaugucacagcugccuacacagaccaccaucuaccucuacacuggcagucuuuguccccugagugugacaggggccccgagaccccucgcauugaccacaaugauguacacacacaccacccacccuaugcugucauuaucccagcugcuggagagggugcuguccaggagggggcugcaagguggagagccaggugguguggccggugggccuggaggcugcagccaacuggcaggaugcaccagcccgugccagagccagcagagcagagugaccagggccuaaagaaagaaugagccucagaaaccaagccuugugaugaaucacagcacuugggaggcugagguaggaauaugaugaguucaaggacaacaguaaucuauacaguaaguucagaagugagccucaggaggccaggaaggucaccugggcaaggaacggguaggguagcccagcaccauaaaggcuuaccugccacagggcccagccucgacuuagggcuuccgcagccauauaccacagaacauuccagggacguggcugccucagcauggguaaggccaacagggccucagcuguggcucgaagcugggggucaggcuccagcaucauggcgaggacagaacgcagcucagaagacagaccugccgaugaggcagggccaugucggggcaggguacugacugggcccuuaguccaauggugcccccuacuacucaccaccccuugccagaagcuggugauaguuggcucuucuucugaaccacucaccagcagugaacucagggggcaaguaucccuggcgcagcugcugccagcccuccccaccauggggcaguuccauguuacaggccacuuccaagauggugagacccagacuaggaaggacaggacgcgaagacaaaaagaggcagagucagcuuugugacacacaucccaauccuauccagcauucuggugggaaagggccguucucuucuaccauaaaccauaaaguuagugagaaagggguaaggagcuuugaggagagcccuggagggccagugagcaccagucaagauggacaccuugaaguauggacuccacacucaagcagcuagcccaucagaaccacacugacaugcaaaugguuccaugguuacuaggguuggcaucaucauucuguagagaugaacagaauacacugaggcaggguaguaguagccaguauggucucaaaacccugggucuggcuguagucccagauguuaacuguggacuuaacaagucccuccaccucauuacucucccuguccuggagcacagccaugaagcugcaaggagacggcuagccuacaguauaaagggccucuggcaggcuugcugcuuacucuggaaaccuuucagcuagcagggagugacagcaccucccaggcuggauugcccuccuacccugugccaggaaggagcuccucuaucaggcagucccuuucugucugcugaucagccaccaacaaagggcucuuacaguccucacccaggccucaccugaacacaucugcugcugucccauaagagcccugcagcaguucuggggccauguagcgaggaucucccuccugggccucgccagcaccggcugaacccagcuccaccaguaguccaaagucgcccagcuugcagcggccccgggggcccaagaagauguuggcaggcuugacaucaaggugaacuaggccuugacuauguagaugguccagagccagaagaaugucccgcaaguagccccagaccugggccucuggcaggcuggccccccaggcuucacaguguugcugcaggcugggcccgcagaguucugucugcagguauaggaugccacccuccucccaggcccgcuccagucucacgcaguguggaugcugccccacuuucucauggccaccuaccucagccaguuuacgaguucggucuuuggggccgcggaauggcgacauguagcgcuuaacagcauagagucgcccaucuuccuuagagcgcaccuggaagggagguguugcccagaagcaggaugugggggcaggggauggggcaaucaaagaaugcuguccugauuucacaacguaggggaauccaugucagccuuagaccucugcgugcaaugauaacuaacuggacacaugcauguccacugcacaacggugcaucagagacccagcaacagaggaggugggguagaccuaugugcuaugaccaggguccagugcuaagaggaaaugguagucccccaaaccacggacagugucucugcuguguccaggcuuuccucuacagaggaaaagggucugugccgcuugcauuuuaaauaaaauugcuuuucaauaaugcuugcauaaaggaaagcuacuauuuuaggagaaauguaauuggaaaauuaaaaccauauuaaagaaaaugaugggcuggagagaugguucagugguuaagagcacugacuguucuuacagaggucaugaguucaauucccaccauucaauugguauuaggauccaaugcccucuucugguguuucugaagacaguuucuuucucucucucucugucuuuuuucucucucucccccucccccucucccucucucucuguaugugugugugugugugugaaucuuuaaaaaaauagaaaagaagaugaugaugagccaaggagaggaacagcuuuugaaccugcuagccuagggaauauggugugggauuagcuccaggucagacagacccagccauggacgcgccagcacagccaucuccaggcagaaagcagagaacugcugugggcugugcuaggccuggacaagaggccagugugcaugagguagcucuugaagguacuugaucuugggauggagagugguuguucaguccuagagaggaaggcugucagagaagaaagggcugcagggugccuaggacacuauuccacucaaguagggaacccaaggcaaagaggcuccugcgaagccugggaaaccacccuccauuuaccuugaagacuucuccauaugagccaugacccaggcggcugagccucuggaaguucugcugaaagaaggacucgggccggcucgggucauacccaggacucugcaggggcucugaggucucacacaggaaagacacccuccggggcuggggcuggugccagccuggggugcgaggggggaauagacggcugacagggaugcagcccuuggcagggggccgaggugggaggcuccgacugaggcccccaggccuuuugagggagaaaccaggcucugcgugucggaaguaagcuggaacugggauggggguaccacuuaggggugguggggugcccucggugggcauggucauggccaacgcuaaaggauccgagcacaaagcaauguguccacucaaacagcacuugguccuguggcccacaagagagccacuucuuugccacacacacguuguauuguccacaugaaggucgugugggccacaaguaccugcagagaaggaaaagaauaggccaugacacacgugcacaugaugccaucugaggccuggagguggcaauuacaccaagccaggaccauguccuguaucccuguaucccugagggccucauagcagcuggggaaugccaagccuggcagcccugcacgugucgauccagccucucccugcagccucucccaaggucccucaucaccaguuuaacaguaaagacaacgucugaguuccaaaacuuccuucuucuauuuucagaguuauuauacuacaacagauucuuuucuagaauauuccuauaaaauaugaaacccgagggcuucuccucagauauagacagaauagaggggaauuuacaaccaucuuaagucucugaauguaguacuaaagacagagaaaugaaguguuuacaggagaaaaucuagcaagucuugguaagaauguggagauccaguaggaucugcaugucgcuggcugugggcagggauccggaggugaggcucugcugccucggcucccugucaaacuugguguuggucuaggagagcaggcugucagcauuacuaagccucccaccaacuccacagggcagaggcugguuccagcugagugguagauuagccaagaccuuucuguuuuuguuuguuuguuuguuuuuugagacaggguuucucuguguagccuuggcugugcuggaacucacucuguagaccaggcuggccuugaacucaaaaacccgccugccucugccucccgagugcugggauuaaaggugugugccaccacugcccggcuagccaagaccuuucuucucuccccugccccacugaaagacaagauggaaguucuauauugggccuagcaggcugagaagccuauggucaagccccagcucauucauaggaagagagcuccacauuggaaaaggcaggcagggaaugccagagaccgcuguccuggcuuggcauccugcuucuaaggcaucagagccagucagggcaaagugcaccacuguccacagcacagauuagauauauugcccagggguagaagcaaucuguaaaacagaguccugaggcuguucccaggaaaacuugacuuugaaauacuaagacguccauaucugacaauacugucaaaaaaguaaggagggcugaauggagcugggcacagugacugucaccuauaaucucagcacuuggaaggcagaggcaaaaggaugaguucaaagcuauccuuggcuacacauagaauucaagaccaacaugauuuauaugagaacuugcuccaaaaaaaccccaaccaacaacaacaacaacaacaaaaaaaaaccaaaaccaaaaccaaacugaaagauaacugagcaggugaaaaacgcuugccuugcaagccugacaaccagccacauccaugugauugcacaccucacccugguaauaauacaucucuuuuagugaaagaaagcuuuaggucuuagcugaggggcugggcaugguaugcauuccugugauuccaguaggggacaguggagcaugaaggccacagaucugacagcagccuggaccacauauccagauuuugucucaaaaagaaggaagaaggagcuagagagguagcugagccguuaagaggagugacugcucuuccaggauuuucagcacccacauggcugccaggggaaucugacacccucuuuuuggccuccacccacauuacucacuuauaaaacauaggcauacauucaggcaaaacacccauacauauaaaguaaauaaacaaacaagcaacuaggaagaaaugcugggcaugaugccuuuaaucccagcauucaggaggcauaaaaucuuuaugagguugagaccaauuuagucuacacagagagauccagguuagccagggcuacauauauagugagacccugucuagaacaaaaaaaaaaaaaaaaaaaggaaaggaaaggaaagaaaagagagagagagagacagagagagagagaaggaagaagaagaaggaggaggaggaggaggagggagaggaagaggaagaagaagaagaagaagaagaagaagaagaagaaggaaagaaagaaagaaagaaagaagaaagaagaggaagaagaggaaggagaagaaggagaacaaggaggagaaggaggagaaggaggagaagaagaggaggaggaggagggaggagggaggaggaagaaaaggaagaggaagaggaagaggagguggaagaagauauguagcucacuggcucaguggcagaacacuucccuggcaugugauaggcccugguuugaucccuauuaccaaaaccaaaaugaauggacauauacuggggcacagcuguccuugcacucauagcuagaacuaggaaaaccaggaauguuaagcacacacaguugucuuuucaaacaaacagaccucuuuuagccagaaggcugggaauagagguggcuaaaaaccuaaccccugugcuagagagccaggccauaccuggcucccccaggauguccccagcagaaccagagguggcuagcagcccagaugacugcucgccagauccuuccgaggccuugagcuggcacauguagccuaucuagagaacugaggcguguuuggaucuaauuaugcuuccuuggacagagugggggggggggauucuguuacacuaggaaaccuuuuuccaaauuguacuguacuuaaauauaccuauaauaaacuacccagggucgaagucuagaaguuugaaccaacaccagcuacugagucguguugaacuggauuuucuucuugccucacagaggucaauccuuugcagguccuagugguugcagagacaccuccuaccccucacgugcauauacaaaaaacuaaaggccuaaauaaaaggggaaaccuguucauaacaauggucuugaaguugugaacugguguauaguuaugguacaguguuaccagacauuucucaaaacaaaguaaaggccuucagcuuaaauuguacaaucucuguuagaauuucagcuggcuccauuauugaaaacaaugagcaucuugggcagugguggugcacgccuuuaauuccagcacuugggaggcagaggcagguggaucucugugaguuugaagccagcauagucuauagagcaagugccaggacagccagggcuauauggagugacccagucucaaaaaaaaaaaaaaaauuguguguguguguguuuucccccucucaagacaggacucauuauguaguucaagcuggcuuugaacagccuccugccucaaccuccagagagcuggaauuacuuauuugcaaaaaggaugucaaacaaaccaacaggaaagaagaaucuuuucaacgaauggcacacaacuggauagcuacaugaaaaaaaaauuacuacaggggaaaaaaaucaacuuuauucaucuuucucacucacuauacuuauaguuuuacuuuguuuugagaaaagucuauguaaccuggacugauccugaacuugaagcaauccuccugccucagccuucuaagugcuaggauuauaggcaugagcuaccacuagcugacauugacagaaauauuaguguuugaucuuggaauggaugccucagauuugcuaguggucuuauacauauaugcuuucuuaggauggcuuuucaaaagcuauuauuuauuuaugggucaaaccauuauuuaaaagcuacuagucauuauaggucaaaccaaggggcuaacacacgucaggaaagcauucuaccagagcuauagccucagcccuacaucuguuugcuuucuuucuuuuuuuguuuuuuguuuuguuuuguuuuguuuuucgagacaguguuucucuguguagcccuggcuguccuggaacucccuuuguagaccagguuggccuugaacucagaaauccaccugccucugccucccaagugcugggauuaaaggcgugcgcccccaccgcccgguucaucugugcuuucuaaaucugagauguauuuuauuuuauuuuuuugagacagugucucuaguuuaggcugucuucaagcucccucacugugcagccaaggaaaacugugagguuuugauccuccggacaccaccuucagggaacuaggaucacagacauguccuacuacauuuaguuuaugcagugcuguauaucaaacucaggacaugauucauguuagacaaaugcuaaaccaacugacuuauuacuauaacuccagguccuaaaucugggauauuuugaauuaugaagagcaccuggcaccaggaguuuguggagcugcaacucugcacagacauacagaacgcugaaggacuuaagacauaaaugcuaacugcugucuuucuuaaucagugcuuuagauaauaguugaaaugacucaaguauaguagugcccuggugucaguaucuuugugccccuuggggcaaaagaggguguuggguugcuccaauguuguaauugaaacaaaggcaaaaaagcaauagaaaguguccauuuuaggggaagccacaauguaucaaaggagccacaccuaaccucuaguaguagcuagaucaaauuacuacuuagguuaaguacuuaagaggcuugcuggaaggcccucuuguuauggaucuauuuacuucaagaaucccaucccagagguggccuuuagcuuagugauagaguacaugccuggcaccaucagcguccugcauuugaugcccacccuaagaaaaaaaaaaacaaaucccaucccaggucuucuguaaggauccacgaucaugcuuguuaauuaaaccuacagucuugaaggggacgugggugggggagguaagaguacuugcugcccuuccaaaggaccagguuugauucccugacacacaagcgucuguaacuccaauuccaaagggaucugacacccuuuucugaccuaugugggcacuaggcacaaacagacaaaaauacacaugcauuaaaaagaguaaaaacuuuuuuuuuuuaaaggaagaaggaauacagucuccaugccuagcaccugggaguccaucaccuucuguuucagccagagagaccauucccucucaaugccauuuucauuucaacaucacuggucauuuacauucuaauaccucuggccuggucaaacagcuuuuauggggugagaaggguugguaguggagucccggcugaguacagagugucccugagccacuggguuuccagggaccucacccucuuacugagcuguacccaucuguugaccaccaucuagcguuagacugugaguuucucccgugcagggccacugcugaauccguucgguaggcgagggggaacucugacaaaccauugcguaaacaggcugucacccggggguggaggggcucuucccagagagccgcgggagaaagagaggcagugcuggaaaaggagcgcccaaugggaagggacaggggacccgcgggaguaggcggggcgugggcgacagcgcugaccuggagucauccgagggcuaguccggcccgugacagacacggagggguggggcugcugcaggggggugggggggugaccggauacugagaagaggccggagggcagucgcggggcgcagcgcggcaggagcgcgggccagggcgccggcggaagagcggcgcaaccgggagaucucacccgggugugggcucaccuggggaggcugggcguggcgcagcguggcgcagcguggcgcagcagcgaggucccagguuccgggucggcgggggccgcuggggaccucacagaggccaggcaggccggggucgggcagcggggccucuggacaccgggacgaagcacccuccaagaaggggaaccgcccgugaacgcgcgcggagccagcucgcgccaaaaauuccaaaccggccucgaggccccgcccaggcucgcccguggucccgcccccgccuggugcagcgggucuagcgcccggggcauuggccccgccucgcgucuugcgugcgcaccgaggucuccccg

SEQ ID NO: 8427 - RNA, 4397 nt, Mus musculus
caggguggcgggggcgaggagccgggguggagccugcuguccccuccggcguccggccgcgcccguccuccgggcugcggcgagacgccuggcugccguugcggccaaccggagcucucccuccgccgcucugcuacgguggagcugaaugcacugagcuccgaccugggguugccagcuuucucucccuugcgggggcgucgaacucgcgcgugcgcagcgcgugagggaagggggccgggaccuccuugcugacccgggcagggccaccggauagccggaggugaaucgggaugagcuucccagcgcugcagcuccacugagaaggaagcccaggcgcagagggucgccggucggccgcagugcgugaggccauggcauuccugaccgggccucgucuccuggacugggcuagcucgccgccgcaccugcaguucaauaaguucguauuaaccggcuaccggccggccagcagcggcucgggcugucugcgcagccuuuucuaccuacacaacgagcugggcaacaucuacacacacgguaggugagccgcgccccgauucacgcuucuugcacucgcggccgccuugccugugagcacagcagccccccaagcucaaguccuggacugucccugcucugguugggucaggcgccgcggugacaaagcugccauugucccaagcuucguugccagcuccugcuuucccaguagugccccaaagcaggacaggggagcagagugagagccagcuuaauccggcugagcucuagggguaagaauccugguauccccuugauaauccugcgccuugggcacccucccccuccagcgcucauccuggagaugggcguucacuggcuaggaggaauuggagagaagacugccccugccugacccaagcccuuccucgcgauagccuugaguccccacgaccauagcaguaccguggggcuccgcuuucccccaccccgccccccaacacacuucuugcgggccccuagagcucugcugacacagcccuggccuguccuugagccgccccagcugggagagggaacuagagccagcuagguuuagacuugggcuuuucucuagaggaagagcgcuauugucuagucagacccccaccaagaguggggcugaugccugcauuuguccucuauuaaggcaaugccaacugguuguggggaagggaggaauguccaagaaaggccagcacuggaaagaacagagcugaaagcgccccaguggagacaggauaggcuucuuccaguccuuuccccucauucuggccuuuccuggcuuucuuuauggaaaacaaaaagacccaaagccuccaucugccuggacauuugacaauguuaaguaacccugaggcugguaugucccuccuguccuaaucagaacucaggcugaggucaugcuucuccagauuucugcaggacggacagacagacagacaagacagaccuggucuggccuccuguguggcagggaggaacuguggcuuuagccaggaauuggucugcccugguucaucauccucucuccuuugccuacucgcugggcucagcugggacagauuacuccaagcuaguuuuugcaccugcaaaguagggcuuauugucucugcuuccuagaucugcagugauccugacagacaguaacccuucugaaaguuuguagcccgcaagaccugcucugugugggcaggcagcagcacugaacucugccuugcucugacuuucguuuguuuuucauagucaggccacuuuaguuuuuuuauuuuuaaacauacucauaguguaugagugggugggcagguguacuucugcccaggaauguggagguuagaagacaauuugugagaauugguucucuccuaccauguggaguucaggaucaaguuaagguugucaggcuuaacagcuuuuaccgacuaagcuauuuuccuggcuccaguugguaccuuuguggauaugauucuccuuuuaugcugauugugucugauauauaacucucccucccuucuagggcuagcccugcugggcuuccugguguuggugccaaugaccaugcccuggagucagcugggcaaggauggcuggcuaggagguacacacuguguggcuugccuggugcccccugcagccucugugcuguaucaccucuucaugugccaccaaggaggcaguccuguguacacccggcuccuugccuuggauauguguggagucugccuugucaacacccuuggugagccagggccccagagagguggcggcaggggccacuggugggagcuguggguugggaagaucagcuaauuuggacuuaaacccuuucucuccucuccucuccucuccccccaccucucucccucccucucucugcaggagcccugcccaucauccacugcacucuggccugcagaccguggcuucgcccagcugcccugauggguuacacugcacugucagguguagccggcuggagagcucucacugcccccuccaccagugcccggcuucgagccuuugguuggcaagcuggggcccgccugcugguguuuggggcccguggaguggggcugggcucaggggcuccaggcucucugcccugcuaccugcgcauggacgcacuggcucugcuuggagggcuggugaauguggcacgccugccagagcggugggggccuggucgcuucgacuacuggggcaacucccaccagaucaugcacuugcugagugugggcuccauccuccagcuccaugcugggguugugccugaccugcucugggcugcacaccaugccugucccccagacugagcugccuccuagcugccaaacuggcuugcccacagcuuccuggacaaauuccaccaccuuuccuccuacuggucugcaaggggcugguucccuggaagaaccagcacaugggacuuccuagcugggagaccauucuucauucuuccccauggauucacuucuugcauccaggccuucaaaccccagcuuccacuuuccuugccaucuucccuccugggcauuguuuugcugucauuagaaggaaaccauuuuuuuuuuucccaauuuacccuguuuaaccugugagagucucugacaguugaguccugccaacuuaccaagccuccagcccagaaccacuaccccuauguugcugcucccauacauaacuacaccuccugcuccuggauucuugagcuagccacucugacccugcuuccugaccuccaucucccugcucugcaugucaaaccucucagcagccagaauuuugcuguuccugucauuccugcagugaggaugcagaggagugggaccaggcuucucucagagccaaguggacauugguccugcuuguaucaucuggccaggagacaggaggggaacugcugcuuuuccuaggcaacaggcacagcuguggaauggagguguuggauucgggcuucacuggaccaaggacucagcucuucagugccauggucugacugaccugccuaccagagacuugucugcucaggaaaucucuauacaguggguggcuccagccugcuggcccaaggguacugacucgcagccagaucaucccaaaggcccaagacccuaggcaacaucaauaaagggacaagaagagcuaugcugccacaugagcaaccuuggguguucccaagacgcauuacuuuuuauuagacacggaaguuucaggggagaggugggcaagacggucagagguuuaaaagcaccaaggcuggcugggccugugcucaggcugggucuagggaguccucaaacaggcugaggagguuccuuggcucaaagguggggcagggaccucuuggaggcucugaguccacaucaguuagguccagggcaucccuugggggaggaagaagaagaagaagaaaaaaagaauaagacacuggauccuaaagaaaaccgugcccaagccuagaccccgggcuugcucaccuagguauguaccugccccgagggguagagguucuucuagugauccgggacaggacggucucuggggagagugagggacuacaagaaagaggacaagcaggguggugacgguugggcaaaguaggauauaaacagcccugcuccuccuuguuucaggccucugcuuggugaagggacaaggcacacuugaaauaaacacuggcagcugacaaguucucccgccugaccacauucauggguuaacucugucccuuuucagguccaacugagcuggguguggaguuuugguaaaugaagcuucucuagcauuuagaacgagccgucagagugaggggauauuucuauaaugggaggcauccugagagcauaagguuccuccuugcagccguuucuuaauua

SEQ ID NO: 8428 - RNA, 18874 nt, Mus musculus
guaccaugagacuacacaggguuuauugagggaaucagaugagcagaagacagcggcaggcaccaggccauuacuaucccacagggguggcuguuccacggcuuguuugcuaagggagaggagcaugcagcucuaugacaugaugaggacagcucuggccagggugcagcacgcaggaaauucugccguuccuggggacauuagagugccacugcuggcauggcuccugaguccugcuaaacucuucuacaggagguggcuuugaugccaucuaacugaccuggugcaucaugcgacaccaggugagcaacccucaguggugccgcugccacuagagcaugccuacauggugucaccuccuccugacaucugggcuggcucccaagaacuguggacacagguuuaaguugggaaagaacgcagggugccaagucugccagggagguagagcgaagccuuuagccuguuccgcucugccacagucagagcugggugagccuuagcaagcagcaagagacuaaagagcaggcaggccucacaccugccccuaaaagaugccacaaagcaaaacaaacccugcugugacuugcacugucuucagaggguggcaagaaguuccugcacauauccuggcuuggggugacugcauuuugcugaacuucauggagcgcacacgggaucacgcccacuggaaagcucugagcaaggcagugugcucugaaagcagauggugcugaggccuggagagcagagcagggcagagguauaucauccagacacaguucuccacagcugucuaaggucaggaugguaagagcagcaugggacaggccugcaggccacccauccagcuugguuaccacccaaaguccaagcacuccuccugggagaccucugaggaaaugugacaguccugggugcuuuggaagaguugucaucaagugcaucugaaggaugggaaacgccugcaaggaugggaagcauuuggggugccagcugcuccucuguugcuccagagaagacucacuucagcaggacuggcugcucaguuuuugcucuuugauuuuccugaugacagagaaaugugcaucauuacaaagguuuauuuaagccaggcaugguggugcacaccuuuaaucccagcacuugggaggcagaggcugguggaucuuuguuuaugguuagccuggucuacagagugaguucuaggacagccagggcuauacagagaaacccugucucaaaaaauaaacaaacaaaacgcuaaagguauauuuacggucucugugugaguuauuuuggguuuuuuucguuuguauuuguuugcugacuguaucucacuauacagcugaggcaggcuuggaacugaccauacaacuggcccagggaguuggucuuggccucuguggugcuaggucugcaggcacggcuaguucuuuuuuuuuuuugguuuuuucaagacaggguuucucuguguagcuggcuguccuggaacucacuuuguagaccaggcuggccucgaacucagaaauccuccugccucugccuuccgagugcugggauuaaaggagugcgccaccaggccuggcuggcacggcuaguccuuuuccucagcaaagacaaagccuguucauugccuggaggcuguccugagauccagcagaccuguaggugggggucuuuguuaucuaauauauggucacaaaucaccccuaaacagcuuuugggaucaaaaauguuaagaguggcugggcuggguacuucugacucacugugaugcugaggaacaacaucacaaggaccacagucauuuaagggaggaaccacucccacgacaguuccugcucuaaucucuucuucaaucaguuuuuguaaccugugucacucuugggguaguuuugugguucuggguauuaaaugcagggucucacacauccuaggcagguguucuaccacugagcuguauuuccaguuccucccucuaguaauucauuaaauaaaucacugaaguuguuuucauaccaauaaauguuaucuguaauagccuauggcuguuuuauucaucauuuuauuaauuuauugagacaaggucuuucuauguagaccaggcuggccuugaacucauagaaaucugccugccucucucucuguggcgaugggauuaaaagcauaugccacuaaaccuaguguauuauuuuaauuuuuuuaaagauuuauuuauuuauuuuauguauacgaguacaccauugcucucuucaaacauaccagaagagggcaacagaucccaguacagauggcugugagccaccaugugguugcugggaauugaacucagaaccucuggaagagcaguuagugcucuuaacugcugagccaucucuccaacccccccccuuuuuuuuuuaaagagaagguuucucuggauagcuuucgcuuuccuggaacucacucuguagaccaggcuggccuuuaacucagaaaucugccugccucugccucccaagugcugggauuaauggcaugaggcacuaacacuuuuuccaugaaaacaaauuuuccaugaaauaaaauuauuuacaaacuuuauguaugugguaccuguagucaaacacacaacauuauuugcauucuuuugugguagucuauauuuuucauuaaauuuuucaagagacaaccagcucuaaguguugagcugucucagaauaagagaggaagauggguuuggaaagauugcugggcaaaggcccaggaagaagcagguacaguuucauggcaaugggaagggaccagaggaaaugagaggcaaagguucugaaaaugcacaaguuaggcaaaagcccuggucacucaguguauaccuuucuucuucuucuucuucuucuuuuucuucuuggcugcacugggggccuucucccgcugccgcagggccuccaggccagccaggucagguggguggcaguggcuccgcaucaccaugacccgccggcccugggugauggcucggcugcggcagcccagccgagccuggucucgacacauccaguacacuuucucaccagcagccuucuccuuccuguacaggaaggacucauacaccaggaagcggccuccaagggauguccgcaggaacuccaguggcugcaggggcucuguaaggcagagucacugugagggcaccaguggagucccagcccgcggccacagggcucucugcucacuguaaucccaggaggguucacucuggucccugcuuccauuccucucccugcuccucagggcucuggggacuaauacucagacaugguccugacucucuagucuguacugccuuccuuuccugcccgggccaucccuggagcucugcuagaagccucaccagaccacgaacucugugcuugcugggagacccccugacagagguggggccuggcuggaccaccagagguucaucugguauuuguacugagggucugucauuccccuggccaucagcuagagcagaagaggcccagggagaagacagguaaagaagagaggcccagaugggaugguguaggggggagggggagagagggucucuagggcucagacauacugcucagucauauaugugugcccuucuagugacugacagccauaccacccuggcccaccacccccacuguuucuagagccagugucucuuagcacagcuccuggaaaggggcuggggugcugcugggcaaugagaagccacacucccuccacauaccugggccuucccagugggucagguuagggaaguucucccucugccgaagggcuuccaggccacccauguccgguggguggcagugccugcgcaugaccaucacccgcuggcccugugugauagcucggcugcgacagcccaugcgugccuggucccggcagguccaguacaccuuaucaccaguugcuuuuucccgucuguagaggaaggacucauauaccaggaagcugccuccuagaggggucuuuaggaacucaggcccuucuguaaagaaacaaaagaauaaucagggaagguacacgggaacugaaccuggccuuggguggggaauauucccauuuucauagccaagaacaccauacaccuuggagagacccuaccacccacuuuaugccuucuuccugcucacagugagauagcccugucuucaaaccccacacuccucaggugccagggucugcuuguccugaggcuggagacuggccaggccaggcccugcaggugaaguuuucuaugaagcuagcugaggaaggaggugggguguuuguuugcuccuguguaccaggugcccugcagaccagcaggcagaucuccauagccgugagagugaguccagggaagagcggcucggcucagcucagcgcucgagucucaggacucauggacuguguauguguguuuaggcuggguuugggcuugagcuacggagguaggaggaaccugaaggacagccuggcccugcccacuugucuuaugccugccucucuuguccuuacuuugaccaggcaccagggcugcuguggugguuuuaauaaaaauggcucccguaggcucagagauuugaaugcuuggucaccagaggguagcacuauuugaaaggauugggggguauggccuuguugggguggguuuugagguuucagaagccccagcuagccccaguggcucugucucuuccuguugccuguagaucuaagcguagaacuuucagcuacuccuccagcaccauuucugccugugcacccccauguuccuagccaggacaaaaaggaacuaaaucucugaaaccguaagcaagccccaauuaaaugcuuucuuuuauaagagcugccauggucauagcaucuguucauggcaacagaacacuggcuaaggcagaguuggugccacggacucggguguggcacugacaguccugaccuugcggcuuuguggcagaauguggacucuggggcuuugcacuaggaaagcaguugaacgcacuaagcauggaaacacggaagacagugacagacuacugagucacuggaugacagaagcugaggagcagcccugagaggccgaggucuugaguagaggcaucgcaucugacuccggagcuccuagaaagguggggaaggaggccaggagguaagggccaucugcagagaaaagcaucccagaugccaagaggaaagcagacaucacacuaaggagacuaagccucguggcuguggggaaugguccaccuccucccacaguggagaagccauuugagauuagaauguuugucaggaaaggguugaagagauggaaauuaagcaguuaagaguacaggcugcugccgggcguggugguggcacacgccuuuaaucccagcacucgggaggcagaggcagguggauuucugaguucgaggccagccuggucuacaaagugaguuccaggacagccagggcuacacagagaaacucugucucaaaaaaccaaaaaaaaaaaaaagaguagaggcugcucuggaggaccuggguucaauuccuagcacccacacuuacaaccaucuguaauuccaguucaagggaaucugaugcccuccucuggccuccacagguaccaagcacagacucaauggacagcagacacacagaugguacguacacauacacacagacaaaacagcuauacacaugaacauucaaagaaaagaaaugguuuucaggaaauaaaaaugguacaguacacuagcagaacaggcagaggcagugaacuguaaaauguuaagguguagccuggggcucucacaaagccacacugccgagcaagugugugggggaaauuaucaacagcuucaaaugagcagggucucaaauggcuucuccaagaugagaggcuccaggaccaccuaagccaaaagagaggaggggaccaaaauaaauaaauaaaaucccagagacagggcaucugacuaaggggauccaggugauagccaggcguggugucaaccccaggcaaggcugcagcagggcucagcaagcuuuguugcugccggugauguaaugcauggcagacagcagagagggaaggaggcagugaugggcuccuagaagaagaggcacacauagcagcuucaggacaguggggggagcacacagggagcggagaugggcagggcuccagcucagcagggguagagcucaggaagaacaaagggcagcuaugauaaugagauaguucagaaaauaacagcaccugcucugagcccgucaguucacuccugcgguucacuccgcagggagaagggagaacugacacguucauguuauccuuaaaccaacgcaugcaugccacagugugcaugugcauaugcaugugugcacacaccgguaagcagacugcugugagcuggaguccauccagggcuacagaguugagacccugcuucaaaauauaaaacaaagggcuggagagauggcucaaagauuaagagcacuggcugcuucuccagagguccugaguucaauucccagcaaccacaugguggcucacaaccaucuauaaugagaucuggugcccucuucuggccugcaggcauacauacaggcagaacacuguauacauaauaaauaaaucuaaaaacaacaaaaaaccuacaaaacaacaaccaaaaacuaaacaaaaagucuaaaaccuacucaaaaaaauauagcaagucuaaaucacuuccucugguuguaagucagcagguaacaaggaaauugaaaaauagauuaaauggauuaacgaugguagaaaugcuuagaguagaaugcauaggcugggaguauguccuguaucaucucccugcaaccaagcuggagagaggcucagcucucucagcuucuagacugugacccugaccguggcccuguuugugcuguaggaaugaggaccuggccuucuacacuugguagccucuacugacaacuccuaaagugucagaggaugagagacuagguuuaucagguuucagccuggaagacuaaguaggcuggugaggagggacccacgagagccauacccagauggacugaguuuggggcacaaggggugggaagaauauagaagagaggaugguagccaggcgugguggugcacaccuuuaaucccagcacucgggaggcagaggcaggcggauuucugaauucgaggccagccuggucuacagagugaguuccaggacagccaaggcuacacagagaaacccugucucaaaaaaccaaaaaagaaaaaaaaaaaaagaagaagagaggaugagaggauggugacuucuagaauauuuacagaaggaaggacaaggacaggacauguguaacaagagaaaaagcuauagggucccccacccccaccccugccagguaccugggccaucccacugagaggggccugggcguuucucccgcugccucagagucuccaauccuaacaggucugguggaugacaguggcuucgcaucacagucaccugccugcccugagugauggcgcggcugcgacaacccaugcgugccuggucccggcagguccaguacaccuucucaccagccacuuucucccgucuguagaggaaggacucauacaccaggaaguugcccccuagagggguuuuuaggaacucugggccuccugcagggaacaggacagacagucagggcuaagagcagaggaugcacaguaagacagcauggggguuggggagaagguagguugagaagguuggccauccccucccaaacugaagcaagccccuaaauguaagacucacuggggucuacauccugguccuccucggggggcuccugcgaggauuccugcugcuucuuugcucguuuucuagaccuggaccuggacuuggacuuggacuuggaccuggauuuggacuuggacuuggacuuggaccuacugagagucagugugcccugcccucuucgguagaacaggcuguccacuccuugcagcagugaguccucuaugucaucgcaauccuccaaguccccagccccaauucgccuugccuguaucuucuuuauggucuucuccugcugucgccgggccugcaagccuucuaugucaggugaguggcaauggcugcgcaucacugucacacgcuggcccugggugauggcucggcuacggcagccauggacugcauguucccggcagguccaguacaccuugccuccuaccgucuuuucccgcuuguagaggaaggacuggugaaccaggaagguacccccauagcaagucuucaggaacucaagaggccgauaccguacuagaggaaagacccagggaagucaccacauugagggcaagaguccggggucccaggaggaaccaccauguacuuucuucccagauguugacauauuucccugagcugggcaugugugaagcccaguccauuuccaccaagccacccaagaggaacaagaauuccuucuccaagucagugagacucaguucacaguucacaccacaaugggagggggccaagcagggcgcugagucagcagauuauguucugggucacucuuguccauauuuuucuaggguuugucuaaaaauuuuuuaucuaguuuuguguuuuacaguguauagaauuaggccuaaggcuuccagcaugcagggcaagugucaccaaguaacaucccuagcgccccccacccccuugaauacuguaggcucaccuucaaauaaucuuaacagacacauacugaaaagaagcuccccucccaccaguacagccacucagacucucagauccuugugggucaggagacucugagcuucuggaagccacaccuacuuacucuaugagcauaccaccucuaugaugccaccucucaccuagcuaggcagugcagaauacgacacgauuauuaucaacccacaagcucuucaauaguccaaguugccacaaccugcuucaggcgcaaacuccagagaccccagacuucaugugaauucugaagcuacaguccuuuaucuguggggcugaauuugaaccugggacucaaagccaaaccuugcugcuaggaacccuguccaaacuuuauuccagaaucacaaaagccugcccauugguauguagauuucugggcaccguaacaggcucugcuacaguggaaaacuugaaaggcccuaggaucccuugaccacagagccgucugaccuguggacuaauguugucauggaugcauuuauauuuuugacuuacagcacauuuugagaacccauuugaaaccccacauuuccuuugggagugaaggaucugaggguucuuuccuaccccaaacaaggagaggccgcauacucacucacccacuccugguguagggcguuucuugggaggcaggcucugcagugccagggaccgguaccccugcuccuccucugggguuucaaugcuuggcugaggaguagguucuggcuccacaggguacaaccauaggcucacuucaucuucuuggacuucagcgcccucaggcagggcugagcugggcggccuuccccuguggcgcuuuuuccuguccaggcccuccuucucaggugggugacaguggucccgcaucucugugacucgaaagccacgggugauggcccguccccggcagcuuagcucugagugcuggcggcauuuccaguacaccuugucccccacagccuucucuugcuuguacaggaaugacuugugcaccagaaggcggcccccaaauggggucuucaggaacuccagaggcuggggaggaacugggggcauaaaaagucuggauuagcuuuucuagagcaaggcucaaagucaggggccccagggaaugggucuuggaauaggucaggguccugugggcagaaugcuuuauugggcuccuagcugccaggcuagcccagguucuaaaagaugcuuuugugguaaggaaagggguuuagggaauuuagagaauucugcguacagcugcaguucucaugaaccuggaagaaagggccaagugcccagaacacuaaaagugcuuagagccuacgagucaacuagaaggacugggguauccaaaaucacccuuggauauggauggagauggguaugcaggucaacagauuugccagagccaggauggcagggcuagggaaucucaccugcaucuacccuacuacguuuccggugaauuauccguccuugcuucuugacuggugcaaccuggagaguauuguucgguaggguugcagugcuagacgucuccugggacgcgacaucugucggcuugggucucucuuuaucccuggccgggaccagauuggaggacucuugaggcuuccuggcuccaacagauggcuccuggccagcucucaggcucucacaguccugcucacugggcucaggcaggggcauccugagacccagagcauggcccucaaggccaccuucagcccucuggcagaugggucucucuucagaaugugggaguccagagccuccguccuaagacaagagccaaggcagucaguggagggggcuccugggccuggggcucuaacgaauggagcagggauggagcucggggauauggaccuugcuugguaccgugggauugagaggcugaagaggaaagggaccugggccaugcucuaucaggaccuuucccgacagccccacccaaaccucccugucacguguaaacugacugcacaggaagugccucucuggggcugccacugacuaacaugcuaaguuacugaguuucuaccuuagaagccucaucaauguccagcacagagcccuuccagcaucaguacuacaaggugaacagcuacuaggauaaguaaggagagagguacugaaacuggguacgccggagaaugaagaggcugaaaucccacugugccugcucagguaccugggugccuaccugggcugucuuugaccuugugcccuuuaccucaaugcugggaaccugucucaaagaacccaggccagugaguacugguacuuugcaugucagaaggccaaagucuagcccuggggaaaugugacccucugggcucacacagcuuauccucugaccuacucuggagaccucagcucagccagaguaaccuugcaauuguugucuuggugcugcccuggcuggccaggggcaagguuccaggccuccagucuggacaaagauggucagaucuggaguagcagcccagggugggcuaaccuuucuguaucucugaaacgacugaguaauauggaguuagcaaggugucucaccuuucaguaagagccauuaaacaagacuguagcacuccagacauuuuagauucucuaauuuuuuuuuaaagcucaguaauauacaccuuuaauuccagcacucaggaggcagagacauucgaaucucugaguuccaggcuagccaagacuacauagugauacccuguuuaaagaaaaauuaaagauuuauuuuuauuaauuauugggggauuuuuguuugguuuugguuuugagacaggucuauguacuuguggcuguaauggaacuaugcagaucaagcuggccuuaacucaagauuagccugccucugccucucuaguauugggauuaaaggcuaugccacuaugcccagcagauuuaguguguguuugugugagaucagauucccuggaacucuagucgaaggugguugugacccaaugacccaaugauaugggugauaugggaaucagacuucuguauucugaaagaacauuucaaugcucuaaccaccaagucaucuccagccauuaucuauucauuuuacauguauguauauguauguaugugcaccuuuauucauuuuacauguauguguauauaugugcaccuuuggcucuucugcaagaacauuaaguucucuuagucccauuaagcaucccuccagacccauuuuuagcuucauugcucguacccacaaguucucuggguccagugccuccugguccccuguuucugacccauggaucccuggucuaggagccugcaucagcuucccaaaggcggggucaucucugguguccaacaggacaacuguggccuaaggcuggaagagcacuggaucccuaauagccuuuuccaguugguguugccuguaggucauacccagcauaacaguggcaggucaggagcccaguccagucccagagacaacaaugcuugccccucucaugggaugcuaaggaccuuggaccuaugcaaagaccccuuagguaauuuuguggcaggaaagcuggaggcuuugccuaccagauguagcacccuucaguucccauguugcuuagguccaggaaucaacugacuucccccuugcccuggaaggugaggauccgagacucauuugcacucugccuugugucuuuaccucuaaauucaagaaaucccauccaccagggccaggcucccugaccaccagcuccauggaggccuuacagacgccugugccugcaugacucacggggagccagauccugugggucccucugccuccucagucgaggcuggcaugacaggaaagcccucauucucugagggcugcucccugaucggagagcaggcuguauggacuucucagcaaagcuucucuuuaucaagcuuccaggacuuaucccaaaagaugugaagacgcucccauaaaauagaaagaucccagaagaggcuggucucugcaacugacucgaucuagacuugagggacuaugcuuacuuucacccuuuaaagggcuugggguaccagccuguguuaugaucccaagccccuccacucagguauacaggcaacuagauauggugacuaacccuagcaaacacuaaaacucgagaguaccguuacacaggagcaaugacuccuaccuucacauguaaaggagaaaacaacaacaacaacaacaauaaaaaacaaaagaaguuaagagaaagcaaagggcuagguggugcaugccuuuaacuccagcacuggggaggccaaagcaggcccaucucugugaauucaaggccagccuggucuacagagcaaauuucaggacagccagggcuacagagagaaccccugucuggaaaacccgaaaaggaaaaacaguauaaguaggcacgagugugguguacaggccaagcggggucugagggcaacaagcagggcuggugagggagagcaggcauaaguguuuaacugggaugggguuuucaugacacacaugugccaaugaaacagaccaauaacaaugguuucagugguaaauuucaugccguguuucaccaugcguacaagaaccaccugccauauuccauuucccucacaucuucugaacaacuggugaugucucccugguggagaauuucaguucugaagaggcuggggaauugagcuuagugucugagugcuuguucuccaggugugaggcccugacuccauccccaaaacacaaugcccccugguuauuuuggagacagggccucucuauagccugucuuggaacuccuauauaaaccaggcuagccucgaauucacagagauccuccugcuucugccucccgaaugcugagauuaaaggcaugaaacuccauauuuggcuucuuuuuuuuuuuuguuuuucgagacaggguuucucuguauagcccuggcuguccuggaacucacuuuguagaccaggcuguccuggaacucagaaauccaccugccucugccuaccaagugcugggauuaaaggcaugugccaccaugccuggcucauauuuggcuucuuuaauacccucagugacagaagccagcaagaaaaaaaucagucacuuggcagugguggcccaucucuaagaguuucaggccaaccugaucuauaaagcaaguucaagaacagccggggcgggggggggggugcuggugagauggcucagcgguuaagagcacuuacugcucuucugaaggcccugaguucaaaucccagcaaccacaugguggcucacaaccauccguaauaagaucuggcgccuucuucuggaaugucugaagacagcuacaguguacuuacauauaauaaauaaauaaaucuuaaaaaaaaaaaaaaaaaagaacagccagggguacuacacagagaaacucucucucgggggauaggggaggaaaagaaaaauuagucucucuggauuuguucauaaacaaucagagcaggccagcacauagagacugaaagaggugccuagugggcuucacgccaaugucaugguaugagacccucucucccaucacacaagcacuagaaaaauaaaaaccagauaaaaaguauaagauguugacauucauguugauagggauguggguguucucuauaaaaucccguguuuggguuuuguuuaccuuugugucuuuguaugaauauacauugacuguacacacguaugcuugaauguaagugugggcaagcgcaucacgguguguauguggaaggcaaauaaccaccuuggcaucaguguuugccuucagcucacugaggaaggauuucuugcuacugugaaaggaaugccaggcuagcuuguguaugaagaguccugagcuucuccugccuccccucucacacagggcugggauuacagaugguuggugccacguccugucuuaugugaaugcuaggacacgaacccugguccucaugcuugaaugggagagcuuuaccaucugagccaugucucucaaccuuauuucaguuuaaaaaaauuaacuauaaauuaccuuguauuuauugucuaugugcauaugugcauacauuugcuuacaugugacagaggucaaaggauaugcuacagucaauucuuuuuuuuuuuaaagauuuauuuauuauauguaaguacacuguagcugucuucagacacuccagaagacgucagaucuuguuacagaugguugugagccaccaugugguugcugggauuugaacuucagaccuucggaagagcagucgggugcucuuacccacugagccaucucaccagccccuacagucaauucuuuauggccagacagagucugguuaucuaaacaggcccucggcuaggcagcaagacuuaucuguugagauaucagcauuccuuuguuuaggauuauuauuuuuuuacuuguuuugagaccaggucucacuauauagaucaggcuggccuggaacucaagaucugcccaggcuggcaucaaaugcaugacuuagcuguggcuggcccugagugcccgauccuccuuucccuaccucuaagugcuaagacuauggagugcccccagccuuguaucauuucguuugccugaugaaguaggcuuuaauguacucaauuuguaacaccaacuucucacucaauacaagucugugaagaaaacaguguuuccagguuagaucagugugaacaggacaucaagagucuaaaguuuguggucugggggcuggagagauggcucagugguuaagagcacugguugcucuuccagagguccugagcucaauucccagcaaccacaugguggcucacaaccaucuguaaugggauuugaugcccucuucuggugugucugaagacagugacaguguacucauacauuuaaaguuugugauuauucuuuccaccucuccucccucaguacucaggucacagagcugggugacuacggcacuccccuggcuugcucugacacauggcccugcugcuggucacagcugcucaaggcacggcaagaagcccugaaauauucgaaauuacccagugccuuucagacauaacuagguccagucccuaaugucuaacuaaaauccugaaagucagaugccucucuugucagcuaggagcagaggcaacaguuaccuuuacaugggagauaaauuacauugccaugcuccuugcuggacaggagacuugggccaagcuccaaaccuuuucuagcuaaucucacuugcaaaguaggaagaguggugcaugggagacgacucaguggguaagagugagugcuguacaggugugaagacugaggcucaacuccccagcaccuaugggaagggucacaugccugccuguaagccuagacuuggguugccgagucaggcacaucucaggaacuugcugccacccaaccucgcugaaacugugagcuucaggcucagugugagggucugucucaaaaaauaagaugguagaucuauuccuggcuucuuccucugauccccaccccuccaguagugaaugagauacugugagugagauucauccaugugcauaaagcauucacaaguccaguuccucacccaagcucagcgggguccugagcaaaggaaaaaggaggcccuguugucuauuaaaaaaaaaaaguccugaagacaacaaguaugguagcauaucccuuuaauccagcaauguggaagagaggcaggaggaucucugguagaggcuagccugguuuauacaaggaauuucaggccugucagggcaauacagugagacccuaccacaaccaaccaaccaaccaauaaauaauaaccaaaagaaccaaaaaccaaaaaaaaaacccaccccaaacaacaaaacccuccugagcugggcauagugguucacaccuauaaucucuguuacagagaggcugaggcaggaggucacuugaguccaggaucucaagaccauuuuaaauagcaugacaaaaucuuggccucaaaccauuuuuuuuuaauuaaaaauuuuuuuaaaguaagaaauguucuacaugauuucaguggcuucucucccaccagccucuuccacgaguccugagacagacagagcagagcacucuaccugguuaauaaacccugugguuacaacacagacuagacacaguacuccucagcuuccuuccaucacacccugggagucugugugcaagcaucacucuggggacaggagaaggugggaacaaucuccagacuucuuuuuuuguuguugggguuuguuuguuuguuuguuuguuuuuugguuuuucugagacaggguuucucuguauagcccuggcuguccuggaacucacuuugcagaccaggcuggccuggaacucagaaauccgccugucucugccucccaagugcugggauuaaaggcgugagccaccaccgcccggcaucuccagacuucuaauguggaguuucacaagcucugcacuggugccauucuagaccugaucucauuucccugggaugggcaggguacgauguuuauuggcaccuuugggcuuuauguacuaaauaaaacccacuaccaccucuuuucucaagucaccggggaaccaauacuccugguggagaggagggaugggacagugaacugaggauacuguuccaaagcgauucagcaaugcagacgcugcagcaggacauggugauacauaccuuuaauuccagcacucaggaggcaggggguggaggagcucugugaauuugaggcccaccugaagcccacagaugagggcuacauagaaaaacccugucuugaaacaaacaaacaaaaaggaauaaggcagagagugauaaacagccuuguguaugcaugcacagagacacacaaacacacacucagaaugauaaggaaaacccacaugagaugugggaagccaacugauagauuuccgcaauccuccuagaugagaaucuuggcuagacggauuccuuuaccuaacaauucagcuucacaucccucccccagcaaagccaucuucaucugcauaagugagcauguauuaucagcucuccucuacuucauaugcuguuuuguucccacaagucagacuaguggcacuugggagaacaaugagauaaacauaccagaaaucuaaaccaagccccagcaaugguaaggacccuggaaagcaaagaaguuaaaaacaaaacaucauaacaaaaagaucuuucuuggggaugguuaucugauuguagaguaaggaguaaagggggguuuaaaacugucagauaagcuaggucuugaaucaauggguuagcaagucagucauuuggaauggaauggaacggaacagaaaggaaugaauuagaacacagccuaaauagaucugcgucaugugagauugguaagcgacucucuuuaaacuugcgauucacgaaaucuaucuucaggcacagaauauacacauaaaacaucuuucucagucuagaaugcgucacaaaguuugaaagccacaaugggcaaccuauagucugaacgaggagggguaacaaccggcaaaaagugcaaggucauugggaccugcggccgccaaggaugggccgcgacggaggacagagcuggauggacaugcaauggguggacacgguucaaggaagaugggcgaauguguggucccggauuuagagguguuaagaucgguacaggagucgaguggguugauggagagaucagguagaaaggaggcgcaucguggauguccgacaaagaagcaccccaugcccgagcuacagagcuggggccccuccccagcaccgggcgcgaccccaggauagccggaccaggcaucgcuccgcugguccgacccucccgcccgcaggggcccguccucaccgacggcagcgggcccugccucuccggcggcugagccacccgauccuucgugugaguguccgccaacgcaggcgccggccuagcagccggggcugcucuaggaaccacgaccccgccgcccgcucccgccgccaacugcccccuggggagcgagcccgugcccgcgcgcgcgcccccgcgagacgccugcuugggaagccuagaaacuacuagcgagcaugcgcagcagaggcgcggagccauuccugaggcgga

SEQ ID NO: 8429 - RNA, 22211 nt, Mus musculus
agcggcucucaugauugcgugcugacgcacuaggucgugcugacgcgcaacgcugcccaggcggggugcgaguggcgcagucgaagcccgcugcggccccugaggaagcgaggaggcggcggcggcggcggcugaggcgggcggaccgacgaggcggcggcuucaggcuccgagggauacgaaaacuuaagcagcagcugcggcgggaccucccuguuugacagucggcggccggaggcggcggcggcgggugagagaaagggagcgcgcuagccgggugggggaggggcggcgggcugggccggaggcuagagcgcggggagaacggcccaggccgccgcgcgcacgcgugcucgucgccucggccggcgcggucgccuucccuuccuccccucccccucccgcgguuccugggacgcgcggccuucaacuccuccgccccucccccacacggccgcggcgcgcgcggccgccuggucucguccgcgcgcccccggugagacagcauugcgcgaggcucugcuucucuccuuugcucuaccuggggcugaggaggccgucguuccgcggucguccucuucggucuuuuagggggcggggagagggcggcagcggagguacuugucccccgcccgagcuucggaccugcugguaccucuccucgaucggcuccggcguggguccacgggcccugcuaggggccugagaaacggccagagccgcccagaccgcggggcgccgcguggcccccuccccccuccucgaggccgaaaauaagcugggcugcccagugggcggcgggaggaggccuugaacuuucggaggccaggauuuaaaccguucguccucguuaguaucagaggcugugagugugugcgugggggugggggauccccaagucuuaaaaagugaggauaauaaaaccgcgaaaguauucagccugcguguauaaggaagaccaaugugcuccuuucaacccuguuauuuuauuucuuuuuuacgguuugguuuuaugagcuagggccucuaaauagucuugguuggucuggcacuaaccguguagaucaggcuagcauugaacucaagaaaucugccugccucugugggaucaaaggcaugagacaccaugucuggcuccuacccugguuuuuguuuuuuguuuuuuuuuuccccggagacaggguuucucuggcuguccuggaacucacucuguagaccaggcuggccucgaacucagaaauccgucugccucugccuccacacccggcuccuacccuguuuuuaaaaaggucuccucaaauauuaaagcuaagccuuuuagagcuuuucgauggggaaaaaauucuugacuuaauagccuggcuucagucagccauuacuuggugaugacguucuuccuugcuguuuccaucuuacaguucuuuuaagaugucucuuaauuguggauucaaaaggaaacuauugccuuuuuccgugggaguggggccuaggccuggauguauacuguagcuuguauguuucauggugccuaugcagucaguagugucucagcucugaguucucuguauuuuuuacucagcguccuuuuccuugaucauugcuguucucucggucgcuguuucuugaauaucuuaguuugcuaauuuucuaccucuuuguauuuuggcauucugauaaguuuuccucccuugccggcaauuuguucuuggagaggcuugcaugcuuugggcuccuguuuuaaauacuuccugguuuugguaguugugguuucccuuuuaguguuucaagcauuguuuuuggcugcugguauguaaguccccccucccccuuuagcucgucucugaaaauucuccaaaacugugacucuaauacuuuuugcuuagcuuucauucuucagguagggugugggaggauuuuugugugaaauggugaaaauaugagugguuagaaggacuguuaggugagaaagcaauauaagcccuagauuuagagugaggaaggauugguuuuucuuuuuccaagacuaucaagagugguuguuagaagguacuacagaaacauuagagggggggggcuguaaaaaagguuuugcauuucuuagauuuagccuuaucucuuacucuuguugucucuccuagauuuaccuuucuugcuuuuaguuuccucuuguguuaacuguugagauugaguaggacuuauguuaggcuugaggaugaaauggggcaaaagugcaucuggguguuugcuuuacauucagcaucuuccuugauucccccccccccccccccgcacuuuggugacauguccccauccccagacuaggauuuuuuuuuuuuguagccaugguuguucuggaacuugcuguauagaccagauuggccuagaacucaagagauccaccugccuugcuucccaagugccgggacuaaaggcagugccaccagaaccaggcaacacacuucaguuuguuuuuuguuguuguuguuguuuuuuuuuuuaaaccgggcauugauaugguacuauuucacccagcuccaucucugcuaucugcuuuuacuaaccucugcuuuccccuguguguguguuuugaugcuaguuuucuuucccauguuugagacccuauuuuggagaaaauguguuagaggaaaaaaguaaaacauacauaguuagaagggaauagggaaugaguaauacaguccaaaaaacuggagcuugagaguuuagugaugcugagcuuggaacaccaugaaaagguagaaccuuacaggaaaacuguuaaauuggagaguaaagcaggacuuagaaaaacaaugaagugucagaacagggauugauugauugauugaaagucaacacuuuuacauuaaagguauggaauuugaacauuucuagguauuuguagagaaaguaugaggacaguuggaacagagaacgaauuugcguuuagacugaguugaaaacaggcaauauuuaacaagagcuagccagacuuggaggagcugcaagccaugugauaaaccuuacugggaaggaaacuaaaauaauaaaaucacuguaguugguaggagcuaugaauauuuggagucaaagagauggcucaccuuccccaugugaaguauaagcuuccccaagugaaguauguccaugauuucuguguuucugaugugcuugcuugcaugugguuuggguaugagacuacauagcacacuugguuuauguuaacuagccaguuugccuauuuagauaccuaggacuguuuaauccauuuuguguuuguucaaguuagcuuaaauauuuucuuggaggaggcuuugaaaauggacuuaggcuuuuauuaggugauucugauccaugguguguguuaugguauuuggaggauuugguuaccuguaguaguuacauuuagaguguuuggugaagauacuauuugugcguauuguggccaaacaguaaagggauagugugaagagauuugagagaacccagauucuuguuuucuuagagaauggaaauauaaguaaaaagaagaauggcuuagaauuugaaaguacauugugaggacuuguaaguagaugcugagugaaaaggaugaaguguggggaggaugaaaggagggauuuguuuguagacuaguggaaugaggaaacauuuuguuaauggagauucagugugagacuaaguguuguacuaagggcuaaguaagagagccagggaugugggagaugugguaaguaguuagauuggagccaggagccugacugguaucuacccgcgcccccucaggagcgguggugcccccugggcacagggccauguacaacgggaucgggcugccgacgccccggggcagcggcaccaacggcuacguucagcgaaaccugucccuggugcggggccgccguggugagcggccugacuacaagggagaggaggaacugcggcaccuggaggcugcccuggugaagcgaccuaauccugacauccuggaccacgagcgcaagcggcgcguggagcugcgaugccucgagcuggaggaaaugauggaagagcaggggugagggaauggguggggagauuccaagcacugagugcuuaguuuggguguuaggugggauguguggaaagaaacuagagcugguggaaagagucuuagagaaguuguaagggaggaagaaaaugagcuugaagaauugagaagaggcaugggucagugcauagugggaugucaaggaaacuuucuggagaauuaauagcaguguaaggggguuugaauuacuuagcugaauuuaugaaggggaaggggaacaugaaugaacaaaagcaugcugugugggaaaggagcauaagguagaagagccagguaaccugauagguguuguuauugguaggaggagaaagguagguggauugaaggauuguggcuguggaaguggcaaaggcagaagaucggauugaaagagaauuugaauagaggauaucaugaguugucagagaagugauauuuuggaaaaggagcacauucaggcagaaaacuguuuagagcagugguuuucaaacuuugagcagugguauccuuuuauacauuuugucuuccuugaagucccaggaaauaaaagaucuuuucuuauugaaguugggaaggagcacugggaacuccaccagcaagcccuccucucuuggcaccugaauuguguagcauguuuaaaauccacuguucuagagagcauaguguagagaaggaaggagugucguggagaaagaugaggaaaacuuaggaacaauuugagugacagugaguacaaaauauugugugcauggagaaggaaaaaggacccuguuggaagaggaagcaucuaaaaauugggacuugggaaaacuccugucaugcucuuaaccuugaagggauuuauccuucagguacgaagaacagcaaauucaggaaaaaguggcgaccuuucgacucauguugcuggaaaaggaugugaacccuggggccaaggaagaaaccccagggcagagaccagugugaguguuguucucuuuuuuccuuuuuugggaucuaugaaguuacagcuacugcugccuuuucucuuuaccuggguaggauucaguuuugccuucaucuuccuuagucccuagccuaacuguuuaauuccuccuuauaacuaaguucuaaauuagggcucugauuuuugcucuuuucaggguaacugagacccaucaguuggcagaacugaaugagaagaagaaugaacgacuccgugcugccuuuggcaucagugacuccuauguggauggcaguucuuuugauccucagagacgugcucgagaagcuaaacaaauagcuccugagccucccaaaccauacagguacucaggagaaaggccugaaucccuuccuggauuaaacauauucuauuauauuuauuacuagaagacuauuuccaaacuuuauuuuuauuuguuuuguuuuuugagacaguaucauuauguagcucuagcuguuccuagaacuauguagaacaggcuggccuuuaaauuagagaucuaucugccucugccuccuaacuguugagauuaauggcauuuauuugccaugacccauggcuuauugccaaacucuuagauuuuguuauuuuggagucaauuuuaaaaaagaaaaauguaugaguuuuuguuuauauguauccuuuuauaaaaugcccuggugccccuggaggccagaagagggcauuggauucccuuggugcuagaguaacagaugguucagcaucccuuagugcugagaauagaccccuagcuacaaaaagcagccuaugcucuuaacugcuuaucaguuccuauuuuuacuuuuuuguuuuguuuguuuuucgagacaggguuuuucuguauauagcccuggcuggccuggaacucacucuguagaccaggcuggccuggaacucagaaauccaccugccucugccucccgagugcugggauuaaaggcguacgccuggcuuauuuucacuuuucuaaaaaauuauuuaagcuggguguugugguacaugccuuugauccuaguacuccaggcagauguaggcagaucucugcguuccaguauagccaggguuacauaguaagaccuugucucaaaacaaacaauaaaacugggugacacaugacuuuaaucucaauauuuugagggcagaggcaaguggaucucugugaguugaggccaccuugcucugcaguagguaguucuaggacagucagggauauauagugagaccuaccuuaaaacauaaaacacacacacagaugcacacacccaggauuuacauccgagccgcccccccccccccccggauuuuucucuguagcccuggcuguccuagaacucacucuguagaaccuggcuggccuuaaacuuaggagauccaccugucucuguccuccuaguacugggauaaaaggcguguaccaccgcugccuagcaaauuuaaauccuuuaauucugaaguuuucaagcacaaaaaaaauugguguguagcaguuguccuaaggugaaaguuaucagugaacugcuccauuuauuuauugggguaguauauuuauucauuagagugauuuuuuuuuuaaauguauaugagugcuuuguaugcauauagauuuugaaugccagaagagggcaucagaagagggcaucagauuccauuauugugagugggugcugguaauugaacucaggaccucuggagccaucucuccagccccuaaggugaaauguuuuaaagaaauaugucuugcuugguaucuagaaucucuuugccuuuuucagccuuguucgagagaccagcaguucucgcucaccaacuccaaagcaaaagaagaagaaaaagaagaaagauagaggacgguaaguugguuggagaguuacacuaguauccagggguuacugccuguuguuggacuuuuagaaguugaguuugcuuuuagguagcagagaaucaaauugcagugacaguugagggaacagaauuacuuuuuagguuucagcugagaggaaauguguauacuuagugggaaaucauugauuauguagcccagccaaaaaaggaagcaguauuuuggauuugaauuuuaugcuuacugauugaauguaaaagugaauuaaguguggcuguugaugguguuggauuuuucuggugcuuuugaagcauuuuugagaauuauagccagaaagaaagccaaguagaaugacuugcuucugaacccauuuuagcaggucagagagcaguucuccucgacgagagaggaagaagaguucaaagaagaagaagcacagguaugagauaaaaaguucuuuuuguuguuuugguuuuuaaaaacaacaggguauuugcauagccuuggcuguccuagaaaucaaaauauagaccaggcuggccucugauuuggcagagaucuauuaccucuaccucugcugauuaaagaaauacagccaccaccucuggcuaagguggaaguucuugggggugauuggagguagcucuuaaauugaaggguagguguggguuaauaaugauuuucuguauuuuucacaaacaggucagaaucugaguccaagaaacggaaacacagguaagaaagcuuuuuguucuuaggggagacauagugguauaugggaguggugaguuacuguuugaugacuuuguuuuacucuauauuuggucuguaagauguguccaucucccccucccccuuuguuuuuaguagagcacaaaucuuuaaccuacuuguuaucaauaauacuugcuuggguuguuacuuucauuucacuucagauucagauuuuauuacuauuuuaaaauuacuuuuuaaacauuuccuucuuuucuaggucuccuacuccaaagagcaaacgcaaaucaaaggacaagaagaggaaacgguaaguguguuugggggaaguagaaaaaugcuucccuuggggaaggauuaaaaauaauugugccagagagagagagagagagagagagagagagagagagagagagagagagagagagggagagagggagagagggagagagagggaggagguagaggccagccuggucuaccucugguucaggaagugaaggcccuuuuuaucaaaccuaaagaccagaguuuuaucacuggaacuuaacguauuggaaggggagagugaacuccuauaacuugucuucugacuuccuuuuacauacuuaauaaacuaaauguaauuuuaaaaauuuuuuuaauauuuuuugacagagggucuuuuuauguaguucaauuauagaguccacgcucuagaugaagcuggcuucaccuuauagagauugacaugacugccucccaaguccugagauuaaaggcagggcccacgaugccaaagccaauuuuguuuuuaaaaagaaauuaguugggagaacucaugcuagguaugacagucuccugagcuuuguggugguuuuccuucaggucucgaaguacaacaccagcuccuaagagccgucgagcucaucggucaacuucugcggacucugcuucuuccucugauacuucucguagucgguaaggggugguccaugaggaauggagggagagggaaugauggguuaaucaauuuaauauuuauugagcgcccacggugugcuaggcgcugcacagaccauuccgaagacacggucccugcccucuaggagcugacaggcuaaagcaacaggauggacagacauauacauuuccccuugucuuuuuuuauuuuauuuuauuuuuauuuuuuguuuguuacgauguauauggacugccagaauagggcgggggugguuugcugguuugguggugucugagggagaaaggaguccuuacccuggcuuccuuaaucggggaaggcuuccugaaggaggugggcucagaggugaguugugaaugaaguggguagggaagggccuggguggaagguuuggguauauuggaggguggugaauaaugggguagagggacuuuuauuauuugggauuauauugggaagagagagaacaacaaaaaaggacuuguauuuucauuuuugaaaaugaauugagucaugugacuaagaacguuuguuuauuguuuuguugguuuuuuuuuuuuugguuugguucuuuuuuuuuggaaaaaaaagguuguacauacaggaaaguggauugcuaacuggggguggaggggguuuucuauucuucuuugagcugauuuuccuggucuccccugcccuccauuaacucacaggucucgaagugcugcugcuaaaauucauacaacagccuugacugggcaaaguccuccccuugcuucagggcaucaaggggagggagaugcaccuucuguugaaccaggugccaccaacauacaacaaccuaguagcccagcucccucuacaaagcaaucuagcaguccuuaugaagacaaagauaagaaagagguauguucugaguugguaguguucauuggguugcagggauuuauuuacucagggaugugccuuaaaugggcaagugugguacauaauguaguuuauuagacaaaaaucuuguccuuuagauuauggucagguucagagaucaagguugacaagcagcuauagaaagcaguuacauguguggggguguaugugaguggauugggugguaguuucagagaaaccaauaguguaagcaaauaugaagauuuuuagacaguauucaaagaagauacagaaugagagaaagaguucucuucaguuggaacucagcaacauggacaaguuuaguggugcauaaugccaucuauaaacaacuacugagaaauacuugaguuccuagcccuacauuccucauucaguuuccaaguccuuuuacacaccuacaaguauuuuagaguuaugacccacuaaauugugaagucuucagaaugaaacuucauuggauauuaguaaguuuuauaucaguaauuuguuuauauccauacagagaacaaaaugguuuauuuuuuugaaaccagaacauuuauuuuaugacugauugaaauccuaaaggugaacuggaugcuacagcagcuaaaacugcccucuuggguugagauguuguuccuucaaggaauccaugucugaaugugggauaaacaauuuuaggcuccucauccacccagacgcaguagugcuuugucucuuuuagucuugggacuccaauaauacucuugcucuugccacaauagccacauuugccacaggucaacuucugaagguggugguuaagugccuuagugccauagaaguggcacauguacaucgaauuaugaccaaggaugauguuuucuuuugucaucuugcuucugcccaacaaaaaguuuucuuuuuuuuuuuuuuugauuucuuuuuuuuuaaauuagguauuuuccucguuuacauuuucagugcuaucccaaaggucccccauacccaccccccaacaaaaaguuuucuaaaaauuaccuuuaacuuuacuacuuaaaguaucuauauccuuuuuauuguaugcuugucaugaguucuuacauuuuucaauccuuugauuugaugccaccaaucugaaagcaugaaagaauuaucuuuuuaguaguuccuguuuuauauucucuauucuaguucuguggcugauuguuucuacugguuucaguaauuaauguaacuuaauauuucccguauugugucucauuuuaaagauaaguuacaagaaaacuuugcugcuugcuaugguguuugugguguuuucuguaauuaagcuguuuuuaugguuuggccuguuccuguaagaccauggugaauuaauuuuuguguguauguaugagggggaggcaaauguguuacauguguuuggaggucaaaggacaaaacuaccuauauauguguucuguggauugaacucugguuaccaggcuuauguugcaagugccaucucauugacuguuggucaguauguuuguuuuugagacagggucuccuuacauaaggcccuggcugucaugcaacuuaauacauaguucaggcuaaucuuaaacucacagagcuccaccugccucugucucugaaguacugggauuaaaggcauauauggccaugccaggccccucuugauaaaauuuaacacauuauacacuuuaaaaccuugugcccauuugugauauuuuaagucaguccauauucaggugaaaguuauugucacccaaacuuucucuuuuuguuuaauuauaccuuuuuugggugguguuguaguguucauuugcaacccauacacaacgucagacacuuucccuugaaaagaaaaaaacauucaauagagaugacuugcuugaugaguuuaaaacacucaucaaaagauauugaguaaguuuaagagaacaauguacaaagcaaaaaaaaaauuaagagguaagauaaaaaaaaaggaaaaugacuuaguaggugaguaauugguugcuagugauagucuauguguaaccccaguaugcaaaauggagacagggcugucugucuauaagguguaccacagggcaggugguauuuuguugguaaugcauuguuuacauuuucuuguuucucugaauuacuacuugagguuagagauuguuuauauggucagguuuuucccuugcuacuuuauuuucucauuguuaaaaaugcauuuauuuugugugugugcaugugauacaugcacaugugcaguucauagaacaauuuugaagaguagguuuucucuuugccaccucaugggcccauuaagcuaucuuacuggcucccaacuaagcauugcauauugucuuguuacugaguauaacuauggguagggaaagggucaauugguauaagaaguauauaguguaaaauuuuauuagaaacucuucguaucuuauaggauaaugagguuuugguguuuuuuuuacuauuccuacuucucuuuucacucuuagaaaucugcaguucgaccuagccccucuccggaaaggagcagcacagggccagaacuaccugccccuacuccgcuccuuguugagcaacaugucgacuccccacgaccccuugcagcaaucccguccagucaggagccaguuaaccccucaucugaggcuuccccaacccggggcuguucaccaccuaagucuccugagaaaccuccccagucuacuuccucagaaaguugcccaccauccccucaaccuaccaaagguucucggcaugccagcucuucuccugaaagucuuaaacccacaccagcuccugggucccgucgagagauuucuucuucacccacaucuaagaaucgcucgcauggcagagcaaagcgggauaaaucucauucucauaccccaucucauagagcagggaggucucguaguccugccacuaagaggggacggucucgaucuagaacccccaccaagagaggucacuccaggucccgguccccucaguggagaaggucaagaucugcacagagguggggaaaaucuagaaguccccagaggcguggccguucaaggucuccucagaggccagguugguccaggagcagaaauacccagagaagaggcaggucuaggucagcaaggcgaggcagaucacauucuagaucuccagcuacuaggggcagaucccgaucuagaacaccagcuagaagggguaggucucgguccagaacaccugccaggcgaagaucacgauccagaacaccugccaggcguaggucucggucuagaacaccagcucgcaggggcagguccagaucaagaacacccgcucgccgcaggucuaggacacgaucaccaguucgaaggaggucucggaguagaucccaagcuaggagaagugguaggucuagguccagaacaccagccaggagaaguggcaggucaagaucuagaacaccagccaggagagggaggucccggucuagaacgccagccagaagaagcgcucgaucucggucuagaacgccagccaggagagggaggucacgauccagaacaccagcacgacgacgaucucgaaguagaagucuugugagacguggaagaucucacucuagaacaccacaaagaagaggacgaucuggcucauccucagagaggaagaacaaaucuagaacaucucagaggagaagcagauccaacucaagcccagaaaugaaaaaaucucacguuuccucaagacggagcaggucucuuucuucaccacgauccaaagcaaaaucuuugaggcgaagccuuucagguuccucuccauguccuaaacaaaagucacagacaccaaccaggcgaagucguucugguucuucaccaccuaaacaaaagucaaaaacaccaccaagacagagucguucaaauucuccucagccuaaaguaaaaucuggaacaccaccaagaccagggucuguaacaaacaugcaggcugaugaaugcacugcaacaccacagagacagagccauucugaaucaucaccugauggugaggugaaaucaaggaccccaucaagacaaagcugcucugggucuucuccucgagugaaaucuagcacaccuccaagacagagcccaucuaggucgucaucuccacaacccaaagugaagacagugauaucaccaagaggaagaagccauucuagcuccucuucuccaaguccuaguagagugacaucuaggacaccucagaggaaaagcagaucaauaucuccuugccccaagguagacucuagauuaagacauagccguucuagauccuccucaccagauuccaagauggaacugggaacaccacugagacacucaggaucuacaucuccauaucuaaaaagcaugcuccagacuccaccagaucaaaaucuuucuggaucaaagucacccuguccccagaagucuagggauucaccaacaggaagcucuggaucuuuucaccucuguccagguguaacaccuaguaguauaguaccaggagagagcuguuuuagcgccucauuugugcaacaaaaaggacacacucaaacuuggccagauacuucaaguccagaagucaugcagacucaaguggaaucuccauugcugcagagcaaaucccaaacaucuccuaaggguagccuuuccagaucuucaucuccagucacugagcugacagccagaucaccaguaaaacaagauaaaagugaaauaucaacagauccaaagcugaagucaggaaugucuccugagcagaguaagacuaaaccugacucuagcauauauccuuuaguagacucuaaaucuuuucuggugcagagcagauuggagccuucugaauuaaaagagagacuggguuuaauucaagaggauguugcaucaucuuguauaccaagagacaaauuuaguccuacacaggauaggccugagucuuccacaguacugaaagucacaccuagaguacuauuaaaagaaagaaguggagcuggcucaccuccaggcaaaagagaccaaaaaaguuuauuaccuaauucaagucaagaugaacuaauggaaguagaaaagucugagcaaccuuuaagccaaguucuacccaguuuaucuccagaacauaaagaaaugccuggaaguaacauugagucaucuccugaaguagaagaaaggccugcuguauugucugcucuugaccaaagccagucacagccuucaaaagcagcagaaaccccugcaguggcuucauguuggagugggccacaaguuucuccagagcauaaagaacuaucucauucucccccaagggagaauagcuuugagucaucuuuagaguuuaaaaacucaggcccuguuucagaaguaaauacuggcuuuucuccugagguuaaagaagaauugaauggaucauuccuuaaucaaacagaggcagauccaucuguggacaugaaagaacagucaaggucuuccaggcgaagcaguucugaguuauccccagaaguaguggaaaagguaggauuauuuucaagucagaaaguaucuucgccuguacuugagacuguacaacaaagaacaccuucaagagaaagaaguaguucugcaucuccugaacugaaagaugguuugccuagaacgccaucuaggagaagccggucugggucuucuccaggacuuagagaugggucugggacuccuucuaggcauagccuaucuggguccucuccugggaugaaagauacaccucaaacccccuccaggggacgaagugaaugugacucuucuccagaaccaaaagcauugccucagacuccuagagcccgaagucauucuccaucauccccagagcgcaacaacaagagugucaccccucagagagaaagaagugggucagaaucaucaguagaacagaaaaaucuggcuaggaccucuccgggacaaagaagucgaucugggucuucccaagagcuugauggaaagcccagcgcguccccacaggaaagaagugagucagacucuucuccagauuccaaacccaagacucggacuccucucagacagaggagucacucuggaucaucuccagagguugacagcaaaucucgacacucacccaggcucaguaggucuggcucaucuccggaaaugaaagauaagccaagagugcuacagagggcucagagugguacugauucuucuccugaacacaagauaccugcuccucgggcccugcccaggcauaguagaucagguucaucaagcaaagagagagguccuuccccugaaggaagcaguaguucugagucuucuccagaacacgcccccaaauccagaacugcucgaagagguuccagguccucaauagagccaaagacaaagucucacacaccaccucgacgccggagcucucgaucaucuccugagcuaaccaggaaggcuagagucucucguagaagccggucugccuccucaucaccagaaauccgcuccagaacuccaccaagacgcagaagaaguccuucaguaucuucaccagagccaacugaaaagucaaggucuucacggaggaggcgcucaguuucuucuccccguaccaagacaacuucgaggagaggacggucuccuucacccaaaccucguggacuccaaagaucccgaucccgcucacggagagagaaaaccagaacaacccgacgcagagauagaucuggaucaucucagucaacaucucgaagaagacagaggagccggucuagaucacgaguuacucggagacggagggguggcucugguuaccauucaagaucaccuaccagacaggagaguucucgaaccuccucuagacgcagaagaggccgcucccggacacccuugaccagucggaagcgaucucgaucaagaacaucaccagcuccuuggaagcgcucuagaucucgagccucaccagcuacucaucggcgguccagguccagaacaccacugauaagccgacguagguccagaucucggaccucaccugugaguaggagacggucaaggucagugaauaggcguagaucucgaucaagagcauccccagugagucgaaggcgauccagguccagaacaccaccaguaacucgucgucguucaagauccagaacaccaacucgccgucguucucguucuaggacuccuccagugacucgcagaagguccagauccaggacuccaccaguaaccaggaggcgaucuagaagcagaacuucaccuguuacuagaagaagaucaagauccaggacauccccagucacccggagaagaucgagaucucgaacaucuccagucacccggaggcggucccguucccgaaccucuccagugacaagacgacgcuccaggucucgaacuccgccagcaauucgaagacgaucuaggucucggacaccacuguugccacgcaagcgcucucgaagccgcucaccacuugcuauccgccgccguucuaggucucguacuccuagggcagcucgaggcaagcgguccuuaacaagaucuccuccagccauucguaggcggucugcaucuggaaguaguucugaucguucacguucugccacuccuccagcaacaaggaaucauucuggaucucggacaccuccuguagcacucaguagcucuagaaugaguugcuuuagccguccuagcaugucaccaacuccucuugaccgauguagaucaccuggaaugcuugaaccccuuggaagcgcuagaacgcccaugucugugcuacagcaaacagguggcuccaugauggaugguccagguccucggauuccugaucacccaagaucaucuguuccagaaaaccaugcucagucuagaauugcacuugccuugacagccaucagucuugguacugcccggccaccuccauccaugucugcugcuggccuugcugcaagaaugucccagguuccagcaccuguaccucucaugagccuuagaacagccccagcugcuaaccuugccagcaggauuccagcagcaucugcagcagcuaugaaccuugcuagugccaggacaucugcuauuccggcaucugugaaccuugcugacucaagaacaccagcugcugcugcagcuaugaacuuagccagcccuagaacagcaguggcuccuucagcugugaaccuugcagauccucgaaccccugcagcuucagcugugaaccuagcaggagcuagaacaccagcugcauuagcagcuuugagucucacaggcucugggacaccuccaacugcugcaaauuaccccuccaguuccagaacaccccaggcuccaacccccgcaaaccuggugguggguccucgaucugcgcauggcacagcuccugugaauauugcuggcucuagaaccccugcaggcuuggcucccacaaaucucuccaguuccaggauggcuccagcauugucuggugcaaaccucaccagucccagggugccccuuucugcuuaugaucguguuaguggcagaaccucaccuuuaaugcuugaucgagccagguccagaacaccaccaucugccccaagccagucuagaaugaccucugagcgugagcgggcuccuuccccugcuucaagaaugguucaggcuucuucgcaaucucuucucccuccugcacaggaucggccucgguccccugugccaucugcuuuuucagaccaaucucguucaguuguccagaccacuccuguagcagggucucagucccuuucauccgggacaguagcgaaguccacauccucugcuagugaccacaauggcaugcuuucuggcccugccccugggauaucccaugcugaagguggggagccaccugccucuacuggggcccagcagccuucuacauuggcugcucugcaaccagcuaaggaacgucggagcucuuccuccucuucaucaucaucuagcuccuccuccucuucaucaucuucaucgucauccuccucuuccucuggcuccaguucuagugauucagaggguuccagccuuccagcucaaccugagguggcacugaaaaggugaggcaauuaagggaucuagggagcagggacuuaacaaugggugggugaguagggagggagaaaucuugucaaaagcacuuggcuuugagaaaguaugggggaccuuggccuucaagcugggaguagaaagaauguugggcgggggcuuuguggggaggaaugggacagauaaaagucuccaaagguuaauucuccagaggauaaugauaaguuuuccaucucuacagaggacagaacuagaggaaauggacuuaauuuuacagcaggagggauggcaguuagaccucaagaggaacucccugggcuggaaggaucuucagaggucaucccaucccucucccugccuccaggcaggacggccccuccccagccaaccugcacucacaggggccuccccaagcugcggcucuccaaggaaggagaucacccagcuucagcuuccacaucugaguccaggggccuuaauccuucaucagggacauucuugagguuuaaccuugaucccuugugcuucgggccccagccuguugcuuguguuagcagagguuuggucagcucugugccacugcuccagagaaguacuacucacuggccugccuucguguuuucccagggcuuuucucaggcaccccucccccacugccguuccuccaggccaaggaagguaggguugggguuggggcaucuugucuccuugugacaccuuucuucucucacaggguucccagccccaccccagucccaaaggaggcuauuagagagggacguccucaggaaccaaccccggccaaaaggaagaggcgcucuagcagcuccaguuccagcuccuccuccuccuccucuuccucuucuuccucuuccuccuccuccucaucuuccuccuccucuucuuccucuucuuccuccucuucuuccuccucuuccuccucccccuccccugcuaagccuggcccucaggcauuacccaaaccugcaagccccaagaagccacccccuggcgagaggaggugagugcuuucuugccuguuguggaagggggguuggggugaguucuccagaaaggggacccugggugagguuccugcuggggugccucguguggacgucugugacugguuguacgggagaaggagugccggacuccucccauccucccacaguguuguauucuggucaagggcugcacuaucuaacugaggugucccaggccauaucugggaagucauaggauucuuccucccucuccccuccccugacaagcagccuggucucagagaucuagcucuaagucuccccauugcugcugcagggcucuggucuggccaccgucaucuucucccgacucuguccacagccuccucccugucucccugccuccacgccauucucuuccacacguagccagagggaucuuucuaaaacgcacaucugguuacuucccuucacuccacaaauccuuccggaacgcccuguggccugcaggauaaagugccaccucugcgggaauggcgugugaggcucuucaccagcugcccuugcccgcccugugcuccuccugcccgcccccacacaugccccgugcuccggccauacccagcgccuugcagucuaaggagagccccaugccuuuggacaugcuguuccuucugccugggauuuccuugucugccuggugaacucguucugcaagacugcauucaaacagcaccuccgagaagacugcccugccauuucccuguccugcccagguccccauccuuucucuggauccccaggcccaugcauauccauccugcugggcuguuuccuauguagggggcgugugugccuucauuguuaaccuuuacuaccaaacaaaauucuuccaagggcagggacucuuuuaucuuugcaucccccgcugcacccugugcccuguccacugggguacucgguggauggugugcgggcggaugggugagugcggacaaaggugggucugaggcuggcccuguguggugugagguuugguggucaggaccugggugggugguccugaaugcuuggcugguggguuugggaggauguggagcuauagaggccuacucugcuuccuaggucucgaaguccucggaagccaauagacucccuucgggauucccgaucccucaguuacucacccguugagcgucgacagcccucgccccaaccuucaccaagggaucuacagagguagggccuauagcaggugcuagcaaccugacucaacuagcuaccauuaauuuguaagcaaaauuuaaaaguuuuugguauuguucugugaccuaauuucuccucuuguagcagugagcgaguuuccuggagaggccagcgaggggacagucacucuccuggucacaagaggaaggagacaccuaguccccguucuaaucgucaccgcuccuccaggugugucuccuuggaagucuggcccuucugagagcuaguaguuagggauagggauauguguggugacccagaaugaccagucuucucuauuccaggucuccauaaucuggauuccacuacaccucauacucuggagacaugaguauuccucauuuuucccagaagaaucauggaaggagucuuuguaugccuucccuugaaccuuggcagcaucuugaggggagagcguccucucccacccacccuuuuuuuuuuuuuuuuuuuuuuugguuccugugaaauguugaucucugugaguuuuuccugguucuuguguuuuggggguuggagugggagggagggagucuagggagggaggggcacagcucaggacaucuaggccucagauugugaugauccagggaguuagcucccuaaauucuugggugacugaugguuuaacuugguaaguuguaaucuuuccugaaagaggaaggagcugaaguugguuggcccugcugcacccccuuacaagguugugaggcccucucccccccaacuuuguuuaaggcauuuugguuuuuuaaaaucuguacaguaaaagcaacuuuuucugucaaauaaaaaugagaaaugcaguaauuggucuguagucuuuacuugggguuaagaguucugugaacaagagggaacagaaaagucaaucagguagacagccaaauuuuuuuuauuggggaaaugggucucuaggggguaggccuaggcccucacugcacagcuuguucauuggcacugccuccagaauccuguggcuucaucacaucuggaagcucuggagggcuggaaaagggcucgaugcggagagcuucgaaggugucaucuggggaagggguauagaagauucucagcguuuccauucauugacuuguaucaaccaucaaggccauaacccuccccaccuugguugccugacuuggcaaugguaugaugacuucuguccucagaggccuaacuuugccucugaccccauuacaugucauugauaaagacccccaacccccagcuuugugcuugucuggcaaguaucaaccucagaauucuuuaauccugguuuccaguguccacagucaguacaaaacaugaacuccacuuucuaucuuuucuccuguuuguguccaccuagaaauuccuuaccuggcccucaaugcuacugguugguaaaauuaguaaggaagacggcaaagagcugggguuugauca

SEQ ID NO: 8430 - RNA, 22211 nt, Mus musculus
ugaucaaaccccagcucuuugccgucuuccuuacuaauuuuaccaaccaguagcauugagggccagguaaggaauuucuagguggacacaaacaggagaaaagauagaaaguggaguucauguuuuguacugacuguggacacuggaaaccaggauuaaagaauucugagguugauacuugccagacaagcacaaagcuggggguugggggucuuuaucaaugacauguaauggggucagaggcaaaguuaggccucugaggacagaagucaucauaccauugccaagucaggcaaccaagguggggaggguuauggccuugaugguugauacaagucaaugaauggaaacgcugagaaucuucuauaccccuuccccagaugacaccuucgaagcucuccgcaucgagcccuuuuccagcccuccagagcuuccagaugugaugaagccacaggauucuggaggcagugccaaugaacaagcugugcagugagggccuaggccuacccccuagagacccauuuccccaauaaaaaaaauuuggcugucuaccugauugacuuuucuguucccucuuguucacagaacucuuaaccccaaguaaagacuacagaccaauuacugcauuucucauuuuuauuugacagaaaaaguugcuuuuacuguacagauuuuaaaaaaccaaaaugccuuaaacaaaguugggggggagagggccucacaaccuuguaagggggugcagcagggccaaccaacuucagcuccuuccucuuucaggaaagauuacaacuuaccaaguuaaaccaucagucacccaagaauuuagggagcuaacucccuggaucaucacaaucugaggccuagauguccugagcugugccccucccucccuagacucccucccucccacuccaacccccaaaacacaagaaccaggaaaaacucacagagaucaacauuucacaggaaccaaaaaaaaaaaaaaaaaaaaaaagggugggugggagaggacgcucuccccucaagaugcugccaagguucaagggaaggcauacaaagacuccuuccaugauucuucugggaaaaaugaggaauacucaugucuccagaguaugagguguaguggaauccagauuauggagaccuggaauagagaagacuggucauucugggucaccacacauaucccuaucccuaacuacuagcucucagaagggccagacuuccaaggagacacaccuggaggagcggugacgauuagaacggggacuaggugucuccuuccucuugugaccaggagagugacuguccccucgcuggccucuccaggaaacucgcucacugcuacaagaggagaaauuaggucacagaacaauaccaaaaacuuuuaaauuuugcuuacaaauuaaugguagcuaguugagucagguugcuagcaccugcuauaggcccuaccucuguagaucccuuggugaagguuggggcgagggcugucgacgcucaacgggugaguaacugagggaucgggaaucccgaagggagucuauuggcuuccgaggacuucgagaccuaggaagcagaguaggccucuauagcuccacauccucccaaacccaccagccaagcauucaggaccacccacccagguccugaccaccaaaccucacaccacacagggccagccucagacccaccuuuguccgcacucacccauccgcccgcacaccauccaccgaguaccccaguggacagggcacagggugcagcgggggaugcaaagauaaaagagucccugcccuuggaagaauuuuguuugguaguaaagguuaacaaugaaggcacacacgcccccuacauaggaaacagcccagcaggauggauaugcaugggccuggggauccagagaaaggauggggaccugggcaggacagggaaauggcagggcagucuucucggaggugcuguuugaaugcagucuugcagaacgaguucaccaggcagacaaggaaaucccaggcagaaggaacagcauguccaaaggcauggggcucuccuuagacugcaaggcgcuggguauggccggagcacggggcaugugugggggcgggcaggaggagcacagggcgggcaagggcagcuggugaagagccucacacgccauucccgcagagguggcacuuuauccugcaggccacagggcguuccggaaggauuuguggagugaagggaaguaaccagaugugcguuuuagaaagaucccucuggcuacguguggaagagaauggcguggaggcagggagacagggaggaggcuguggacagagucgggagaagaugacgguggccagaccagagcccugcagcagcaauggggagacuuagagcuagaucucugagaccaggcugcuugucaggggaggggagagggaggaagaauccuaugacuucccagauauggccugggacaccucaguuagauagugcagcccuugaccagaauacaacacugugggaggaugggaggaguccggcacuccuucucccguacaaccagucacagacguccacacgaggcaccccagcaggaaccucacccaggguccccuuucuggagaacucaccccaaccccccuuccacaacaggcaagaaagcacucaccuccucucgccaggggguggcuucuuggggcuugcagguuuggguaaugccugagggccaggcuuagcaggggagggggaggaggaagaggaggaagaagaggaggaagaagaggaagaagaggaggaggaagaugaggaggaggaggaagaggaagaagaggaagaggaggaggaggaggagcuggaacuggagcugcuagagcgccucuuccuuuuggccgggguugguuccugaggacgucccucucuaauagccuccuuugggacugggguggggcugggaacccugugagagaagaaaggugucacaaggagacaagaugccccaaccccaacccuaccuuccuuggccuggaggaacggcagugggggaggggugccugagaaaagcccugggaaaacacgaaggcaggccagugaguaguacuucucuggagcaguggcacagagcugaccaaaccucugcuaacacaagcaacaggcuggggcccgaagcacaagggaucaagguuaaaccucaagaaugucccugaugaaggauuaaggccccuggacucagauguggaagcugaagcugggugaucuccuuccuuggagagccgcagcuuggggaggccccugugagugcagguuggcuggggaggggccguccugccuggaggcagggagagggaugggaugaccucugaagauccuuccagcccagggaguuccucuugaggucuaacugccaucccuccugcuguaaaauuaaguccauuuccucuaguucuguccucuguagagauggaaaacuuaucauuauccucuggagaauuaaccuuuggagacuuuuaucugucccauuccuccccacaaagcccccgcccaacauucuuucuacucccagcuugaaggccaaggucccccauacuuucucaaagccaagugcuuuugacaagauuucucccucccuacucacccacccauuguuaagucccugcucccuagaucccuuaauugccucaccuuuucagugccaccucagguugagcuggaaggcuggaacccucugaaucacuagaacuggagccagaggaagaggaggaugacgaugaagaugaugaagaggaggaggagcuagaugaugaugaagaggaggaagagcuccgacguuccuuagcugguugcagagcagccaauguagaaggcugcugggccccaguagaggcagguggcuccccaccuucagcaugggauaucccaggggcagggccagaaagcaugccauuguggucacuagcagaggauguggacuucgcuacugucccggaugaaagggacugagacccugcuacaggaguggucuggacaacugaacgagauuggucugaaaaagcagauggcacaggggaccgaggccgauccugugcaggagggagaagagauugcgaagaagccugaaccauucuugaagcaggggaaggagcccgcucacgcucagaggucauucuagacuggcuuggggcagauggugguguucuggaccuggcucgaucaagcauuaaaggugagguucugccacuaacacgaucauaagcagaaaggggcacccugggacuggugagguuugcaccagacaaugcuggagccauccuggaacuggagagauuugugggagccaagccugcagggguucuagagccagcaauauucacaggagcugugccaugcgcagaucgaggacccaccaccagguuugcggggguuggagccugggguguucuggaacuggagggguaauuugcagcaguuggaggugucccagagccugugagacucaaagcugcuaaugcagcugguguucuagcuccugcuagguucacagcugaagcugcagggguucgaggaucugcaagguucacagcugaaggagccacugcuguucuagggcuggcuaaguucauagcugcagcagcagcugguguucuugagucagcaagguucacagaugccggaauagcagauguccuggcacuagcaagguucauagcugcugcagaugcugcuggaauccugcuggcaagguuagcagcuggggcuguucuaaggcucaugagagguacaggugcuggaaccugggacauucuugcagcaaggccagcagcagacauggauggagguggccgggcaguaccaagacugauggcugucaaggcaagugcaauucuagacugagcaugguuuucuggaacagaugaucuugggugaucaggaauccgaggaccuggaccauccaucauggagccaccuguuugcuguagcacagacaugggcguucuagcgcuuccaagggguucaagcauuccaggugaucuacaucggucaagaggaguuggugacaugcuaggacggcuaaagcaacucauucuagagcuacugagugcuacaggagguguccgagauccagaaugauuccuuguugcuggaggaguggcagaacgugaacgaucagaacuacuuccagaugcagaccgccuacgaauggcuggaggagaucuuguuaaggaccgcuugccucgagcugcccuaggaguacgagaccuagaacggcggcggauagcaaguggugagcggcuucgagagcgcuugcguggcaacagugguguccgagaccuagaucgucuucgaauugcuggcggaguucgagaccuggagcgucgucuugucacuggagagguucgggaacgggaccgccuccgggugacuggagauguucgagaucucgaucuucuccgggugacuggggauguccuggaucuugaucuucuucuaguaacaggugaaguucugcuucuagaucgccuccugguuacugguggaguccuggaucuggaccuucugcgagucacuggaggaguccuagaacgagaacgacggcgaguugguguucuggaucuugaacgacgacgaguuacuggugguguucuggaccuggaucgccuucgacucacuggggaugcucuugaucgagaucuacgccuauucacugaccuugaccgucuccuacucacaggugagguccgagaucuggaccuacgucggcuuaucagugguguucuggaccuggaccgccgaugaguagcuggugaggcucgagaucuagagcgcuuccaaggagcuggugauguucuugaucgagaucgcuuccgacuggucaaggguguccgggagcggccucuucugcgucuagaggagguucgagaacucuccugucugguaggugaucuugaaugguaaccagagccaccccuccgucuccgaguaacucgugaucuagaccggcuccucugucuucuucgagauguugacugagaugauccagaucuaucucugcgucggguuguucugguuuucucucuccgugagcgggaucgggaucuuuggaguccacgagguuugggugaaggagaccguccucuccucgaaguugucuugguacggggagaagaaacugagcgccuccuccgugaagaccuugacuuuucaguuggcucuggugaagauacugaaggacuucuucugcgucuugguggaguucuggagcggauuucuggugaugaggaggcagaccggcuucuacgagagacucuagccuuccugguuagcucaggagaugaucgagagcuccggcgucgagguggugugugagacuuugucuuuggcucuauugaggaccuggaaccucuucgagcaguucuggauuugggggcguguucuggagaagacucagaacuacugcuuccuucaggggaaggaccucucucuuugcuugaugaaccugaucuacuaugccugggcagggcccgaggagcagguaucuuguguucaggagaagaaucaguaccacucugagcccucuguagcacucuuggcuuaucuuucauuuccggagaugagccagaccuacugagccugggugagugucgagauuugcugucaaccucuggagaugauccagagugacuccucugucugagaggaguccgagucuuggguuuggaaucuggagaagagucugacucacuucuuuccuguggggacgcgcugggcuuuccaucaagcucuugggaagacccagaucgacuucuuugucccggagagguccuagccagauuuuucuguucuacugaugauucugacccacuucuuucucucugaggggugacacucuuguuguugcgcucuggggaugauggagaaugacuucgggcucuaggagucugaggcaaugcuuuugguucuggagaagagucacauucacuucguccccuggaggggguuugagguguaucuuucaucccaggagaggacccagauaggcuaugccuagaaggagucccagacccaucucuaaguccuggagaagacccagaccggcuucuccuagauggcguucuaggcaaaccaucuuucaguucaggagaugcagaacuacuucuuucucuugaagguguucuuuguuguacagucucaaguacaggcgaagauacuuucugacuugaaaauaauccuaccuuuuccacuacuucuggggauaacucagaacugcuucgccuggaagaccuugacuguucuuucauguccacagauggaucugccucuguuugauuaaggaaugauccauucaauucuucuuuaaccucaggagaaaagccaguauuuacuucugaaacagggccugaguuuuuaaacucuaaagaugacucaaagcuauucucccuugggggagaaugagauaguucuuuaugcucuggagaaacuuguggcccacuccaacaugaagccacugcagggguuucugcugcuuuugaaggcugugacuggcuuuggucaagagcagacaauacagcaggccuuucuucuacuucaggagaugacucaauguuacuuccaggcauuucuuuauguucuggagauaaacuggguagaacuuggcuuaaagguugcucagacuuuucuacuuccauuaguucaucuugacuugaauuagguaauaaacuuuuuuggucucuuuugccuggaggugagccagcuccacuucuuucuuuuaauaguacucuaggugugacuuucaguacuguggaagacucaggccuauccuguguaggacuaaauuugucucuugguauacaagaugaugcaacauccucuugaauuaaacccagucucucuuuuaauucagaaggcuccaaucugcucugcaccagaaaagauuuagagucuacuaaaggauauaugcuagagucagguuuagucuuacucugcucaggagacauuccugacuucagcuuuggaucuguugauauuucacuuuuaucuuguuuuacuggugaucuggcugucagcucagugacuggagaugaagaucuggaaaggcuacccuuaggagauguuugggauuugcucugcagcaauggagauuccacuugagucugcaugacuucuggacuugaaguaucuggccaaguuugaguguguccuuuuuguugcacaaaugaggcgcuaaaacagcucucuccugguacuauacuacuagguguuacaccuggacagaggugaaaagauccagagcuuccuguuggugaaucccuagacuucuggggacagggugacuuugauccagaaagauuuugaucugguggagucuggagcaugcuuuuuagauauggagauguagauccugagugucucagugguguucccaguuccaucuuggaaucuggugaggaggaucuagaacggcuaugucuuaaucuagagucuaccuuggggcaaggagauauugaucugcuuuuccucugagguguccuagaugucacucuacuaggacuuggagaagaggagcuagaauggcuucuuccucuuggugauaucacugucuucacuuuggguuguggagaugacgaccuagaugggcucugucuuggaggugugcuagauuucacucgaggagaagacccagagcagcuuugucuugaugggguccuugauuucaccucaccaucaggugaugauucagaauggcucugucucugugguguugcagugcauucaucagccugcauguuuguuacagacccuggucuuggugguguuccagauuuuacuuuaggcugaggagaauuugaacgacucugucuuggugguguuuuugacuuuuguuuagguggugaagaaccagaacgacuucgccugguuggugucugugacuuuuguuuaggacauggagaggaaccugaaaggcuucgccucaaagauuuugcuuuggaucguggugaagaaagagaccugcuccgucuugaggaaacgugagauuuuuucauuucugggcuugaguuggaucugcuucuccucugagauguucuagauuuguucuuccucucugaggaugagccagaucguccucuucuuugugguguucuagagugagaucuuccacgucucacaagacuucuacuucgagaucgucgucgugcugguguucuggaucgugaccucccucuccuggcuggcguucuagaccgagaucgagcgcuucuucuggcuggcguucuagaccgggaccucccucuccuggcugguguucuagaucuugaccugccacuucuccuggcugguguucuggaccuagaccuaccacuucuccuagcuugggaucuacuccgagaccuccuucgaacuggugaucguguccuagaccugcggcgagcggguguucuugaucuggaccugccccugcgagcugguguucuagaccgagaccuacgccuggcagguguucuggaucgugaucuucgccuggcagguguucuggaccgagaccuaccccuucuagcugguguucuagaucgggaucugccccuaguagcuggagaucuagaaugugaucugccucgccuugcugaccuagaccugccucuucucuggguauuucugcuccuggaccaaccuggccucugaggagaccuugaacggccacgccucuggggacuucuagauuuuccccaccucugugcagaucuugaccuucuccacugaggggaccgggaccuggagugaccucucuugguggggguucuagaucgagaccguccccucuuaguggcaggacuacgagaccucccugcucuaugagaugggguaugagaaugagauuuaucccgcuuugcucugccaugcgagcgauucuuagaugugggugaagaagaaaucucucgacgggacccaggagcugguguggguuuaagacuuucaggagaagagcuggcaugccgagaaccuuugguagguugaggggauggugggcaacuuucugaggaaguagacuggggagguuucucaggagacuuagguggugaacagccccggguuggggaagccucagaugagggguuaacuggcuccugacuggacgggauugcugcaaggggucguggggagucgacauguugcucaacaaggagcggaguaggggcagguaguucuggcccugugcugcuccuuuccggagaggggcuaggucgaacugcagauuucuaagagugaaaagagaaguaggaauaguaaaaaaaacaccaaaaccucauuauccuauaagauacgaagaguuucuaauaaaauuuuacacuauauacuucuuauaccaauugacccuuucccuacccauaguuauacucaguaacaagacaauaugcaaugcuuaguugggagccaguaagauagcuuaaugggcccaugagguggcaaagagaaaaccuacucuucaaaauuguucuaugaacugcacaugugcauguaucacaugcacacacacaaaauaaaugcauuuuuaacaaugagaaaauaaaguagcaagggaaaaaccugaccauauaaacaaucucuaaccucaaguaguaauucagagaaacaagaaaauguaaacaaugcauuaccaacaaaauaccaccugcccugugguacaccuuauagacagacagcccugucuccauuuugcauacugggguuacacauagacuaucacuagcaaccaauuacucaccuacuaagucauuuuccuuuuuuuuuaucuuaccucuuaauuuuuuuuuugcuuuguacauuguucucuuaaacuuacucaauaucuuuugaugaguguuuuaaacucaucaagcaagucaucucuauugaauguuuuuuucuuuucaagggaaagugucugacguuguguauggguugcaaaugaacacuacaacaccacccaaaaaagguauaauuaaacaaaaagagaaaguuugggugacaauaacuuucaccugaauauggacugacuuaaaauaucacaaaugggcacaagguuuuaaaguguauaauguguuaaauuuuaucaagaggggccuggcauggccauauaugccuuuaaucccaguacuucagagacagaggcagguggagcucugugaguuuaagauuagccugaacuauguauuaaguugcaugacagccagggccuuauguaaggagacccugucucaaaaacaaacauacugaccaacagucaaugagauggcacuugcaacauaagccugguaaccagaguucaauccacagaacacauauauagguaguuuuguccuuugaccuccaaacacauguaacacauuugccucccccucauacauacacacaaaaauuaauucaccauggucuuacaggaacaggccaaaccauaaaaacagcuuaauuacagaaaacaccacaaacaccauagcaagcagcaaaguuuucuuguaacuuaucuuuaaaaugagacacaauacgggaaauauuaaguuacauuaauuacugaaaccaguagaaacaaucagccacagaacuagaauagagaauauaaaacaggaacuacuaaaaagauaauucuuucaugcuuucagauugguggcaucaaaucaaaggauugaaaaauguaagaacucaugacaagcauacaauaaaaaggauauagauacuuuaaguaguaaaguuaaagguaauuuuuagaaaacuuuuuguugggggguggguaugggggaccuuugggauagcacugaaaauguaaacgaggaaaauaccuaauuuaaaaaaaaagaaaucaaaaaaaaaaaaaaagaaaacuuuuuguugggcagaagcaagaugacaaaagaaaacaucauccuuggucauaauucgauguacaugugccacuucuauggcacuaaggcacuuaaccaccaccuucagaaguugaccuguggcaaauguggcuauuguggcaagagcaagaguauuauuggagucccaagacuaaaagagacaaagcacuacugcgucuggguggaugaggagccuaaaauuguuuaucccacauucagacauggauuccuugaaggaacaacaucucaacccaagagggcaguuuuagcugcuguagcauccaguucaccuuuaggauuucaaucagucauaaaauaaauguucugguuucaaaaaaauaaaccauuuuguucucuguauggauauaaacaaauuacugauauaaaacuuacuaauauccaaugaaguuucauucugaagacuucacaauuuagugggucauaacucuaaaauacuuguagguguguaaaaggacuuggaaacugaaugaggaauguagggcuaggaacucaaguauuucucaguaguuguuuauagauggcauuaugcaccacuaaacuuguccauguugcugaguuccaacugaagagaacucuuucucucauucuguaucuucuuugaauacugucuaaaaaucuucauauuugcuuacacuauugguuucucugaaacuaccacccaauccacucacauacacccccacacauguaacugcuuucuauagcugcuugucaaccuugaucucugaaccugaccauaaucuaaaggacaagauuuuugucuaauaaacuacauuauguaccacacuugcccauuuaaggcacaucccugaguaaauaaaucccugcaacccaaugaacacuaccaacucagaacauaccucuuucuuaucuuugucuucauaaggacugcuagauugcuuuguagagggagcugggcuacuagguuguuguauguugguggcaccugguucaacagaaggugcaucucccuccccuugaugcccugaagcaaggggaggacuuugcccagucaaggcuguuguaugaauuuuagcagcagcacuucgagaccugugaguuaauggagggcaggggagaccaggaaaaucagcucaaagaagaauagaaaacccccuccacccccaguuagcaauccacuuuccuguauguacaaccuuuuuuuuccaaaaaaaaagaaccaaaccaaaaaaaaaaaaaccaacaaaacaauaaacaaacguucuuagucacaugacucaauucauuuucaaaaaugaaaauacaaguccuuuuuuguuguucucucucuucccaauauaaucccaaauaauaaaagucccucuaccccauuauucaccacccuccaauauacccaaaccuuccacccaggcccuucccuacccacuucauucacaacucaccucugagcccaccuccuucaggaagccuuccccgauuaaggaagccaggguaaggacuccuuucucccucagacaccaccaaaccagcaaaccacccccgcccuauucuggcaguccauauacaucguaacaaacaaaaaauaaaaauaaaauaaaauaaaaaaagacaaggggaaauguauaugucuguccauccuguugcuuuagccugucagcuccuagagggcagggaccgugucuucggaauggucugugcagcgccuagcacaccgugggcgcucaauaaauauuaaauugauuaacccaucauucccucucccuccauuccucauggaccaccccuuaccgacuacgagaaguaucagaggaagaagcagaguccgcagaaguugaccgaugagcucgacggcucuuaggagcugguguuguacuucgagaccugaaggaaaaccaccacaaagcucaggagacugucauaccuagcaugaguucucccaacuaauuucuuuuuaaaaacaaaauuggcuuuggcaucgugggcccugccuuuaaucucaggacuugggaggcagucaugucaaucucuauaaggugaagccagcuucaucuagagcguggacucuauaauugaacuacauaaaaagacccucugucaaaaaauauuaaaaaaauuuuuaaaauuacauuuaguuuauuaaguauguaaaaggaagucagaagacaaguuauaggaguucacucuccccuuccaauacguuaaguuccagugauaaaacucuggucuuuagguuugauaaaaagggccuucacuuccugaaccagagguagaccaggcuggccucuaccuccucccucucucucccucucucccucucucccucucucucucucucucucucucucucucucucucucucucucucucucucucuggcacaauuauuuuuaauccuuccccaagggaagcauuuuucuacuucccccaaacacacuuaccguuuccucuucuuguccuuugauuugcguuugcucuuuggaguaggagaccuagaaaagaaggaaauguuuaaaaaguaauuuuaaaauaguaauaaaaucugaaucugaagugaaaugaaaguaacaacccaagcaaguauuauugauaacaaguagguuaaagauuugugcucuacuaaaaacaaagggggagggggagauggacacaucuuacagaccaaauauagaguaaaacaaagucaucaaacaguaacucaccacucccauauaccacuaugucuccccuaagaacaaaaagcuuucuuaccuguguuuccguuucuuggacucagauucugaccuguuugugaaaaauacagaaaaucauuauuaacccacaccuacccuucaauuuaagagcuaccuccaaucacccccaagaacuuccaccuuagccagaggugguggcuguauuucuuuaaucagcagagguagagguaauagaucucugccaaaucagaggccagccuggucuauauuuugauuucuaggacagccaaggcuaugcaaauacccuguuguuuuuaaaaaccaaaacaacaaaaagaacuuuuuaucucauaccugugcuucuucuucuuugaacucuucuuccucucucgucgaggagaacugcucucugaccugcuaaaauggguucagaagcaagucauucuacuuggcuuucuuucuggcuauaauucucaaaaaugcuucaaaagcaccagaaaaauccaacaccaucaacagccacacuuaauucacuuuuacauucaaucaguaagcauaaaauucaaauccaaaauacugcuuccuuuuuuggcugggcuacauaaucaaugauuucccacuaaguauacacauuuccucucagcugaaaccuaaaaaguaauucuguucccucaacugucacugcaauuugauucucugcuaccuaaaagcaaacucaacuucuaaaaguccaacaacaggcaguaaccccuggauacuaguguaacucuccaaccaacuuaccguccucuaucuuucuucuuuuucuucuucuuuugcuuuggaguuggugagcgagaacugcuggucucucgaacaaggcugaaaaaggcaaagagauucuagauaccaagcaagacauauuucuuuaaaacauuucaccuuaggggcuggagagauggcuccagagguccugaguucaauuaccagcacccacucacaauaauggaaucugaugcccucuucugaugcccucuucuggcauucaaaaucuauaugcauacaaagcacucauauacauuuaaaaaaaaaaucacucuaaugaauaaauauacuaccccaauaaauaaauggagcaguucacugauaacuuucaccuuaggacaacugcuacacaccaauuuuuuuugugcuugaaaacuucagaauuaaaggauuuaaauuugcuaggcagcggugguacacgccuuuuaucccaguacuaggaggacagagacagguggaucuccuaaguuuaaggccagccagguucuacagagugaguucuaggacagccagggcuacagagaaaaauccgggggggggggggggcggcucggauguaaauccugggugugugcaucuguguguguguuuuauguuuuaagguaggucucacuauauaucccugacuguccuagaacuaccuacugcagagcaagguggccucaacucacagagauccacuugccucugcccucaaaauauugagauuaaagucaugugucacccaguuuuauuguuuguuuugagacaaggucuuacuauguaacccuggcuauacuggaacgcagagaucugccuacaucugccuggaguacuaggaucaaaggcauguaccacaacacccagcuuaaauaauuuuuuagaaaagugaaaauaagccaggcguacgccuuuaaucccagcacucgggaggcagaggcagguggauuucugaguuccaggccagccuggucuacagagugaguuccaggccagccagggcuauauacagaaaaacccugucucgaaaaacaaacaaaacaaaaaaguaaaaauaggaacugauaagcaguuaagagcauaggcugcuuuuuguagcuaggggucuauucucagcacuaagggaugcugaaccaucuguuacucuagcaccaagggaauccaaugcccucuucuggccuccaggggcaccagggcauuuuauaaaaggauacauauaaacaaaaacucauacauuuuucuuuuuuaaaauugacuccaaaauaacaaaaucuaagaguuuggcaauaagccaugggucauggcaaauaaaugccauuaaucucaacaguuaggaggcagaggcagauagaucucuaauuuaaaggccagccuguucuacauaguucuaggaacagcuagagcuacauaaugauacugucucaaaaaacaaaacaaauaaaaauaaaguuuggaaauagucuucuaguaauaaauauaauagaauauguuuaauccaggaagggauucaggccuuucuccugaguaccuguaugguuugggaggcucaggagcuauuuguuuagcuucucgagcacgucucugaggaucaaaagaacugccauccacauaggagucacugaugccaaaggcagcacggagucguucauucuucuucucauucaguucugccaacugaugggucucaguuacccugaaaagagcaaaaaucagagcccuaauuuagaacuuaguuauaaggaggaauuaaacaguuaggcuagggacuaaggaagaugaaggcaaaacugaauccuacccagguaaagagaaaaggcagcaguagcuguaacuucauagaucccaaaaaaggaaaaaagagaacaacacucacacuggucucugcccugggguuucuuccuuggccccaggguucacauccuuuuccagcaacaugagucgaaaggucgccacuuuuuccugaauuugcuguucuucguaccugaaggauaaaucccuucaagguuaagagcaugacaggaguuuucccaagucccaauuuuuagaugcuuccucuuccaacaggguccuuuuuccuucuccaugcacacaauauuuuguacucacugucacucaaauuguuccuaaguuuuccucaucuuucuccacgacacuccuuccuucucuacacuaugcucucuagaacaguggauuuuaaacaugcuacacaauucaggugccaagagaggagggcuugcugguggaguucccagugcuccuucccaacuucaauaagaaaagaucuuuuauuuccugggacuucaaggaagacaaaauguauaaaaggauaccacugcucaaaguuugaaaaccacugcucuaaacaguuuucugccugaaugugcuccuuuuccaaaauaucacuucucugacaacucaugauauccucuauucaaauucucuuucaauccgaucuucugccuuugccacuuccacagccacaauccuucaauccaccuaccuuucuccuccuaccaauaacaacaccuaucagguuaccuggcucuucuaccuuaugcuccuuucccacacagcaugcuuuuguucauucauguuccccuuccccuucauaaauucagcuaaguaauucaaacccccuuacacugcuauuaauucuccagaaaguuuccuugacaucccacuaugcacugacccaugccucuucucaauucuucaagcucauuuucuuccucccuuacaacuucucuaagacucuuuccaccagcucuaguuucuuuccacacaucccaccuaacacccaaacuaagcacucagugcuuggaaucuccccacccauucccucaccccugcucuuccaucauuuccuccagcucgaggcaucgcagcuccacgcgccgcuugcgcucgugguccaggaugucaggauuaggucgcuucaccagggcagccuccaggugccgcaguuccuccucucccuuguagucaggccgcucaccacggcggccccgcaccagggacagguuucgcugaacguagccguuggugccgcugccccggggcgucggcagcccgaucccguuguacauggcccugugcccagggggcaccaccgcuccugagggggcgcggguagauaccagucaggcuccuggcuccaaucuaacuacuuaccacaucucccacaucccuggcucucuuacuuagcccuuaguacaacacuuagucucacacugaaucuccauuaacaaaauguuuccucauuccacuagucuacaaacaaaucccuccuuucauccuccccacacuucauccuuuucacucagcaucuacuuacaaguccucacaauguacuuucaaauucuaagccauucuucuuuuuacuuauauuuccauucucuaagaaaacaagaaucuggguucucucaaaucucuucacacuaucccuuuacuguuuggccacaauacgcacaaauaguaucuucaccaaacacucuaaauguaacuacuacagguaaccaaauccuccaaauaccauaacacacaccauggaucagaaucaccuaauaaaagccuaaguccauuuucaaagccuccuccaagaaaauauuuaagcuaacuugaacaaacacaaaauggauuaaacaguccuagguaucuaaauaggcaaacuggcuaguuaacauaaaccaagugugcuauguagucucauacccaaaccacaugcaagcaagcacaucagaaacacagaaaucauggacauacuucacuuggggaagcuuauacuucacauggggaaggugagccaucucuuugacuccaaauauucauagcuccuaccaacuacagugauuuuauuauuuuaguuuccuucccaguaagguuuaucacauggcuugcagcuccuccaagucuggcuagcucuuguuaaauauugccuguuuucaacucagucuaaacgcaaauucguucucuguuccaacuguccucauacuuucucuacaaauaccuagaaauguucaaauuccauaccuuuaauguaaaaguguugacuuucaaucaaucaaucaaucccuguucugacacuucauuguuuuucuaaguccugcuuuacucuccaauuuaacaguuuuccuguaagguucuaccuuuucaugguguuccaagcucagcaucacuaaacucucaagcuccaguuuuuuggacuguauuacucauucccuauucccuucuaacuauguauguuuuacuuuuuuccucuaacacauuuucuccaaaauagggucucaaacaugggaaagaaaacuagcaucaaaacacacacacaggggaaagcagagguuaguaaaagcagauagcagagauggagcugggugaaauaguaccauaucaaugcccgguuuaaaaaaaaaaacaacaacaacaacaaaaaacaaacugaaguguguugccugguucugguggcacugccuuuagucccggcacuugggaagcaaggcagguggaucucuugaguucuaggccaaucuggucuauacagcaaguuccagaacaaccauggcuacaaaaaaaaaaaauccuagucuggggauggggacaugucaccaaagugcgggggggggggggggggaaucaaggaagaugcugaauguaaagcaaacacccagaugcacuuuugccccauuucauccucaagccuaacauaaguccuacucaaucucaacaguuaacacaagaggaaacuaaaagcaagaaagguaaaucuaggagagacaacaagaguaagagauaaggcuaaaucuaagaaaugcaaaaccuuuuuuacagcccccccccucuaauguuucuguaguaccuucuaacaaccacucuugauagucuuggaaaaagaaaaaccaauccuuccucacucuaaaucuagggcuuauauugcuuucucaccuaacaguccuucuaaccacucauauuuucaccauuucacacaaaaauccucccacacccuaccugaagaaugaaagcuaagcaaaaaguauuagagucacaguuuuggagaauuuucagagacgagcuaaagggggaggggggacuuacauaccagcagccaaaaacaaugcuugaaacacuaaaagggaaaccacaacuaccaaaaccaggaaguauuuaaaacaggagcccaaagcaugcaagccucuccaagaacaaauugccggcaagggaggaaaacuuaucagaaugccaaaauacaaagagguagaaaauuagcaaacuaagauauucaagaaacagcgaccgagagaacagcaaugaucaaggaaaaggacgcugaguaaaaaauacagagaacucagagcugagacacuacugacugcauaggcaccaugaaacauacaagcuacaguauacauccaggccuaggccccacucccacggaaaaaggcaauaguuuccuuuugaauccacaauuaagagacaucuuaaaagaacuguaagauggaaacagcaaggaagaacgucaucaccaaguaauggcugacugaagccaggcuauuaagucaagaauuuuuuccccaucgaaaagcucuaaaaggcuuagcuuuaauauuugaggagaccuuuuuaaaaacaggguaggagccggguguggaggcagaggcagacggauuucugaguucgaggccagccuggucuacagagugaguuccaggacagccagagaaacccugucuccggggaaaaaaaaaacaaaaaacaaaaaccaggguaggagccagacauggugucucaugccuuugaucccacagaggcaggcagauuucuugaguucaaugcuagccugaucuacacgguuagugccagaccaaccaagacuauuuagaggcccuagcucauaaaaccaaaccguaaaaaagaaauaaaauaacaggguugaaaggagcacauuggucuuccuuauacacgcaggcugaauacuuucgcgguuuuauuauccucacuuuuuaagacuuggggaucccccacccccacgcacacacucacagccucugauacuaacgaggacgaacgguuuaaauccuggccuccgaaaguucaaggccuccucccgccgcccacugggcagcccagcuuauuuucggccucgaggaggggggagggggccacgcggcgccccgcggucugggcggcucuggccguuucucaggccccuagcagggcccguggacccacgccggagccgaucgaggagagguaccagcagguccgaagcucgggcgggggacaaguaccuccgcugccgcccucuccccgcccccuaaaagaccgaagaggacgaccgcggaacgacggccuccucagccccagguagagcaaaggagagaagcagagccucgcgcaaugcugucucaccgggggcgcgcggacgagaccaggcggccgcgcgcgccgcggccgugugggggaggggcggaggaguugaaggccgcgcgucccaggaaccgcgggagggggaggggaggaagggaaggcgaccgcgccggccgaggcgacgagcacgcgugcgcgcggcggccugggccguucuccccgcgcucuagccuccggcccagcccgccgccccucccccacccggcuagcgcgcucccuuucucucacccgccgccgccgccuccggccgccgacugucaaacagggaggucccgccgcagcugcugcuuaaguuuucguaucccucggagccugaagccgccgccucgucgguccgcccgccucagccgccgccgccgccgccuccucgcuuccucaggggccgcagcgggcuucgacugcgccacucgcaccccgccugggcagcguugcgcgucagcacgaccuagugcgucagcacgcaaucaugagagccgcu

SEQ ID NO: 8431 - RNA, 4951 nt, Mus musculus
uuccaggucuccauaaucuggauuccacuacaccucauacucuggagacaugaguauuccucauuuuucccagaagaaucauggaaggagucuuuguaugccuucccuugaaccuuggcagcaucuugaggggagagcguccucucccacccacccuuuuuuuuuuuuuuuuuuuuuuugguuccugugaaauguugaucucugugaguuuuuccugguucuuguguuuuggggguuggagugggagggagggagucuagggagggaggggcacagcucaggacaucuaggccucagauugugaugauccagggaguuagcucccuaaauucuugggugacugaugguuuaacuugguaaguuguaaucuuuccugaaagaggaaggagcugaaguugguuggcccugcugcacccccuuacaagguugugaggcccucucccccccaacuuuguuuaaggcauuuugguuuuuuaaaaucuguacaguaaaagcaacuuuuucugucaaauaaaaaugagaaaugcaguaauuggucuguagucuuuacuugggguuaagaguucugugaacaagagggaacagaaaagucaaucagguagacagccaaauuuuuuuuauuggggaaaugggucucuaggggguaggccuaggcccucacugcacagcuuguucauuggcacugccuccagaauccuguggcuucaucacaucuggaagcucuggagggcuggaaaagggcucgaugcggagagcuucgaaggugucaucuggggaagggguauagaagauucucagcguuuccauucauugacuuguaucaaccaucaaggccauaacccuccccaccuugguugccugacuuggcaaugguaugaugacuucuguccucagaggccuaacuuugccucugaccccauuacaugucauugauaaagacccccaacccccagcuuugugcuugucuggcaaguaucaaccucagaauucuuuaauccugguuuccaguguccacagucaguacaaaacaugaacuccacuuucuaucuuuucuccuguuuguguccaccuagaaauuccuuaccuggcccucaaugcuacugguugguaaaauuaguaaggaagacggcaaagagcugggguuugaucaagaaagaagucaaggauguagaugugcuuucuauuaagagcaaagguuuagaaacugaccaucagccaagugguggugguccacgccuuuaaucuuagcacuuggcugggcagcuaagguuacacaaacuucuggggguugggggagaaugaauucucauuccuguuacuggucuaguuaaaacgccauuugccaaaccuuccuaauagccuucagccuucaguauggacauuugaguggcagcagcagugaaagcaaccuaauuagguccagaaaccuaaugcugucagcugcuuccagaagugcuucugcaaauccugccauuaacacauuccauuggccugagggguaauaaagccucugguccagucuugcccauaucuaaugccauaucaggaguugugugcccuuagcuuugacauaacaaccuaacuuagcuuacgcagacaagcuguauuuuagccacaggaacccacgcaaaaggggaucuaucuggcccguguaucuucaccagcccuauaagugccucauugcugacucacaggcuacuaguuaccuuggagcagauaccucccaggauauuuaucgugauaaaaggauauuugcagcaagcccuugggggggggggggcuauggagauggaaauuccaggcuggguggggcagggacaaucggcuaugcauaaggauauauagcuuggugagcugagguuuacuuuacaaaaacuaaaaaggauaauuuacacuucuauuucuuuucccaucuuagccucuuucuagaguauguauaugggcuuucauguauguauguaugugugccaaugaaggccaaaggcacugauuuucuggaaccgaaaugaacaguuguaaacuaccauguggguacugggaacugaacccagguccccugcaagagccaguauucuuaauugcugagccauuuuucuacauuuuauuccccauauacacaguccuugggguucacagcugugaaaacaaguccgaggaccaucccucuuuaaaaucucagaggcaaauaauaaaauuauuaaaucucuaccugccucucauugccuagcuguccuggaacucccuguagaccaggcuggccucagcauaggauuaaaggcaugcaccauagguauaacaugaucuaacuuucccaaaucacuugcuucacuugucgugucuaucuggcacaaucugucggggugugguagcacacaccuuuagucccagcacucggcaggcggauuucugaguucgagaccagccuggucuacagagugaguuccaggacagccagggcuauaacagagaaaccuugucucaaaaaaacaaaaacaaacaaaccccaaacaaacaaaaaaggugauuugcuaaaucuggcaugguaucuguuccagccaaguaagugcauuauagucugccugucaucuauagcacuucauuguccuaguuucaaaaucugcaaagugaagacaauggccucacaaggcuacuaugaaaaaauuaggcggagcuggguucaguggggaauaucuuuaaucccagcacuugagaggcagagcaaauuacaggucagccaggacuaaacucugggucuaaaaaacagaaaaccaaacuauauagauaaacucuuucuagaaaacaaacaaaaagaucagguggaauaaggccauggacucaauaaauccuguuaaaaaugugggugguaccaggaaccuacaaguuaccuuuaauuuccacaccucuuguuuauguuucaaguuuuaaaaauuauguguaugggcccuuugcauguaagucugcuccaaguacaugccuggugcucaagaacacuaaagaaggcuucaguccccugauguacaauuacacuucugaccuagaauggaacccaacuccucuggaagagcuacccuuaaauugcugagcuaugucuccagucccuaugcuuuguuuuuuaacaaggaaacaaauacuucaugaucuuuguggacugaaaagguauucccuaaaagcucagaggagcaguauaggcuuccaaaguuguuguucuuuggauguuaccagaugcuagcuaccauccauccagguuagccaucuuaccugcucggaaggccaggcccacuguggcuggggccuguggccgugcugucuggcuagugaagccacacucgcccagaguuuugccaucaucaaggagcuggucauccugaagagagaagcaggguuuagggagagguccuaaggucccaaagacagccaacuuaggugaggaacuuaggaagaggcaucccuaaguauaaaacacauauuccaggacuauauccaagaauuuccagcucugacugcacugauggcuuacagcagcuaaaagcucuggcagagacuuccaagggcauuuucuagcacccauauagauugguucacaauuccacuuccaugagaucugaucccuuuggccuccagagcaccugagcaccuggacuguaugagagcagguaucacacacacaaaaauaaaacucacaggccucugaauucuggcuuuuccaagcucucuagauauaucuaauucaaaagguaguuggaauuuuuuuuuuuuuugagaaaauaucucaaacaguauuuuguucuugaaauucugauccuccuacaucuagcucccaaacaggauuauugcccaguuuuuuccgccuggugaucuaaccuaggcuuucauacagguuauguuaacacuaaacacagcugcaccccugaguccuaucaaguuuuucucuccacuccccaccuuucuuuuaaaaaucaaccuuaaccuuaaaacgggaauuaugaggagcauagaaagcagcacuaaaaacacuaugugguuccuagaccagcagagggucuuucaagaaaaagaucaguggguaucagugagaaaagcccuuuagagacaugaauccaggcucuaaucuggaguuacagcuggaauuagcucaauguauuuagauuacuggcacgcuucugggaagccugacucgggauuggggcaugaggacccaacuccgcaggcuagcuuauucaaaacuggagcuggcuucuggaggugagcuugaaugccaaguguuucuagaacaucagaagacuggcgaggguaaacacuggcugggugaaucacuggugggaucuugaccuaucuucuaaacaacacuugcauuccucgaguuccaccccacccugugacagugggauuccggugggcucccgacaggccgaagguggcuagccaggaacaaacccuggcucugccacgaccuucggcugcguaagauuaucgaggccucgguuuccccaaccgcugagcaagacggccuggcagggcggggcggcugccgggagaccugaugcugccggcucuucagcacgaucaagagaccuccuuguuaaguguccugucuggacccccgcgcgcgcaaccgccacgcccgcucgucgcaccuuguaaagccgcugcuccucuggcggccgcuugaggaugcccucgacgaugcgcuucaguucgaacacggugcucgacuccuuggcguccguaaagaugguggucuuguggcgccggaucaugagaaacacguccugaggacggcgggcccgcgucagcgcuagcccgcggcccccggcguggccccggagcccccgccgcccccggccccgcgccccucccccccgcgcccgcucaccaucccggcggcugcuucuggcucgacgcgccggcgcggccgcgcuccgccccuucccggcagcccaagcgcgaccca

SEQ ID NO: 8432 - RNA, 4951 nt, Mus musculus
ugggucgcgcuugggcugccgggaaggggcggagcgcggccgcgccggcgcgucgagccagaagcagccgccgggauggugagcgggcgcgggggggaggggcgcggggccgggggcggcgggggcuccggggccacgccgggggccgcgggcuagcgcugacgcgggcccgccguccucaggacguguuucucaugauccggcgccacaagaccaccaucuuuacggacgccaaggagucgagcaccguguucgaacugaagcgcaucgucgagggcauccucaagcggccgccagaggagcagcggcuuuacaaggugcgacgagcgggcguggcgguugcgcgcgcggggguccagacaggacacuuaacaaggaggucucuugaucgugcugaagagccggcagcaucaggucucccggcagccgccccgcccugccaggccgucuugcucagcgguuggggaaaccgaggccucgauaaucuuacgcagccgaaggucguggcagagccaggguuuguuccuggcuagccaccuucggccugucgggagcccaccggaaucccacugucacagggugggguggaacucgaggaaugcaaguguuguuuagaagauaggucaagaucccaccagugauucacccagccaguguuuacccucgccagucuucugauguucuagaaacacuuggcauucaagcucaccuccagaagccagcuccaguuuugaauaagcuagccugcggaguuggguccucaugccccaaucccgagucaggcuucccagaagcgugccaguaaucuaaauacauugagcuaauuccagcuguaacuccagauuagagccuggauucaugucucuaaagggcuuuucucacugauacccacugaucuuuuucuugaaagacccucugcuggucuaggaaccacauaguguuuuuagugcugcuuucuaugcuccucauaauucccguuuuaagguuaagguugauuuuuaaaagaaagguggggaguggagagaaaaacuugauaggacucaggggugcagcuguguuuaguguuaacauaaccuguaugaaagccuagguuagaucaccaggcggaaaaaacugggcaauaauccuguuugggagcuagauguaggaggaucagaauuucaagaacaaaauacuguuugagauauuuucucaaaaaaaaaaaaaauuccaacuaccuuuugaauuagauauaucuagagagcuuggaaaagccagaauucagaggccugugaguuuuauuuuugugugugugauaccugcucucauacaguccaggugcucaggugcucuggaggccaaagggaucagaucucauggaaguggaauugugaaccaaucuauaugggugcuagaaaaugcccuuggaagucucugccagagcuuuuagcugcuguaagccaucagugcagucagagcuggaaauucuuggauauaguccuggaauauguguuuuauacuuagggaugccucuuccuaaguuccucaccuaaguuggcugucuuugggaccuuaggaccucucccuaaacccugcuucucucuucaggaugaccagcuccuugaugauggcaaaacucugggcgaguguggcuucacuagccagacagcacggccacaggccccagccacagugggccuggccuuccgagcagguaagauggcuaaccuggauggaugguagcuagcaucugguaacauccaaagaacaacaacuuuggaagccuauacugcuccucugagcuuuuagggaauaccuuuucaguccacaaagaucaugaaguauuuguuuccuuguuaaaaaacaaagcauagggacuggagacauagcucagcaauuuaaggguagcucuuccagaggaguuggguuccauucuaggucagaaguguaauuguacaucaggggacugaagccuucuuuaguguucuugagcaccaggcauguacuuggagcagacuuacaugcaaagggcccauacacauaauuuuuaaaacuugaaacauaaacaagagguguggaaauuaaagguaacuuguagguuccugguaccacccacauuuuuaacaggauuuauugaguccauggccuuauuccaccugaucuuuuuguuuguuuucuagaaagaguuuaucuauauaguuugguuuucuguuuuuuagacccagaguuuaguccuggcugaccuguaauuugcucugccucucaagugcugggauuaaagauauuccccacugaacccagcuccgccuaauuuuuucauaguagccuugugaggccauugucuucacuuugcagauuuugaaacuaggacaaugaagugcuauagaugacaggcagacuauaaugcacuuacuuggcuggaacagauaccaugccagauuuagcaaaucaccuuuuuuguuuguuugggguuuguuuguuuuuguuuuuuugagacaagguuucucuguuauagcccuggcuguccuggaacucacucuguagaccaggcuggucucgaacucagaaauccgccugccgagugcugggacuaaaggugugugcuaccacaccccgacagauugugccagauagacacgacaagugaagcaagugauuugggaaaguuagaucauguuauaccuauggugcaugccuuuaauccuaugcugaggccagccuggucuacagggaguuccaggacagcuaggcaaugagaggcagguagagauuuaauaauuuuauuauuugccucugagauuuuaaagagggaugguccucggacuuguuuucacagcugugaaccccaaggacuguguauauggggaauaaaauguagaaaaauggcucagcaauuaagaauacuggcucuugcaggggaccuggguucaguucccaguacccacaugguaguuuacaacuguucauuucgguuccagaaaaucagugccuuuggccuucauuggcacacauacauacauacaugaaagcccauauacauacucuagaaagaggcuaagaugggaaaagaaauagaaguguaaauuauccuuuuuaguuuuuguaaaguaaaccucagcucaccaagcuauauauccuuaugcauagccgauugucccugccccacccagccuggaauuuccaucuccauagcccccccccccccaagggcuugcugcaaauauccuuuuaucacgauaaauauccugggagguaucugcuccaagguaacuaguagccugugagucagcaaugaggcacuuauagggcuggugaagauacacgggccagauagauccccuuuugcguggguuccuguggcuaaaauacagcuugucugcguaagcuaaguuagguuguuaugucaaagcuaagggcacacaacuccugauauggcauuagauaugggcaagacuggaccagaggcuuuauuaccccucaggccaauggaauguguuaauggcaggauuugcagaagcacuucuggaagcagcugacagcauuagguuucuggaccuaauuagguugcuuucacugcugcugccacucaaauguccauacugaaggcugaaggcuauuaggaagguuuggcaaauggcguuuuaacuagaccaguaacaggaaugagaauucauucucccccaacccccagaaguuuguguaaccuuagcugcccagccaagugcuaagauuaaaggcguggaccaccaccacuuggcugauggucaguuucuaaaccuuugcucuuaauagaaagcacaucuacauccuugacuucuuucuugaucaaaccccagcucuuugccgucuuccuuacuaauuuuaccaaccaguagcauugagggccagguaaggaauuucuagguggacacaaacaggagaaaagauagaaaguggaguucauguuuuguacugacuguggacacuggaaaccaggauuaaagaauucugagguugauacuugccagacaagcacaaagcuggggguugggggucuuuaucaaugacauguaauggggucagaggcaaaguuaggccucugaggacagaagucaucauaccauugccaagucaggcaaccaagguggggaggguuauggccuugaugguugauacaagucaaugaauggaaacgcugagaaucuucuauaccccuuccccagaugacaccuucgaagcucuccgcaucgagcccuuuuccagcccuccagagcuuccagaugugaugaagccacaggauucuggaggcagugccaaugaacaagcugugcagugagggccuaggccuacccccuagagacccauuuccccaauaaaaaaaauuuggcugucuaccugauugacuuuucuguucccucuuguucacagaacucuuaaccccaaguaaagacuacagaccaauuacugcauuucucauuuuuauuugacagaaaaaguugcuuuuacuguacagauuuuaaaaaaccaaaaugccuuaaacaaaguugggggggagagggccucacaaccuuguaagggggugcagcagggccaaccaacuucagcuccuuccucuuucaggaaagauuacaacuuaccaaguuaaaccaucagucacccaagaauuuagggagcuaacucccuggaucaucacaaucugaggccuagauguccugagcugugccccucccucccuagacucccucccucccacuccaacccccaaaacacaagaaccaggaaaaacucacagagaucaacauuucacaggaaccaaaaaaaaaaaaaaaaaaaaaaagggugggugggagaggacgcucuccccucaagaugcugccaagguucaagggaaggcauacaaagacuccuuccaugauucuucugggaaaaaugaggaauacucaugucuccagaguaugagguguaguggaauccagauuauggagaccuggaa

SEQ ID NO: 8433 - RNA, 7390 nt, Mus musculus
cguuaaagcugggcacccgacuucagagaggccgccauggguauacagggcccagugcugcugcugcugcugcugugcgugaugcuggggaagccuggugagcuaaggagauucauucaccagacugggggucaugggggaguaugggaaacucggagguccgcgcgaggcucaccuuaucuccacccagggucacgugaagaaagccaggcggcaggugaggaaccguggucccugugagaaacaccuaccgaggccaggcauaaagaagucgccucaucuuuuccacuccucccccacagaucucaagagcacagacaucaagcuucucucaagugacugaugggcucuguggagggcugggugucugugaaccacgugugaaggguuucugcgccaucuccugaucuccugccucuucaacaaaaccccaggauacuggaggaagggggggggguguacgguugcgugguucuccccaguuccucccauacacguguacccuagggaugcuaugggccuuccuaggcugcucagccaugugucuuauuugucugucccagugcccuguggccgccggaaugacacucggucccggauagugggcgggauagaauccaugcaagggcgcuggccguggcaggccagccugcgcuugaagaagucccaccgcugcggagggagccuucucagccgccgcugggugcucacugcugcacacugcuuuagaaagugagugugggaugguaggagcggggugggacagccuccugauauccugagcuccaagcgcugcuuacaauccaaaaaccuuaccauuggcccugcagggggcgccacucuaauucuuccaggauguuuuauucaaacauucccaugcuguuucgggucuauucaucuaugcucacugcccccuaccauaucgaauuaggaaggcgcaggucucauuccaccuucccuuggagguucccaagguugguugguugguugguugguugguugguugguugguugguugguugauugguugguugguuuugaggugccuugaacuuuuuacuuaacagaagaugacuuugaacuucugauccucuggccucuaccucuuggcaugcuaggauuacaaacgugcaccuccaugccugagucuauacaauucggggggggaggggggucaaacccagggauucacucaugauaagcaaacugucuauugaguuacauccccaaccccauaccagauaugaauucuauucagagaggcccuuaagaagugaccagaccaaccaggcagugguggcgcacgccuuuaaucccagcucuugggaggcagaggcaggcgaauuucugaguuugaggucagccuggucuacagagugaguuccaggacagccagggcuacacagagaaagccugucucggaaaaaaaaaaaaauagugaccagaccauuggggacuguggucuuccuguuucucuccucagagucccaggagaagggaaucugguuaugucuaggcuuuguuucuacaagggggucucagcaaguaaauaguaccagagcuacggugucaccucacacagagauccgguggcucagguggccagcguccuccugaggguccugaucacuuucaucuucccugcuagguaccuugauccagaaaaguggaccguccagcuugggcagcuuacauccaagccgucuuacuggaacaggaaggccuauucuggacgguacaggguaaaggacaucaucguaaacuccgaagacaagcugaagucccaugaccuggcccugcugaggcuggccuccucggucaccuacaacaaggacauccagccugucugugugcagccuuccaccuuuacgucccagcaccagcccaggugcugggugaccggcuggggaguccuucaggaggauuugagugagauuagcaacgcagggugggcaugugggugugcuaucuguccccuguuucagccacagcaggcccugaaacccuucucuggcucuggagcuccaagagccuccugccuuccugcucagcccccacccccauugcuucccaccugcauggagcugccuucuguucuggagcagggguaggccaauggccagagaugcaggaagggacucagccaggcuugcauuccucagccagaaugggugcuuaagaccuucugaggacagucucuuugacacugauuuaauuuacaagcccuaaaguaugaacaugagcaguguugaaaucacacauuuuaacaccagugaaacugucaccauuaucaugccucuaaguccucacuaggugacacuuuagccuucaagaucaggcguguucagaguggugaggucauaggcugucaccucugucuaagugcaacauuuucaucauuucaaaaagaaaaccugccagccuggucuacagagcaaguuccaggauuacauaaauaaaaacccugucuuggaaaacaaaaagcaaaaaccucagugggcauugugguauaagaccagcccuugggaagggaagccaggaaggucaggaguucaugucuaauccuaugcucaauauccuggacuccauagcaaguuugagaccagccugggcugucuaaaacaaacaaacacaaaacaaaacaagaaaacuucauaccccuccgccauuucucucaaucuccucaugucccuaggaccuguagcccuuggcagcccagaccugcuuucaggcucuuagcugccucuggaaaugcuacacaaguagucagagaaaaauggucgggauucuuaaauguaauguacuguccucaauguugccccuuguggcaguagugggaacugcuucucucuaaguuguacuucacauaccauuaaggaaccauacaaagagugugcuccaaccccauuuaguguguugacaauacuguucaacuagggaccuucauucccacccggccuuuacuccucaugagucccucccuacagccccugauaaccacaacccagcuuucugagcacggaaccauuguuuucugcccauaagugaaauacaguuugugguccuaugggucuggcuucguucacauaccagcccaacuuaaagauucauccuuucuccuuuccaguuuggaugccuuuaacucuuccucugaaaggggauauucauuacucugagugcacauguguuguguauuugguauguguuguauggcauguguguuguguguauauguguuuuauguguguguguauuaugugugugcauuugugcuauauguguuaugcguauauaugugguguguguauguguggugugugugugugugagagagagagagagaacaauuuacaaaaggaguugguucucuucuuccauuauguggccuggggauugaacuugggccaucaggcuaugucucugaccacuaggccgucucaccaguccuuauuucucuuucuuaccuaauuucucugccuagaccuuccaggauaucaugcacaaaaaggagagguacccaccucauuauuacucuggagcaagagcuuuuuguuuuuccaccauugagcacaauguagcuuuguggagguaguugccuuuggauccuagcuggcuuagugcuuuuaugaaagagcagggaaguuuuggguuuuggagguggggugggagggaauaugugcaucuucauguguaugugcacguccaggcccgugaguauuccaagcaugugugcacauguguagagaggucagaggucaaccuugugcaucuuccucaaaugcucuucaucucaguuuucaugcauguauaaauaaauuaugcacacauaaaacaugcauauauaaaaacacauauaguuuuaaauuuuacuuauuugggggaggagugcauucauacgacagcaugcuuguggggguuggaggacaaguagcaagaaccaguucucuccuguuaccaugugggcucuggaaauagaacccaggucaucaggcucagcaguaaaugccuuugccagaugagccaucucaauggccccacauuggcuuugguuugguuuuguguuuaaagauauauuuauuuuauauaugcaaguacacuguugcuaucuucagacacaucagaaaagggcaccggaucccauuacaaaugucugugagccaccauaugguugcugagaauugaacucaggaccucuggaagagcaaucagggcucuuaaccaaccgcugagccaucucuccagccccugguuuuguuuugcuuuguuuuugagucagggucucucuguaccaugagcccaccagcauugcuaggcugccugccugugagccagacccuccuguccccagucccagcacuugggucgcaggccacgccaccguaccuggcuaucaaauuuugcuuuguuauaugaaagacauuugaucaaauguuuucucugcacugauggagacugucuuuucucuugcuaacaugucucugcugugcugauuucccaugcaggacccuccuguacccuugugggacccuuguggcugcucauggaucacagcccuuuccugcgcugagggccucauugcugcaugcugugauauuuuuuuauuacuuacuuauuucuuuuuuguugagauagguucucuaaauagcccugcguguccuggaacucacuauguagaccaggcuggccuuaaacucagagauccaccugccucuaccucucuaguacuggguaggauuuaaggcgugcaccaccacccggcuuuaggauauuuaugaguggucccgaguuuuggguuucuauuuuuuuuuuuuuuuuuugagacaggguuucucuguauagcccuggcuguccuggagcucacuuuguagaccaggcuggccucgaacucagaaauccgccugccucugccucccgaguguugggauuaaaggcgugugccaccaugccuagcugaguuuuggguuucuuuuggcuuuuauguuugucuagcuucagcccuugggucucacuggccaaguguguaaaucaggaaguguuucucuggccuguaguuagggagaguacaggaaggaucccagaucuuuuuucuuuacacauugauagaauuuaacagugacacacccaggcacuucuccuugguugggaaaccuugauggcugauuuuaucucuuuguuuauuguggcucuaucuugagucuguuuaacaguguaugagauuccugggauuuuucugugccaccuuggcaggcaagcuaucuaauucguugguguacagcucucauccagauucccuuguuguccuuuugguuuuugucuuugcugcuguucuuaugaaguagagcuggguuacaauauuguaauauacaugauaggcaugauggguagggcuggagagauggcucagcgguuaagagcacuggcugcucuuccagagguccugaguucaaguugcagcaaccucaugguggcucauaaccaucugcaaugggauccgaugcccucuucuggugugucugaagagagugacaguguaaucauaaacauaaacauguuuauaaacauccuauuggcccuggcaauauuucuugaauuucaucuuauuuuauuuuguguguguauauaccuggguaugugugugugugugcacaugugugcauaugugugcucaccugagugaggguguguguguacccaagugccugugugugugugugugugugugugugcgcgcgcgcgcgcgcgcgcgcgcgcgugcauguaugcgugcacgugcacaucauaucagaagaaacaccagaccaauggaaauaguuacagacaacugugagucuucauguggguucuggggacuaaaccuggguccuuugcaagggcaguaagugcucuuaucaguuuuccagucccaacccugagagcauuuuaaagacuauguuuuucuuuguagucuaggcuguccucaaacucacaguccugucaccuccaugcugagaguucaggcaugcaccuccaagcuggugaacucgggagucuccaucuugggauccugugugcccaaacuaucucagcaccccaaccccucccgccuaugcuccagcaaaggucucccuccacugccacacucaggggcuagcccuuccagagcagacauggaggaacuggggcacucagggaacuucaacacuuaccuccacgcugguucuuucugucauacuggacuguccgugguguggggugaucagcaggggacaccacccuuauguaagagguguacucuugcccuuaagaguagaggaggucuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaauaaaucuuuaaaaaaaagaguagaggagaccucaauacugugcucuguaucuuccuacccccagagccucugccaccgcccuaucaccuucgagaaguacaggucagcauccuaaacaacagcaggugccaggagcuguucgagauuuucucccuacaccacuugaucaccaaggauguguucugugcuggcgcugaggaugggagcgcagacaccugcagugugagucugccugccccucugaggaagccccccucuccuucacuucaggcuggagagcucgcuccaggucugccaucagcaugcuuuugcuucaucugugagaaaucauuuauagccuuuaauuacccagccuauaaaccuacuucccauuucccucucaugauaguuuucuccaucaucccugaaacccucagagguggaaaacauggcccuacuuuccugaugaagagccugaggcucuguggcugccaggggaagaccucaugaagccuucuaccccacgguguucccuuccccaaccccacccaccaaguuaucaggcucacccuugcuccuccucagggugacucaggaggacccuuggucugcaacauggauggucucugguaucagaucggaauugugagcuggggaauaggcugugggcgacccaaccugccuggcaucuacaccaacgucagccauuauuacaacuggaucgagaccaugaugauccucaauggugcagucaggcgugaucuggcccugccacugcugucuaucacucugcuucaggcucccuggcuccugaggcccaccugagcucaugaggcugcagcuuugcacucucugcagccccaggacaguccauauacuguagggauagcuugcuucaccaggcucuugucuugucuucuuugccaauaaacucauugugcauaucugag

SEQ ID NO: 8434 - RNA, 5819 nt, Mus musculus
uaauaugagcgcuacggcuccgccccgggggaccgaugaucccaaaacccguaggguucgagaagacgacugcguggagccgcgggccagcgaagacccaggcaaggcugagcguugggccccgggccccgaggacuggugccagggcccauaaauuguccaagggcugccggcgagccuggagccucgcucccccaccggcgcaaagugguacagcccgugggggcggggacagaucaugugacgcgagcgcggccgccaucuugcuuugcggugcugguauuuagagcgcagcgccugacuggcggggucgccuucccauccgcugccucgacgaucuucgcuugccuccucgcucgcugucccguuguccuagcucgccgccgcccgcugagcuugucuuuucccugcuugcagacauggcugacaucaagaacaaccccgaauauucuucguuuuucggugucaugggcgccucguccgccauggucuucagcggugagcaucgcugcaggaggagcaggggaugccgaagcgaugcgggacucuagaccgcugcucacuggggguugggcgugacgucacucugacgucauucccagcuaugugggugucgggccuuacgggcgcagguuugggggggugguggggacugauggauuuguggagcacggggcuugauccggcugcgggucuuaucagcccgccuccugugccucgcuucuguggggguggggcggcaguguggcugccaucuuaguccugggaaguaggaaugagggugggguggggggcgcggggggcggcgcgcgaugcugugcccccucgcauucugcaggcaggugugacaucacaucuugaaaggcgccaguccguaggcgggggcaggcccaggacgggagucccuggccucuuggcuggagggagccuggguccccgcuaagguucacaagcccugcuuuuauggcggcccagcugcccggggucaggugggucucuacccugggugaggcagguguuuccgguugaggcuugucucgguuucccaauaguucagucaucgguguggguugguuaggaaaacuggacugagggguugguccugggaaccugcaaggacuccgguuagagcuuauggaaguggguuuggccuagguaggagcacuuuaguggauggcugcuggggaucugggcuuugaggugggugggagggcggcauuagagugccugcauuuacacgauuacaucuuugaucuucagcccuggaccuaaugaauggaugagugaaugaaugaccuuccucuucuaggggggugaggggcuggaacugggcgacgcuuccgugcccagaaaaggaaaagccuagcaagguucuugauggcaucuugcuuuugaaguugggccuugacaauucuucagugucaaauuuuagugaaaauuggccuuccugggagaaaagcuuugggccagacccaagaaugugggauugagggagguaagucacagccccuggccggggacuggucuggccugggccuccccuggaaggucuggucuuuggcuuaacugaccucgcccugccccacccuaccuggcaaauggagaggcugguucucugugcagguacuuggugaguuuggacuccaaacagugucuguugacuguaaacaccuguagggugcagauugggguagaggguugucugucaguggugaccuccccugccuggaccugucaggugcugcugagagagcccugcuguacccacagcauuagaguaaguggucauuuguggugggagauguggccuggacuucuccuucccuccucucccaccacgacucuucuccccacacuucaggucuccuuagagaaagcugccaagcauguuuuucugcucuuugcacccagaauaauguguccauagguuccccuguuuuagccaccuaugauuaauuuuugucacucauucauaaauuaauccagcaaaucuuucuugaguccauacuguuucccagauaguggaggagucucagggaacacagcaauauaucccugaccaugugggugucaugcucugguugucacgauggcuccugcaacuccaaauuucuccacaguucuuuuucugcacccagcuucuaggaucucuuguaugaagaccuugcaugugcuaaagcuggccaacaggugugucugcacuauugcaagcugaccucggcuuuccuugucugauccuucacaccagcgucucacaguccuguggggguuagccucuuacuuguccagcugaaucaccuucugacuucuuuuuuuuccuuuuaggcaugcuauucuguacaaugucuuguccucccauuacguaaagaaauccuuccagccucugauguugcugcugggagaauuccaagcuucgucucagugacugacccuuggucucccuuggacuuaacuaaccaaguuuucagaccauuguucuuuaacgcauccuugaggccuccguuucaugcuaacaaucuaacuucccuuuuuuucccuuaugacaaauauccuguucuuuccucaucauguucuccaugaaacugccaguuacuucuuuucuguauuuucugugacuuccucccuguauuuguugauuuccuggaagugccuccagaccaugcuguauuaaauuagcauucucagcaggucucccuucugcagccuaucaugcuugcucuucuggguagcugcuacugucugggccugggcuaaauuuuuuuccuccuuuugcccugaucuccgacagugucccuguuuuccauccucuaucuucuugucacccauccucagcuccaugaucuauacuuuggggaaggaccugacucacucaccuuucuuggaguaucaccuuuugggguacagaguuguguugagaucucaccuuuaaaguacugcacggcaaccuguauucuugguguuuucaagcaugccucagaagugugagcccuuggaacacacacuuucuguacuacgugauacagcucagcauggacuuggcuuucaguagggcccaagaaaugcacugugaccagaauggcuccaggaacuaucucuugaaguggacucagggauugaagaugcagaucuuuguuggacagugucugggccucuaagaaucuguagaaaagacaagcugucuguucugccuccaguugaucuccccuaguccuccaguugaucuccccgaguccuccaguugaucuccccgaguccuccaguugaucuccccuaguccuccaguugaucuccccuaguccuccaguugaucuccccgaguccuccaguugaucuccccgaguccuccagcugaucuccccuaguccuccaguugaucuccccuaguccuccaguugaucuccccgaguccuccaguugaucuccccuaguccuccaguugaucuccccgaguccuccaguugaucuccccgaguccuccaguugaucuccccgaguccuccaguugaucuccccgaguccuccaguugaucuccccgaguccuccaguugaucuccccgaguccuccaguugaucuccccuaguccuccaguugaucuccccuaguccuccaguugaucuccccuaguccuccaguugaucuccccuaguccuccagcugaucuccccuaguccuccaguugaucuccccgaguccuccaguugaucuccccuaguccuccaguugaucuccccuaguccugucgugcaugggucugaaugugcugucaggaaccuugcccuuugguuugccucugcugcucacuuuaccaccuucccguauacuugguugguuucugugaucuguuuuuagacccuccuccccucaccauagcuccccuaggccuuuucucuuuccuugcugaauauguuguuguguugggucacugucuucuugcuguuccugagcucugagaaggcagaggucucugacucuuucccuacucagugaugggcacacaguagacaucuugugguuccgugagauccauaagucauauagaggaggggcuggagcuguucaugucucuuuuaccucuggcccauguuguuuucuguguauuggguuaugcacaacuucccccacaauggccaugggugcccugggcaaagauuuuggaggcuccagugucagccauauuaguagcucaauauuucuuauagggucugaggacaaguggcagaaaugagaagaauuggaguucaagaccugaagauaggagagggaaacaaaguccggaaggguagcagucucucuuggagagguugaagugggggggcaguaccagaagaaacagauauaacucuguuguccugucugggaaggcuugaaggccccacuguaggcagacucuaggcaggaacugauugacacuggaguggccucugggcagcugacauguagcucuuaugcuggaagugccuggagcuuagggugugggacagggauugccagagucucgagcaaggcucuccuuggcccagccgccucuuccacgugacuauguugccagagaucacaagcuagggaaggggagugcuagggaacaaagucugguuucacagcaaacgagcccccaugaccacaggaagaacugcaggcggaaguagagcaggagguuggagguauggcucugcuagugggaagagaaguggcugcugcucuugcuuggcugcccgccucaguucuuguaaugggugggaaccuggggagcagaauggaaaaagcugcucugggcucacuuacucucuccucccacagccaugggagccgccuauggcacagccaagaguggcacuggcaucgcagccaugucagucaugaggccagagcugaucaugaaguccaucaucccagugguuauggcugggaucaucgccaucuacggccuggugguggcaguacuuaucgcuaacucccugacugauggcaucacccucuacaggugagugcugggccuuuccucccaggugaagugcuucauuguccuguggacaggcagauugcugacaaccugugucucuucucuccccaggaguuuucuucaacugggugcuggccugaguguggggcugaguggccuggcugcuggcuuugccauuggcaucgucggagaugcugguguucggggcacugcccagcagccucgacuguucgugggcaugauccugauccucaucuuugcggaggugcuuggccucuacggucucaucguggcccuaauccucuccacaaaguaguccuuuuccaccaucagucacaggauaggauguaaagaucaccccuccucauuccagaacgaacagccugacacaugcacgggcagcugccccucaguaguuggucuuguaaaugugcaguguccuagugcccauugucugucgcccccgccuugccccuacugcaccgugcuguggacauacgggcccacucaucucccacccaggccccugaccagugacgaagucagccucugguuaccccacccaucgcccuagagugcuccuguguauaagaaugaacuagaguugucauuuuucucuucacuggauguuuauuuauaaaagauuugaccuauucaugcgucuguggagcagcuccugucucccaacuauauaguaaucauuaguagacuguugccuugugggguuccuguugcugagacuccuuggauggagccacccuucccccugcccugaacagccaggguggaggauagagugcuacugcuccucagagcuggcucccagcuguguccaauaaaaguucucggaugugacu

SEQ ID NO: 8435 - RNA, 12872 nt, Mus musculus
agugguggcacacaccuuuaaucccagcacuugggaggcagaggcagguggaucucagaguuggaggcuaaccuggucuacaaagugaguuccaggacauccagggcuacacagagaaacccugucucgaaaaaccaaaaaagauaaaaguaaaaaauaauugaaauggagacaggaaggucaugaguucaaggucaucagauacauagugaauugaaggccagcugagacuacaugagauugcacaaacugacuugauggagaacauaauguacugauaaucuaugccaaacaagucaauauuaaccauguauugacaagcuggccuagcuugguagaucuuugagggcaaagaccauugcucugacccuuagcugcuguguuugcauguguccuaucuacggccuccuggccauucucugggcuucagccuccccuccgccuaucuaucuacuaucugacacuccucugucucuugcacaaccuuccaugacguagagcagcuuagcagaccuauucuaagugccacaugcuccagauucccugggcuucauuguucacgucuggcgccugacauuccuaagauguuccuugacccaguucuagcauugucuucuggccauaugcuugauugcuaagucauccuggagucagcaagaccgcuuaucucugcuuucaaaguagguucggcaaaaccugguuaagacaaaaaaccaaacuuuagagggucacggaugcccugucagaagagcauuaucugauuagccaaaucagaagcuaucuuaucuacaguggcacuguccagguuccaacagagccuuugcguccucccgugggagggguuagggcggagucugggaugauggguggagcuugagauggauucgcguuuuggagcuggacuugcaagcugugcucaagauuggguagccuacccggaagugggcggccuucugcccggaaggcgcgggacuccuuggcggcggcaaaaaugcuugguguuaaaggaaacuaccuacuacccgcagacugcgcucaccggugggucucgugcaacggaagggaauugggcggacgggagcgagguucggaggcucacauaguaccuguccucaggcugguagcggagcugcagggcgccuuggacuccugcgccgaucggcagcggcaguuggagcggagccugcgcguuuccaggaggcugcugcaggucugguacgcggacccaggaccuccuggccagucccuccucggaccaucaggauuaugcagagucccagggccuagaaggccaaauacaaaugcaugcuuuuagacuccgguugccauugcuauccuuaccccuuauccagggucugaggcugggaaucugcuuagggauagaauguuuggaccauaccauggcugcccugucuuugcagggaaccagccaggaccccaucuccaguuccagaaaccaaagaagaggacccaaguccagguaaacguuagcugcuuuuuaugggugcugucccuggccuuucucuggcuugcugucaugggggaauccauccugggacagugaggaggaauucuugcaugguucuugacguucauagcaugugcaccgaguucucaagaucucgaggagcuggaacuuuugacccaggcucuggagaaggcuguacgugugaggaaaggcguguccaaugcuggacaaagagacagaacccccacucugacaucuaaggcagccacuucuggugccgcugccgccucccauccucgggcucccagccgggguggcagccguguauuggguacaagauccaccaaggguauacagcgggccacagccccucccaaggauuacccugagcacagacuacgaucaaagggugauaagacccauguaagaacacaagaccaaacuacuggguauggaccagaccucagggaccaacaaaugaccccgucaucugcucaucacaccacagaacucuucgcauuaaaggagaagggguaagcuucccagacgcucguauccugacagggcauugagcugguugaggaagccccuggugccgacccguaagggucaugcacugaagcaaacagggcagaacaggguugggaugguaucagguuugucguucuggagccuaaccagcccaugagcucucuggacugggcgagcacccacccuccuccagaagccguuuucaaaaagcuugucagaauuaagcuguuaaaggagaggaggugagaagguucgccccaauggguucugagccaugaguaagaaugacaguccuaaugccgggcuugguggcccacgccuuuaaucccagcacucgggaggcagaggcaggcagauuucugaguucggggccagccuggucuacagagugaguuucaggacagccagggcuacacagagaaacccugucucagaaaaaaagcaaaacaaaacaacaauaacaaaaagaaugacagcccuagaaugugaggagacugcucuuagcauuggcuucucucucucacaggacucuccugcagcuaccugaggacuucaggaaggcagugucucggaauuccugguaaggcugaguggugacagagacaggaaaacauugcaaacauugggaaggggaggucucucugcuucugcacucacuaaucccugugcaugcugaggcuuugaaguucccaguuaaaccaagcaaccuuuugucuguuuccuccuccuccuccuccuccuccuccucucccuccuccuuccucucucucucucucucucucucucucuuuuuuuuuuuuuuuuugguuuuuugagacaggguuucucuguguaaaccuggcuguccuggaacucacucuguagaccagacuggccucaaacuuagaaauccgccugccucugccucccaagggcuggcauuaaaggugugcgucaccacugccuggcacguccuucuuguuuuaacguagcgugcguguguguuugggugagcaugucaccaggagaggggagucggggugccuggaucugcagucacagugguugugagcugcccgaguccaugcugggaucugaacucagguccucuauuaaaggaccaccgugugcucuuaacugcugucuccagccccagucuuaagggcugaauguagacacuuagucuacaaauuccagacugucuuccuucuggaaucacaguaaugggcccuguuuuauagaagugcuguguggucaaacaguggcuccucucacauguuuguacugugccuggaaagaucucugcugcccccuuguuuuggacaauaucucuagguucucugaggcuucgguugccuccuccugccaucuagcaaagccauacaccuaaggggauaugccccugcccaucacuuccccugccucuuaagcuauacucugguugguuaaaauaacuuuguuccucuggugugccuuugggccuguuucagccugugggcccagcucaacucugcacgaaccaacgacuccacagaugccacuagagccgccaaaacucaguuccuccacaaacuccagauggcuguauccuuacugucauggggaaacugggcguccuagaacaggcucuaagcggggcagguuugggaaaggaccaguguggccugugauguggcagugcugucucuccaaacucaucuugggugggaggguugggucuggccacagacggguuucccuaacuaauacacagucaggcuguuccagccacaggcccagugcuacagagguggaggcgcacgcacggauccugaggaaggccuguaugcugcugagacuucguaugcaaaaggaacuugcaauaggucagugguccugacuggaacuuggguggaggguagaauguaaaagagggacaggcaggguuuggggaccaucauggacccugcuugcccuccuucacuuguguagcucccacugacuggaugcaggaguaccgaugccugcucacccuggaaggacugcagaccguuguaggacagugucuccacaggauacaggugcugcaagcaggugagguuucuagcccagcacuaccugugcugaggucugaauuagggucgaguaaagcaagaaauuauuuucuggugugugugugugggggggcuguuauaccucuuuuuguucauaaauaacuauugggaguuucugucccaugacugguuguauagaucccgaguaaacgacacagaaacacuauaauuuuuuuuguuuguuuuuuugagacaggguuucucuguauaacccuggcuguccuggaacucuguagaccaggcuagccuccaacucagaaauccgccuaccucugccucccaagugcugggauuaaaggcgugugccaccaugcccgacuauaauuuauuuuauuuacauauaaaauauauacacacacacacacacacacauauauauauauauauauauguaagcuauaggcacuacgcugagagguuguuucgaacuuuucuaauucuuccgucuguuaaaaccacacaaaugucagucacaugccaaucuugucuccauggaugccucugcucugucagccuguccucaggguucuccugguccaucccucucuguucucuuccuccuuccccucccccucucccugccccauuacucacucacucacuuuccagccccgcccccuccuucucuucuguccaaucagaagccccagccauuuacugaccaaucaugaacuaauagggagcauucuucacgauacauugguuaauacagcaccccacuauuaaguuacaguguggucugggacuuaguauucaucuucugaauauauaaugcacaagcugaaccucuggcgcuuuaaccugccuugccugugacuuuggaaggaagggcuaccagcccagaggcugacaaacccauuacacuaugcauacuacgggcugcuacacacuaggguggggcuuuuguuacucuguuuguuuugguuuguuuuuuugagacaggguuucuuuguguaguccuggcuguccuggaacucgcucuguagaccaggauagccuugaccucugagcugccugccucugccuccgaagcccuggcauucaaggugugcgcuaccgccugacuuauucuagguuguuuuaaaagcucagcuuuguauccuuuagaaccaagcauacaacugacaguagggaaggggaaagcuaaguacuggccuauaagaagagagaccuuggugauggcugucaccccaugagacuacagaugucucuucucauagcugugacagagcaacuuccaggagaaugccuugcagagacgcgcacucaggccucguccguuugcggaggagagguggacucugccugcagcccugagcuccuucucuaugcuagcaccgaggagcugcagaccuuggccaccuugaagcuucagguggccuugcuacaccagcagauccaucuagaaaagguaggguuccugggagccagugaccuuacugaggcuggcacugacucccacccuacuccaaccccaggguaagucucgggagaagcaguagcugggauagguugugacagugagccucuuggccuccaugugagcugggacauccucauggccaggaugucuagaaucugaggaaggaaagaggguggaaguguucuuaucccaggcuugcccacugaggucuuuucucuguacuguuccccagguucugauggcugaacuccucccucugauaaacacccaggauccuggaggaccgccuuggcuggccuugugucgggcugcguacagucugcucugugagggaggcgaacgcuuccucacaguccuucgagaugacccugcugacuaagcagucugggcaaacaagccucugugggagagcccccuccucucuucuggacuguagugaacagggauugagggagauuuuccaguuugggggagcuauaaccucaccgagaaagcugcguggccagggugcucccccuccccccaagcucuucuuagacuucuuagucaggcucagcuuucugccuuccugggggaguccuuggcugccucuacuuucucucacucuagaccuccagacuaccuguaugacacuagaacuccuuuaggaaguguaaguauuuaaauuauaucauagcaggguuugguaagcagcuuuuugguuucuuguuucuuucuuugugguuuuaagaauuguaucgauuaccuaggugggaggcagaggcuggugauucugugaguucaaagccagcuugaucuacagagcaagccaggaccacaaagagaaacccugucucaaaaaccaaaaugaaaagacuuguaucaauuaagggguuuggagugccugcaaucccacaggggaggcugaaggaagaguauccuaaguuuaaggccagccugaacucuguuuaaauaaaaaaggaagggguuuaccaauaaaaauucaaaaguaugagcuggagagauggcuugacgguuaagaguacugacugcucuuccagggguccugaguacaauucucagcaaccacaugguggcucauaaccaucuuuaaugggaucugaugcccucuucuggugugucugaagacagcuacaguauauuuauauacauaaaauaaauaaaccuuuuuuaaaaauucaaaaguaccgggcagugguggugcacgccuuuaaucccagcacucuggaggcagaggcaggcggguuucugaguucgaggccagccuggucuacagagugaguuccaagacagccaaggcuauacagagaaacccugucuugaaaaacaaaacaacaacaaaaaguauaacauugucucuucugcauaggggaaggugaaaaucauuaacauuuguccccuggcaccccugaaagccauaagccacaucagaauaggcuugccccucccugcccaugaucauuuuuucacgugcccauaccuccacuccauccccauugucaccuaggaccagccugugagggucucugcuucaugcugaguaccccucacuuauggcacuguccccuccuaggcuucaucuguaugaaaggaauuguaacuucccuaggagaauaaagggcagggggcagggcuguagccucugcagcaauuauggauugcuuccugcuugggguuuccugcaagaaucucaaguacuccuaggcuguuccccagaguuguuuuauuuugggggcuggagauagagcucaguaguuaagaguauccacgugacucagcugcuuguagacccaguuccaagggauccaauggcuucuuccaguguugcuagcuaagcacugcgcacauaggauggacuacauacaugcagacagaauacccauauguauaaaauaauagguuuaaauaugugaaugugggugccuauauggaaaugugcaccugguguguguaccugauaccugcagaagccaaccaaguuacaguugguuuugagcugccacaaagauguuggggacaaaaccuggguccucuacaagagcaccaggugcucuuaacugcugaucccucuuuccagcuccuagacuuuuuguuaaaacacuuuagcugaucauuauguccaacaccuuuaaucccaguacuucagaaacugaggcaggucuaucucaauggguuuaaggccaacugggucuauauauuaagacccugucucagaagaauuguuuuuaaugcagguguauaacaccucuguacaguuucccagaagcuccaaaagagagcaucggcucccccguagcuagaauuaaaggcugcagaugaaugcuggaagcagaauuuggggccuuuugaagauuagcaaguguucuuuuuguuuguguguuucuuagggucuuucuauguagccuucauuggccuggaacucagguuggauucacugagacccagcugucucucccuccugagaacugggauuaaagguacugagauaaaguaccacuaugccccuaagcaagcauucuuucuucuucuucuuuuuuuuuuuuuuucuuccuuuuaaugguuuuucgagacaggauuucucuguguagcccuggcuguccuggaacucacuuuguagaccaggcuggccucgaacucagaaaucugccugccuuugccuccagagugcugggauuaaaggcgugugccaccacgcccggcucuaagcaagcauucuuagccacuaagccauuucuucagucccacgucccagauuuuuguuuugucuuguugagacaggaucucacuguguagcucagccugcucuccaacuccuagcucuccugucuguuucacaagagcugggauuuuaguuuauuuuaagaggacuuagccauaucccaagcauuucuuccagcuggcuacuagacucguguuuauacagcucuggagccucaccaaacuggggagaggacaggaaccuuucacagagaaaaauagccuuuaucacaagggacacgaagugugcaugagaguaaaccuggccuuaggagagccaggugaggucuguaggugaagggagugaaguagauaaugguuaagaaccuuacucugguuuccagcagaagguccuucuugcaaagaaaagucuuuacaaaggucaguccugccgaccaaauuagucaaaacagccccagguaagggcuggaagcaaauuagagacugaaguagaacauaaaacaaaaaacaaaaaacauggacuucuuggacugagaagugucucccagaacagaacccagaaccuuugagccaagagagaaggcuacuccacccugucaagcuagcuagcacccagcccuagcagagugccccugacuagaaccaucccuuagacuaaccaaucagccuccugcuaccuggaaagcuuauguccaaguacugugaucuagaggaggccuuaaccuuaccgaccaaucauuagccaccccaagaucccuagaauuauuccauugguugguucgcuugcuuguucauacugucucaauguaccagugauugauccuaaaccuaagaauggcaagggcauuguccaccuccacccccugaccaagcuuugggagcucaguggcccuugacuacaugacccuaccugguaguguccagccgaguguucuaauugcucaacaccugagagguacccugguuggaguuagacgcgguauuugaaggguuccaugaaaauaguggaagcacuuuaaauauuacccaacauccugcuugcccaauuccuugccaaagccaggaggaggcaguggaacucccaagcguccuggugucgucaccaaguucgggaccaauuggcucuuacguggcagaccaggaugugacguaaggcugugaugggcauccuuaccauugccaccccaucuccacccccaaagcacggccaccuagucggaaacaugaggucaccagaguccuugccugagcccacccugccaggucuggcauccccagaacccccuggagcccuccaugcccuguucuuggccaccggcggugcggggggcuccuggucgcgcugcggcuugcccuucggcgcccuggcggugcuggccggugcaucuggcaccggcaucaccuucucgcugugcgggcccugccuggaucuggcccaaagcaugucucuggcugcucuuggcgucggccuuggacuccugaccgccaccuuucugugcuggcgagcucggcggaguaagagggcuggguuuguggagcagcgggagccuaagccugugugaggggccaccucccagcaaggucugggcgagagggcugcauuucacuguuggcaagacacagaagaccccucccuaaacuguuuauuucuaaauccucaugaaguagggagggcuaccagccuuuacccuuccuccuucuucuacgcccuucccccucacaccaucccuccaccaaccggugcuuuucagcuuuucguuuucaacacggagagcugauugcugccgcccagcuggccugacaguguggaaagggaggggguuugcaaaaagucugcgcaaggagugcagggcauggagagaguaagggacgaggugagacggagaacguagacuugccagccuuccucucuacgucugggccuauugaggcauaauaggcacucauacaaggcaaggagaagugguggcaagggucugaaggggacaguuggucccgggcuggccaggggguuauuugaaagaucagcagcccccugagaccugaaauuguccaacacuaucauccucugccccccucaacccaauugcuguuauggauuggggugagugugcagagcuugagcaguugcaggugugaggcagggguggggggggggcugggggggaaaggagggcggaaccucuuuguuacagaaaaugccuggaggggguagggaaucaugagaggagaggccuaagaggccucaaucaggggcggaggcagguggcuggguccacagagaguuauaagcagcucuuggagacuagagaaagcuaucccaaugcccaguccaccaucugcaagaguagcccuggggccagacaaugugugcaaagggcaauucuaggaaagagcucugaagcccaugccuccuccuugaagggcuggugaggcaauggccauuugagcuccuguccggcuccaucccucaggaccugaucaaugcagagaucaccaggcaccaacuuccacccacaucagaauccaucucauacucugcagaccccagcagucacaguucacagggagcugagcuagagauaaggcuuacuucacuguuggcgugaaaggcugucccccugucccaccucccauaguugucugacagucuggggacucuagcaugggcuugauguucagaggacagccugguuuuccccugagucagcuguucuagaggaacaaguguccaacacccugccacacugcuucucucccggugccugccucugccgcagccccuguguccugggaaggguccaggguucuuguuucacuauuccuuuccugagagcuucuguuucucuccuuuuuuguuguaggaacacuuucaguccagaaugcuagcucugaguauacaggcauucucccucauauggccucucuuaccaucugcagggacuggccuguggucagccuccuuucugaaaccagguaauuggaccucaggacugcucccccaagauggaacuguaucccacccgcucuucguggaguccauggcagccuugccugguccgucagggaccaaaggcagugagugguuccucuuggcaagacccucucagccacagcccaccuccaacuuguaccccagcaacucaucuggggcaucugccuguuuuucuacccagauguacuaggcuguagacggucagguucagggauucugacucugguuuauuugugaccagccccucuccagucguuaaaucccacuccuuaccuuuccacgagggugggggugggguaacaggugaacagaccuugaaccccaagggaccaucaaauaggcuguacuuugugcucaaacuuucaagcccuucuggacaauggggcuauccuaugacacagcuauacccugagacccaggagugauuuagauuaagagauuggcuggaucucacuguccaaccgugaccucaucacuuagccgcaucccuagugcaccucgcuuaggaugauaucuauguuagcucaucaaaugcucccagcaacuccacaaagcauggcaaacaauagacauuuugguggaugaggaaacugaggaacucaggccacacagccagaaauccaaacagcuuggauuuaaaauaagaccugaguucuuucugcuagaacagacuacugccuuggggauaccuuacaagaacaccagccccaacugucuucuucccccauucuggggagcauccaagacuucaagcuucaguucuaagguugugccugcaugaugggccucugggaggaguggcccagaccccagcccagcacguggcaccaccccaggagcagucaaagccuggcuucaggccgaggacccugcuggguggucccucacgggcuguaaggcugagcugcccccucccguaagcgcauuccuggcucuccagccccuccccccggaucgugggccucccagcccccucccgcgcuggcccagccugugucugaaucugcuucugauucuggcugucgggacaaggcccccuccccuccuuccuucccggcccgagcagcuccgccccuggcuaggaccaggcuugcuccugcugagccccccacccccuucuggcacagcuccucugcucucgcugcagccaggagaagccggcagcccgggcgccccaggccccgcccgcccaaggcccuucccgggaggccgggagaccugcuccuccuggcccuccgugggugagugcuggcggccggcggcggguggggccuccgcgggcggaggcaccgggagcgggggcgacgccugucaacgcuucaggccuagcaggaggacucgccaacaucccugcuccugugcucggccccgggcgugccgguggcugcucccacuucugggccugugcugggggccgcccuggugcucugcuaucuuggcacugcagacccggcacgcagaguagcggacuaggcucucucuucgagggcagacucguuaggcggaagcuggcugguugacuuacagcggccacggccaugcccaccuggcucugggggcugcugcugaccgcgggcacgcucuccgcugcacugagcccagggcugccggccucugccgaccccugcuaugaugaggcgagggagccucgcucuuguauuccug

SEQ ID NO: 8436 - RNA, 5800 nt, Mus musculus
uggauucgcguuuuggagcuggacuugcaagcugugcucaagauuggguagccuacccggaagugggcggccuucugcccggaaggcgcgggacuccuuggcggcggcaaaaaugcuugguguuaaaggaaacuaccuacuacccgcagacugcgcucaccggugggucucgugcaacggaagggaauugggcggacgggagcgagguucggaggcucacauaguaccuguccucaggcugguagcggagcugcagggcgccuuggacuccugcgccgaucggcagcggcaguuggagcggagccugcgcguuuccaggaggcugcugcaggucugguacgcggacccaggaccuccuggccagucccuccucggaccaucaggauuaugcagagucccagggccuagaaggccaaauacaaaugcaugcuuuuagacuccgguugccauugcuauccuuaccccuuauccagggucugaggcugggaaucugcuuagggauagaauguuuggaccauaccauggcugcccugucuuugcagggaaccagccaggaccccaucuccaguuccagaaaccaaagaagaggacccaaguccagguaaacguuagcugcuuuuuaugggugcugucccuggccuuucucuggcuugcugucaugggggaauccauccugggacagugaggaggaauucuugcaugguucuugacguucauagcaugugcaccgaguucucaagaucucgaggagcuggaacuuuugacccaggcucuggagaaggcuguacgugugaggaaaggcguguccaaugcuggacaaagagacagaacccccacucugacaucuaaggcagccacuucuggugccgcugccgccucccauccucgggcucccagccgggguggcagccguguauuggguacaagauccaccaaggguauacagcgggccacagccccucccaaggauuacccugagcacagacuacgaucaaagggugauaagacccauguaagaacacaagaccaaacuacuggguauggaccagaccucagggaccaacaaaugaccccgucaucugcucaucacaccacagaacucuucgcauuaaaggagaagggguaagcuucccagacgcucguauccugacagggcauugagcugguugaggaagccccuggugccgacccguaagggucaugcacugaagcaaacagggcagaacaggguugggaugguaucagguuugucguucuggagccuaaccagcccaugagcucucuggacugggcgagcacccacccuccuccagaagccguuuucaaaaagcuugucagaauuaagcuguuaaaggagaggaggugagaagguucgccccaauggguucugagccaugaguaagaaugacaguccuaaugccgggcuugguggcccacgccuuuaaucccagcacucgggaggcagaggcaggcagauuucugaguucggggccagccuggucuacagagugaguuucaggacagccagggcuacacagagaaacccugucucagaaaaaaagcaaaacaaaacaacaauaacaaaaagaaugacagcccuagaaugugaggagacugcucuuagcauuggcuucucucucucacaggacucuccugcagcuaccugaggacuucaggaaggcagugucucggaauuccugguaaggcugaguggugacagagacaggaaaacauugcaaacauugggaaggggaggucucucugcuucugcacucacuaaucccugugcaugcugaggcuuugaaguucccaguuaaaccaagcaaccuuuugucuguuuccuccuccuccuccuccuccuccuccucucccuccuccuuccucucucucucucucucucucucucucuuuuuuuuuuuuuuuuugguuuuuugagacaggguuucucuguguaaaccuggcuguccuggaacucacucuguagaccagacuggccucaaacuuagaaauccgccugccucugccucccaagggcuggcauuaaaggugugcgucaccacugccuggcacguccuucuuguuuuaacguagcgugcguguguguuugggugagcaugucaccaggagaggggagucggggugccuggaucugcagucacagugguugugagcugcccgaguccaugcugggaucugaacucagguccucuauuaaaggaccaccgugugcucuuaacugcugucuccagccccagucuuaagggcugaauguagacacuuagucuacaaauuccagacugucuuccuucuggaaucacaguaaugggcccuguuuuauagaagugcuguguggucaaacaguggcuccucucacauguuuguacugugccuggaaagaucucugcugcccccuuguuuuggacaauaucucuagguucucugaggcuucgguugccuccuccugccaucuagcaaagccauacaccuaaggggauaugccccugcccaucacuuccccugccucuuaagcuauacucugguugguuaaaauaacuuuguuccucuggugugccuuugggccuguuucagccugugggcccagcucaacucugcacgaaccaacgacuccacagaugccacuagagccgccaaaacucaguuccuccacaaacuccagauggcuguauccuuacugucauggggaaacugggcguccuagaacaggcucuaagcggggcagguuugggaaaggaccaguguggccugugauguggcagugcugucucuccaaacucaucuugggugggaggguugggucuggccacagacggguuucccuaacuaauacacagucaggcuguuccagccacaggcccagugcuacagagguggaggcgcacgcacggauccugaggaaggccuguaugcugcugagacuucguaugcaaaaggaacuugcaauaggucagugguccugacuggaacuuggguggaggguagaauguaaaagagggacaggcaggguuuggggaccaucauggacccugcuugcccuccuucacuuguguagcucccacugacuggaugcaggaguaccgaugccugcucacccuggaaggacugcagaccguuguaggacagugucuccacaggauacaggugcugcaagcaggugagguuucuagcccagcacuaccugugcugaggucugaauuagggucgaguaaagcaagaaauuauuuucuggugugugugugugggggggcuguuauaccucuuuuuguucauaaauaacuauugggaguuucugucccaugacugguuguauagaucccgaguaaacgacacagaaacacuauaauuuuuuuuguuuguuuuuuugagacaggguuucucuguauaacccuggcuguccuggaacucuguagaccaggcuagccuccaacucagaaauccgccuaccucugccucccaagugcugggauuaaaggcgugugccaccaugcccgacuauaauuuauuuuauuuacauauaaaauauauacacacacacacacacacacauauauauauauauauauauguaagcuauaggcacuacgcugagagguuguuucgaacuuuucuaauucuuccgucuguuaaaaccacacaaaugucagucacaugccaaucuugucuccauggaugccucugcucugucagccuguccucaggguucuccugguccaucccucucuguucucuuccuccuuccccucccccucucccugccccauuacucacucacucacuuuccagccccgcccccuccuucucuucuguccaaucagaagccccagccauuuacugaccaaucaugaacuaauagggagcauucuucacgauacauugguuaauacagcaccccacuauuaaguuacaguguggucugggacuuaguauucaucuucugaauauauaaugcacaagcugaaccucuggcgcuuuaaccugccuugccugugacuuuggaaggaagggcuaccagcccagaggcugacaaacccauuacacuaugcauacuacgggcugcuacacacuaggguggggcuuuuguuacucuguuuguuuugguuuguuuuuuugagacaggguuucuuuguguaguccuggcuguccuggaacucgcucuguagaccaggauagccuugaccucugagcugccugccucugccuccgaagcccuggcauucaaggugugcgcuaccgccugacuuauucuagguuguuuuaaaagcucagcuuuguauccuuuagaaccaagcauacaacugacaguagggaaggggaaagcuaaguacuggccuauaagaagagagaccuuggugauggcugucaccccaugagacuacagaugucucuucucauagcugugacagagcaacuuccaggagaaugccuugcagagacgcgcacucaggccucguccguuugcggaggagagguggacucugccugcagcccugagcuccuucucuaugcuagcaccgaggagcugcagaccuuggccaccuugaagcuucagguggccuugcuacaccagcagauccaucuagaaaagguaggguuccugggagccagugaccuuacugaggcuggcacugacucccacccuacuccaaccccaggguaagucucgggagaagcaguagcugggauagguugugacagugagccucuuggccuccaugugagcugggacauccucauggccaggaugucuagaaucugaggaaggaaagaggguggaaguguucuuaucccaggcuugcccacugaggucuuuucucuguacuguuccccagguucugauggcugaacuccucccucugauaaacacccaggauccuggaggaccgccuuggcuggccuugugucgggcugcguacagucugcucugugagggaggcgaacgcuuccucacaguccuucgagaugacccugcugacuaagcagucugggcaaacaagccucugugggagagcccccuccucucuucuggacuguagugaacagggauugagggagauuuuccaguuugggggagcuauaaccucaccgagaaagcugcguggccagggugcucccccuccccccaagcucuucuuagacuucuuagucaggcucagcuuucugccuuccugggggaguccuuggcugccucuacuuucucucacucuagaccuccagacuaccuguaugacacuagaacuccuuuaggaaguguaaguauuuaaauuauaucauagcaggguuugguaagcagcuuuuugguuucuuguuucuuucuuugugguuuuaagaauuguaucgauuaccuaggugggaggcagaggcuggugauucugugaguucaaagccagcuugaucuacagagcaagccaggaccacaaagagaaacccugucucaaaaaccaaaaugaaaagacuuguaucaauuaagggguuuggagugccugcaaucccacaggggaggcugaaggaagaguauccuaaguuuaaggccagccugaacucuguuuaaauaaaaaaggaagggguuuaccaauaaaaauucaaaaguaugagcuggagagauggcuugacgguuaagaguacugacugcucuuccagggguccugaguacaauucucagcaaccacaugguggcucauaaccaucuuuaaugggaucugaugcccucuucuggugugucugaagacagcuacaguauauuuauauacauaaaauaaauaaaccuuuuuuaaaaauucaaaag

SEQ ID NO: 8437 - RNA, 5531 nt, Mus musculus
cuucuaucgacuagcuccuccucgccucgccguccuggacuaaggcagagugcagagcguguguuaagguacgggggacacgggaugagggcugcuaccgaccacuggguggcuaggagagugcggucgggguaaucgggccgguaacacagagccagggcggugugcagagcacuggggagcgcggggguccugccagauagcgcccccacccauccgaucccagugccggucaacuacgcaugcucagcagcagcagugccgggcuuuuccuuagucgccaugcgcaugcguugccuacccuugcgagagacggcgcccgggcgauggccuucugcgugugacugccuccugcuggcugcuggcgagguggcgucuccaagcgugagggugaagcugaaggaacacucucccgggagcaaaguagccggagucuuuuuuuuugagacugucagcgugacccugaacacucuuauuuuucuuaguuuuaaagugaaguuaauaccgguacacuguagugugcagauuguuaugcguacaucuuuucucuccaaacguuuugaccuuuggaccuuacuuaucaccucuuggcccagugcaggucucauuuuuuuucuccagccaucaaacaaugaauaccaccccaggcacagugggcagugacccugucaucuuagcaacugcaggcuaugaccacacggugcgcuuuuggcaggcucacaguggaaucugcacucgaacagugcagcaucaggacucuguauccuccucuuggcagcaggauggugcuggccagaauuaaguaugaaugauauguguuuggggaaacucaggccaggugguggaggucuugauggccuuguagccccaagguuucccucucuggguucucuuccuguuauccuuaacaugcucagcagguaaaugcauuggagauuacuccggaccgaagcaugauugcugcugcagguaccugagauucucgaccucugacccuuuacuggccguaguucuaccuggcacacccaugcuucaauucccccugugucccuagguuaccaacauauccgcauguaugaucucaacuccaauaaccccaaccccaucaucaguuaugacggagucaguaagaacauugcaucagugggcuuucacgaggauggucgcuggauguauacagguggcgaggacugcacagcucgcaucugggaccucaggugguguuguguguugggcugaagaggacggcugcccggggagugggcaggccaggggauugucugugggcaggcuauucugcaaucaguuagucuuagugcaagagggguugagcgggcgauggagggaagguagaaagcagaauagaauuacaucagagagcuagccuugccuugaggcuagggggccagacuuuccuucccuuuucacugaccucaagcuuguggagaaagagcuaaacuucacaaccauuucuccuaagguagaagcaacuccuuugagcagagaaugggggcuuuugguagaggcauggaucaaauccauuagaagccauguguaaccuuaacuccccacaggucccggaacuugcagugucagcguaucuuccaggugaacgcacccauuaauugcgugugucugcaucccaaccaggugaggaaugcucauggggccaggugucaggggugggguggggacuuuagaggacaagaguauugcuacauuucaccucccuccccuacauccuaggcagaacucauugugggugaucagagcggugcuauccacaucugggaccugaagacagaccacaaugagcagcugauucccgagccugagucuuccaucacgucugcucacaucgacccagaugcuagcuacauggcagccgucaauagugccgugagugcugggaguggcuccgggggcaucuuggcaccuagccccuuaucuucugcacuugaguugacucccugguucucucucaggccucccugagcuuccacccagcucccaaagucaggcaccuggguaccacuccucauguccaccuugcggucugccauagccccacccaucagggccaguuauuucuccuuucguguuccaguccauggcuuugcucauccuugacacuaauaaguuucucuguggccuuccugggaugccuguucugccccccuucaaccaugcaaguauccuuuagucuuccuggcaagcugcacuguucugagaccuuaagaagcaacuccucauggacuguggaugcuuuaguuugggcccugcucucaucucuagucuccuauuuuccuuuuaaaucccagaacaucauuugucccacguaucugcacucccuccucccauccuuggguugucacauuaucuaucucuguguccucguuacugccuccccuccugcacaucucuguuggccagcagcagccucuggggagcuguguuugacuuggcuagugugaccuccugcuuuuggcuggcugggcucgauuccuuguuggggcuaaauuuccuauagacaugacccaggaugucauuggccuucaggccuuggcccagguguccccaauccauaucugagggucuggguuuugaaugacugcccuccuaucuuauagggaaacugcuaugucuggaaccugacagggggcauuggugacgaugugacucagcucaucccuaagaccaagaucccagcccauacacgcuaugcccugcaaugccgcuucagcccugauuccacgugcguguacgguccugggggaaaggggaaucuacaagcugugggcaugaccuggugugugguaaguagauaugagguaguaguagcuacugagacaccccauguucaaccccaggcuucuugccaccuguucagcugaccagacauguaaaaucuggaggacauccaacuucucccugaugacagagcuuagcaucaagaguaguaacccuggagagucaucccguggcuggauguggggcugugccuucucaggggauucccaguacauugucacaggugagcccugcccuccuuauccccauauugccaaguccacuagagaggccauucacagcugcuuagcucucuucugccugaucucuccuuacagcuucuucugacaaccuagcccggcucugguguguagagacuggagaaaucaagagagaguaugguggccaucagaaagcugucgucugcuuggccuucaaugacagugugcuggguuagacuuggcccuugaggcugcauugggcaaucaggacugccugguauagugacgccaagaggauguaucugaacaauacccggguccaagugagacucucagguuagcaugucaggccaguuggaccugaccggacuaugcaggccccuccuggccaaccuagacuuuuuggcuacucuacgcugggacucuuuccaugcccaguuuguugucagaaagcucacucacuaagccagacuggacugggagucuuugcuccuuuagagagacuagaccuagaggacuugggacuguugaggaggucagagguuaaugccuguauuccagguauguuaccccgacuugcuucagaaauuaccauuauggccaggcaaucuggguuuauuaaucccuacugucagcugccuuccauagguacuggugaccuggccagcuuacugaccuguggggacaggacuggccuauggaaccaaaggccaggagggcuuggguagggggucuuagucugggagguaauaaaagcagacagacacacagauguugcucgggaagcagaugucaaugcagagguagaucagccgcugucucuggggcccuggggagaagggaacuucgugaaucccaagggcccccuacccaguacuguccuacaggagccauaguccucuucacccaaccuaucccaauuuaccuucugcccauuggguccaguagaugggagugucugcacaaagguguugcacugaaacucccacuuggguaggguccacaguauggccccccaaaacugccagcagcuccugggcauaguggguaucccggccagguacaugugacucuugggccugcagaaagacucugguggaccaccguauaguacuuccuugcuccuggcugggaaggguauuggugcccaccccaggcugauggccccuccaccugcccuugucaacagccuuagucaggggaaaauagagcuuucuguuccccugaaaccagagccuuggcuggcccagcuggacugcacagaggaccuuuuguuuauccccuggccuuggggguuuguggguggcaagccaaguaguacugcucacccuggaaguguucagcagcagcugcagggucucccaaucuugggcuuccaucagacggaggaagcaggcuuggugcucugcagggcgguaacagauguagcccuggggguggcggggcagauagguaagucgaggccaccccugacaccuccacucucucucucucccaagcccacucacguucugcccgucaaacagcacagcccagcugugguugcucugaaacggagucaccacgaugguugccauguucugggccacauccacuagaguaguuugguugggccaggguacccuggagcucgggaaggucuuucggagcaucugcagcaacggcuaagggauauuugggauucagccuuaaccuauguuuccacauccuucugguucucuaucugcucgaggcugguaucuagaccuggccccaugcgagaacugacagguacuggccuuccugcccucuucccacucugcauaccccgaggcuugaagaggugcuuaccuugggagagcuguacaugaagccaagaagccccccagccacggcccccgcagugagcagugucagcagcagcagcaggccugcugcucuccagccccuauggcaggguuuggucuucaccugagggcacaguacuggccguggggcuucuggcuuagagacucagggaaggggcugaggaugguaugugguaacauuccuuucuucuauggcaucccugaguucuugucuugggggugguagagacuuaccucagcaggcuuggaccugaggcucucaguguggaugcgcccuugcuucaugcugcagccccugcugacaaugcacugauugucugcagccccuuggaggagucagccagggaaaccucaggaugccuuugaugaaucaaacuguauccuccccuuccaaccccacugcuuccuucccagccaguaucugauauccugccucagccaggacaacccucucccccacaugugauugcuggucacuaguuugucucuggacucuuggccugugcagaacauggggucuugguguguguuagagcuggccuugaagucagaauuggcuaggucuucgccagggugauuuugaucugguugggcagacuuuuuuucuugguguugccuccggacuccugagcuagacaccggaacuaucaauaaauguguaugaaccaucagu

SEQ ID NO: 8438 - RNA, 496 nt, Mus musculus
ucuuuuugggagugaguguguucguggucccuuucaucuagguuuuguaaggaacguuuugggaguagugcucgccgaauggaacucaaaggaccucugcuacagaucugccuuccucccgagcugaagugcuuuaguccuaaggguuuaacccuuccccauuuuucuucugacuccauuuuugcagguaugaacuggucgggccuggcuucccuuuucagccccaagcccgugaugaauuaauuucugacaccucguaugaaaacugcaugcguagucugauuacauuauaagacugaggcuugggcgcgacgucacuaauuggauggguuuugagugaaaaguuaaccaaaguaaagauuuauguuugauuuuuuuuuuuucagggcauguugagucggcugcaucuagagauccaacgaguaggaguguuggcugguaagcugggcauccguguaucugaguuucuuagcaauaaagugaaaugcaaucuuac

SEQ ID NO: 8439 - RNA, 36817 nt, Mus musculus
aaguacggguugcgcuuccggcagcugcccugggccgggggugugcgcccuucccugggugcaggaggaccugcgcgcgaaaggcgcgcgcggggugaguagcccuggaggcucugacugcuggggcggguugcgaugguuuguguggucgcgucgcgauggggugaggggaauuggucguucugauuccaauccuccgccgcucccaccgcugacaaguccuagcgcuucaagcccuccauugcgaaugugagcgggccucugcaucuauucacgcgacagcuccuccuuaaccuagggagaacuaauggcaaucaacaggcgggucgcuagaguaagccuauaccuccggaguugauuuguggcugaguuccuccugcauggaguugaguugccccagaggcuguaggaaggacagguuauugccuacccuugaccuaggauucuggagguucgccucgagggcagaagggagaaccuuuccugggguguaucaaauaauauguuuauuucuacacagagcaguucucuaguacugcccugcccaccauggccaaaccaacaagcaaagauuccggcuugaaggagaaguucaagauacuguugggauugggaacaucgaggccaaaucccaggugugcagaaggcaaacagacugaguuuaucaucacaucggaaaucuugagagugagugaguggccaaugucuuggcuagcccagcacaaaggcuaggaaggcuggguuugucugucauuggguucugugggagauggguugcugguaaccaucugcauagggcugcuguccccaguacuguggagacagauauaugccuguccucaggaucuugguguccugcuuuagcacacuugccuuagaaguuagguguuguaugaaaacuuauuuuguuuaguguuaugguagauagaugcccuguacucucucagcacgugagaggcagaggagauaggauuaugaaguuggaggcaacauaauuguaacccaccugagcuacaguagugagacuggguccuccucuccucaaagauguucguuuccuuuuuuaaauuggagauccacccuuucuuuuuaggaacuuuuaaaaaaagauuuauuuauuuaacauacacacacacacacacacacacacacacacacacacacacacacacacacacuguagaugacacaccagaagagggcaucagaucccaucacagaugguugugagccaccaugugguuacugggaauugaacucaggaccucuggaagagcagucagugcucuuaaccacugagcuaucucaccagccucgagauccagccuuaaaaaaccaaaccaaacacaacaaaacaaaaugcugggugaugguggugguugguguaugcugcuaauccugcccagcacuggggaaguucaguacagccagagauacacagagaaacgcuggagagacagaggaagggauggagcgagggagggagagagagagagaaaaaaaaacagagagaggaaagaaaccccauugguuuacaggggaaaugcagaacaacguuaggugguuuauggccaguggguaagaagaccucuuuuuaaaagcucagcccuuuuccucuuuucucuucucuaggaacugaguggugaaugcggccucaacaaucgcauccgaaugauagggcagaucugugauguggcaaaaacuaagaagcuugaggagguggguuugccucagcugcacugcuggaguagugcaugcccacugcaggcuguagagagucaugcccacugcaggcucuagagaaucuccagucugcggcugcugccuugagcugucuuuucuuguuuuugagaugugcuguguagcccugacuggccugguauugacugugugguucaggcugauacgcugugaacuugauguggucuuccuuccucagccucuucaguguagaucaggacuauaggcauagcccagaaagcuagcuuugugaugaggcaguuuuuaccauuuuagagaaauuuagcuuucaucuuaaugauguggaagcuucuagaaaugcccuaagugcaaccugagagacuuaccuuggugguagcaaaagaaaugagcuuucccugaauuccuggaaaagcuuauggcuauguacgucugcuuauccucuuugucgugguggugguugagacagggacuuaccauguagaccaggcuggccuuagauucagaaucccgugccuguguuuccagugcugggauuagaggcgugcgcugucgcugccaccuggcuuccgagcgagcagaucuggaacauuuagucggggcucacucacacaggaacaccuuggagugggugucuggggcagaugccuguuuaggguuccaucugugcugcuuguucuaagcaccauggugccucugagugcagcgagagcuaccagggacucccuggcaggcggcuucccuguccucccuggucuuuuccacgccgagauccagggcccauuaaacagacuuggcugggugucagauguggcggcaaaaaugucacgguuuuaagucagaaggcccuauuccgugcucuguguuguccuuugcggggcuaaggucccuggaggcuacacccuucucacuguccccuuuuugucauggcagcaugcaguggaggcacuuuggaaggcugucucagacuugcuacagccagagcggccaccagaggcccggcaugcaguucucaccuuauugaaggccauuguacagggacagguaagggguggagcugugugagccugugggaugaaggcagaccgucaccguuugagcuccugccuuugcuggugugccagggcaggguccagcgauuaacaggccugacugagugugagaacauucuggugucacgugucuggugaucgaccgugcccagucacuguagcuccugagccuccgucuuaugugggaguagagaaugacagcuauagcuacugggggugguacaaguaguuugugcaggauauuagguuauggugguuguuaguucgcuguuacugaccaguuguggccacucccugcccuucucuagccauuuaggucucaacuggcccuuuaacccucaugguccucugugcauucccggaagggucuuccucuaggccauucucuuccuugauagucuagccucuccaagagcugugguaucucuccuaagggcuguggcaccucuucuggggcuagaucuuuguccucccaauaugugggcacacuagucuagccugacucuugaguugggccagagcaagagcuuuacugucacacugugugccugucccuaaccauguccaagcuuaaugcauuaggugguauauacaugacauucagcuauuggcuggugccucuggccacugucugaaccugugauauugcuaaccugccuuccauaagguacuucuagaacaggcaugucuggagucuuggguccuuauguacuucuuggcuuuucgaaagcugcaugggaaaugcuggaaaggcucuauuguuuuugucuuuagggugaucguuugggaguucucagagcccucuucuucaaagugaucaaggacuaccccuccaaugaagaccuccaugaaaggcuagaaguuuuuaaggcccucacagacaaugggaggcacauuaccuauuuggaagaagaacuggguaggugucacacagagagaggaugagagaugccugagaugagaaaaggugcugcaguucacgggguggccugcagggggcacagggccauuuaccauuugccuugggagcuuaucagugcccuucugggauucacugcagaccugcugcuugaagucuuuggcuggcagggcccagaaggugccuuugaaaugaguggugcguuuaucuuuggagagggugccgaaucugcgugccuggguccgucuucuucccugucaccaguggaccuguguuguuacucuuugucaguguggcuugacaucccagccugguuucugcuugccuccugucaugugacaguaagagguuuuaguacguuuaagacuuccuuucccuuuggugagaaaaaaagaaagacuggggaguaagucagcuuggggcucugcuauucugaugcccagcaaugguccucgacugcugaucugccucugggacaggugcuguuacaguuugccaucagauucucugaggcuguauggccugcagccuugccuguaucuauguauucuuuauaucuucuagagauuuuuuaugggguuggggaucuccuaagaaccugcuuccugagcaagaauuuuaauguuugugugcccuguaauggagccaguccuugaauggaacguaugccucuuuuaucugcucaguuccaacacccaggcagagcaagugucugugcagggcuugcucagauuccugcugagccuccuuggguccaguauguugcagugauaggaugcagaccgaucuuccuggaggaggaggaggauauagccucaucuuuucuccuacagcagaguuuguccugcaguggauggauguuggcuuguccucagaauuccuucugguacuugucaaccuggucaaguucaacagcuguuaccuugacgaauacauugcaucaaugguucaguaaguaacaauguaacuaagggcugaagugaggcugagcaguagaguugcugcuagcauguaagagacccuggguuccacucccugccccagaagaaagaaagaacuuuaguggcucuuugauaucaguuccacggucuugggucucaagcuuagcucuuuaggauuaauaacguuagugaagcuaccagauaaaugagauugccaguggacaagugcacuuuauuuauauauuuauuuauuuauuuauuuggagacaggguuuuucuuuguaucuguggcuauccuggaacucagucuauagaccaggcuggcccugaacucacagagaucugccugccuuuaccuccugaaugcugggauuaaggugugugccaccaccaaccaccauaagcacauauuuuuauuuuuacacuuuacuuuguuauuguuuuuuuuuuccacgugcaccauggcauguguguggaggucaggggacggcuuuguggagucuguuuucuccuucccaccuuuacaugugaucugaggacaacacucacguuuuagauuuaugcagcaagcacuucaguugcaagugucucgccagcucccuuuuccuuauguuuuuccuuugugguuucuaggcagggucucacuauauagcucugacuggccuggaacucacucuguagaccaggcuggccuccaacuuaaagagaucccccugucucugcccccugaggacugggacuaaagguguguucuaccaugcccagccccuuuuugucaucauuuuuuauuguauuuuaauaauuuauucauguaccugaguauuuuucuugcauauaugucuguguaccauuauaugcccugccugcggaggccagaagguaucagauacccugguuaaagaugguugagagccacucuuuggguagugggaauugaaccugagucuccuagaagagcagauggugcucuuaaccacugagccguuucuccagcccuguguguguguguguuuuguguguguguguguguguguguguguguguguuuaaagccaucuugagaucucaguggaagcagagacuuuguuugcuuuacaccaugcacucagcgcugggcaugugguuggcacagaacaggcacacuguggacaagcacacuaugauaacugauaccauacaguggagaagcaauaaacuguagucacagagucuucuugagacgcuguuuaccugacuucaauguucuucuuccugcagcaugauuugucugcuaugcauccggacaguguccucuguggacauugaggucaguuacuccuggcuuuauuuguggaaggcugggguuugaggucaagcccugcugccauucucuggcuauguggguucuggagcugcucagcuucucugagcuguaggcauguacugucaggacaguugggugcucugcauaguguuguaauagccuaagaugggaagucgugcuuacgauggcugauggcagcuaacagccccucccagugcacgcuuacucucgcuuaccugcacugugguuccuacagguuccuaugcucaggcauagguaggaggauaagaauugggcaccagcaugaugcucuaccucucaugcagguguccuugcaagugcuggaugcuguggucugcuacaacugcuuaccagccgagagccugccucuguucauuaucacccugugccgcaccaucaaugucaaggagcugugugagccuugcuggaagguaggcuucccccaggcuguuucugcgaacuccuuccccagggcaagcucugcugccagcaccugacaggacagggcuguguuauagucagugaacgcugcuagacuuuugggaucaccagacagugaaacguugaggaaacacauccugguggccauuucccagguguuugaguugaggcccagguuugggagauguuuugagcguuugucuuaggguuuccauugcugagaagagacaccauaaccaaggcaacucuuuuuuuuuuuuuuuuuuuggcuuuuugagacaggguuucucuguguagcccugacuguccuggaacucacuuuguagaccaggcugccuuugaacuaagaaauucgccugccucugccuucaaaguacugggaucaaaggcgugcgcaaccaccacccggcuccaaggcaacucuuauaagggacaacauuuaauuggggcuggcuuauagguucagcaauucaacccguuaucauagugacaggaaguuuggcagugucuagguagauacagugcuggagaagaagccaagaauuuauaucuugaucuggcugcagucaggagaaacugccacauuggcagcuaggaguggggucucaaagcccacuccgcggugacacacuuccuuuaacaaggcuacaccuccuccaauaaggccacaccccuuaauagugccacuucccaugggcuaagcauauuacaacugccacagggcucugucgucuucuguguuuguaaggaggacgcagugaacuugggaucaagugggauugcagaacaguguccaugcaaggcaggcugaggcuagggcuccgcccuccuagagccuggggcuuauaucaccuaacccuaauggggucuguguguguguguucuguuuuccaguugaugcguaaccuucugggcacccaccugggccacagcgccaucuacaacaugugccgcaucauggaggacaggugagugcaugugugugugcaggaagacaggugagugcaugugugccaggggacaggugaguguguuaugugccaggaggacaggugaguguaugugugugugccaggaggacaggugagugcaugugugccaggggacaggugaguguguuaugugccaggaggauaggugacugcaugugugccaggggacaggugagugcaugugugccaggaggacaggugagugcaugugugugugccaggaggacaggugagugcaugugugccaggggacaggugagugcaugugugugcaggaggacaggugagugcaugugugugcaggaggacaggugagugcaugugugugcaggaggacaggugagugcaugugugugcaggaggacaggugagugcauaugugugugcaggaggacaggugaguguguguaugccaggaggauaggugaguguguaugugccaggacaggugagugcgugggugccaggugacaguggguggcuagggucaggaggagggcuuuagauacuuggcugguguugaugagauugagguuuucuugguaguuguucuccauucggauaugaccuuccaucuucugcuucuccuaguccagucaugguguucacauuuagacuuaccuucuguccuaagccucauggccauugugugggccuuucuagucugcuacagucuagacuuacggccugauguuguccguacuucacccuguagccaagccauuacaaguacugaugcuuuugucuccagagguggcucagguuugcccacugucuaguagacacccacaucagcgcuccccauuuugcgucucucugacguccaucauugccuccugagguauacuguuguagagcaaccuagugagauuucucuuucacagaccauguuagccuuuguuugagaucauaguggucuuaguccaaacagacccaguggaagucuuaggccuuagucccauaaaccucuuuugccuugucuuucuuggcauccucccuccugccaagggucuucacauauaccugucacuccugguaagauggucucacuuuuguugcauccugaguguucugugaggucccuacacgugcuuagcuaccuggcuuccuagguaguucucacuguguccauggcuucucagcugggguuucaggugcagccuuugcacuugugagauucuuuuuuuguuuguuuguuuuuucuugguuuuucgagacagguuuucucuguauagcccuggcuguccuggaacucacuuuguagaccaggcuggccuugaacucagaaaucugccugccucugccucccaagugcugcgccacuacgcccggcucaccugugagauucuuaagucugucuuccaccaggcuguuaguaccgugcugcccauggucuuguuacaugaguucugugucugaugacagccauaacccaugugaccaguagugacuggcugagcaaguugugaaggaaucacaguugcugcuggccucuuuguuccccgcccauuucaccaaccacacuucugcaccauaagugcaaggugucuccuggggacacugccagagcccagcucugccuuggguccaacucugagcgaggacucugcucacaucugucuuucuggggaacauuuucagauccuacauggaagaugccccacugcugagaggagcuguguucuuuguagggauggcacucuggggagcucaccggcucuacucucucaagaacucccccacaucugugcugccgucuuuuuaugagguaaggugcuuuguauaccacagcggauuggagaaagugggagagcuugcaucagguuugcccaccugucuggcuggggcugaugaggcugggucugagcagcuauuuccagucacuugcuuuuuaacuguggaugagagggcuuuaaagaggauuuauucucaagaaaauguuuuaucguaaaaauugcaucuccugcccaccagugcugagguacccaguguugccccuaggauagcauuccuucucucagugcuggcucccuucugucaaauagugaucguuccagcucucuggaugauguucacagcauagcuuuuguucugugguacccugugguguccagagaacuucccugugugcuuguauuuaguucucacggcucccugguaagcugaggucuucauuuuauagcagaguugcucagacaaagugccuuucaucugguuguacagucucccaaucuguagggguccugcaguucugugcaagcugugaucuuuauacauugcauugcuuacaccacaacuuagcacccaucaguuuggucugagacaguacuguacuuuuguucuggaauuuggaguuccugucuccuccuagucaggccuuuuggagguggggcccuugagccuuacauaacagauaccuuucugaguuccacacaugcuuugugggccugugugugaaaugcuacccauccaugcauuuacgcccaccucggagacaggacaggagacaggacaggagacaggaugcucucauccucuaugaggcauaacacugccccaugguacuguguuucaggcuaugaccugucccaaugagguggugucauaugagauuguucuguccauaacaagacucaucaagaaguauaggaaggagcuccaggcugugacaugggauauucugcuggacaucauugaacgacuacuucagcaacuccagguaagucaggaaugccagaaaggacuaagaucccagagaggcgggcuugucccugcugggagguguacaugcguucugugcgucugggcccuuucuuggggucugaagacuugauguggauguuuucuggugacucuuggugccaguuugucuuccacugaaggacagaauuuguuuuuccuggugugcuccauucuuuuggcucuagggauauucaguaggugagcaaggccugagcuaguuguccaaggcagaccaagugacaggacaggucaccuuccuggcuugaguaggccccagaggcaguuuacagagcaucuacacugccaucugugacuuuggaggacaguguaaguggcacagugcuagagaaaacaccagggccacaggcucucaggaaugcagggcucugugaggugaggccaguaucuggcuuagugcagccuggggcuguagaugaaaaggggacaggccaguggaaggaagacugugacugggagaagcaugcaaggguuugaagcugcaagauuuuaccuccuguuuguucaaccucuguuccuguaggaggaaaugggucauagcagugauuuccaccucucucucagauggccuagucagagaauaugagagagagagugcgcgcguauguguaugggauggugugggugucugguaggugguauguuuguaaguagcuccucucaagcuguguugaaaggguaaaggaaauuagguuauaugauguaucuugguacuguagaaccuggacagcccggaacucaagaccaucguccaugaccugcugaccacuguggaggagcuaugugaccagaacgaguuccauggcucgcaggaaagauacuaugaacugguggagagcuaugcagaccagagaccuguaaggacccuauccugguggagcuguggggaaugguucccacggagcugugguuucugauuuucaaguaaaagauggacaggcuccuguguuccuagcuuugugcuccagcaggaaagcuggcgggcaucagcucgcaggcuuguguggguuuguuaaagagcuuuguguuagccuaacagucagucucuucccaccugggugggggaauguucugggcuggcuccacagagcccagcuaucccagggggcggcagucauuuugccaggguuacucuguccacugccagacuaucacauagccuugacaggagucucucacuucuaggagacaguuguucuugcuaauuccgcacggggcugugagguagcuaaucucggagaaaacugccuuguagcagguuagcagcacuugccgaagggcaaagagcucucugaccuuagaacuguuuuccuuccacaggaauccucucucuuaaacuugauauccuacagagcccaguccauccacccugccaaggauggcuggauccagaacuugcaguuguugauggagagguucuucagguagcggagccucuauuauccccuugucuccagggcacuguuuauaguaagaucaggcuuuccuuucugagccuccaaaaucacggagugagggggaagguuggccuuuccgugggucauggccucuggcccacauggcgguggauuccaugagggugguccccgccagcuguguugggcccacagcagugugcugagggcgcugcagcgggccugcucuucccccaggaaugagugccgcagcgccgugcgcaucaagguguuggauguucuguccuucgugcugcugaucaacaggcaguucuaugaggugugcacucaggucuaaagcccaggcggggugugcucggguggggcuggcucuggguucugccugcucugggccuuguaccugcuccagccgagccaaggucugccuggggucuuaccggcuccccuuuaugcaugcuuucagcuggcuuucuuccucccuguacauuccauaguuuguuuauuuugucauguccugguggggcccuggguugggccuggaggcugaagaagcaagguagguacuuacuacacgcuccugaagcucuggccggagucccacuuggaacccaggaguuucugaacaaucuggaucaacuucagaaguccuccucucuguguuguucuggggaaggacucagguugcaugccuguugggcaggugcucugucacccuucggcacagucugguggguggugucugucucuguagucauuucuacuguccagcaucccuuaguccgauuaccagcugcagacugcccuaggccccaccagguggccuuguggugucgucucugccucugugcuuccucaagucugugguauucugguuuuggggagcacuauuagugcuugacauucuguguggccuuuuuugcaccucagacagcucuuucuccuucugcaugacuguugggccugacuucccagcuucuuuggcgccuccuucuuccccuuccagccuuucuguacugcacacugcacucugcucaucuccacuaugaucuggccccuccuccaucagggaagagcacaucuuuucaggaugguccucuggaugcucuacccucccuuaccaauugguguuuaaaugcucucuucccguuaucuucugccaguucugugaaagcgcuccuugcaauguuauaguaauuucuuugauaucagaguuuccauuugcccaacacgcacacgcacgcacacacacacgcucacguugauacauggcccuccacuuaggaggguucuuuguauauguguguguuagacauggaacccagggucucacacagacuacaggaaguauccuucacugucuagcuuuucugcaguuuuuuuuugggacaccuuaccugccucgggucugugucuugagggagucacagagucagugaaguguguccccugcccacugugggacugaauggagaccuucuccaccuuguguucgaugcaggaggagcugauuaacucgguggucaucucgcagcucucccacauucccgaggauaaggaccaucagguccgaaagcuggcuacucagcugcugguggaccuggcagaggggugccacacccaccacuucaacagucugcuggacaucauugaaaaggugagagccauuuagaggucugggcuggcauggacaaagcccuguggcuagaccucuuugucccguuuuuaucacugugacugauggcugucugcacgggcagcagaaguguguggugucagcaggccguguugagccaccuugcuuggcugguguacugccucagcaccuugcaaaugaguguccugucacucucaggggucugcgccaggcaucuggagaauagcacagagcagggauccagggcugcggcccacauccccccagggaggcugcuuuguccuuucaguuuugaacuguuugugagcagucacuugugagaaggcauaucuucccucccgagaaggacaggagggguaguccugguagucaggucuguggcgaacugccugugagccgugacuuggaccuuacaugcuggccucuuggaaggugauggcgcgcucacucucuccacccccggagcuggaagaaagggaccuggccaugcacucggccucccuggaggacgugaagaccgcgguccuggggcuccuggucauccuucaggugggugcucugcaaggguagaaggcuuguuggaagcuucucuaaagagauguguguccuggaaaccccagcucugacuggguuacagggauugggugguaccgcugaguggcaguaugaagaugugaccaagccgugagaggccugcggccugcagcaggugagccuucucugcucuaaaguuacucugcaguuacuccauccuugcugcucagagcucccucuguugccgccaguacuguuccuuagcugcugaguggagaagcugcucuugcccugcggcugcuugcuucugggagagcuuuauuaagauacuguggcacauaucauauggugcccuccauuauugucaauagccuauugacuaucaauauguccacaaggcugugcagcuguccccacaaccaauuuacuagauugguuuuucuguuuguuuguuuuacuuuuuuggggagagggccucacuauguagccuagucuggccuuugagagcuaggacuauaggaccgaaugaccauaugacacuguccaguuccagucagucagccuauaccugcugaccgcuguuccccacuuccuccaaggucccggggcugcugcucugucuguucccauggagacauugucuuguccuagcuguuucacauacauggccucgcaugugggccucugugguuggcuuucaccaagcauccacgcuauggcguguaucagagcuucguugcuuuucagaauguuccauugugugcauggcccacuugcugugguccguggcuccucccuguggcugccuuugcugggcuggauagcguugggcagaccuaggaggaauugcugagucacacuaagucuguaacaucugaggcaugucacaguuugugagcuuuucuuguaguguguucauguguguguccauacauuaguuugugugugugaggauagacacacucuugccacacugugcacuuggcaguuagggaacaaccucaggugcccguccucacugguuaccuauuugucagagacucuuguuuaccgcugacuacuauaggccaguaggccuaggagcugauagggauccuccugucucugccgccaaccuccccaugggagcacuggaguauagauaggugcuaccauguccugcuguggguggguucugcggauccaaaugcuguccuuacacuuguguaaaaaguccuuugccaccucaugcccagcccccuucuuaaagguaggacccgcccaggcuggacuggcucugaacucguggggcuccugcuuccguuuccgcgugcugcuguuagaggucugcagugcuguggucagcuugcuaggcugcugugcacucagacugcacccuuuuccacacuagccucguaugcguucuggcuuccccaucggaguauguaguuuuccauauccagaucacgucugggcuuugccauguuguuguuguuguuguuguugaaagaagcucucauuaucuuguuaaggcuauuuuaaauucacgaucuuccuccuccauuugauacacacuaugaugccuaccuccuagcauguagauuuguuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuuccuuucuuuccuuuuguauguaucgauacaggucucacuagguaguccagguuggccuggaacuuucuuuguagucaaaacugucugucuuuaggguucuaggauuacuagugugggccacuaucuuggcacaguguuuggcuuuuaguuuuaaaaaaauuguauuuauuuuaugugugugcucacgcaugcacuuaagugccguuuaggugggugucaggggacagacaacuugugggaguugguuuucuccuuucguuuuguauaucccaggaacuaaacugaggucaucgggcuugguggcacaccuuuagcuaugacgcccacucgccagcuuuguuuuugagugacagggucucuaugcuucucugggccuagaacucacucuguagaccaagcugaccucaaacucacagaaaucugccugccucugccucugccucugcaguguugggauuaagguccuguugcaguucaggcuggccuacgucuggagguccuauagcuucuaucuuacgagguuaugucaucggccaucacacccagcuggcauccaaauugucacuggcauaagcacagcgccacaguuccuggggucuuuuugggcuuucauccaaaagaguucagugcccuuucccucccugcucuguugaaaggagcacuuacucugugccacauuuucuggguagcgcaagagaaggauuucuuguccuaccuuagaagucuaguugugagaccaaguuccuggcuauaggcugaacuaugcuauauuggaggcaaagucuuggccuggucauucccugacaauagaaauggcaugguucucccugguucaaccccguggaaggguuagauucucugccaacaguagccgucugcccaucaugggugugguuuguguuagauuuggcgccucccauggucugcggcaggacuuugguggugugcuaugagacugggaaauagagucagugguacucaccuuucaccccagcgcuccggaggaaggccagagaacacagagagcgucaggccagacaggaaaacaaacaaacaaaacucacagaggugacuuuaucaguucccgcugcucacuuccaaggcucagggaccaugacagccccuguggcagcauggguccuuucuccugggucugccaggagagggcuagagcuguguugggaugguguggggcugggaggaagggugcucccaauucgcccuacccagccucucuuuguugaccuccuuagucuuggaggacugaaaucccaugcuagcacauguauguauuguggucacccuuucuggcacauggagagugggucacuacugugcagugcuagguguuucccugauuugcuaccugcuguccugcugguaagauggccacauagugagauggcuccuugacugaaagguguagagggaaauggcggcugcugcuggauagucuuuggagaacugaugcuguuuccucuggccugggccaggugccgucucucuggcugcugucauaggauugaugcacucuuucucggcagaccaagcucuacaccuugccugccagccacgccacucgaguguaugagagccucauuagucacauccagcuccauuacaagcacggcuacucccugcccauugcuagcagcauccgacuacagguaagacugccaggcgggugaccacuugggggccagcaugcugcccuaggcuugauggauguacaacggucuagagaggcaguuggcggucugggaaggguccugugcaaggcacauggcuccuucccaucugcugugucugcccugccaaggaccucugccuuuccuuggcuuacacuccuuguaccuguguggcguguuacucugaagucacacagucguccaaggucggggcaccuuggccuccaggcuuggcaacggucccagugcuucuggugcugaagagacccccaagaaccugaaagaggggcuccuuuggauguagcuaguggggagaggggaggacagggauggacagcugcugacagcuggucacccugauaccucugcugaguagaagucacuaagaaggaagcccugaggucuccaggcucaguggauaaccuguucuuuaaggaucccagccuagucagucacuguggggaagccguggggcugugagaauauuuugcuguuagaugucagcgacugucuauagcuccuggggagaaguuuccuucugugcaggacaccagcucagaggcucaggccuuguuguauauaaagugcuaagugacuaggaucuccccuccugcccuggagucaggcucguggccugacugaauggccacuguucucccugcuaggccuuugacuuccugcugcuacugcgggcugacucgcugcaucgacugggccugcccaacaaggauggggucgugagauucagcccuuacugccucugugacugcauguauguguggcaggcccucccucgggcuccagggugggcuggucacgagaugaagcuggguguugucugccuacucaggguuauuucauaggagggacuguacagaagggaugucagcggaagcuggggccaggaggggccgugucaguuuaacuuguccaguguccaucugccuccacagggaacuggauagagccucagagaagaaagccagugggccccuuucaccuccaacugggcccccuagcccugugccuaugggcccugcugugcggcucggcuaccuacccuacucccugcucuuccguguccuguugcaguguuugaagcaggugagaaguauaucagauucuugaagcaaacccaguuucucacccuuguaugagugaaguuuuacaacaggacuuaaauauguauccagauaacaguagcccuagaccagcaugcaccucauagggagggcacagguggacggacacuccugucuuaggagcaucuaccaggugagucugaagucaggccugagcaauagggaagguccagaaacaggagucagcaaagccuagaagugggugguaugguuuugugcagugagagguguuaaagaugccaggcaaaagaccagggcagugaaacugugggggcacuggagggaguagaaggcccagaguccuuggagaugcuggagcuggcagguugucuccugggaguaucuaggccuucugucacaagaguguugaugguuuucaggacugauuaagguuuggcugugggagugggcuaucucuaauggagauaugaccaggcagaagccaagagccauguccucucuguggcuguggccuuaggcugacacuggcucucugucagagaucuuggcugauggauuguugugugcucucuugcacccacagcuauggcuuagcuuucugccacagugucauuguuggagacgcuuagcugggauagaaguuguguguguguggggggcugcggggaguguuggcaggcagucacugggcccucacugggcaggugagggaugacagagcuagucugaggaagauguaaguuguacugagaagauggaggaggcacuggcucucugcugggucuccaugcagacuggccucuggaccacagccucuguuggcugucgaaggugcugcccauguccaaggcugucucugagcaguggcugcucgugcauuugagggacagaggucaaggcuccauacauaccuuguggcaaaguagcagcaauccaagccucguagcugugcagcagcacgcagcuucaaguauggauggacccuuguguuaccaaggucuagagagccccgccuccagcacgaaacccuucccuguaggagagcgacuggaaggugcugaagcuggugcucagcaggcugccggagucacugcgcuacaaaguccucaucuucaccucccccugcagugucgaccagcugucuucugcccucugcuccaugguaacgaacgcccucuguauuagucagggucucuauuccugcacaaacaucacgaccgagaagcaaguuggggaggaaaggguuuauucggcuuacacuuccauacugcuguucaucaccaaggaagucaggacuggaacucaagcaggucagaaagcaggagcugaugcagaggccauggaggaauguucuuuacuggcuugccuccccuggcuugcucagccugcucucuuauagaacccaagacuaccagcccagcgauggucccacccacaaggggccuuucccccuugaucacuaauugagaaaaugccuuagaguuggaacucauggaggcauuuccucaacugaagcuccuuucucugugauaaccccagcugugucaaguugacacaaaacuagccaguacaauugaccccuugucaacuugacacacaaacacaucacuaguaagccucaacccuuacauucuuauucauccccaagaucuaaauaacuuuaaaagucccacagucuuuccaaagucuuuuuacaauuaaaagucucuuaacugugggcuccacuaaaacaguuucuuccuucaagagggaaaauaucagggcacagucacaauccaaagcaaaagucaaucuccaaccguccagugucugggauccaacuuacgaucuucugggcuccuccaagggcuugggucacuucuccagccaugcccuuuguagcacacgcgucauccucuaggcuccagaugccuguacuccacugcugcugcugcucuugguggucaucucaugguacuggcaucuccaaaacacugcaugaccccuucaguccugggccaucaauugcaacugaggcugcacuaucaccaauggccuuccauggccucucacagugccaagccucagcugcucugcucaacuccuucaugccuucaaaaccaguaccaccugggugacccuuacacauuaccaagucuagccacagcacaagguacaacuuuggcuauaucuggaacacagccacugugcucucagaaaacacuucccagaagaugucaccucaaugaugcuggucucuucuuaaucaccgcuaauuucuuagcuccagcuaaccagcaucaauagucccaguaauguaaaguuuuugcuuuaguaguucugguaucuuguuaaucacagcugauucuucagccccagcuaaccagaacuacagaaucuucacaaucaaaauagcaauggcccugaaaagagacuuuaauuuucccucugaaauuucacaagccaggccuccaucuucugcacuguucucaacauuaucuuccaagcuccuacaaaacaucugacagagcucuuaacaacgaauggaucuucaagcccaaaguuccaaaguccuuccacagaccucuccaaaacauggucagguugucgcaggaauacccccacucugcugguaccaauuucuguauuagucagggucucuauuccugcacaaacaucacgaccgagaagcaaguuggggaggaaaggguuuauucggcuuacacuuccauacugcuguucaucaccaaggaagucaggacuggaacucaagcaggucagaaagcaggagcugaugcagaggccauggaggaauguucuuuacuggcuugccuccccuggcuugcucagccugcucucuuauagaacccaagacuaccagcccagcgauggucccacccacaaggggccuuucccccuugaucacuaauugagaaaaugccuuagaguuggaacucauggaggcauuuccucaacugaagcuccuuucucugugauaaccccagcugugucaaguugacacaaaacuagccaguacacccuccacccgcgccagcuccagugugcuacaauggcuuucuccuccauauaggcuguuccucacagauacuuauacuguuuaucugggguccuguguccuucagaauaagccuugacaccaggccaugcuccuggggcuauacugcccaaaaugcccuagggaucccacccaucccaucccagauaugagcauugguggucccuagucaaggauauugucuuaggguuccauugccaugaagagacacaguagccacagcagcucucauaaaggacaacauuucaaucggggcugccuuacaguucagagguuuaguccacuauuguggugggaagcaugcaggcagaugugaugcuggaaagcuagcuagagugccacaucuggaucugcaggccgcaggaagagauaagugagccacuaaacucaccccccaaugacucacuuccuccaguaaggccccacuuacuccaacaaggccacaccuccaguugugccauucucugucuaugggggccacuuugauucaaaccaccacagauaguuacugcuccugcauucccuagacuagagcacugugugugugugugugugugugugugugugugugugugugugugauauuguacuugggcuacauuguuacgaguugaggguuuucucacaaagaccucugccuggaaggggcuucccuagccaggacuccuggccuccuaagaguccugcgguggagcagagguuuuagggcugugucuuguauguuagcuuucagcuccaaagacccuugagcggcuccgagguaccccagaaggcuucucgagaacugaccugcacuuggcugugguucccgugcuaacagcauuaauaucuuaucacaacuauuuggacaagaccagacaggugagagaugggaagaggggcaaugggacaaaggggcucucagugagcuggcugcugggccagagugaagucaguuggcuuuguuccaugcugugggccacuaccugucagccagccagggagugugggcaucugaaacccaggcucuacagaaguugucgguucucugcaggcuccaggcuuugauaaugacccuuggcugugccuguuguccucuccucagcaggaccuccccauugagaagcaccccuugaacucuuucuguuagguuuggggaccugugaccagaccagcuuuaagaaguguggugguuggucaggaccccuggcuguuacuuccuuuaucagagccacauagugcccacuucuuguccugugcuguucucugccauccucccuguguccccuagauucugcuaugucuccaugacaaacuggugcuauugcugaggucaggagccuucucacagugcuggcagccaggagggggcugggcucaggccugucuucccugacugcggcacuacugggaacugaggcuccgugcgcaggcccagcuuaaagggaacgcccugcacauugggcugugcuccgcaguccucgcugccauuaugacuucucagcuagcucagaaggcucucugacucuacaauguuucugaggguuggcuccaggaaaguagaaauauucuaggacaauaagccccggucuguagccugaaaugccauuuuacuguugucuucauagaggauacuacccaggaggggcuugcuacaucaguuggugccugcccugaaggccaguucuuuagaaggcccagagugaugggguugugaguccaggacaucuaguuucaucauacgggcuauaggcugagguaccaucugugaagcugggcccacuuagacauugaggggcguuccacaugcucugauucuccucaagagucaucucaaagcaggcgaaaggaagggaaggaaggaaggaaggaaggaaggaaggaaggaaggaaggaaggaaggaagaaaggaaggaggggagggaagggaagggaagggaaggaaggaaggaaggaaggaaggaaggaaggaaggaaggaaggaaggagagagagagagagagagagagagagagagagagagagagagagagagagagagaaagaaagaaaagcaagcaggcaggcaggccuggggcagaacaugguauaacagagcagcuuggcccucuugggcaagggggcaggggaccuugccagcugauggcaggcagacccaguguaucuuguaucuugcuuuccucagcgugagaugguguacugccuggaacaaggccuuaucuaccgcugcgccagccagugcgugguagccuuggccaucugcaguguggagaugcccgacaucaucaucaaggcgcuuccuguccugguggugaagcucacacacauuucugccacagccagcauggccaucccgcuccuggaguuccugucuagugagugugugguucuguuacagagccugugcaugugugucugugaggcggacccuugaguauaagccuguacuggugagcacauccagugaugucuccagcccuccugacuguguacaguuuggccucccuggagaacaugggucuuaacacuucugaugccugcuuagugcuuugcuaucugcucuaggauaguccguccauuccuuuucuuucugcucauaagccugccugccauccccagccucugccccaugccuagacuggcucuuuuuuagccuucucucuccucuuagaacacauggauuuugccaauuuaaccugcuuugucccucccuuaucagaacucgcagaaguucggggcauuguacugguccccuuuccuaccucccuguguaucuggggcacacagggauguugagauacuagacagcugggucagcacuuggugggcauggccaggguggaaaggcaaugcugugagggccacaggaacuugguuuugcuuacuacccuguaaagauucuuagcauguuugcagcucaugacucacacggcugcaggucauaggcuagguuuggucugggaaccauaggucucgugucccugagauggggagcugagacccugauuucaaaggugauguuuagcuggcuguggauagccgcccugacuuuugggacuggagcacagugugcugaugucagucuguagcuguggccugggcuccccugauggcuguccuugugucacagcuuuggccaggcugccccaccucuacaggaacuuugcugcagagcaguaugccagcguguuugccaucuccuugccauacaccaaccccuccaaguaagucugcuugccugggccccccaaagccauggcccggucccagccucuugaaguauagucggcuccaagcuuaagagucucuugagaagcugggcggugucgggaggcagaggcaggcggauaucugaguucaaggccagccuggucuacagagugaguuccaggacagccagggcuacacugagaaauccugucucaaaaaacaacaacaacaaaaagucucuugagccucaugaugguuccccugaagccaagaggaagaccagaguaucugucucuccuuccaccagguucaaccaguacauugugugucuggcucaccacgucauagccaugugguucaucaggugccgacugcccuuucggaaggauuucgucccuuauaucacuaagguuaguccaagggacaugggggagugggaaacggcuggagcucugaccuaggagcuggcuauacugaacuggcuacugggcucaaccugaggugggcaugggaaaagaacugcagauuuggucucgcauggucccccucauggcuugugucucuaccccuacuccaggguuugcguuccaauguccuccugucuuuugaugauaccccugagaaggacaguuucagagcacggagcaccagucuuaaugagagacccaaaagguucgggggcugcuggggauauaccugaugucaagugggguggaacccugggcugugacaugugauuagugaccuaggccagugaacaugggacuaggaaugaaggggugucaucguacauagugacccgaggcucagaugcccugggcaggaccuaaaaggcugccggugcuucccuuuugcuagauugguuuauagucuccagcccuguggcgccugugccagcaucuuggccucucugggccaggauuacauacagggcuggcccuuacugcacuggaacacaaguaaaagauggcagcuaugccuugggccuggccagggagagcccagagacaucuccuuggucccauggucucugguuagcccagccuuuagccagagccaccucucuuccuccagagcuugcucaucagggacacgcucuucaccaucacagcugcuugugccaaaccugagagcagagcugugcuggcccucauuguuccauuugcccugccucauugcccugccgcccugcccgccccgcuuucugcgggcuaccucagcucuccuugggugggauacggcacuuuccagugcagccucuacucaagccccaugguuggggcugaagaaugucaguuugaccguccuuggccagagccuuguucucucaggggcuuugggccccucgggagcuuguguuaagaaguagccuuuguccacagugaguuccagggccuggccucaaggccucucuaugggguaagcggggcuaucuggucugccuagccuggaaucugccgugccgggcgauccacauuuaauuugcacugaugucuuuuguuuuggugucaugcgugaaaccuuacuuuuuuuucucagucgcauuuacaagcuguauuuuuaugcauuuuuguuuucuguuucucccucugcucacuguccuuuggcaugguucuguuguucaucucacccgcgggaccucuccaucuugacccuguggccugggaccuuuccuccucaccccuccaauggcuuguucucccauuccugggagcugggcucucuggggcuuggggcuuccuuccucgcccgguaguuugaggauagccagagcccccaaacaaggccugaauaacucuccaccugugaaagaauucaaagagagcugugcagccgaggccuuccggugccgcagcaucaguguaucugaacaugugguccgcagguaguggggcugugucggguggggggcacggaccuggagcuuggccccgugagcacccgggugguggugcauggggcugcaugcaugaccuccucgccugcuggcagcagcucucccugacaagagccggaggacaaccuggccccagccuagcagagccugguggcaaagggugggaagguugcauucuguccaagcccugauagcacaauuggcugcacagccuccucagagaucauccuccaagcccugacuagagcuagaguagcugcccugagaacauugggagccagugucagccccucagguugguaccacagaggagaggccacgagcuuugcagauccaaguugcuccugugcagguggcacacacacacuacccuaaguucggcaucgcauucugcagggcagauuuucuucuugggcuucauucuaagaggaacucgaggcuuuugcauagggaucugggguggaggccagccuggaggggugggggugaugcugggccccagagguagcuagcaucuuucugugaauugugucugucuagugauagggcaucuuucccucaccuuccagcccuuccuggguguggcuucagucacccugagaucuagccccgugugagugccugccuuggguuucuaccucuguauggcuucugagagcuggggacagugagugcccaguagaaccccaaucaccucuuucuuucugguagacuccuuauaaccaaaacguggcuaaagagcucagaaucaaaccuagaaaaggccuuccucugguuccugggcaugaguggaacuugaccaguuacuccaguucacucagccuguccuugcuaggagguggcccugugggcagaaugcaaucuugcucuguccuccuguggucucugaagucugcaugacuaagcugugggcugcagccauggcugacuccugugugcuuuggggagaggauguucugucuucccauucucucagcuaugcuccagacagcgggcucugcugugaggcuccugccucccuuccucucugggaugacgugguccacagggcuugugagguuguagcuccauuagccacugugaccugggccuggugggcuuucugagcaaggccaucuuggccaugcaugcauugagcuuuggcuccuggugguaggugacucggcaugguccuucccuuaguccugaccucaaaccuaggcaugguuucucccucuagcagaauacagacaucccuuacgagcgccagccuggggucugcggaugagaacucuauggcccaggcugaugacaacuugaagaaucuccacuuggagcucacagaaacaugucuggacaugauggcccgauauguguucuccaauuucacugcaguccccaagaggugugagggccuccaggacugggguggguggggcagcugucuacuuguucucuguggcugaacuggaugcccaggguggcagcugcucuggguuccugagguccugcuggccuucaggagcugagagccugcacauacaagcaggagauagacacucuuacucuuuuagguccccugugggagaguuccuccuggcaggggguaggaccaaaaccuggcugguuggaaacaagcuugucacugugacaacaagugugggaacugguacacggucgcugcugggccuggacucuggggaccugcaggguggcucggauucaaggugacugucccucccuucuggguauacugugcuccuagaaacccugggggaccaugguugacucuguauggucacuucuguccuuagcucugauccuagcacacaugugaggcagacaaaggaagcaccggccaaacuggagucccaggcugggcagcaggugucccguggggcccgggaccggguccgcuccaugucagguaagacuauacccaagccaucuccugacacgugcccauuaucccucaccuaccucucaguuugccccagugugcagaagagcugaaagacuguuggcuagcuuugugacuggccacuuccugaugacucuuggauguggucuuuguggcauaccagucuguguauagaggcaugguaacucugcucaucggggagcgaggcuccugcaguucaagagccuggaagucagcucacccagggcacucucuguugugauugaggaguugugggucagugggugagcaucggggcucuuugcugcuugguucacaggaggcccccacuccuccuccuccuccucucccuccuccuccuccucuucuuccuccuccuccucuucuuccuccucuuccuccuuucucuuucucuuccuucuuccuccuuccuuuuccuguucuuuuguuuucuuuuuuguuuguuuguuuuguuuuguuuuucuuaagacagaguuucuuuguguagccuuggcugucuuagaauuugcucuguagaccaggcuggccuugaacucacaaagauccaccugccuuugccuccccagugcugggauuaaagacaugcaccaauacugccugguuuuuuguuuuguuuuguuuuguuuuguuuuuuaacuuuuuagugacuuauuuauuuuuauuuuaugugcauugguguucucccugcaugugggucugugugagggugucaggucuccuggaacuggaauuaaauauaauuguaaauugccaugugggugcugggaauugaaccuggguccucucaaagaacauccaauguucuuaaccacugagccaucucucugaggcuaccacucuugaagggccaaacccagggccuggggcuguccuguuucagcuuuccuugggcaugggccaggugcuuccagacuggcuggacuuugugucugcucugugcuggagacuuuacugggcaaguggucaccaauucuaaacucccuuguuuuuagggggccauggccuucgaguugguguccuggauacuucagcucccuauuccccagguggcucugcuucucugggaccacagacggcgguggcagcgaagcccgagaagcccccugcaggagcccagcuuccaacagcagagaagacgaaucuggcagccuaugugccuuuguuaacccagggcugggcagaaaucuuaguccgcagacccacagguacugagagagcaggcagccuggagagugcccaguggucuucagagcauaggggcauugagacauucgcucugaggcugcucuucagaggggugguggcugaggcacuugcaaaagugccaaacagggcagcucacacuucagacauuuagucuccggguguagaagaccagaagaugagacugaaugugggcagggcagauuccuucugaguccugagccugcagguggcucgcgucucucugcccuugugcuugagcccauacccuuuauuaugugcacacaggcuuuagacagggccaacuuucauacccuuuauuaugugcacacaggcauugacagggccaacuuucauacccuuuauuaugugcacacaggcauuagacaggaccaacuuucagguagucucauuugaccuuguuaacuucuuuaccauuuccacagucauguucugagguccucucugagcuuagcauaugaauuuagcuugcagcaggggcaugccagucaccaagaggggcuuaacaaagacccuaagcccaggaauagucgugggugccguguggaugugguacaaggagaaggcucugggcgccaggcugucugaggagccccagcccugaggugugucugagccuggccugccuggccucagucuagugcugcucugaaccgacacagggugugaguggguauaggcuguuggugauagugcuaagaguggggcaugacugggagguauggccuacagcuuagguaccacccaccccaccccaccccacccccaggaaacaccagcuggcugaugagcuuggagaacccgcucagccccuucuccucagacaucaacaacaugccccugcaagagcuguccaaugcccuuauggcugcugaacguuucaaggagcaccgggacacggcccuguacaagucauugucagugccagcggcuggcaccgccaagccuccuacucucccacgcucuaauacaggugagcacagagcaugcauggguagccgagcucagaugcccagucugacugcagcaaggcuuccucuaucgaggccucucacguguaguuuucaggguguuuggggaagauacuaguguucuggucccuaaaguuuaggagcaggcucaugccugcugaagaacucucuuccuuggagacugguaccugcugccaccaucaggacgcugcugaagguuggcagugucuggauggagcucucuggagccuuugacggcacuuccaugacgggcuuggccuggggugagaaggcacugugggcagcugagcacacccugggccuggggugggaugccugagccugccugccugccugggugcucccggccugccaacccugcccagcuaggcccuuaaucacaugugaccacagauggcacuuggaggcugaggacauccauaugucagcagcuggccagcaguaaccucccaaaggcugugcaugcaguuuggagagcugggagcccugugugccggcccuggccgccgcugguccuccccucuguccucuccaggcccggggcuaugcccguccucucugcucggccuugugcagucucugccgcugacgaggcuacucgcgugguucccuugcaguggcuucuuucuccucccuguaccagcccagcugccaaggacagcugcacaggagcguuuccugggcagguauuggcgcgucccugcgaggaaaccaugugcucugccucauagaugcuguucuccucgccccccccccccaucugcucaccuuuccauggcuggcugggccucucaucgcccuuggggaguaggguccuggcugacaugaggacaucuuguguaggacaccugugcuuagcccauggggacccuuugacacguguccugagcugagcucugcuucugagcuauuguggccucuggcugauggguuggguaggucuccuuuuucccuguggguggcagcuguugggguugagccuggcccuagggcccaggugagccccuuuccuggcuacugaugaucugauuguuuugugcaucuccuuucgucauagcaguucucucauguguacuggagccaguuuuggaagggcauuguauacauggcugcuggggugugggcaguugcuaggggaggugucagucaggcugcacugacccuugauugcuucuuacacauccccugcccuggcaugcucugcccagggacuucaucccuccccucaaguaccacacuugaagcuucuguuuucagaguagguugcaagucuacauauggggacauccugucagcuucuuucugagguccaaagccagagcuggcuucaggcccugcaccccucccaugcuggagcccuguucuccuccuugccuugcuagugaugcagggguggguggagcugcugcacacuggccugcuggagguguuagagccagggcuccccaggccugcagaguucaucucagccugcuccaguggcagcgggcagaggguggacagcucugcaggcgcugcccuuccagcagggagaagcugguguucugaggucacaugagcguccgcccugcccagcacacagcaagcuucccugucuguguccucccagacucagccaugguccuugaggagggaaguccaggagagacucaggugccaguggagccccccgaauuggaggauuucgaggcggcguuagguacagacaggcacugccagcggccugacaccuacagccgggugagcaucaugggagccauagggaaagcuggggcaggcagcagcgucuaacucagaccuccuggcucuguacugacuugcugugugagcuggauaggccuuccccccaugucgcuucugcucccacccucugggucucucacccucuaucuggguggcauuuauuguggucuuuuucaguuugucagaaucgggauggcaggugcugccagaggccugaaggggaagccagaggcccuaauguuucagugccuccuaacaguguuucuuccaaauugucuuugcagucauccucagcaucuagccaggaagaaaagucccauuuggaggagcuugcugcaggggguauccccauugagcgggccaucuccucugagggggcucggccugccguggaccucuccuuccaacccucacagccuuugagcaagucuagcucuucuccggaguugcagaccuuacaggacauccuuggagaccuaggggacaagauugauauuggacggcugaguccugaggcuaagguccggucccagucagggauccuggauggggaagcagcuaccuggucagcuacgggugaagagagccguaucacagucccaccugaagguccucugccuuccaguucuccccgcucccccaguggccuccggccccgaggcuauaccaucucugauuccgcuccaucacgaaggggaaagaggguagaaagggauaacuucaagagcagagcugcggccuccagugcugagaaggugccaggcaucaacccuaggugggcacaaaucccagguugcuaccaacuccaggggauacacuuucuucuuggcuggagcucccauacacugcacgggagaacaggcagucaugaauugugucuuccuguagcuggugggagccauaaggaggguggguccuuggccguagaguuuagguccugccaucggccccgcccugaccaaugcuuucucuguagcuuuguguuccuacagcucuaccauucgcccuuuuuuggugaugaguccaauaagcccauccuauugcccaaugagguaggccggccuucucucugccacaguagggguggggucacagagggucuguccccucuuggguggagacaaucauccugaggacuggugcuauguagcugucuggguugguggcugguggcaggguagugucugcccugaacucacauagacucugugugccugcaguccuuugaacggucaguacagcugcuugaccagauuccauccuaugacacucacaagauugcuguccuguaugugggagaaggccagguaaggcccuggggucagcauaggacuacugaggcucagcaguaggucagaguucagucucugauucuuugauacuuuggaggacugggagcuuguugaguccugagccagaaacacagccaugacaggccaauggguugauaugcagagcugugagaacugcagggugcauacaugcaauagcagaguucugaggucccaggaugggccacugaaugaguguagcuaaguggcaggacagagggucaucauggacaaucucacagcccaauauauaaacaugagccauacuuuucuuaugagguagggacccuggacuacuuugagccaccguuauuaaugccggcauuuugaaaaguaucccucugcuguguagugccuugauggaguuaggugaucacuauccuagcgagaggaauaggauuggguuugguugcaaggauaugaagcagugcuaagguucuggguauguugauuuugcuagcugaauguauuacggguagagaagggagggaggccagguggcacccaggucuauagacuggacagcuguaagcaugacaguauugagugggggauggcuuuccauccgugccgagccugccaggugacucugaacuguuaacuauucucauucccuggauuuccccacagagcagcagugagcuggccauccugucaaaugagcauggcucuuacagguacacggaguuucugacaggccugggucggcuuauugagcucaaggacugccaaccagacaagguguacuuagguggacuggauguauguggcgaggauggacaguucaccuacugcuggcaugaugacaucaugcaagguguguacuccucuagguaggccugcuuccaagcccugccucuggaaaaaaaucaggaaaucuggagggauacagaggucugagccugggcccuaaaguccagcauuugguguccuguccuggcacccaguccagugucacccacucuacagcuguuuuccacauugccacccugaugcccaccaaggauguggacaagcaccgcugugacaagaaacggcaccugggcaaugacuuuguuucuaucaucuacaaugauucuggugaggacuucaaacugggcaccauuaaggugagugagauuuccaugugcgauugccuaggcaauggcugugcucugccacugccaucaccagacucagcagcagcccaggcggucuacaaaaaugccugcugauguauuuugaaguggccuugagugucuugggaggguacacuuuugggagccccaugcacugggacaggcuaucagagacacaggagacaugaucacaaaaccuuccuucauauauaggaugagcuguggcccucaagacuaacuaggugaauauguccugguggguguacagugcucaacaggaguguacugucugcuuacaguggcuuuuaaggguccuuguuggacacauuguagcacacuugggucugcacguaucacaacugagaggagaugaggcagggcucugggaagcuaguguaagggcccaugggcaguaucguccugggagaacacccucagcucuguccuuaggcacagucggaagccugcaaggcaggguguauguuuuaugcuaaacacauaaaccugcauguuuagccagagaugucaaaggcaaguggggaagcagcguggccuucagcacaugcucaugccgggugacuuuccucuccuuugggcagggccaguucaacuuuguccaugugaucaucacaccgcuggacuacaagugcaaccuauugacccugcagugcaggaaaggugaggcccaggcuggguaggguggcaguuuuggccugagcuggguaugagcauugugucuccacagacauggaaggccucguggacaccaguguggccaagauugugucugaccgcaaccuguccuuuguggcccgacagauggcccugcaugcaaaugugagugguggcggcagccuggggagauagucgugugggcgcucccuguugugauggagcucacugucaccauccugcucugucaccuccagauggccucacagguacaccacagccgauccaaccccacugacaucuaucccuccaaguggaucgcaagacuccgccacauuaagcgucuccgccagaggguagggaggacaggcuucagagaugcgaugucugagucugguugaacagaacuuccggacucacugccagagcuuucucucucucuagauccgugaagaggugcacuauuccaacccaagcuugccucugaugcacccuccagcccacaccaaagccccagcucaagccccugaggcuacacccaccuaugaaacaggccagcggaagcgccucauuuccuccguggaugacuucacagaguuugugugaggccagcagauccaugacuagaguccuguggccagccauguagcuauccugacuguacuccuacaugaaauaaacugcacacgcacaucuggcccguggaguucagagagcagcacagacagcagucagacagcuucuuuauuugacuuugucuugucuguuugggguuggggcagaauccaggcuagagcugcagaugagcccacagaagcaggcaggugccaucacauacauucucuuucccccacccgccaugggggcaagccccauuggugggcuuguccaguaacuucuuggcaucuuucaucccacaguaguccugcccuugcucagaucugaaaccagcagaucugcgugcugccuggccccagacaagggaggaaaacaaggccacgguggccccaauugcuguccagcaccugcccgaggccagacucggauccaguaauagcugcagcuuccccuguaccccugcccuggguaacaauggacccauuuucagcccaaguagaaaauacugacauacaaaaauauauacauuuuaaccccauauaaauuauugaugguggacauagaaagcagaugguagcuagagggcaaguaugcugcagaaacaagagagguaauaacuuaggggacggauaaaggagaaguguagcuuagcccucccuccagcuuagauuuuuagcaagaggagauggccaccuagggguagagcugggcgcagcccgcugaaccugaggacuuggggggagggggggcgaauaaauuagcaucuuggaggcugggu

SEQ ID NO: 8440 - RNA, 6161 nt, Mus musculus
uguaguuucgcgugcgcguugagcaaguggugggaucgcggggcugcucggaggaguaguuuacagcccaggcaugaacucaggggugcggauggugacucgcagucggagccgcgcgacuaggaucgcgucggaaggguguagggaggagcucgccccgcgagaggcugcugcagguagcucugcgccugcaggcguuuuggaggaaaggaggaacguggaacuuuggcuccaggcuugcgucccgggccgcagcaucugaccuaaacucuaggcgccgcggaguaggcagcugccuugaaucuugaauugaagcuacgcuuaaaucucacguggccccacuucuagcuucuuccaagggucugggacccgcagggucugcaggguccguaagacuggguucuggauguauucauccacccuuaucgccagugaaaaguuuuaguccaaccagccuagcuuaggacauucacuugcuccaggcuguccgugggacacagcucuguucucagagcugccucccucucuuguagggccaggcugugugccaagaacacacccagcuagaagucuucucucccagcuggacggugguucugaaagaaaacaggcccagagagaaaacaggaaagggcauggcacucauuguguuuguccuguagccauuaagggccuacuaugugccaacuagugguacucagggaguaauuaucagcccguccccgccugggacuuagacauaaguggcuagagcaggagugugcguaggcagcaauggucucccagaaucgguucaguaguagagauccgcugggauccaggcugaggcuuggcaagggccaagggccacagaaaguguugauacuguuaaggcagcaaauguuuuauaguaguagaguuuggagcucauccuaaaugcaacgauuucugaaaggggaguugcacuguccaguuugggugugaagagagagguucucuugaauguaacucaaaggacuugggacaaaggagagagguuauauuauccuagaggcuguuacuagugucggugugcuaacaggcacuuugucagacugucauguacuguugugacaagggcagagcacagcacuucuguacacaucgugguagauaauggacaguuaguugcacaaacaaguguggggauguggauuggcagguaagcagcacccuucccccacccucauauaaaacccacuccaaagacugaauggcacuuuuuugcagaaggaagaaaaagccacaggcccgugagacauccacggagaacacagaaaacgcauguggccuaugaagcggcuaauggugaggaaggcgaagaugcugagccccucaaagugcccguuugggagccccagaacuggcagcagcaacuggccaacauccgcaucaugagaagcaagaaggaugcaccuguggaccagcuaggcgccgagcacugcuaugaugcaagugccuccccgaagguaugcaacaccuccgccuauccagcaaggugcuuacuuccuuuuaggucucuaccagaaaaagagcaagaccugccagcucucccugcugccauacaggaggauacauacauacauacauacauacauacauacccaggaagaugcgcuccucccauaaccuuagaacauguacaacguacaucaccugucaaucauuguggccaccgugcauggcagagugucugagacuugaagccucaugcacagugguggugcauuugggaacauccaauaaugcaggagaagcagacucccuuacauuguguugguuccuuagacuaaccauagggcuaacuaccuucggauccugguauccugaguaucucuaacucuggcccuucuugucuauaaaaugaguaguguuacacuguaacaguagcagcuagcuauggucuaauauccaucccauacaagguaugauuccaagcaauucauccaagcuucggcuacucuauagaaguaugugacaagacagauggguaagggacuugacugggacccguccuugcacaagcaggugaggagguaccagguacuccugucgcugaugcucuccagccagaccaaagaccaggucacagcaggugcuaugcaacggcuccgggcccggggcuugacuguggagagcauccugcagaccgaugaugacacgcuaggcagacucaucuacccugugggcuucuggaggguaagcauuaccuuuggcaacagagccaagagggggcacuguucugaggaugugaggcgggcaucucugacgacagagacucuucaugcuucugacuugccacaggucuaucccauggggcuaguacccugccccugaaguuccugggaugcaccucuacacaucccuucauuucucuacccuccuacccagcugccuccacuuccuuuccuucccuuccccuccuaggcuccccagacugugucacuccacagaacccugggagguggguggaacuguggggagggcgcuuccccuuggcacugcgugggccaccgucuaucagauugguuuuaaauagcccucuccacucaggcacaggaugggaaccacccagcuguucugucgguugccugggggagucccaggcuccagccuuccuuccugaaggcccaggugcuauugagucuagguacugcuuagccucuggagggaauacugaggcagaggaccccaacugguucccacacacuagggggggggugucuaguuaugcgcuggagaccugccaggaguuccuucaggccucuuugcugccuucuucaccuccuggagaggugggacauaggcaggugaucugugacgcugggcaccuauggguccucccgauuaggcuaugccuugccccaaggcugacccacaccaucuuucagaacaagguaaaauacaucaagcagacaaccgccauccugcagcagcgcuacgaaggggacaucccugcuuccguggcugagcugguagccuugccagguguugggcccaagauggcacacuuggcuauggcuguggccugggggaccauaucaggcauaggugagucguuugcgccacaaggagggagaagucagcucugagcuugauucuucuuggguucuauugggguuccccaaaguuuuugugacucaaaccagaguagcaaaaggguauggucaguguugagcagacugacugcugggugcugaagacaagaacucaacguuggccggguuccaucugcaugcugaucucuaugagggacuugaagccagcugaugugcacacacuguggagccugacuuagggcucuggaaaaccuuucgguuuugguuuuuggggggugguauuuguuuguuuguuggguuguuuuguuuuauuuuugagacaggguuucucuguguagcccuggcuguccuggaacacacucuguagaccaggcuggccucgaacucaccgagaucugcccgccucugccucccaaguaccaggauuucaaggugugcgccaccaccacccaucgaaucugccucagcuccauaaaucccgggcuuauaaucaugcuugacugugccuaaccccaggaaaucuuucugaggucauguuucaguuuagaguuucuugugaguuagugggaccaagagguggaagugugucccagacagaaggaagagcaaccauaaagcugaguaacgacacagaaagcucuagaaugggugaggcaaauugaugucgugguggaggaagaggaagguggucuugugggaugagaaugggcagugaugucuggcauccuuuuucugaguaucaucugguagcauuugaagcaccuugguguagcuagguugaagacauacucccuggggcagugacagaggugcugccuucucagagauuugccuagaguugucggggcuccuguggucacauuaaaaaaaacaagauuuaguccugaacucucuuugggcucccaacccuuggcuccugcaugugcccaauggagggauuccgucagagguuucuaagcugguagggccuuuuagcacugcucaguggguagagggcagcuaggggcccagggcuuugacuggaagcuggugacugcuuguuggcacugaagaacagugagcauuggaagagccaggccagguaggaagugggugaggccucccgccucagucuccacuccuccccucccaaagccaccagcagccucuuaguugacacuugagcuuaucuagcugguguccucagcugccugugucccaggaguaggaagugucuuuguuggguagcucugugggggaagggcccugcagggaauuaugcaugcaguggucaggacaagggcugaguccacccacuucucuguagucuaccugcugugagagcccuaggguugccucuugaggagaaaauguguucucucaaaugaaaaagcuggaacucuggaguucugaccuuugcagcugggugaccuuaggucaaacauagggccucucugagcuugaguucaccuccagugaagugacugcccuccgaaacaccacaaaugcauaggaagcccuucuggccaacauaggagguuuauacaugugguccugcguugggccucugggguucuaaugaguaugcucgccucugugacacggagaaggaaaaggcuuccaugauauggccccucagccugcaccuccagccuuuuccccagacaguuagcaccaucagggagcuggcauggggacuagcaagcuguuugacaaaccuuugaaacagaaaggcaggcauugcaguugagcagguggcuuggcaggagcccccagugaaggcaugaggccgaaacccuacaguggccagcggaugggagcagggauuggaacacagcuggagccacccugauccugcuccccauucuguccccaguaauuucguagcagguaccagcuaccucugcaacagugacccacagggccaagcuucugccacccaguccagugcucaaagccaguggauagcuuggaaggggccguaggacccaggaagauggagcagaggaagcagagggaggcccuuuucuaauccaggccucauucuuggauuuagacuaaguucacacuuugggguuugaggcuuguuuuguuuuucccaggauagagguguuuuguuuuuguuguuuguuuguuuguuuguuuguuuguuuguuugagacagccuuacucuguagcccaagcuugccuugaauucagagcacugcuacuuaaaccuuuuaagugcugggaaggaaccgccaugccugccuuacccuucgguuguuucguuuugucuuguuuugaaacuggguuucucuguagcccuggcuguccuggaacucacuucacagaccaggcuggcuuuaaacucagagauccaccugcaagccuuuaaucucaucacuugggaggcagaggcagguggauuucuugaguuugaagcuaggcuggucuacauaguaaauucuaggaggauagucaaggccuugaagaaagacccugucucaaaaacaaacaaaaaccaggcugcuuacacgccagauugagggcucacucagacagccacugcagauacuuacuguaccuucucucaugggagggacccugggcugucaccuagccacacuugcuuaggaccggggacugggauagggacacagcccagcuggcagagugcccuuggucagccugccuugucuccaagcagcaguggacacacaugugcacagaauagccaaccgacugagguggaccaagaagaugaccaagaccccagaagagacacguaagaacuuggaagaguggcuacccagguacaguguagcuuggugagcuugggggagggagguguccugcugucauccacacugaccuuucucuuacccucacagggugcuguggagugaggucaacggacuacugguaggcuucggccaacagaucugucuuccuguccauccucgaugucaggcuugccucaacaaggcccugugcccugcugcccaggaucucuaagggccauagggcuuccucuggcuagugucugugaggugccuuuguggggcggggugguaaacuuugggggguguuugcaauaaaccugggaaguuuuucacaguugau

SEQ ID NO: 8441 - RNA, 11048 nt, Mus musculus
cagaguucaaggcaaggccuguuuaauuugagggcgcgcgugcgcuauggcuuaugaggcagacugcagugccagugagugaguuuggggagucaaggguggaggguaggagccagguaggcauaaggcaggggacaggcccaggagcccaggaucauaccugagaauggcucacacagacccacgauuccaggcccuggagcugcagaacaggauaaggggcuuguccggaggcugcccucuugagucauggaacacccauccucuggccccucagagagccuaggcucugcauuccagaacccagcaugugggagguagcacagggguagcuaggcagagaagagaggccuggccuagggaccaucccaugugagggauggggcagagggacagcuccuccaggcacagcuggcccugaggucccugacugccuguucccuggucucugcucagaaaggcgcugcugacaggguggguaagaaaggguuugcagagaaagguuguguuuuauugcaauuauuuagagugagucccaagggguugggggagggggcuccacuauuaacuagaaacauguggagcuggagaccgguuaggaaaaaaagcgaaaacaugaauuccuuucagucagcaggcccgaggcaggauggcagaggcccuuggcagaccaccacgcacagcuccucccucucucacuguuucugucuccgugucugucuuggcuggcugucuaucucugucucucucuucucuggguuucucuccucucugaucuugcuaugaccaccgcagcacccaguggacaagacaaggguucauggggucauggguugguuucuggguggugugugaccacccuccagucugcugaggcuuggggagcucuggagaggcccaagguccgagcaggaagagacccuggaaccccuggacaggcaaagagggacucagaaguugcugaagaucucucgcuuccgguuccaguccaucuguggugcccgcuuguugacccgaguagcucgagccuucuccuuggccucagcugcugugggacucagguggaggccacuuuccuggaaggggucucgcuuccagguacugccauccugggggcaggcaagguacaaacagugagccauacuggugguagccaccuuuccaaggaccuuaagccaggggccaccucaggguuuggggaacuagccccaaaggcuucuuggaggugguagcccuaccauccugguaggugucuccacagagauccacuccaaaggccucugaagccccaugugugagcaucacggcaguuaccucauuguccuucucugagccuggcaggucacuucgggaugagcacacagagccaccauugagcuaggaaaccaaggauagguugugcuuucagcauccccauccuggugcacccagaucuacacacacacacgcacacgcacacgcacgcacgcacgcacgcacgcacacacacugcugcagcuaguucuuauucaacagugagcacacuucggucacugucugggccagggcauagcuggcaccuaacagcagacgggcaaguccaaccugagaagucacgauacggggagcagcuguggagaugggaaucagcuacgugaauucaccuguugucaaagcaggauggugucccaagaagguaaagacuacucaguagucauguagggacaaggcacggaaagauggcccaggaccccaguaucugcccacacugugcaucugagcuggugcuaaccccauacaagauccacaguggcuauuuguuuuguuuugaaacagaguuucucugugcagcucuggcugcauuagaacucacucuguagaccaaccuggccuugaauucagagcucugucuguuuuugguucccaagugcugggagcacugccugcuagcacagaggguauuuuugagggaaccaggccaguugguuucacaacuguacaucuucaagggcagaggucuccagaagcagcuucuaucaugucuggggacagaaguagagguauagccagucgugguggcacaugccuuuaaucccagcacucaggaggcagaggcauucggauuucugaguucgaggccagccuggucuacaaagugaguuccaggacagccagggcuacacagagaaacccugucucaaaaaaccaaaagaagaagaagaaggaggaggaggaggaggaggaggaggaggaggaggaggaggaggaggaggaggaggaggaggagaagaagaagaagaagaagaagaagaagaagaagaagaagaagaagaagaagaagaagaagaagaagaagaagaagaagaagaagaagaagaaguaguaguaguaguagugguaguaguaguaguagagguauacggauggucacuugagcccacccucucaccugggcaggacuggucccguucgugacuggugauggcaguggaccuguggggacaguuaaguuaguggcugcacugacccuacccucugccccgaagggcaacaaccuaccuucuacauguuccucaguggguaugacccucaaccgcuugaaguguucaucagucucaggaucgacuaccagcagccgggccucguccuccugugccuugauucuggcgacaaccucggcaugucgcagccccuccacguucugcccauucaccugccgccacccacacagggucagaaaggccuaaggggcccagucggcccagugccacccagccaggugugccaucaaauauucaucgaagccaccagcagccaaagaagcaagaagagugccagcucaaguucccugugucuucccuccuccugcagggacccagggcccauacauggacauucagggacauacagauacacggggacccaggguaccucaaugagccgauccugggcacggaggccagagugagaagcaggagagccaggguccacagagcggauguacuggccaggccgggacuugucacuaugcagguugaacccguagcccugggguccccuucgcaaguggcagagccggggacgcagcucucuugggggcccauugacauccuguagacccauaagaggugacaucaggcucuacccgcagccucucugcccuuaugcucuaaggaaccaaucccagguuucaucaaugacacuaugugcccugugacugagggguuuagugagggagccaccuauuacacagcuuuagcuguggggcuagggacaaagcauguuaucaaacacggaaacaccuaaggagcuagcuccuggcagaccuguggaagaauucacagggggcacuguacauaccccagggcucuagaaggaaccggaagggauaagugccccaucagaggcuccaggaagaccguaccuuuggguuuugccuccccugucucucuucuugccccccaucucuaggguuaguacccuggaggcccgaggagcuucgucuuccucucaggccuucgagaggcucccuggcugagugacagcugucugcuuuagaauuccaacacuaacuggagccgcugcccaaaccccaugggcccagaaagcagggguggcaaauaagaaagguccagugguucccaguccuagccuaugguguuuccuaacccacaacauggaagggcccaugggacacacagggaauccccccacacacacacugacccaggcugcccuucuuuaccucuggcauccugcaguaggucucugggccagcaggcuaugcaggcagggaccagccugcugaccccccgaccccagccaggggccaagucagagauggugcugcugaauggccagcagcugccggugcccaguuacacagagccaguggccggggugggcagacagguggcagcucagguuucugggugugagugcaggugacagugugcuagcagggggcauuuccucaccuuccacuacuacccuacccccucauggcuggugcugagggacucuagaaccggaaggauugauccuucccgucucagggcagaucucuaagucucaggugacuaacugucuuucccuaaagccgcauaucucuacacuccugcugccuacuaccaccccucuuacggagugugggggagaaggucccauguuuuaacccaggcuagccuuaaacucacaagucaaagugaucuuuuuguuuagcuucugagugcuggaauuauaggcauauaccaccaugcuagcuccgaucccuccaugggcggcaggaauaaguacucuguucuaugcagggccacuccuagcguuaggacucugggauacuucaaccugaauacucugucugucuugccugcguucaggacuccuuccuugaucccaaagcccagcuggcuauucaucuggacucuccuguagagcuuucgagcauagccacgucugucccaucacaccaacaauuacagauuaaguuguccccugggggcucaggcaggcaauguugccugaacucaggguuauaaggcuucaaagguccucaaaaccccacuacauagaacucucaaagacauagcugaagauacaggcuuuggggcaaggcccugagagccccucaccaucagccugggacagccagaggcuaauucacagggaagagacuggaguagagacagaagccaguccaaaacaguacaagggaaugugugaccacuccuggcacaaagucgugucccaacagacagggccacaucauguggccauagagacaagacauccaggcuuaugcucauaaacaaacaacacagacacacacagccacccacacacaugcaaacuuagauccacagcacuggcccugugaccucuucccacgaccucugaggcuuacagggcaggguuucuuggggcucccaaacgggaagcaggacuuggcacgcuacuguggccaugaaacuaggggccauuccugagagguggcuguucuggccaaccccucagccccaacccaaaacauccuccucucagcacaggcuaacgauuccuaacuagccuaaaccaucucuggccacaggcagagucccagcugacaggccuggcauaagacccucaaggacugaaagauucccccaagccugugggggagaggggaggcaagcaaguggggguagggugccccagcaaacagcgggaggggugcauugcuggaauucuuccucccagcccuagcccugagcacacuuccugccuucuucagacaggcccucuggcucccacgggcucugagacacauagccauagagcugggcaaaccccaguccccccgccacugaaccuacagccagacaaggcagauaagggggugcccugggagccaggcucugccccccaccagauaaugacucaccagccccagcagagaaaggcccccauuguuucuugggguccaucuuguaggcauaaacauccccgaguucccugcccuuccccagagauugagcuaaagcugggguccugacugcccagcucugccucaucccaucugaccugaguaagccccaguugagaguucacaggaggggcuccuggggcugaggcaggcagcaugcuaguccuggagcgagccaugagaaggggcuaggagcgcuggcagcagguggucagaguucuuggaccagcugagacugucaccccacuuaucuaccucccacuguggcccagguucccuggggauggguggggacauagggacugacucauuuuggguagcagggugguuacugaacccccuccccuguccggcgucccccccacccagcuugguuuccgucccaagaaaggaaggaaggaagcugcuggaggcccugcccugcuccaggacccagggcaguggagacagggagucaagggaggggaccuuggcuggggaacagagacaguggaugggggaagggagaagaggaacagcaggaacugggggagcccccaaagcggucaugcuaccacuuugcucagaccauucuaucccgugaacccgacaccugcagacuugugucagccauaacucaguccaccaugucccccaggaggugcagacaugguaggacccaaggguggaagggcaagguccaccacuaccucccugucccuggcacugcuagcugcugggucucuguuugggggcugucccugucaucacagcuagaaucagcuggcugcagcugcagccacccccagcccugaauggccugggacugagucaccacugacuaggccuucccacccccaaagggaggggcagacauaucaguguucucccucaucccaccuccccgucaggcaggcugggacagagaacacaagaucagggggaggaaaaggccccagccuccugugggggugcucaauggacacccacccugcaucaucagagcagaggcauacaggccucacuggucuguccagccaccaguacccacagcagcgcucaacaccacagagucaggggaacccucugcaguaccuacaccagccugaggcaggcugucucuaaaccugguuuggagaggucuuaugcgacuccccuuucucuuccaggcuaagggugucccuuggauuccucugccuccugaaguccuuguucccagguuugagcgaucuacaaugggacaagcccauuguacccccuuuuguuccucuaaaaauacacccaagggaagcccccuccuagaacuuccugcagccccuccaagccugaaauagcagagccggggaaggacccacccacagccaaggggccugggccaccccaucuccagauaaagcccuaggguggauuuuuccacaggaaggugaacugagaguuugcuucuaaaugaauggacacacgccugaggcugggaggggggguuucuuccuaagaaggagaaaggggugcuugggaaaaagggagacuccuaguccccagccagaggaaggugggccuggcaccaucuucuucccacaaaauuccuacuaagauuccugaucuuaagcagcccagccagagggcagaaucuagauuccaggcuuggcaccugccuaccugcaggccucugagggaaagaauccaacagaugcaaagcacagaccuuggcccagguuggccuuacuacuggggaugucaucucccagccuccagacaggucccacagggacuagcacaggccuaaccaguaggaaacauuugggugaggucagagguaaauguuaaggucugaaacacauccagaaauuucaaaccugacacucccucgaccuaagccaaugguucucaaaauuggaugugaggaacugcuuggcucaaguaauaauuagaagacaaaagaaacaacaaagccgggugugguggcgcaugccuuuaauccccagcacucaggaggcagaggcagguggauuucugaguucgaggccagccuggucuacaaagugaguuccaggacagccagggcuacacagagaaacacugucucaaaaaacaaaaagaaaugaaaagaaagaaaaagaaacaacaauacuagauccuccaagaaguagaauaaguagcuaccuaaaaaaaagguggaacagauucccccuuguuuuauuggggucuccuagccuggaaggauaaagacgagggaggggcuccggggaggggcucuccagccggggccaugggacaguagcacaaaggguuucugcacaggugggaagugggagugaggacaggaacuggaacccagcugagcuguaaguggguccucauaagaagcgccugcauguguguccuugccuugaccuccuuucccuaggaagccccuguguucuggaacccacccacuccacccacccccaucgcugcucggcuacagcagcggcaggaucuaacccacccaagggcuucagagcacauagauggcuuaggcuggacgcuucagacagagacauggacaaaacccaggacgacagacacccaacacggacaugcauccuuuaaagucccagcagcuccucucagagcuccuuagucccuggaaccuccagcaaaggggacaaaggcagacaaguugcugcagugcucaccagcagcauagagagcgguuacugcaguagguaaagagcccuaagaggaaauggaggcuuauagaagugaccaaaaggaagauuguuaucaaggggcagggauuguaguucugggaaaggcucauuguucccacagacacagccuaccauaccuucuggccaguguccgagccaaggcugcccgagcaugcccaguccggcuuuggcucccagggguugugggcugggggaagcccucgaugggccaucuccucagugcaggucaguugccgccggcagagcuccucaucggucuccuuguccaccacaagcagcugggucugccccuccacagccuugauccucuguaccaccuggaacgggugcgaagcagggacccggucagcagccaacaccccaggcagcacauggguagggcaucacucccggcuaggccaagacucauggacagaggggcagggguuggccugccagggguggguagcuggccugagaggccugcaggcuccaccccccacccccaguuucuagcaguucccucccucuucucccuguagcuagggcccaggcugcaaguacuucaggauucucuuguggccuugcacccagcucaggugagcacaggaagacugcuuggaacagccagaugggagaguccaaaucuguucaguugagcuucaggauuucaaucuggucuaugcaugugugcaggcuuaucucucucucucucucucucucucucuguguguguguguguguguguguguguguguguguguguguguguguguguguguguauuuuaaagucuguucuuugguccagggguaggagagagcaaugucuuuguuggccccagugugaguauuugggcuuauuucuuucuuggagaugcagugugaaucuaaugcccaacaaguucuagaaccucaauuugccuccagaucaggacuagaaacccaucccugcuggaccugcaaagaggugaagacaauucuaaggugcucacauccaucagguacagcagcagagcagauguggcuuuacagccaucugugugucuaucugccugggugucugugaggugugggacaccguggaccgugcaagauccacuccuacagccugggagugaagagauggcuucucuagcacaugccaccacagauaagaaggcccuaccugggcccaucucuaccuggccccucagugcucauccucucuccccauaaccaacagagcagagggaugccagcucucugaugcuucugccaugggagccaagccagucaccacagucgcuaccagcagaaugggggucgugguuuuggcuccuaucucucugagcaguaggaguuuaauguggcucuaggugaaggucuuuagagaccugggauaaacagguacauuucagcgacugcaagaggcauaugacaucaacucugccagucucucccuugcuuuuuaagccaaccacugggcuucacucccaaacucuucagcacacaaccaaauccaggggucacuguagucuaccuacuggucgcuggggagauagaaguucaacucaguccagcaaggaaccacugcuuucuccaggccucaggacuaaccacucccauaggucauggacuuagugguacuaggguuccagaacagaaaagguggagggaggcugaaguguaaccauggucuuaacuguaucuaccccucagcgggauacagacacuccagagguagaaccugcagagagaccaguggaucaucucuccuccuuccuccugcugcagcaggcaagggcuauacagugaccucuacagggccaggcagccgcccagaaaaaggcuuuuucugagcccaaggaaucgcugcuacuagagccaacuccaccagauccagacacacaagcccaugaaaaguacacuaguguaaccagguaagcaggcgcaagcgcgugcacgcacacgcacacucacaugcacacacacacagagagagagagagagagagagagagagagagagagagagagagagagagagagagaccagcacacaugccugauguguccacacaacccuagacacacauuccagcccugacacaaguauguuuucauccacuccuggaacacuuggguaguguauucauauggaugaccccagagagaccugagagcacacacacauaacucacacacugacagaaaagcaucuauaccacaaggccacaaggugccuuagccaccuccucccccuccauggcacacggaggccaaaacuagcagaagcagccagggcccuggccagaguagccgcagugcggccccucccuaccaggauguccucccucccccgcuugugcaggacugagcuuccucaccaggaggccagcuggcgggccacgucccacaccucgacacccaaacagcaggcccccaugggaccccugcagggucccaccauacggcacgcagaaggguggucguaggcaucuuggccagcgcuguagggacgcgccccuaggagggaaccggggggcggggcgcagcgcagggacccaccuggugaugcgucucgcccucuacguugacgccguugaccucaaccaggcgguccccggcgcgcagcgcggccgccucggcuggggagccuggcuccacgcgccggaugaacuggccacggcggccuuucucgccaugcaggugaaagccguacccuugcucuccgcgcaccaggcgacacaagcggggccgcagcgauuccagcgcggccauggcacccgcugcccccuggccggccgcgacuggccacggcucacaccacccgcaggcuggagugcggaggcggcggaggcgcgggcgggagagcaggcagcggccucgguggcuccugcucagcucgcgucgccucgggcuccggcuucggcucuggcccuggccccugcuccugcug

SEQ ID NO: 8442 - RNA, 1121 nt, Mus musculus
ggcgcaggaaucagguugguuuuauugaccagaccacgaggccugacuggagcuucaagcugugcuccugccuaggucaagcaugggggcgccaucgguucuugggccugacaggaucggcaaagaugacuugcugcaggaaccauggcugggcacgaagcgucucuccgaaggcucuagaaagaacaaagcaggacucuagagacaggggcaaggcucuccauucuguccucagguugauauggaaggaacucugggaaauucuccuaacgugaugggaaacagaauggguagggggggcguaguggcccacacauguaaaaucagcaaccaggaagauagggaagcauaauaucaaaaggggggggcuggaaaacaggguauaacucaguaggcagagugcuugcuuagcauaugugacguccuggguuccauuucuaguaccacguaaaccgagugugguggugcacacuuguaauccuaucacuugguaugugggagaaggaucaggaggaguucagccugagcuacaagaaaaagggaaaaaacaaaaacaacaacaacaaaaacccaccaguacccauaggcucgcggucuuguguggucuaagaccccuggaaauucccuugccagaugccacgcccaccuccucucuuuccuacuuaccuagcagcgggcuccucugagauccaggagugaaggcuuagcgacugcuccgguuggcggacucccuccaggucccgcggacuccagggugcauggacgggaagcccugcaggugagcuccugcuucguaccucccacagcuccugcccugaggaaggaagcaggagagcgccgcgggcgaccgguccugggagccgggagagggguccagcagccccgcccagggcacggcgccacugguagggcgagcggcgcagccccaugagcagcccggaggcacgacccacugugugauagcggggacucgccacgugcuuauaccaggcgcuggcgggcagcgguagcaagagcagaagcagcagcaggggcagcaggggccgguuccugggagucccgggcccagggccccgcacuucucuguuagacgccagcgcgcucacgucaauugccccuug

SEQ ID NO: 8443 - RNA, 12339 nt, Mus musculus
cggaaggggcggguccgccgggagccaggccgcgcugugccgcgccggccaggagggggccggagcccggccauggcggcggcggcgggcgccgaggggcggcgcgcggcucuggaggcgguggcagcgccggagcggggcggcgggagcugcgugcugugcugcggugaccuggaggcuacggcgcugggccgcugcgaucacccggugugcuaccggugcucuaccaagaugcgggugcugugcgagcagcgcuacugcgccgugugccgcgaggagcugcgccaggugcgccagcggggcgcgcgacggggcgcggggagggcggacuccugauggcuuugccugcucgguguccggccgcggccuggccucacccgcucccuccggaggccggguggucggucggggcgccaugcgaucaccgggccuccuggggcugggagaagccagaggcggccgggcuggggaaggaggagcgaugucugugggaacucuaagccuggggacuuuucccuaugaccuggcugcgggaagggcaaggucaggucgagagcccuccugucugugaaucuuaauuuuuucgggaucgucacugaggaggagcagacagccagggggaaccuccagacacugucuauucuggaagcugacugcucuggaaaaaaaggguuaaacuggacauuuccagacuaguugggcuucugggccccaccggugauccuuagcuccugagacagcguuuccauuuguagaguggaggugauaccaggaccugauuccuaggugcuuggugguccacaauuuuaggaaguuuuccuccucguuacuaguucuagcuuugaggcuuccuuccagaguggugggaagaggauguuucuggcugucuagacuuggaaaucccgaagggggucagaggacuccagcaaugccagccuuugauggggaguauccagcugaaccucccuugguuugcugcccguagagaucuguuugcuuccagaauugugaaauuaccuugguugguucguggaagguuuuggcuaguggcuucugccagggaaucacccuuuccuguucuuagaagugaugcagagauagaaaugaugccaaaauuuugaguuuuuuuuuuuuuuuuucuuuucuuucugaccuuuuucuuucucguugagauagggucucacuauguaguccuggcuggccuggaacuuguuauguagaaccaguaucugccuccugauuucugagauuaaaggcagugcaccaccauaucccguauuugagacagggccuguagcucuggcaguccuggaacucauucucuagaccagacuggccuugaagucacacagauccaccugccucuaccuccugagggcuaggucauucuccaccauacccagcacacccagcuuuucuuucuugauauuuaugucaaaagacucagcuggaaucuggaacauucccuaagcaucuaugucauacuggggaagagggacuagaagaccccagacauagugugguggaaggagccuuacccuacuggaugagaucugggguuuagaaacaucucuggaagcuuuuggcugguguccuacucagggucuugcuggggcuuugcuggccagucgugcacacgcugaugggaaggucugacacggguuuugagcacacauaccuguagcuuccuucuaggaagggagacauuuuguagguccuuauguacgucguccuggccugggcucugggucucacucaggaagugagugaacauacauacauaugucagcuguagccagugucugcccucccucagucuuccugagccucacaccucuaagagcucuguggcaggggcuuuugacaugagcuguuagcuugcccuggcugggaugugguuugacacucugugccccuggcuaagccugggcguccucuuagacuuguaccaccaugcugggcagcaggagcucuuugggaaguggggugagaugguagcuguccagcucagccucaccguuuauccugauucccuccacuuguaaccuagcgccuucacccuugucccuuacugagucuuguauuacccuuugaauauguccugaauuccagaauuccacaaugacuuagucccuucaugugacuaaaaauuaggagggauguuuguuaagauguuauauaaagcuggauggggguggcacacaccuuuaaucccagcauucuguagcacaagcaggcagaucucugaguucauggccaagccuggucuacagaaugaguuuggacagaaacugccuuaaacaaaacaaauguguugaagggccaguuuccuuugcugugacaccuuguauaggcuucggguagggggcggucuggguguaguacagagacgguauacaaguuugaaacugcuggucuggugaagagccagggcaauuggacucuucagugugcagcuuaggugggcugccauguggugugaggcuccugugcugaguaguggagaggucugugcucagucuuucuuuagguacuucuuguguuccucuggacacaucucucuagagccauuuucucauccuguugcucuccaacuugcccgucucuggacgggccacacccccacccacaagcaggaagugggaggggaaugcggagggccuucccaggguuauuccaaggcccaggucggcaggcuggaccugaugaugcaauggcauuuucuguugugaaugcuugucugucaucuggucccucccacucuucuuccuuuucugagacagucucacuauguacacagacuggccuggaacucgcagggaucuaccuguuucugccuccuaagggcugggauuccuggccuuuccaaaggcucucugcuccugucccuuuugggcucccaccauaccuguuucuaacaucugugagcaccuaacauuaguguugugcauaaacauacacacagaaauauauaugcauaaaauaauaauuucuuucuuaauuuaaagauugcuugcuugcuugcuugcuugcuugauugauugauugagaugggguuucucuauguagcccuggcuguugucgaauucacucuguauaccaggguggucuuguacucagcagaaauccacuugucuuugccucugggauguugggauuaaaggugcggcugauuuauuuuucuuuuaugcauguaugcauguuuuccagaagaugauguuggauuccccuagaacuggagcugcaggugguuguaagccucuauguggguaguaugaaccaaacccagguucucggggggggggggggggggagaaggaagcacucuuuaccgcugagccaucuucccagccccuguacacuucaaugcaugauagcucaccugucuuauugagcacauguugcauguggaggugaggaguagcaaggccucuggcagacaccaucugagcgagcuuccuacccccucagucuucucuggaacuggguugcagauuccacacaguugacucagaagcaccccugccuaaccucuagguugugugcugccuagcccauccaggggcucccccagguagcccagccucauaccuagacccagccuaagcuuuugucucagaccaugagcccuuuccuaggccuccucaaugacuccuugguuuuguccccuuacaacccaggcaaauuauuggccccacacuuccauguuccuuuguccccuccuaaccucacaggaaugucuccaggaagagaggguccugcugguuagaccccugccuuacuacacuggggagccuccuggccacuuugcucuuccagcaccuaccuaggcaguccugcucucucugccugaagaggcagcuuuuucugccuaucgcuccaggcccacaaacuucagacccgacacgccuagccuucccccugcauugcccauggcuccuuuccuaagccuuguccuguacuucuuuuccgaucuugagccagccugugucuuccuucccuauucucagccugacccagguguguaugcagcuuaggccaccuccaucagacugguaggccuggggccugcuggccucuguuucuuuuuuuuuuguuuuuuuucgagacaggguuucucuguauagcccuggcuguccuggagcucacuuuguagaccaggcuggccucgaacucagaaauccgccugccucugccucugccucugccuccggagugcugggauuaaaggcuggccucugucucugcuuggcagauccucaccucacucccauucagacuuggcucaguggccccuugacacugccucuugcccugcagucagauggucguguuucuugguucucagccuccguggcauaagguaaagcagguuugguucgcccgaacacucaucccacugucuggucaccagccaggcucuauaagaaacucugcuuagcuucuggucuuacuccuugcaggaugugugcugucgcccugccucuccucugggcacagcugcccuuaaucucaggcaguuucaagagauguuuuguagguaaacaacaagccagcguguuuagggcagggaucauaagacaagaggugacacagaugaacucccuacucagcaugcccuggcacugaggcugugcccauagcccugaaguagaugaaccucuuccgugauagccugagaugcuacacagaauagacccaagugcacagcugagagagggcccuggaguuaguggcagugacgggggcgucccuggcacagcuucuuuuagggaaggaaguugauccuccgcuacgucuguuaggcuuagaugcuuuuuggcagcuucagggaguuuccucggacugcucuugugccugccuuggaggagcuaaguuggguauggcugugucuggugcuguguggcccuguagucugcuugugcucaggaguuuucaggcucugugucuuaucagcacucugcggggguucaugcuccugagucccuuguggauggaucuaggcuggagaggaaaguuuggggauggcuggaaagcauagccgggugcgagcaaagaaacagcauggaguuuuaggggcuccuguacauaauuugggauccagaaaaagaguuuccugggaagaaagcugcccuauggcggggcaguauagcccauggaaggaauccccacagggagccuuuauugguuugccuuuagugagggcgccaguagccuggugugguagcacaugcauguaauuuggauacuuuggaagcaggggcaggauuuuugcuuuuugguuuuuaagacuagguuucucauagccgggcgugguggagcacgugguggugcacucgggagguagaggcagguggauuucugaguucgaggccagccuggucuaaaaagugaguuccaggacugccagggcuauacagagaaacccugucucagaaaagagaagaagaggaagacuggguuucucuauguaguccuagcuguccuggaacuuguuacuaggcuggucucaaacucacggacacucaucuaccuggccgucugucuguuuguuuuuggguuuuuguuuuuguuuuuuuguuuuguuuuguuuuguuuucaagacagcuugucucuguauagcccuggcuguccuggaacucacucuguagaccaggcuggccucagacucagaaaucugccuggcugccugaccuuuuuaagaucgaauaaauuaaauaaagaugauguuuggguugcaguuguacuugagcuagacagagcacaaggcaggaaguucaucuuauucagccuuaccagguaggguuuguuaggccacugcugaccuguucccaccccuaacaguggugugucugaaucauggagcagccuccuuuguuggaggagcagauugugguccaugugugccauuucuaaguauaauaugucaaaguggagcuggacucucccucaguccuucauagaaccagcuuuaguuauuucauugcuuggggcccuguguguggauugugauuguaaaugggcccauuuucccuggucacuccugaguuaccucaaacucuuguauauuuugguucaaaauacccuccugggcuaagccuagaccucacuggugaccuuggugugaccuucccuaagguaggauguauuggaacugagcuagagcgagauguagggcaguagcaaagaggcagcugggcaagggcuugaguaggagagaugugagagucgcuguggaauuggcacuguaagucaccaccugaggagcuucauggagagaagagggagccuugcggggugcaggggaaggcuuggacguccagauccugucucagggcacccaagccuugcccuggacccucuaggcuccuucuucucuaggggcugaaauaucucuguggcucauaccugugaccagguccagauaccaaucuuguaggagcccuuuucuccuguggcaucauggacacaugcuaaggugguucaggacaggguagccaggaguugaugcaucugacagcuucuaggcaccauuugcuauuucuuuagcugcugucuagaacacaugcccuucagacccacaccacucugugaaaguuguucuacacugaccugcucugugcagcuuucggguguugcugugggugaauaccaggccuucaggaagcaugacugccuccugguggagagccuggauaucacaucuguucuauaguucuuguggguaacuuggaaugagaggaggccuaggcuggcuggggauccaguggcugcugccagcuuaggauuuuugagggugccucuucugccucugcuugguccccggucauuccacccaggucuugcucacugcucucugucucuucagguggucuuugggaagaaacucccugcuuuugcccugauccccauccaucagcuccaacacgagaagaaauaugacaucuauuuugcagauggaaagguguuugcauuguacaggugaggguucucagcuggaggcuguagucgccccccucacaacccggacuggggugugcauacacggugcuggugaccucuguucccucgcacgagguagggagcuccuggcucuccacugagauggcaguggaaaugaggggguuugcuguuuuagccuuuugaggggcacaagaauaugcaaacauuguuaacucagggucuguaaaaacccaggaagaauaugacuaucacggguccucuccucauggcugagggcuaagaccacagacuuggaccccauaccuugugcauacaguuguuguauuccugaguuggggccuggcauguggcucugcucuggacaacacguagagccaaccauguggguggcugugguuucuccccaggcagcugcugcagcaugagugcccacggugcccucaccugccacccuucagccucuucggggacuuggagcagcacaugcgcaagcagcaugagcucuucugcugcaaguugugccucaagcaccucaagguauccugcacuggggaacccagagacugccaggccccacagagccuuagguugcuuuaaaugggcaugggggaccuccaaguagcaauauggcuccuccagccuucagugggcucuagggcagagcugguauuaucaggguccacucauugccccuaauguuccacugcgaagucaggagguugggagccccaacucuguguccagcccuguguucucugcagaucuucaccuaugaacgcaagugguacucacgcaaggaccuggcucgacaccguaugcagggugacccugaugauacaucccaucggggacauccacucuguaaguucugugacgagcgcuaccuggacaaugacgagcugcucaagcaccugcgccgagaccacuacuucugccacuucugugacucugauggggcccaggacuacuauaggugggcggggcugggcugcugcagggagugggaccuggagguacuauaggugggcggggcugggcugcugcagggagugggaccuggagguacuauaggugggcggggcugggcugcugcagggagugccucggugauucucuccuaggacuuuucugggaguugucugguuguacaguagaugaucuggcuucugcugacucugucugccagugacuaugccuaccugcgugagcacuuccgggagaagcacuuccugugugaggagggccgcugcagcacugagcaguucacccaugccuuccgcaccgagaucgaccucaaggcucauaaaacagcuugccacagccgcagccgggccgaggcacgccagaaccggcagauugaccuucaguuuagcuuugcaccacggcacucacgccggagugagggugagcuagguggccguaggcucagccaggcuuagguacuggggccuuccuucugugaguaucugcuucccagacuucagaccuaggucccaguuagauuccuucuacccagcugagacacaggaggcacccaccuggcuaucuccucaccauuccuugcuccaagcaccugagccgagugauagcugugagcuccuugcccucccucucucacccucuccggugcuuugcauuugggcucuggaguccuuggggugcuucugugccucaggagacuacagacuaucacugaagcccauauaucccauccccaaagguggggcuuaggccccuguccuuguaccaauugggaacugauuuuuagagguuacggcugguuuggauucugcggcgucugggccuacccuuguggaucguaagcuguuggggguggagaagccucugcccuccagacaggagcgcuggccucaguguggucuggacagcaguucuuuuguccuauugguugacccgggaaagugacaggcuauguacugaccacaggagucgucaguggugaggacuacgaggagguggacagguacaaucgccagggccgagcuggccgggccagcgggcguggagcccagcagaaccgccggggaagcuggagguacaagaggugggaggauuugcauaccacugacauucuccugccgccaccucuccaugguggcagccgccagcagucaagcugggucagugggcuccagccagagcuccugggcuccugaggguggcaacaguguuugcccagcaaguagaauuuucuuucuucuuuaccacuugcuagggagaaacaacagaaucuggggggaggaauggccccgagagcagagcacaguuuugccaggaaguaccugcaaagcaugcaugugcccaggcugcaggcugagcucagacacugcccaucugaggucuuuccucaccucuacuccaucccagggaagaagaagaccgagaaguggcagcugcuauccgggccucuguggcugcucaacagcaagaggagacucagaggguugaggaccgggaggaggguagcaggcccaagaaagaggaagccgcagccagggugccugaggaaccccguggccaccggcgucugccucgggcucagggugaaggcucagguaacccagucccaccuaaugguagcuccuagucaauaucucaccuuccccaagccuuccaucacagccuuaccuggacucaucuuaugucuguaggcuccaaggaagccucagcaaaugguccuguaagccaagaagccuucccagccacaggcccaggcccagugguugcccucucaaaguaugugugggaacugggaaggggagugugguagacagggcuagaucuggccaaggccuggugaugguguaacucuaaccaguccuucccuccuuggacccaguacccucccaccacccagcccugagcucaaggaggaagacuuccccagucucugugccuccaccuccuccugcugcacagcgguuaccccaggcucuguaggcuuggcacuggcuuauccugguccucccaggggcaagaacaccuuccaggaagaggacuuuccugccuugguuuccuccgcacccaagcccagcagugccccuuccagucucaucucagcuuggaauagcggcugcagcaagaaagggaaccuacccaccccggggucccaggcugugguugguggcagccagccuccccggaaggcaggaaaggggagcagggguggcagaaaggguggcccagccccaguggaugaggaggauagcgguggccucacugugcaggggcugcggagugugcccaccacgguagcugugucuucuuugcuggcaccagccaccaaccagaguucagccaagguuggcaagaagaagaaggugggcucugagaagccuggggccacaucauccccacuguugcccccugaucauaccccaaagcccucuggggcugagcagguccuggaagccccuuugagcaaagcugaagugccaguaaccaucguugucaauggacauuccgaagggucagcccugguacggagugccccaaaggaaccuccagggcuuccaaggccccucgguccccuccccugccccauaccacaggaggacuuuccagcucucggaggcccuuguccacccaggaugccuccucccccagguaugugugccuaaugcuguggguuccuuagaaguuucggagaagugcuggagccguagugucaggcuggaagccugcacauggugggcacaagaugcccacuucuauuagagaugucuaugcugcugaguacagucuggaugcaagugccaccuugagcuuccacaguuagcuacuuuaugguacuuuguacugcuuaaggcuccccaaagugggcccacgacauagagcucuggcccugagccugcugaggcuggaugugaaugggccccagcgcuuacuggggcuggacaugcagaauaacagggcuaguugggaucacacugaagcucuuaugucacccugcaggcuucagcaccgugguacucuugaagggcacaccaccuccacccccacccccacccggccuggugccucccaucagcaagccacccccuggcuucucuagucuucugcccagcucccacucagccugugcuccuagucccaccaccacaaccaccaccaccaccaccacgaaaacguaaguggggugagccacugggagccggugggagggugcagccuaagccacccuaaaggcucaagccuccaucugaccucagacccgggcuagcacccacaccacaagccuacuuaguuccugagaauuuccgggagagaaaccugcagcuuauccagucuaucaaggacuuucugcaaagcgaugaggccugcuucagcaaguuuaaaagccauucgggggaguucagacaggugaggggggaguggguaggaggcuggccucccuugcccagggugaaaaugacugccuaugcuucucuggguggcaggggaugaucucugcggcucaguacuacaagagcugcagggaccugcuuggagagagcuuccagaagaucuucagugagcugcuggcgcuccugccagacacagccaaacagcaggagcugcugucugcacacacagacuucugcagucgugagaagccucccaacuccagaucuaagaggaacaagaagaauguguggcagaccagcacccaacaguugggccuggacugcugugugugccccaccugccagcagguacuggcacacggugacgucagcagccaccaggcacugcacgcugcccgggacgaugacuuccccucccuucaagccauugccaggaucauuacguagcugcugcuggugagggcaggagcugucacacccuagcgccuccuuucuccuuccucccucuucccagcugcuuggcccugguagggcccugggaaggccgaaggccaggccuccugguuagccaggccugccagguggacaucaggaaaggucuacccugugcaccgucacucauaaguucugucccaugcuuggcugagggucagucuugguuugugaucuugugauuuuggaaugugccaggggagggaaaggcuaggaugcugggaccugagcuagaggccucaguggccugaagagaguucucgugaggcaaguccauagccccagagcugacagcuucggguccacuggugcuggagucagaugucaaguguguuguguaaacaauuggcuguuucauagagaauguuccagauuaaaaacagacacaaaauugugcuacuugaaguucaaucuuuuuacaagacaaguuaaaucuaagaucucaaauugccucugacauuuuauaaaagacaguuuaucuucaaauaaauuuauuuugcaguacugcacauagcug

SEQ ID NO: 8444 - RNA, 12339 nt, Mus musculus
cagcuaugugcaguacugcaaaauaaauuuauuugaagauaaacugucuuuuauaaaaugucagaggcaauuugagaucuuagauuuaacuugucuuguaaaaagauugaacuucaaguagcacaauuuugugucuguuuuuaaucuggaacauucucuaugaaacagccaauuguuuacacaacacacuugacaucugacuccagcaccaguggacccgaagcugucagcucuggggcuauggacuugccucacgagaacucucuucaggccacugaggccucuagcucaggucccagcauccuagccuuucccuccccuggcacauuccaaaaucacaagaucacaaaccaagacugacccucagccaagcaugggacagaacuuaugagugacggugcacaggguagaccuuuccugauguccaccuggcaggccuggcuaaccaggaggccuggccuucggccuucccagggcccuaccagggccaagcagcugggaagagggaggaaggagaaaggaggcgcuagggugugacagcuccugcccucaccagcagcagcuacguaaugauccuggcaauggcuugaagggaggggaagucaucgucccgggcagcgugcagugccugguggcugcugacgucaccgugugccaguaccugcuggcagguggggcacacacagcaguccaggcccaacuguugggugcuggucugccacacauucuucuuguuccucuuagaucuggaguugggaggcuucucacgacugcagaagucugugugugcagacagcagcuccugcuguuuggcugugucuggcaggagcgccagcagcucacugaagaucuucuggaagcucucuccaagcaggucccugcagcucuuguaguacugagccgcagagaucauccccugccacccagagaagcauaggcagucauuuucacccugggcaagggaggccagccuccuacccacuccccccucaccugucugaacucccccgaauggcuuuuaaacuugcugaagcaggccucaucgcuuugcagaaaguccuugauagacuggauaagcugcagguuucucucccggaaauucucaggaacuaaguaggcuuguggugugggugcuagcccgggucugaggucagauggaggcuugagccuuuaggguggcuuaggcugcacccucccaccggcucccaguggcucaccccacuuacguuuucguggugguggugguggugguugugguggugggacuaggagcacaggcugagugggagcugggcagaagacuagagaagccaggggguggcuugcugaugggaggcaccaggccggguggggguggggguggagguggugugcccuucaagaguaccacggugcugaagccugcagggugacauaagagcuucagugugaucccaacuagcccuguuauucugcauguccagccccaguaagcgcuggggcccauucacauccagccucagcaggcucagggccagagcucuaugucgugggcccacuuuggggagccuuaagcaguacaaaguaccauaaaguagcuaacuguggaagcucaagguggcacuugcauccagacuguacucagcagcauagacaucucuaauagaagugggcaucuugugcccaccaugugcaggcuuccagccugacacuacggcuccagcacuucuccgaaacuucuaaggaacccacagcauuaggcacacauaccugggggaggaggcauccuggguggacaagggccuccgagagcuggaaaguccuccugugguauggggcaggggaggggaccgaggggccuuggaagcccuggagguuccuuuggggcacuccguaccagggcugacccuucggaauguccauugacaacgaugguuacuggcacuucagcuuugcucaaaggggcuuccaggaccugcucagccccagagggcuuugggguaugaucagggggcaacaguggggaugauguggccccaggcuucucagagcccaccuucuucuucuugccaaccuuggcugaacucugguugguggcuggugccagcaaagaagacacagcuaccguggugggcacacuccgcagccccugcacagugaggccaccgcuauccuccucauccacuggggcugggccacccuuucugccaccccugcuccccuuuccugccuuccggggaggcuggcugccaccaaccacagccugggaccccgggguggguagguucccuuucuugcugcagccgcuauuccaagcugagaugagacuggaaggggcacugcugggcuugggugcggaggaaaccaaggcaggaaaguccucuuccuggaagguguucuugccccugggaggaccaggauaagccagugccaagccuacagagccugggguaaccgcugugcagcaggaggagguggaggcacagagacuggggaagucuuccuccuugagcucagggcuggguggugggaggguacuggguccaaggagggaaggacugguuagaguuacaccaucaccaggccuuggccagaucuagcccugucuaccacacuccccuucccaguucccacacauacuuugagagggcaaccacugggccugggccuguggcugggaaggcuucuuggcuuacaggaccauuugcugaggcuuccuuggagccuacagacauaagaugaguccagguaaggcugugauggaaggcuuggggaaggugagauauugacuaggagcuaccauuaggugggacuggguuaccugagccuucacccugagcccgaggcagacgccgguggccacgggguuccucaggcacccuggcugcggcuuccucuuucuugggccugcuacccuccucccgguccucaacccucugagucuccucuugcuguugagcagccacagaggcccggauagcagcugccacuucucggucuucuucuucccugggauggaguagaggugaggaaagaccucagaugggcagugucugagcucagccugcagccugggcacaugcaugcuuugcagguacuuccuggcaaaacugugcucugcucucggggccauuccuccccccagauucuguuguuucucccuagcaagugguaaagaagaaagaaaauucuacuugcugggcaaacacuguugccacccucaggagcccaggagcucuggcuggagcccacugacccagcuugacugcuggcggcugccaccauggagagguggcggcaggagaaugucagugguaugcaaauccucccaccucuuguaccuccagcuuccccggcgguucugcugggcuccacgcccgcuggcccggccagcucggcccuggcgauuguaccuguccaccuccucguaguccucaccacugacgacuccuguggucaguacauagccugucacuuucccgggucaaccaauaggacaaaagaacugcuguccagaccacacugaggccagcgcuccugucuggagggcagaggcuucuccacccccaacagcuuacgauccacaaggguaggcccagacgccgcagaauccaaaccagccguaaccucuaaaaaucaguucccaauugguacaaggacaggggccuaagccccaccuuuggggaugggauauaugggcuucagugauagucuguagucuccugaggcacagaagcaccccaaggacuccagagcccaaaugcaaagcaccggagagggugagagagggagggcaaggagcucacagcuaucacucggcucaggugcuuggagcaaggaauggugaggagauagccaggugggugccuccugugucucagcuggguagaaggaaucuaacugggaccuaggucugaagucugggaagcagauacucacagaaggaaggccccaguaccuaagccuggcugagccuacggccaccuagcucacccucacuccggcgugagugccguggugcaaagcuaaacugaaggucaaucugccgguucuggcgugccucggcccggcugcggcuguggcaagcuguuuuaugagccuugaggucgaucucggugcggaaggcaugggugaacugcucagugcugcagcggcccuccucacacaggaagugcuucucccggaagugcucacgcagguaggcauagucacuggcagacagagucagcagaagccagaucaucuacuguacaaccagacaacucccagaaaaguccuaggagagaaucaccgaggcacucccugcagcagcccagccccgcccaccuauaguaccuccaggucccacucccugcagcagcccagccccgcccaccuauaguaccuccaggucccacucccugcagcagcccagccccgcccaccuauaguaguccugggccccaucagagucacagaaguggcagaaguaguggucucggcgcaggugcuugagcagcucgucauuguccagguagcgcucgucacagaacuuacagaguggauguccccgaugggauguaucaucagggucacccugcauacggugucgagccagguccuugcgugaguaccacuugcguucauaggugaagaucugcagagaacacagggcuggacacagaguuggggcucccaaccuccugacuucgcaguggaacauuaggggcaaugaguggacccugauaauaccagcucugcccuagagcccacugaaggcuggaggagccauauugcuacuuggaggucccccaugcccauuuaaagcaaccuaaggcucuguggggccuggcagucucuggguuccccagugcaggauaccuugaggugcuugaggcacaacuugcagcagaagagcucaugcugcuugcgcaugugcugcuccaaguccccgaagaggcugaaggguggcaggugagggcaccgugggcacucaugcugcagcagcugccuggggagaaaccacagccacccacaugguuggcucuacguguuguccagagcagagccacaugccaggccccaacucaggaauacaacaacuguaugcacaagguaugggguccaagucuguggucuuagcccucagccaugaggagaggacccgugauagucauauucuuccuggguuuuuacagacccugaguuaacaauguuugcauauucuugugccccucaaaaggcuaaaacagcaaacccccucauuuccacugccaucucaguggagagccaggagcucccuaccucgugcgagggaacagaggucaccagcaccguguaugcacaccccaguccggguugugaggggggcgacuacagccuccagcugagaacccucaccuguacaaugcaaacaccuuuccaucugcaaaauagaugucauauuucuucucguguuggagcugauggauggggaucagggcaaaagcagggaguuucuucccaaagaccaccugaagagacagagagcagugagcaagaccuggguggaaugaccggggaccaagcagaggcagaagaggcacccucaaaaauccuaagcuggcagcagccacuggauccccagccagccuaggccuccucucauuccaaguuacccacaagaacuauagaacagaugugauauccaggcucuccaccaggaggcagucaugcuuccugaaggccugguauucacccacagcaacacccgaaagcugcacagagcaggucaguguagaacaacuuucacagaguggugugggucugaagggcauguguucuagacagcagcuaaagaaauagcaaauggugccuagaagcugucagaugcaucaacuccuggcuacccuguccugaaccaccuuagcauguguccaugaugccacaggagaaaagggcuccuacaagauugguaucuggaccuggucacagguaugagccacagagauauuucagccccuagagaagaaggagccuagaggguccagggcaaggcuugggugcccugagacaggaucuggacguccaagccuuccccugcaccccgcaaggcucccucuucucuccaugaagcuccucagguggugacuuacagugccaauuccacagcgacucucacaucucuccuacucaagcccuugcccagcugccucuuugcuacugcccuacaucucgcucuagcucaguuccaauacauccuaccuuagggaaggucacaccaaggucaccagugaggucuaggcuuagcccaggaggguauuuugaaccaaaauauacaagaguuugagguaacucaggagugaccagggaaaaugggcccauuuacaaucacaauccacacacagggccccaagcaaugaaauaacuaaagcugguucuaugaaggacugagggagaguccagcuccacuuugacauauuauacuuagaaauggcacacauggaccacaaucugcuccuccaacaaaggaggcugcuccaugauucagacacaccacuguuaggggugggaacaggucagcaguggccuaacaaacccuaccugguaaggcugaauaagaugaacuuccugccuugugcucugucuagcucaaguacaacugcaacccaaacaucaucuuuauuuaauuuauucgaucuuaaaaaggucaggcagccaggcagauuucugagucugaggccagccuggucuacagagugaguuccaggacagccagggcuauacagagacaagcugucuugaaaacaaaacaaaacaaaacaaaaaaacaaaaacaaaaacccaaaaacaaacagacagacggccagguagaugaguguccgugaguuugagaccagccuaguaacaaguuccaggacagcuaggacuacauagagaaacccagucuuccucuucuucucuuuucugagacaggguuucucuguauagcccuggcaguccuggaacucacuuuuuagaccaggcuggccucgaacucagaaauccaccugccucuaccucccgagugcaccaccacgugcuccaccacgcccggcuaugagaaaccuagucuuaaaaaccaaaaagcaaaaauccugccccugcuuccaaaguauccaaauuacaugcaugugcuaccacaccaggcuacuggcgcccucacuaaaggcaaaccaauaaaggcucccuguggggauuccuuccaugggcuauacugccccgccauagggcagcuuucuucccaggaaacucuuuuucuggaucccaaauuauguacaggagccccuaaaacuccaugcuguuucuuugcucgcacccggcuaugcuuuccagccauccccaaacuuuccucuccagccuagauccauccacaagggacucaggagcaugaacccccgcagagugcugauaagacacagagccugaaaacuccugagcacaagcagacuacagggccacacagcaccagacacagccauacccaacuuagcuccuccaaggcaggcacaagagcaguccgaggaaacucccugaagcugccaaaaagcaucuaagccuaacagacguagcggaggaucaacuuccuucccuaaaagaagcugugccagggacgcccccgucacugccacuaacuccagggcccucucucagcugugcacuugggucuauucuguguagcaucucaggcuaucacggaagagguucaucuacuucagggcuaugggcacagccucagugccagggcaugcugaguagggaguucaucugugucaccucuugucuuaugaucccugcccuaaacacgcuggcuuguuguuuaccuacaaaacaucucuugaaacugccugagauuaagggcagcugugcccagaggagaggcagggcgacagcacacauccugcaaggaguaagaccagaagcuaagcagaguuucuuauagagccuggcuggugaccagacagugggaugaguguucgggcgaaccaaaccugcuuuaccuuaugccacggaggcugagaaccaagaaacacgaccaucugacugcagggcaagaggcagugucaaggggccacugagccaagucugaaugggagugaggugaggaucugccaagcagagacagaggccagccuuuaaucccagcacuccggaggcagaggcagaggcagaggcaggcggauuucugaguucgaggccagccuggucuacaaagugagcuccaggacagccagggcuauacagagaaacccugucucgaaaaaaaacaaaaaaaaaagaaacagaggccagcaggccccaggccuaccagucugauggagguggccuaagcugcauacacaccugggucaggcugagaauagggaaggaagacacaggcuggcucaagaucggaaaagaaguacaggacaaggcuuaggaaaggagccaugggcaaugcagggggaaggcuaggcgugucgggucugaaguuugugggccuggagcgauaggcagaaaaagcugccucuucaggcagagagagcaggacugccuagguaggugcuggaagagcaaaguggccaggaggcuccccaguguaguaaggcaggggucuaaccagcaggacccucucuuccuggagacauuccugugagguuaggaggggacaaaggaacauggaaguguggggccaauaauuugccuggguuguaaggggacaaaaccaaggagucauugaggaggccuaggaaagggcucauggucugagacaaaagcuuaggcugggucuagguaugaggcugggcuaccugggggagccccuggaugggcuaggcagcacacaaccuagagguuaggcaggggugcuucugagucaacuguguggaaucugcaacccaguuccagagaagacugaggggguaggaagcucgcucagauggugucugccagaggccuugcuacuccucaccuccacaugcaacaugugcucaauaagacaggugagcuaucaugcauugaaguguacaggggcugggaagauggcucagcgguaaagagugcuuccuucuccccccccccccccccccgagaaccuggguuugguucauacuacccacauagaggcuuacaaccaccugcagcuccaguucuaggggaauccaacaucaucuucuggaaaacaugcauacaugcauaaaagaaaaauaaaucagccgcaccuuuaaucccaacaucccagaggcaaagacaaguggauuucugcugaguacaagaccacccugguauacagagugaauucgacaacagccagggcuacauagagaaaccccaucucaaucaaucaaucaagcaagcaagcaagcaagcaagcaaucuuuaaauuaagaaagaaauuauuauuuuaugcauauauauuucuguguguauguuuaugcacaacacuaauguuaggugcucacagauguuagaaacagguauggugggagcccaaaagggacaggagcagagagccuuuggaaaggccaggaaucccagcccuuaggaggcagaaacagguagaucccugcgaguuccaggccagucuguguacauagugagacugucucagaaaaggaagaagagugggagggaccagaugacagacaagcauucacaacagaaaaugccauugcaucaucagguccagccugccgaccugggccuuggaauaacccugggaaggcccuccgcauuccccucccacuuccugcuuguggguggggguguggcccguccagagacgggcaaguuggagagcaacaggaugagaaaauggcucuagagagauguguccagaggaacacaagaaguaccuaaagaaagacugagcacagaccucuccacuacucagcacaggagccucacaccacauggcagcccaccuaagcugcacacugaagaguccaauugcccuggcucuucaccagaccagcaguuucaaacuuguauaccgucucuguacuacacccagaccgcccccuacccgaagccuauacaaggugucacagcaaaggaaacuggcccuucaacacauuuguuuuguuuaaggcaguuucuguccaaacucauucuguagaccaggcuuggccaugaacucagagaucugccugcuugugcuacagaaugcugggauuaaaggugugugccacccccauccagcuuuauauaacaucuuaacaaacaucccuccuaauuuuuagucacaugaagggacuaagucauuguggaauucuggaauucaggacauauucaaaggguaauacaagacucaguaagggacaagggugaaggcgcuagguuacaaguggagggaaucaggauaaacggugaggcugagcuggacagcuaccaucucaccccacuucccaaagagcuccugcugcccagcauggugguacaagucuaagaggacgcccaggcuuagccaggggcacagagugucaaaccacaucccagccagggcaagcuaacagcucaugucaaaagccccugccacagagcucuuagaggugugaggcucaggaagacugagggagggcagacacuggcuacagcugacauauguauguauguucacucacuuccugagugagacccagagcccaggccaggacgacguacauaaggaccuacaaaaugucucccuuccuagaaggaagcuacagguaugugugcucaaaacccgugucagaccuucccaucagcgugugcacgacuggccagcaaagccccagcaagacccugaguaggacaccagccaaaagcuuccagagauguuucuaaaccccagaucucauccaguaggguaaggcuccuuccaccacacuaugucuggggucuucuagucccucuuccccaguaugacauagaugcuuagggaauguuccagauuccagcugagucuuuugacauaaauaucaagaaagaaaagcugggugugcuggguaugguggagaaugaccuagcccucaggagguagaggcagguggaucugugugacuucaaggccagucuggucuagagaaugaguuccaggacugccagagcuacaggcccugucucaaauacgggauaugguggugcacugccuuuaaucucagaaaucaggaggcagauacugguucuacauaacaaguuccaggccagccaggacuacauagugagacccuaucucaacgagaaagaaaaaggucagaaagaaaagaaaaaaaaaaaaaaaaacucaaaauuuuggcaucauuucuaucucugcaucacuucuaagaacaggaaagggugauucccuggcagaagccacuagccaaaaccuuccacgaaccaaccaagguaauuucacaauucuggaagcaaacagaucucuacgggcagcaaaccaagggagguucagcuggauacuccccaucaaaggcuggcauugcuggaguccucugacccccuucgggauuuccaagucuagacagccagaaacauccucuucccaccacucuggaaggaagccucaaagcuagaacuaguaacgaggaggaaaacuuccuaaaauuguggaccaccaagcaccuaggaaucagguccugguaucaccuccacucuacaaauggaaacgcugucucaggagcuaaggaucaccgguggggcccagaagcccaacuagucuggaaauguccaguuuaacccuuuuuuuccagagcagucagcuuccagaauagacagugucuggagguucccccuggcugucugcuccuccucagugacgaucccgaaaaaauuaagauucacagacaggagggcucucgaccugaccuugcccuucccgcagccaggucauagggaaaaguccccaggcuuagaguucccacagacaucgcuccuccuuccccagcccggccgccucuggcuucucccagccccaggaggcccggugaucgcauggcgccccgaccgaccacccggccuccggagggagcgggugaggccaggccgcggccggacaccgagcaggcaaagccaucaggaguccgcccuccccgcgccccgucgcgcgccccgcuggcgcaccuggcgcagcuccucgcggcacacggcgcaguagcgcugcucgcacagcacccgcaucuugguagagcaccgguagcacaccgggugaucgcagcggcccagcgccguagccuccaggucaccgcagcacagcacgcagcucccgccgccccgcuccggcgcugccaccgccuccagagccgcgcgccgccccucggcgcccgccgccgccgccauggccgggcuccggcccccuccuggccggcgcggcacagcgcggccuggcucccggcggacccgccccuuccg

SEQ ID NO: 8445 - RNA, 4867 nt, Mus musculus
cgucgcagccgacgcgcgcucccgggaggcggcggcagaggcagcauccacagcaucagcagccucagcuucauccccgggcggucuccggcggggaaggccggugggacaaacggacagaaggcaaagugcccgcaauggagggagcauccuuuggcgcgggccgugcgggagcugccuuugaucccgugagcuuugcgcggcggccccagacccuguugcgggucguguccugggugaguggucccuaagcuggccccuucccugucccccgccucucuuagcaucccuuauccuccacccucacccacccccugcccaucgccccucacccuccucuccgccggucccuccccccaccccccgcccgcagguuggggugacgucacauggcuaggcgcgcccaccugcgggcgggggaagggacggcggcuguuaccaauagaccuugagaggucaccacuggucucccccugcccucaauuccucuuaaggucuaauacaguccccuuccuaggucuuuucauuuuuccgguucccacgaccuggaaguaggcacagaguugcggauguaauucucccaguauaucagggacuuaauuccacauggaagaggggguauaggagccaaggagaaugcgcaguuucuucccuuugccugauaacauccgccaggcucauuuggagggagcgguucuuccuagaucccucaggucuagcugugaguuaaaggagcauaaggaggcucccugcugcuguagcuagaaggggcucaucugggagggcuuccuggaaauggcauggaagcuagagacggggaguaaucuaucucauuagcgaaugucuucccuguccuaggcauuuaggagaugggugcuaaguucuggauuuuggauuuuguccaucugggaguccucuaaucuccaugccugucuugaaagagggcgguucccaggguggagccccacccccaccccccaagaccucguggacugaaggaagaacagucucugguccugacuuguggauugcuuucaagaaacaugagcaugcuguggcguuuuucaugacuacauuaucaaggaguuuaguugagaauuguggaaugauaggaguugagauguuucuuagaaauguccuagacgucugcacuaaaaugacugugguuugcuucuguccugccuuggagaacuaguuggugggcagaggguccugagguuggcucaaaccuuagagccucaaugcucuugacugauauuaugauaacugacuacucacgggaaucuauucugaaaugcccacuauugcugguggacauucuuggacccagcauuccaaacuaggcuccuugacaccaugugggacacugaggagcacacacacacacagguccugugugcagaggucagguucgaaaagggaaaggcuuguauauuucucuagacagcugucccgugacuucacucuccacagugcacuggcccaccacaacccuggaaaucacugauguaggugaaggcuccugcuuccacgcuuccaguaaacucugggaggccauaagguucuaagaccggaggagugacugcccugagaaguacagugugaacccuuuauacucccuuauaaaggggauaagaguggcaccucugauauuuuugauuuagaucaccuguaacuaagcuacagucugcagcugccaugugggugcugagaagugaacacagguccucuuaaccgcagagccauaugucagcccuguauuagagccucaaguagccaaggcugucuuccucugauccuucuuacuccaccucccgaucaauuguugagauuacaggcaugcaccuccuugcaaacguaaauguaaauaucaguuuuuguuuugguuuguuuuuucgaggcaggguuucucuguauagcccuggcuguccuggaacucacacuguagaccaggcuggccucgaacucaaaaauccgcuugccucugccucccgagugcugggauaaaaggcgcaccaccacugcccggcauaaguagcaguuuuaauuacuccuuaaaugcuucuuuauuuucaauaauugugcaguacacgagggagugagaaauggguucggugcugcagaggaacucuggggcagguauggagaccugaacucuugacagggggaacagaugccucaagcaguggcgugaggcucugcuugcugcucugcagguguuuucuauugcgguguucggaccgauugucaacgagggcuacgugaacuccgacagugguccagaacugcgcugcgucuucaacggaaaugcgggagccugccgcuucggcgucguacuaggucuaggggccuucaucgccugcguggccuucuugcugcuggacgugcgcuuucagcagaucagcagcguccgagaccgucgccgggcugugcuacuggaccugggcuucucaggugggcggggccagcggugaaaggcggggccuaauguagggugcggugcuggugcgggaccugaugccugagcgaggggggcgugggugcccucagaggagagacagagccugauucuuuugggaaaaccguaggaucuuuguggggacgugacugggccccuaaggaacaggacuaggcgcggggacugccgcagagcuucuuccggggcuguggcaggcugagaaauacuccucaggguuuugagccgggaggacccaaccacaagagggugugaucuagagauacaggguggaagucuugaguugaaagcaccgagucaaaagaaaaaaaaaaaaaaagccgggcgugguggugcacgccuuuaaucccagcacuugggcggcagaggcagguggauuucugaguucgaggccagcuuggucuacaaagugaguuccaggacagccaaggcuacagagagaaacccugucucaaaaaaacaaaaaaaaaaaaaagaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagaaagcacagaaucucuuuagggcacgccaggacuagagaaagagguggcugaugggcggaguaaggcugggcuucgaagggggcggggcuuuggaggucaugugaauggcaauuugcuggugaaccuaagggacauugcacuuucucugaaugcgcgagguggguccuguuggcggagcacuaucugaucaucagcucccaccugcaggggucugguccuuccugugguucguaggcuucuguuuccucaccaaucaguggcaacgaacaacgccagggccaggcaccgcgcaggcuggagaugcggcgcgugcugccaucgcuuucagcuucuucuccauccucagcugggugagugagggacccguggguggcaggguugggggugucuccagguuuuccccagcugacccugauucccucacccagguggcgcucaccgugaaggcccugcagcgguuccgccuaggcaccgauaugucucucuuugccacagaucagcuagguacuggggcugcccaggccuacccaggcuacccagugggcagugguguggaggguacagaaacauaccagagcccgcccuucacugagacccuggacaccagcuccaaaggguaccaggugccugccuauuaguagguguuaggcuccggccagggcuggaaggccaccucaccaccguaggccucaaggccuccugagaccuuuucuggguccuaccgugccaaggacagagaagguggccacuaugggccucugggaccaaggggaguagccucccuggugccuggacuguccccacaaaguuccccccuagccagagaucucagucuuaaggcccugagaagaaaacuacuucuuggaguggacuggccugggaggcauuccuuuuaugggccagccaaccagggacucaccuguccacucuaggucagaaguccagcugccucccagcucagggugcaagggcucuggggaccagggagagggagacuaauuguacccuuagguggggauuauggcccuuguucccagucccaugucccuggcuccacauggugguccacccuguccagaggcucccuccccuccucuuacaggaucccuagagcagcucagcccugucggugucgugauugugauuaagucuucaggucucaucucauagugcccccauaagccgccccucucuguguggcuccugcccagguguuucuggccaggaagguauagacaacuaugggccugggcacccgcccuucaguaagaccuucccuagggaacagacagcuggguaccugggugccaggcaagacaagacucuuacaaggagaggacuaaaggucucaucugcccagggugucacuggagagucguuccuguaaauggcuuaaccuuggcuuccugaaccagucccucccuagucuaucuucuauccccuuuuaaggcccagaccagguguggguccuugugcauagcagacuacucauacauugcuugaagcuggcuuuucacaucaagucaaaaccaaacucguugccaugucucauucuuccagacaaaaugccucccuguggaguugcaguugaaugacaacccuguacguuguagcauagaccaaucauguggauauuuaagugaacauguuuacaauuuuuguauauauggaucuauuccuuuuccucugaaagaacaauccaugauuguguauuuucaguguccccuguuacaacugcaacuucuuuacaauaaagacuguacgugcauugaccaucag

SEQ ID NO: 8446 - RNA, 1475 nt, Mus musculus
aguaguagcuccugccccccccccccaaaauguucccuagcugcccuagcagccuuggccuguagacucggucugcaaguggguguuggaggaggcugagcgugagccuccucgucucucuggggcagucgccugcacgcagagaccuuucgcugaccucagcgucccgcugcugcgcaaggaagggcggggccgcuccgaccuggacagcguccgaagccaguccucuggaggccgccguaguccgggggagucgguggucacaugacccaaagcuguacuauggcuuccaccaaaccgcugucucguuucugggaguggggcaagaauaucgucugcguggggaggaacuaugcagaucacgucaaagagaugcgcagcaccgugcugagugagccugugcuuuuccugaagccguccaccgcguacgcucccgagggcucaccgguguuaaugcccgcuuacugccgcaaccuccaccacgagguggaguugggagugcuucugggcaagcguggugaagcgaucccggaggcugcagccauggacuacguggccggcuaugcccugugccuggacaugacugccagagaugugcaggaggagugcaagaagaaggggcugccguggacccuggcuaagagcuuuacguccuccugcccggucagugccuucgugcccaaggagaagauuccugacccucaugcccuaagacuguggcucaaggucaacggagagcucaggcaggagggcaaaacaucaucuaugaucuuuuccauccccuacaucaucagcuauguuucuaagauaauaaccuuggaagaaggagaucuuaucuugaccgggacuccaaagggaguugggccaauuaaagaaaacgaugagaucgaggccggcauagauggggugguuaguaugagguucaaggugaaaagaucagaauacugagaguagagugccaaaggggaagggagacagaagcaagggaaauaaaugacacuaauaaugaaaaucuaaaaauuaugcuagacaugucaaaaaagaugaauccuuaaaaaauaacgugaucuaaaagaccugggacugaaauagaaacaggaacaacgaagcuaaaggauauagaaugcuucccaagagggcaauguuaaacuaaacuuugagaaguuguaguuuucuuuucuaaaacugaacugaauagacuuuucaauaaaucauucugaagucuauaccuccagacuuaaaagugcaaaggaaguaacucauuaaugcuguuggccuuuaggaaagcuguuuguacagagcacuccaguugauuuuuacuugggaaaguccuccaccucaaagccagauaagaauuuuguuaagugagcucuugcugcagcccugccuuguuuacuuuggguguggcuucugaguuuggaagauaauuuugaaauuguuuuccaaauaaagaccauuucugugugacugaaaag

SEQ ID NO: 8447 - RNA, 5512 nt, Mus musculus
cgaagcugccauagagcccgccuucggcugccgggccaaugcagggcgggggcggggauuguuugcgucgcggccggaacggaaagugggucagcgccgggggagcuuuuuggccgcaggugagccgcgccggcccagcccggucaggcccggcggccggcggguugaccuugcaggcggucaagccggccacccguuguucccuggcgguggcgcucgggagucugggcgggggccucggagucaggcgucagggacggcaucgcuguggcgagauccgcgagccuuuggcgagggaagcaaccuucagccccgcggaggccgagcguggcuacguccagggacaucucugguucauucauuggguuccuacuguguguucuuauacggcgcucagccaacccaacugcuguggagugcugugcgcggccccgcccggcuucuuuguggauggccggggcgagguaggguaguacagugggucuacagggggacaggaggcagcuaggacagagucgacuauuagacaaagacaguccacucgggagaggagauccggaccucucaaagccuuucauuuugucccaagaacgaugucaagccagugaguuuaagguuguaucaaagacugaguuuguagugugcagagccggaugggugagagggaguuguguggugcaggaagcggugggggucuccaauggcaaggaggggugucaggaguggaugacagcgguguuucuggcaugaggaacuggaugcuguggaugccauuugccaaaguggaccgcggaggaggagcaaguuaagugucaaaugccugaggggcaacagcuccugaacagaaugcagagaugggcugggacacauccaaagucaugggugucuggguuguguuucacaccaucgcccugggcuugauugaggugcucagauacucgagccagguacgagcuugugggaguuucuggagcucagagcucaguguugagggcuuggaguccccagccuuugguggauccauggcuuaggcugccagguagaaguggcagggggcagaguugugggguguagauuugggccuuguuuggacauugauacauuacaugucuuuaaaguuacaguuauuuuuuuccagguucucuccacuauggcccggcguacacggaguagcagggcauggcauuucguccugagcgcagcccgccgagauacagaugcccgggcuguggcucuggcaggcagcucuaacuggggcuaugacucugaugggcagguaggucgaaguggcaagguggggauaaccagugucuauguugggugaaaaagacacugagccaggcagcugagcuguguccugguauguggugcuuuuuggucugguaaagccugagguaugucaggccucaagacaagagacagggaucgaaaguucuggauagugcugguuacuguacaaugcuuguucaccaggccugccaauuuuauuauugugugccacagugaaugggucaggagccuuguauguguguucuaucuuacaccuuuauuugguaucuggggagcaagcuuagguuguccgugacgugcaguagcacacauacauaugcugagccauuuggaucacccuggauguuuuugucacacaaaugcuguauuucauguguguuguauaugauaggaucugugaucuuuuuuggguuuuugagacaggguuucucuguauauaccuggcuggcuuugaacucaagagaacugcccaagugcugggaucaaaggcaugugucacuaucccugcugguuuuauuuucagaaauggucucacacuguaacacaggcaggccuuggacgugagacaguuuauugugugugggcacacguguagaggucaggagucgcuggagucaguucucuaccaugugauacccuuagggucaucagugcaugauuuuucuuuauaauauuuauaguucuugaaguucaaauguccuaagacuuccuuuguuggagucucugagcacaagguagauacccagcccagugugccugacuuggcuccugggaguagguggcuacugacuugcugguaccagacugguguucuggcucugcccuguacugccucuacucugauguuacagcucucugaagccggguuaggguuacaguuaggcucccuucuagaagcccauuggaucaccagauuauaaggaaaacuugauuuacuuacuaggucagcagugccccaggcccuucuugggggcuuuugagcuugagucagcccaaauuuucagcuacaccuccaguuccuaaugaugcaccugaaacagccucagucaucacagugacacacgcaugccuguugucugucauguggcagguagcuguggguguuccugggccuggguuggguugagcauccuccucccuuccuccuguccuaggcagauuggcuucuuacucaguggaucugccuugccucuagaagaucccaucuuugccagugggguacaaggucugcucugagguaugagccuucccuccaggcaaaggagcuggucuguuuggcuucggaguggccuuaguuaacguugacuaaccaaacuggggcuggcuccuuguggguuauacgccccuauuucagcacacaguacccagaauuggauguugguuuucagucccgacucggcugccuauugcuggacauuucuucacuucucaugauauuauacauccaccaugaugguucuccaucucuagacuuuuugaggcccuuccugaggagccagugaacuugaaaaagcaccagagaccagaaugguggacacccugaguauugugaagagaaagaauacagagugaacgugguccaagcuccucuuggugguugaaugcuuccuuguagagaagugcaggauggcuauauggcuguaaauagaucuaacuucaggguggguguuagaacugugauguggucgccauuagaggggcuccuggaccacuguguggagcacagcagggcagcucaggaaguagaggccaaaacuucagggacugucaagucagcuagccugaacccuagcaccaaaacagggauccaagggccugcagagcagcugaauagcaagaguugauuggucagucaguggcuggaacuugaccagcucagcuguguccucacccccagcuagguucugaggccugagagcaucuuuggaagaguuugcugcagcuuggagcauuaguccauuagaccuuguggagcaugcuugcuccucuugauuccagugcccuugcaggggauggagacacacaucccaugucuuagccugaguggagccagaugcuagaccuuguugacagcagcagcccugggcuuuaggagaccaugaacuacccagggaagacagguaguggaugcuguguggccuaugguagucagaccuucuggggggaaauggggcagaggaagccaaguaagaagccauuccccuagggccaccucccaucucauuggagucuuagcacucagguugauuauguugagcacuggagagcgccaggugucuggcugcuucucugguggauuugagaagggauuugucauaaacagagugaccuaccccuucccucccuuccagcacagcgacuccgacucugacccugaguacuccucccugccaccauccauccccagugcugugccugugacaggagaguccuucugugacugcgagggccagaaugaggcuaccuucugcaacagucugcacacagcacaccguggcaaggacugccgguguggugaggaggaugaggguacgugucuugccgcugggacguguggagggcugggcagguucccugggaccaggcaggcaccguuuagcuguagcccucccuaguuuaggcccucugucuuacagauuuugauugggucugggaugaccugaacaaguccucagccaccuugcugagcugugauaaucgcaaggucagcuuucacauggaguauagcuguggcacugcagccauucggggcaccaaggagcuaggggauggccaacacuucugggaaaucaagaugaccucuccaguguauggcacagacaugguaaauggccaagcaagaggguagaugccaugggcccugccgcuaggcaucuaacuguccaggcccacuauuuacagauggugggcauugggacgucggauguagaccuggacaaguaccaccacacguucugcagccugcugggcagggaugaggacagcugggggcucuccuacacugguagguguugccugggucauggguggggcuggcaguacagcagaccucccaggaucaccccauugcuccucgcagggcuccuccaccacaaaggugacaagacgagcuucucuucacgcuuuggccagggcuccauuauuggugugcacuuggacaccuggcaugggacacugacauucuucaagaacaggaagugcauaggugagguaccuuuguagagccuuuagggguggggccaggcagucugacuugaggcuccugacagaugagggagggugggcaggccugaagcagauugggguuaccaggccagaccagaguauuuucuguguucagacuauuugagcugcuuaccguggugccuuguaggaggagcuuccuggcucccaacccacauggcacucaggcuaagccuuccucccaggaguggcugcuacucggcuucaaaacagaagguucuacccgaugguuugcuccacggcugccaagagcagcaugaaagucauccgcuccugcgccagcuccacaucccugcaguaccugugcugcuaccgcuugcgccaacugcggccaaauucaggggacacccucgagggccugcccuugccaccuggccucaagcaagugcugcauaacaagcugggcuggguucugagcaugaacugcaaccacuggaaauccccugugcccccuccuggcacagcuacaccuggugccgagagucuggagaccaggcccugucagaggaagcgcugccgaagaagcugacuucuccccugggaacgcagauaccuuccucuuucucgcccuuccagggcagcaggagagggaagaacugagguccaggcuuuucccuaucucccugaggccaggacagucuucuccggugaccauggagugaaggucauucuacugccugugcugguagggaagccguacuccuauuuguccuuugaguugccacgugucuugggaacugcagcuaggcaccugugaaccuagauuccaagcccgggaggcuggccgacgaaggggagugcauucauaucccggggagaagaugggcuguccccacccacggggccguggggcuuuccugacuugcacugcauguugucagcuccugcugcagagauggcagugggugcccugugaagggguuuugucuugucccucuauguuauaucauuaaaagagccuucacaaaugcccaagcug

SEQ ID NO: 8448 - RNA, 2672 nt, Mus musculus
ugcccguaaagccuuggcugcagcucugcgcucuccugcuggacucggggcuugcgugccgaccucccuagcggggacaccuucaccgucugagucggaaaucucccagguuugaggucgccgauggccgagacgcaggccccgaccgagacgcgagaccgugacucucccgggaccaaccuccgccauaaguccuucguuccugaagcuuccggacguacccggaugcuuuuguucaggacaccggccgcuuccggaacgggagagcuccugaagcgcagauuuccuguggaguaaggacacugacauggcgcggaagaaaguaagaccccggcugaucgcugagcuggcucgccgcgugcgcgccuugcgcgagcagcggaaccagccgcgagauucgcagcucuacgcccuagacuacgagacgcugacccggccgcacuccggucgccggcugccgguacgcgccugggccgacgugcgucgcgagagccgccuccuacagcugcucgcccgccuccccuuguucggccugggccgucugguuacccgcaaguccuggcuguggcagcacgacgagccaugcuacuggcgccucacgcgugugaggcccgacuacacggcgcaggugcgcuagcuuccuguacugcccauucuuguuuccacuuucauuuugcccacccuggacuauacaucggcugguuucacccacucugagccaccugggcauguaugucucccuuacccacguaacuuaguggcaggggcugcauguugacaauccucccucuuguucugcagaacuuggaccacgggagggccuggggcauccugacuuucaaagguaaggcuggaugcugguuggagccggggaugguucucauaucauccagccagcaggcagucagcuugucuucuuuccuucagggaagagugaggauacggcucgggaaaucgagcaagucauguaccacgauuggcguuugguacccaagcacgaggaggaggccuucacugcguucacugcgaaaccagaggacagauugaauucuguccccuauccaccucugcugcgagccaugauccucgcugaacggcagaaaaacggggauaccagcguccaggagccgcuccugaaccuggagaggacucgaaugcgccccugggacuacccugcaaaacaggagacgaaagggagggccaagggcaccccagucuaacugccaggacuggcagagagguccugugagucauuugauggacgagugccuuugacugugcuagaucuucacuucgguggcgaguuauauccuacagcccugacacaucaggcaaugaauaauggggcagaugacaggcugcuuggugucauuuucaggcgggccccucucugauuccucggucuggaaauaaacgccaggaaacagccuguguugugguuucauuacauguguaccgcaggacaagggaggaaagguggcgguauggagcagagcagcaggugcucccgcacacucaggcaggacuugggcgccgagacugcgcuuugggcucaaaugugcugggauugcagagccccaggagagcccgcgccaagagguccuuuaagggaggccccgcccccuugccgcuuggcccgccccauccgccgccaugaucugucuggugcugaccaucuuugcuaaccucuuccccucaggugagcacccgggcggggccgggcgggggucgcccgguggggcaugccugaagccaguacucccgcagccuacagcggcgugaacgagcgcacguucuuggcagugaagcccgacggcgugcagcggcggcuggugggcgagaucgugcgucgcuuugagaggaagggcuucaagcugguggcacugaagcuagugcaggugugggcgcacaaaggagcagguggauccgggaagggaaucgggacggucuaggguuggggcccugguauaggucgcuacuccuccccguaggccuccgaagagcuacugcgggagcauuaugucgagcugcgcgagaaacccuucuacagccgacugguuaaauacaugaguucuggccccgugguggccaugguaaguuuccgaugaccugcaaggggagagcaaggccuugggagcucucaucuugcugacaguagccccuacagguguggcaagggcuggaugucgugcaugcuucgcgagcccucauaggggccacugacccaggggacgccaugcccgguacgauccguggggauuucugcauggagguuggcaaguaagucuuaccaucuucccuggccaccccucauccuucucccucccccugcucacuugccauucccgcacaggaauguaauucauggcagcgacucgguggaaagugcucacagagaaaucgcucuuugguuccgugaggccgagcuucugugcugggaggacagcgccggacauuggcuauaugaguagauguuauugcagucagcauuaccaaucuggagguuguuggucuucugugaucuucacagagcucagcaucaguaacagugcugugugagugcaggucaacccaaccuagucgguccagggacaaccacucccaccccuuguugccuuucauaauaaaacugcagaaaacccuugugcgcuggugaaguuucaagacaaaag

SEQ ID NO: 8449 - RNA, 1037 nt, Mus musculus
cagagccagcaggcggcagccaaggucagaggacagcaggaaugggggcccaugucucccggacucugcacaggcugugcucuaggucccaauuggauggagaaaguggcacucccagcagcaucggcaucagcaucagcaucagcagcauacugccggcugagccgagcuggcugcuccacgcuacccacaccgucccucaccgucccucuccgcggcggccggggcccacgcaccuccucggccuguuugcgcagcgccuucucgcgcucguauugcgugagcagcugcucguuguccucgcguaggagcuccagcuccaccucgugcuccugguucucgcucagcaccgagucaagguucuccagcacguucaccaccagcggcaugagcuccuugaccaccuccucgucauagcagugaaugaggcgcucgaacucgcgguagauggagcccgccaggcccgacacacgcuccgacaugaccgagcccgagcaguagucgucuugguacaccaccacuccuccucccucguccaucuggaucuccaucaucgcggcuaccgccgccgccgccagcgcggcucguuccggggcccgaauccacgggccgcugucaccucaggcagccgcuaccuuaggacgugccgccgcccaggccgcgcccgucacucccuugccggaagucccgccuggcugcggggguggagccccauccaguuccgccccgagcgccuugacgcuaaaggaacguuuccggcugcguugcugguggcucuugaggacguagcucagucugauuggagugaccuggaugcuucucuaucucuguccuguuugucuucagaccuuugucauacauacucuggccacccucaacguucacgcgacaugugucgcuugcccuguuucugguuguuucccgcucugcugguugcuuaguuccaugcagugcuucauuuugcacaggacaccagguucuaaaauccuuauguguggcgguacuuuugagacagaaauauaaagcgagucgaucua

SEQ ID NO: 8450 - RNA, 23273 nt, Mus musculus
uaaauuuauuuaauguauucaccguugcucucuucagacacaccagaagagggcaucagaacccauuguagaugguugugacccaacaugugguugcugggaauugaaccuaggucuucuggaacaaccagugcucuuaaccacugagccaucuuuccugcccuugaacuacuuucuugcuuacgugguuuucccgguccccaaagccuuccaaggcagcucagauucacauccucuuaaaaaaaaaaguuacuuguuauuuuauguguauguguuugguuguauguagacuugugcaucacacacauuccuggugucugugaaggccagaagagggcaucugaauuggaguuaagaaggucaguugugagcagccauauggauggccagaacugaacagagguccuccccucuaagagcaaguacucucaacugcaagccaccagaucuuacucuuaaccaacacaguccuucuuguagcugaaguccagagcacuuaaaacauuccucacaauuucauaugcaaagucuuacuguguagcacuggcugaccuggaacuugguaugccuggcuucugccauucaguauacaccauuaccuggggcuauacuucccucaucuuuccaaacacauagauaaauaccuacucuaagagauuguuuuguaacaugccucagaccuuagcacaacucacuccaugauggaaguccaauucaggcuguaaaacucggcauguagauagcaccaccugccaaaagaaugaaaacagacccaaucccucaguguggauaguucugagaaagucucuaaauuccuaacuuugcuuuuuggcuucuguaguucugccucugacuaacuguucuuguuaacugaagcaugccaacccagaacauggcuuugcccuuaaaagcucauccugagaaaggcucaaggccuuucuuguuugagauccuaaacacccaguguacucaccagccagcuaauaaagacuuuccuauuggcuuaaaacuaugucagagcauucuuccacggugaacaccccacaacauuuucagguugccugaauuuugauacugauuuaauuuuucaagccugcaaaacugagccuacguauuauauuaucaaccaacuaggaaaacaggcugacgagaaggggcauacugcaguagcacuugcagugacugcuacccgagccaguuauuaguauuuacuguagaugguguuucacuuguaugugcccugugcccacagaaaccagaggagggugcuggacgcucuggagcuggaguuaacuagggguuuugagugucacgugggcucuggaaauagcaucuagauccucugguagagcagccaguggucuccccacagguccagucccaccggaguuaguuuuuaauugcccaaaugaggagccagaacaaacugauaaaaugauuaauucuuuaagauuuuuuuagaguuauuaacuuuguaugguaugaguguuuugccugccuauguauauaucacauggaugccuauguauauaucaaucacauggaugccuagugcccauagaggccagaaucauuggaucucccaaagcuggaauuacaguugugagucaccauguggguccugagaacugaacguagguccucugcuagcauagcaagugcucuuaagcaccgagccaucucuccaguccccugguaaacagauuacaguuacaagauuguguuuagggguuaucugaguauuuuguuuuaggucucagcaauuuuaaccccauaaguucuuuuccugagacagggucuauauagcuuuggcuguccuggagcuuauguuguagacuagaccagaguacguucuaaauucagaggcagagggaccaccugccucugccacccaaguaccgggacuaaaggcaugaaccaucccuguaaauucuuaaaguuagaacaucacagugggggcaccucccaccaacaaagggacagaccaacugacuugaaaauuaccccccucccccccccccaaaaaaagggaggaaaggccuggagagaugguucagggguuuagagcacugacugcucuuccaaaggccccgaguucaauucucaccaaccacaugguggcucacaaacaucuguaaugggauccgaugcccuuuuucuggugugucugaagacagcuacaguguacucauaaacaaaucuuuaaaaaacaaaaaaaccucacucuguagaccaggcuggccucaaacucagaaauccgccugccucugccucccaagugcugggacuaaagacaugcgccaccacugcccagcgagacagugucucuuuacauagaucugacggacuuagaacuauguggaucagucuggccuugaacuuacagaaagaucugucugccucccaagugugugcaccacaaguucuagugcuccuuuguuguuaacauaacugggggcaaguuuguuaaacugaucaaagcaaagugaguuaaaaaaaaaaaagguucucccacccccaccugaaacaggguuucccuguguagcccuuacuguccuggaacucacucuguagaccaggcugaccucaaacucaagagauccaccugccucugccuccugagugcugggauuaaaggugugugccaccauaaaaauauuaaaaaaaaaaaaagaaagaaagaaaugccacccuuuucaaccuaguuuucuuggcgauaaaaauagugcuuaccuaauaggaaaaaaaaaaaaaaaaaaaaaaaaagguguaugccaccaugccgggccuagaccuuuguauaaccauguagugcuaccugaaguccagcucaugaaggaaugagcuguacuguauuccuuuucuaucgcuguaauaaaacaacaugaccaagacaaccuauagaagaaaguguccaucugagcuuacaguuccagagggcuaagauuccaucacuagcauuacagcaagcgagcgagcaagcaagcaagcaagcaagcaagcaagcaagcaagcaagcaagcaagcaagcaagcaagcauggggucagggcaaacagcucacaccucaaagucugccccucugacaaacucacugaacaagacaccacuuucuaaacuuccccagacaguauagcaucuucaacugaaauccaguauucagaguucaguuggaggccagcuuggucuacaaagugaguuccaggacagccagagcuacacagagaaacccugucucaaacaaaacaaaacaaaacaaaacaaaaaguaacaaaggucuagacuauuucauuauucaucguucaggaugcuaguuuaggagcuaacacaaaaacuauauaauuccaguaguauuucuaagaaugagcucuaccugugauaagaaugagauggcaacugugacaguuucacuuccucauucuuaucacagguagagcugcugucuagccucucgagacauacccacaucuuuuagugccugccuaagggcugaaacaguuguuagcacgggauauggcauugucaguuucuaaugcagcucauggaacucaguacauuucuaauuacguguagacaagcuuucuaauuacguguagacaagcaagguaagauguuguuuuggguaacacauuggcuuugugaagcauuggucaccuggcuguccuugaacucagagauccaguugcuucucucugccuuccaagggcugggauuaaagguguuuauggccauuccuagcuuguuaaguguuguuuuuuaucgaaaggcuccguucaguauucagaaugugaaacuucugggagacucuucuaagcaggcagucauccugacacaagccaucuaucuuaguguuuuauugcugucaacagacaccaugaccaaguuaagucuuauaaaggaaaacauuuaauuggggcugaguuucagguuuaguccauuaucaucaaggugggaguauggcagcaucuaggcagguaugaugcaggcagagcuaagaguucuaauucuuagggccgggcauaguggugcaugccuuuaaucccagcacucgggaggcagaggcaagcggauuuuugaguucgaggccagccuggucuacagagugagugccaggauagccugggcuauacagaaaaacccugucucaaaaaaaaaaaaaaaaaaaaaaaaaaacagaguucuaauucuuuauuuaaaggcugcuaguggaagacugaccucuaggcaucuaugguugaaggucuuaaagcccacacccacagugacacguccacuccaacagagccacaccaucuaauagugccacucuggaccaagcauauacaaaccaucacaccauguaauuuagaucuagauauggaguuugcuuguugaccauuugaaaguguauuuucucaauggggcuucgaucuaacacagcugaauagguggccaacccacuaguuaccacaggcuuguuacugggucacugaggcauucugaagucaaacuggagcagguuuucuccuaguacuuguccuaaagaauaaacuccgacuacagaacacuaaauagauuacagcauauucccaauuaauucuguucaaauauuaaauccugggcauuucuagaucaaggaagggagaagugaacuuuacuaaagagaagcuauaaaaaagggucaaaguucagcauuguuucccaaccccucaauuggacuauggagaagcacaaacacaaaauacacacaggcuguaugugguuaguaaguuuaauucaaccauuauacccaguucugccucauaaaaaauuaacaaaauguuccuaucaaaauuguauuaucgcuggguggugguugcacaugccuuuaauccuagcacuugggaggcagaggcaggcggauuucugaguucgaggccagccuggacuacagagugaauuccaggacagcccgggcgacacagagaaacccugucucaaaaaaaacaaaacaaaacaaaacaaaaaaaaaguauuauaauguaagggcagguuucuugcucugacacagugauagaaaaauauuggcaccagauacacuuaaaaaaaguuuuaaugcuuaauguaggugacaauuguauauuacuggauuuagcugggcacuaauuuacagauucacacucugaguccagcuguagcagaagauagaaggaugggagaugaauaaggcagccacugcuguggaccacuguugcagguccccauauccucccagccauccaggccagcagguggcgcuugaagcuuuucucucacagggcuaagagcagaaucagcauagugauguuagauuccucgagacaauccaauuuggaacucacaaaucauuuucuacuuaagagagcaguuauaaaagguuuaucucuaucauuguauuauuuccuuauaagcuaaaaaaguuagugucugggcuaaauaaagucaacaucauuuaugacauuuucuuaaauggaaaaaaaugcucuaaauuccaaaauagagcucaugaugacugaaccacaaaccauuugaguuguuagagaauuacauacauguaagaccuguuacuuggcuucaggauacagggcaucugaagaggaaaacucuuugguugauaaagccauggucagagcccucaacagaccggguaggaugcagagcccggcagguggcuccugcaggcacuuguaggucagugugucggugugugaaugcaggauugccacuuuuccaagauuuacugaggacauuuuuggcaccuacugugaagcgcucugugggcgggagaagcagaagcagcagcacucagaaucccuuuccacagaugcaccccagaggggaaagaaggaaccccgcaagggcugaacagggacaucugccuggcaggaagugacgugacucuaccucugcugucaaaugacuguucugaccuuccugccaaaacacuuaguauccuggcucaaggagcacuguuuaugagcagggucaagaagucuaaagcuuucuaaaggcagcucuugugcuuugguguagagaguagcacuuuucuaagcguugaagcaaugcacagguauuuauaagaagcugacacuaaaaacaccuuuccauacauugguaaagcagccaacgaacccaacauccuucagcaggcuuuccucccaauuauaggagcaaagcaagacaggagaacaggaauccacccaauaccuggacauauauggcccugcagaggccagagaccuucuguacaggaagaaccaugaacagggagaaccccucacaggugcagaacuaaggccuaugcuuaaggcugaugagacaaacaaaaggaacaacccacaugcaaaucuggcacaucaggaacuaagccagcuguagaggaagacaggcugcuaccacagaccuggccaugauuuuaggugcaguaugggacaacucagaagauugguguauaaaaaacccuuccacccaggacaggacugagaauaacggccugacuuucuguugacugcuaccaaaaagagcagucauguuucaauacuacagagugacauaaugggagaaggagaggagacauuaggguucugagguaucucagagggggaagcauuuagugauaggcauuuccugaaaggcuuaguuagugcagacuccacuuugucuuuaagaguuucuguuugugugugucuccuccagcccacagugagaguagugugggguuuuuuucaaccaaaccauacuuagaugcccaacagccagcagccugcuaacacaaggacaagaaagacccuggaacccuucuguuaauggcccagcucuucugccuuccccagaacuuuacagauguguuucauagagagcaguuagagaggagggaccagagcaucccaguuuaccccacaauguaugucuuggcaguccucugugcagcucugcccaugacaacaaggcuuaugagcagucaaccccacacgcaugacaaacccucucccaccccagcucauuugaguuaaaggaaacacuaacauucaauacucuaucucugucuggucuaguuacaggcagagcaggagcuucucaauagaaggagaggcuggauuugccuccugguggguucaggacuuuguugugggagcgaggucguggccccagucuggguucaugacugucaacuguaggugugggcuccgguaucuuugcaugcucuacuucuuuugagcuuccuuugucacucugcucuccucuggguguggagucuguugcagcuguaggauaaaaaucaacaaaaguccaugaaaggcaagugcauaguccacuacacugugcagcaagcugcacuaacugaaagucagugccgcggcauagccagaaaguucugaagccaacugguccaaucagucaggaagcacuuuggauggugguucucaaccugugucaaaacccuugugaugguguguaugcucagccuagggaugacacuauuagaagguguggcacuguuggaguaggugugucacugugggugugggcuuuaagacccucauccuagcugccaggaagccaguauucugcuagcagccuucagaugaagauguagaacucucagcuccuccugcaccauggcugccuggauguugccauguuucugccuuggugaugaugauaauggacuaaaccuuugaaccuguaagccagccccaauuaaauguuguccuuuauaagacuugccuuggucauggugucugcucacagcaguaacacccuaagacaccccuggagaggguagugucaaauugcccuuucacgggggucaccuaagaccaucagaaagcacaaacauuaacauuaaaauucaugauaguagcaaaaccagaguuaugaaguagcaaugaaaauaauuuuaugguuggggggggucaccaaaacaggaggaacuguaauuaaagagucccagaauuaggaaggcugagaaacacucuucuagaagaaaagaaaaccuaacaguauuacuagcaggaacugugcuccugucccgagccugcuuuaaauacuaaaccagagccacccucuuaugcuuguuuuggucaguuguuuugaaggcagagcaaugcuaggaagagcaugagcuauuccucuggaauacagaagggcaggaaauaagcuuaccuuucaggucagacuuagagucuucaccuucacacagcaaaacaugauccugcagcaagguaagcaagccagcagguuagugcucguccaggcaggcaaugaaaguuuagggaugaguggcugguuuauuuuuaauuguguuccucuggccaucuaagacaucuagacucugcuagggaaguauucuacccaccaccaggccacauccucagucuuauuucuacuuucugagucagggucucauugaauuuuccaaagucugggcuuaaacucacucuguagguagaaaggcauugaaccucagcuuccuccugaacagguggagguauaggcccccacuauauggucuguuuuauuuuuagccuuuaaaauguuuauggcaggcuggggauggcucaguaguuaaagcucuugccguucuuagguacaguugucuguaacuccugcuccaagggaauaugcugccucugaggguaucugcauuuaccugaacacauacacacaugcugacauaccuaaacauaacuaaaaauaauacaaucuuacaauaaacaaacuagcaggcuucugaauaaacugcucaauaacaaagugcuucucuagcuugcgagagucucugugcauuugaucccuggcacuacaaaacagagacccgugacuaagccccuguaacucgcuggacugcaacagugauguuagcucacugccagccucucaaagccccaguuauuuuauuucuuaauagcauaaggcauagcuuuuuaagaaguagccacaacagguuuuaaauuauaaaaauuauuuucuaaaagaacccacuagcauguuucauagcuucaccuacauuauaguauaucagaaugucuuguuuugacagcacagcauuugaauguguggcucaaagcagacaaaccaaauaguuuggccacauaaccaaaugugaaaucucagcauuuaugcaggaugccaagaguuugaggucagccugggcuauuaagaggaccacuuguuucuguuucgagacagucucacuauguaaccagcuuugaacucaagagaccugccugccuuuucuuaaaugcuggauuaaagguguguaccaccaugcugacaagagagaacaugccuuuaaaaacaugugguuuugagccuacuuagcuuugacuuuugggagaagcuggccugagauggucucugauggacuucuacuaggaagcuguaacuauuggucggcucuuuguucuguuagcaaauaguaaauauuaucuaagucuauuuaccccuucacggccaggguuacaaugcugauauccuaucauugcuucaaagcugggauauucuuuuccagcuguguccucacuaugccucuuagcuagcguccacgucacuguucugcugucccuccucccaaggagcuuccauacagguaaacugcauugugcucaacucuagagaacaccuauuuucauugggaauugguggggucaaggggugcugccauaaugugcaugcugagccagaagacagcuuuugagacuguucucuccuuccaccucaugggucccaggaaucaaacucaagucuuaggcucgggcaggaagcagcuuuaccaauggacccaucuugcugguauccuguaguauucuguaaaggggacuuuucuuuaauagguacucucucuacacuucaugcaggaaaugcugauuaaacaggauuuuuuuuguuguuguugcugcuacuguuuuugguggggaggagggaaugaguucagacagagucucucuaaguggcucuaacuauccuggaacucacagaaauccaccugccucugucuccugagcggugggauuggauuagagacaagugccaccaugcucagcuugguuaaacacuuuucuuuuuuugcaacaaauuuaaugaguugguuuucuggcauucucuaaaggucuaaaauuuuuuuuuuuuaacuaacaaaugcaaaauaguuggugaauuuuaauccauugcaauuacauguuuaucuuaguacaugggugccuucacuggaucagagaccugagauccauaauccucagagauaacaaacauaagcucacccuuguggagagccaucguccugggcuggcuggggaggcagcugggguagagcagugaucgagugauacaguguggggguuggucugaugcugcugguucucuaaugcugccccgggagacccucucacacaccaaacgaugcuaaguaaccuugcuggcagguuuuuaguuaccugacuggggguugcagguagagagaaaaggguggagaaaagagaagagaccaaaggaggagggaagagcccugagaggaaauggaccacgagcacauggcaggacagacauaaguaacagggacacaugguucagauauaaguuaaaauagcuccaaaaccugccaaucuaggcuuacaaaguaaauaaaguaccuggagugugugucuuuuuuauggacaagcuaaaauauauaaucccaguguuaaacacgcccagguuaaaucucuagugcuaugaaagacagacuuuuccucuccagaacucagcaagggucaaaccuuuacacuaugcgcucagucaugagaccgcagguacagaguggagcagcacaggcaggugccugguggcugcuguguagagaugaacacaguuccuuccucaggucuuagucauaggcugaaacauguuuccugggugacuccgaccaaugagugagcacacccaggaaagcagcacagucucucugucugucugucuuguccuagucauaccuaugucacaccugcuuucugucugucucuucccaguauuacgccacaccugcuuucugucugucucuucccaguauuacgucauaccugcuuucugucucuucccaguauuaagucacaccugcuuucugucucuucccaguauuacgccacaccugcuuucuacgucacacugcuuuggaacucuuugagaagugaacuugaaacaacuuuuauuuuucuuuccugucuggcuauaugaauguaguccauaccuugggcuuguuugggugugccagaggcgcaguggcagugacuggggacccaaauaugucacuggucuuccccccugguggauucaaacguugucgaguuugcacaggagucgauucaucaaagaucccacuuccuuugccuccugcaggaacaaucacagaagggugaacaucagagcucaacucugaugcgacgccaucacugucuuccuucuacaaaagacuuaaugccuucuuagguuccaggacaauagagugggacaauuacuccaagucccugaagccuuauaucccagcuaaucucuaaucuggucugcuacaguguucacguguauauagccaagcugaccugggucuggauucagaaaaggaauaaaaaaacaucaccuuuccccagagcucccuuauaaugaacaaugcaaguuuuccugugggaaagucucuucuguuaaucaaaaggaguucuuaagccaaucaaaagcaaauaacuagcgguuuuaguucccccccucuacucuggaaaauaagguuagucacucugaccucuuuccggcuagaaggccuagcaaugaaaaaaugccagcaaguuaaaagacauguuccuuaauagaaaugugcaucucaagccgaucuuauggacccaggccuggacaggauggaguuaugccuauguuaggcaaaaauguaugaaauaccaauagaugucuucacucagcagguauuaagcaucuagacccucaccugagauuccagccacucuucuccaccuccaaugcccagcucuauagaauccugacacagagacauacauugccucaggaaaugguagaccagaccagacauggaaauuaacucaaggaugguaggaggaauuaacucaaugcuaccuuuaggaggcuaacaucuaugcugacaaacaacuuuucagugauuugcguguuuauaguuucaugugcuccuaacuaacccuucacugaugcuccuauaaacaacccaaauaaacuuaguggcuuaccaagcuggagcuagauggaauguuuacuuggguggcugcugcuggguuauuuaggagacuagaggguaacuagaagucugcuuacauugccccaggaaaagucaaauaccaccauaucacuaaaggacuggcccauguucuucugugcucguuuuuuguguccccucaaauaaucccaaauaguuacuccuuugcucucaugaccauguugucaccacagcacucucaacaacaaucagaaugaaaagcaggaaugccuaagucuuuuucaaggaaucuauuuugcuagcuagcagagcuaucaaaagguacuucaagauccuacugaugggcuagagcacccuuccagaagacacugacuggcuugaagggaccaagaguguagcugcugggauguagugagaauuguaguguccuuuuuaaaaaguuauguaaggauacuguagcugccuucagacacaccacaagagagcguuggaucccauuauagaugguugcgagccaccaugcgguugcugggaauugaacucaggaccucuggaagaguggucagucaguacuuuuaacugaugagccaucucuccagccccaacuguggugucuuaaaaaucccagugugggauacggggcugcuucagacugaacacagaaacagacuauuuguugugugugcucuugcucuuggagaggcauuuucuuugccagcugcagauaguuuaauucugggggcucuggagagggaauaaaugccagagcccagagagagagacguggggagcucugaagaaagugguuguguaucuuuucucaucaggucugaaaaccaguaccuucugacucauucucaggguuaguuguguuacuugguacagaacuggcaucaaccagguucuggaauguugugcucccuauucgugacuucugucuuccuucacuuuuucaugagcaucaucacauacuuaaaggauguauacacucugucuuaguuaggguuuuacugccgugaacagacaccacaaccaaggcaacucuuauaaaagacaacauuuaauuggggcuggcuuacagguucagagguucacucuauuagcaucaagguagaagcauggcagcauccaggcaggcguggugcagaaggagcugagaguucuugucuuuaucugaagagagcuagcagaauacugacuuccaggaagcuaggaugagagucugaaagcccacacccacagugacaaaccuacuccaagaggaccacacccucuaauagugccacucccugggccaaucauauacaaacuaucacacucucuccagggaagaauuuucuuguaccaucagauuuuuacuagaaauacucaaugaaaacaguaugugugagcuccauaccuuacccgccuguugggaguuagcauaaauaagccgacaaguggccccaguagggcauguaauaauggaaaaucagcaggguacagaaaugaauauacuguuucaugucaacaaugugugcucucagccaggacuuucuauauucuuccuccuauauucccucucaggaaagguugggaaacggccgagcacuacagcacagaggguucagacccuggugacuaagcaggagagagaaaagcaagcugggcaagaagguacaugaacuccucaaggugagcuaccuaggcagaacuuuugguuuccaguccucacagccccagagggcaggaggcgacaaaguuagagaaacacagcccuuuugucuugagagaaaggguuauucuugagcaaacugagccccugggguuacaagauuacuagucuuagccaaaagccuuagaaaucaaaaugcccuuugcacggggcgugguggcgcacgccuucaauccuagcacuugggagacagaggcaggcggauuucugagacgaggccagccuugucuacagagugaguuccaggacagccagggccacacagagaaacccugucuagaaaacccaccaaaaaaaaaaaaaaaaggaaaaaaaaaaucccaguucugggauaugggacugcuucagauuguguacaauaacagacuauuagcuuugugcaagcucugggaggggugugaucuuugccagcugcagauaguuuaaaucugggacucuagagaggaaauaaauaccagagcacagagggagaaagagagagggagggggagggaggcaggcaggcacagacagacagacagagacacagagauguacccuaagaagaggagcuccugcggguuugucuaaugguccagcgaggaaacaagaaguuggagauauccucacaagagaaagguuagauuuaccccacagaacacacuggcacuaacuagcaggaaguaguuuacagagcucuaagcccccuuucccgacuaaccuugucucuccuaccuggugcuggaaggggcuggggaggaaaaggucgagugauauuaaggacccacuaaaguaaacacagaaucuuuuuaagggagaaauaaaacuuuuuggacaucaagagcugcacguuuguaaaaacuuagaaauuaaaauuuucugcaccucagccauagacuuucugggaauugguccccacauugagugagcacuccugccuggagaaggcaaggcaauguggggagaagggcuccguggccagucccugcuuagucauuaacugugugaccuuguaagcacaccuugauuucuaccuccggaacuauaaaaugauagccaaagugacuagaggaauuaaaccuuggcugcugguaaagagcugguguguuaugagcacccuagcaaaagggccugggccuugagaggcagaggcacugccucccaggguuauucucagcuguccaaaggcuuauuacuuuauuauacaaagucagucugguuuaaacagaaagcaaaacagcuugucacaaccccaccaggcuaaggcagaaggacuaagaagccuaggugaaacuuugaaaaccaaacaacaaaccucaggaguuugaggcuuggggguuuguggcucaguggaagagugaucagcuaucuauauacugaguuguaaaccacagccaaaggguggcggagaguaacaauuacaaguuuuuggucagacacucaugcucauuaaaaaaaaaaagugaaucagagaacuggaaaguucucaagauaucacggagagcuguagggugagcacugcucauaauagcacuggcucuccagaaacuucuacauauuccuuucacucuagucacucaauuuucuugaaauuagaaacuugcuacgucccaaguaaagucuaucuugaacaagaguuuugcuuccaacucuaaaggaguaguagucacauggcaugccugguagcuuacuaaggaaaacuaaguucaaaaugaauuuuuagaagccguauuauaagagguuaagggugauugcugcucucguaagaggcuugguuugcuuccccgaaccgauauagcugcucucaaaugccuguaacucccauuccaagggauuggacaccuucuggcuucugcauacacauacaauaaauuaaacacuauauugacagaacauagcaugaacauuauggacguuagacucaaugugucaguauuuuaaauucauguacccaaugauccagcaauuauccuuucagaaguuucucucaauggauauauucuggucaguuuauuugcuuucugaucauauagcccagguugacuuacaucuccugacccuuuugccucuaugucucaaaugcagggacaacaggcacgugcccuagugugcagauuuaggucaauuuaggcauggaccucuagaaacagguaaacuagauccaagggccaagucugccaaugauuaacuagcugugagguucagucaugcaaggaacuucccuggguuucaguuucagcuaugagagaggaaacaucuaccuccuaggguuguacugaggaugaagugaaaauuaugcaaaguacguaaacaccaacaaagaccaauguuaucaggcaaauaaaggaauaauuuauaaagauauaugcaauaaauaaggaacauggaaaauaaugaauaugaaacaccaaagggcaagcaaucggagcaaaucuuccaugaucucacacuguuaaaucaucucugcucugccucugcauacuucucaccaggcucccaacuuucugagugcuguaggacuaaguucgaaagacugagcacagcacccagggcacccaagcccucagggaaugaacauacuagugguugugccuuucuguccucugggacuauuuucaaaggagccccuaacaggacagaaaacaagcuccaaacuuguugcagaaaucugcucacugcagcaagauagcuagaugaccacacugagcauuaagggugcccuggggacagguacagaggaacaccaugcuuuccagggcaccuggcuugccacuggggcaagccuaaagacaauucugcggaaggaaggccaagauggcucacagacaucaaaugcaacucuaacccacaccauaagagaacaaacacggggcuggagagauggcucagcgguuaagagcaccgacugcucuuccagagguccugaguucaauucccuuuccuuuuuuauuuuauuuuuuugguuuuucaagacaggguuucucuguauagcccuggcuguccuggaacucacuuuguagaccaggcuggccucaaacucagaaauccgccugccucugccucccgagugcugggauuaaaggugugcaccaccacgcuuggcucaauuuccuucugguaugucuuaaaacagcuacacuauacucaucauauacauaaaauaaguaaauaaaucuuuuuaucuuauuuaucuuauuuacuuauuuaucuuuuuaaauuuuuaaauuuuaaauuuaaaaauuuuuaagucagcuuuugugacaggguuucucuguguagcccuggcuguccuggaauucacuauguagaccaggcuggacucaaacucacagagaucuaccuguucugccucccuaguguggggcuuaaagguguacaccaccacucccugccaaaauccaauuuuuuuucauuaguauuucauaaaaaaacaaaaaacaaaacaaaaaacaaaaaaaaccuuuaucaguaaauugacaaaagacagagcgcagaucucaguccuuuuccagcauauggacuccauauguagccccucgaggcuuacaaggauagaacacaucuagcuuuuaaaaaauggauauagacaagaaaaaggcccugaggauaauuuaucacucaagguguuuugcugcccucuuuuuuuuuuugagacaguuugcccaaguuggccccaaaccugcagccucuugaggucugagauaacagacaucuaacaccaagaccaacuaaaggcuuuucaaaaaauuucccugguaacagcaggaaaugauagagagcuguaccaaggugaaugcucuagaauuucaaccccacugaaaucauacugaaaauacuauuuauuccuaagaaaagcauuugaaugcacaauuugcaugaaauuucagauuaggggcucugagaccagaacccccuuacauagugggcagccucagcaacugcacccagcaaauacugcugaguagauggagcacuuugaagagagaagaugacagccauggaaagcucucucuccuuuuaaagacacuacugacaacaaaggacaaagugcuacagaaucuuaucuaaaagcaaaaggaggcauguguuccacguuugcaaucccagcacuugagagacaagcaggaaggcuuugaguucacagucugggcauggcagcacagguccuuuaaucccaacacucaggcagaggcaggcagaccucugggaguugcaggcuagccuggucuacauagugagagccuugucucgaaaaccaaaacaaccaagaacuauuucaugucauucugacauacgcuauaaucauguagggagggagcucaauuaggaaaaugccucuuaagacagagcugcaggcaagccuuuagggcauuuuuauaacuaguaacugaugugggagggcugugcccauuguggguggggccaucccugggcaggugguccuggguucuauaagaaagcaaguugagcaagccaugaggagcaagccaguaagcagcacuccuccaugaucucuacaucagcuucugcccuggccugaauucuuguccucacucccuccagugaugaacaguugaugugcuuugguccuggugucucaugauagcaacagaagcuugucagacagauuuuuaaaaagaaaauagaguuuaaggccaagaacgugagaaguauaaaguccacaccuggaggauuuguccucuuggguauguuuuuagguucuucaguugguccgaaaauauuagaugccauccuauuaggcuugcuugaagaaauaccuucuucuggacuuccgaaaagaucgcucgauucuccucccgggggcuucauggaccuacaagcacagagugaacaagagucacugacauccguccaccagauucccaggauucucuuggacuggugcugauggucucuugucuguggucuagcccaacaccaaacaguacugaugugaaugaaagcuggccccauccaaagugugaugguauaggccuauaacucccagcacuugggaaacggaggcagaauuuagaguucaaggccaaguuggguuucacagaaagacacugucauauucacagggguagggguaaggugaaccccaugaggaacuuuucauuuuuugagucacauuauauaguaauuaggaucaaaauuuuaguuuuaauacuuugccaauauuguuuuagacucggauccggauaaaacacgugauuaaagagagauuccuuugcucuuuucuucaugcugucuucagcuuugccauggagcucacauggaaucaaaucccuuuaccaaccuuucugcuucauagccaugguagccagagacuucucugccagaauuuauagauucuaauaagaggagucaggcgugaccgaguauuaagguaaaggggcuacccuuguuuaaccccuaguuccuuugauuggguuuuaauucagacuccuuaugugccuuuuaacaaauaccauguuucucuuuaucuuagauccaucaucccugacgguaauuccugacuuaaaagacucauuguagggaucuauauuggaauguuugguguagccauugaaaugccuagacuagaaagaaaaaaccaucacccacuggcagcauguccuuauggaaugaccauuccucuuuaaacucugauauucuacaagcacagcuuuuaaacaaacacccacaaaaaugugguuucuaugccuuagcuacaaacaguaguuuccaccuaaagucccaaacuuugggaacuucgucuagagcuaaugagaagucuaaaaaguugcuuguuuugaaugcagcagccgaagaccuauggcauuaccugaaagcucugcucugauguccagagcacggguauacaacugcaauauggugaaagacuucauaugcauauuucagauaccugguuagacuuuuaaaaugccuuucagucaugcaugcaagcuaauaccugugaucccaccacuuggaagguggagguagaaagaucaguaguucaaaaguuauccuuagucaggcaugguggcucaugccuuuagucccagcauccaggaggcagaggcagguggaucgguggugacacagugaguuccaagacagccaggacuaccuacguaaagagacugccucaaaacuaaaaccaaaacugauccuccacuauagagugaauucaaagucaguaaaggcuaccagagaccaucuaaaaaauaagacaugaauuuugaagagaggccacuugaaagugaauuuuaaaucggugaauggccuauauucauccugccucccucccugcucugaucuaugguuaccuacgcagcugaagaagcuguggcuguccuagaacucuauguauaccugacuagccuccaacucacagaaagcucugcucugccucccacuacaagaauuaaagguguguguacugcaccuaguuucaccuucucacaguaggccuaaccacugagacugcaugaccucaaauauuuagaaaaauauuuaaaaucaaagacuaccacauaaaagcaagacuggagguuaggacugacugaacagcuacguaaaacagugaccacucaaagacuucauuaaaaacaaaaguaccuaaaauguguuuguuucauucaaagagcuaaaaggcugucuaucauugcaauguaaugggugugaaguucucagucagccuaaggcagggagggaaguguaaagugugccagucacagaugccaggucacugucuucuuaggaggaaggggaaagaggauguaucaaaccuaccccaccaaccguuacuauuucuugaagggucuuagaaagggauagaaguuccuuugaaaaggggggaggagguggggaugggggagcuuggcccacuacaaagaacuuaacaagauuguagaccauacaaagcaguugauggguaaguuaagacuaccugacuuccacgcccaucuuuagaucuuauucugaccaucuucuucugggcggucaggucuaacagccuugggucuagucuccucuuuucucuuucuuucuuucuuucuuucuuucuuucuuucuuucuuucuuucuuucuuucuuucuuucuuucuuucuuucuuucccgcucucucucgcucucucucucucugguguuuugagacuggguuucucuguaucgccuggcuguccuggaacucacuuuguagaccaggcuggucucaaacucagaaauccaccugccucuuccucccaagugcugggauuaaaggcaugcgccaccacugcccagccauuuauuuucuuauuggggguuggaaagagcugagucaggaucuugaagugcucaaauucacuauguagugagugacaacccugaacucauauucucuaccuccaugucccgagugcuaggauuacaagugugaauacuccuagcuuuauuuuaauaaucucauuuuacaugaagccaccagcauccuacccuguggagguuugaccccggcagacccucacucuacacucucaccuucccagucacucugugguuauucagacacaagauaccgacagccagacgugugugucaaugguauguguuccauguaugugauacaacagaagcaggagccucaaaaccaucuccagagaugaggcccaaauugagucuguuacgggaauauaggaacuagcuuuugaacuuaauauggguauugaaaguaaggauuuaguauugcuuuguguacuaaaauaaugagccacuugggcaagagcaguguccaccuccaucucaaagacaauggagcaagcacaagcuucaaagccuacagcagcaaugcaagucuuaagguugccccugcagggucucacaaaugggccuuucaacaaauagggcccagaacaauggcacaguguggccuucuggaagccacuagcagccauuaaucacaguaacaccaguggaguggaagguucuagggccagauuagucaacucagacuuuaggaccaaauccauaauuccaauuacuuuuuccuuuuguaguacccuuuaaauguuucaguagaaauacucaaguuaucgagaaaauauaagggauauaggcaaagaugaaaagccagaguucaaaugaacuauggcacuggagagaaagaaaauaucgacgguugucagcgcucccaggccucccuggaaugaugaguuucauaagaacuaggaacuaaugagaaaaucugggacaaagccaugagaaauagaccggguggggggugacguguucuucaugguuaguaauuuuuguggaugaaugacaguaauaccauaacgcuuuuacaguucaaacaucuccagcacaagaaaaucccucugcugaggagacaaaagacaggguuagacgaaaggaaacccuggaguacagacagaccuuacagacucaggcuuuguagcaaucagucggacuaugugcugcuaucuucuccaaccugccuaaguugccauccaaagcacgcuuucuaucuaauauggcccagacugaggcuuccaauugcgcuucauuauccaguuaagguagcuccccuuucccccucaucccgcuaucaaguggguauuuccuccuuuuccuaaauuccucuccauggacgccuacucaacaauuaacuccuggagcucguaaagucauucgaacaccaguuucauuuuaucaacucaaauggggauuuccuccuuuuccuaaaauccucuccauggacgccuauucaacaauuaauuccuggagcucguaaagucauucgaacaccaguuucauuugaucaacucaaagcagaucagacagaaagccuagaggaaacuguguagggaagguccccgcccaggguguagcagucaguagugcauccaacaaacaccuggucguggguugggucugagaacgcugccgcuacucagccacauucaaaggucgucaugaccaaccaaacuggacaagggaagggcucaggaagcggcaaacagcucggagcgcccggcuagcgucuguccugagcaagcacuucaggagagccacgugucuuaaucccgccgcccggucuccacuccgcucuaaccccacagccuuccugcaaggcccugcgggagagcgcgcacaguauccucaggggagccccgcgccacacccaccgcacuuguagggucucccgcccgccacguggcugcggcuaugcgcccacccgggccccagcaccgguccgcgcaccuggaacccgacuugccagcuuggcuguccgcgcccuggaacaugucggccgccgccccgcgcuuucacagccgccgcgcggcgguucccgcuuggucccgcgcagguacccugacccgccca

SEQ ID NO: 8451 - RNA, 1104 nt, Mus musculus
uaccuuuuccucgcggcccggaaccgcuggcaccaccacugcccaaagcacagggugcguccuuccugggccucuugcucuggggucgcacgcuggaccuuaggaaauggugcugguccugggggcugcccugcgguggagacggggucggcagcccucuggguggcgcgggggcuccggaggcccgaggggucugcccgucccucuuugugcugcugcuguccgccgcguccgcgccgccgggccccucuccguccagcgacuccucaucggccguccgcuugcccagcuucuugagcccuuccuccccgcugccggcgucgcccaacuucacugucauccugcggcgagagagacgaggagcggugaggcgggcggcaggcagaaguuuaccgccggccucccaacauggcggccguuguuuguuccagcgccgcccgccgcccgccgcccgcccgagggcccacagagugcugagcccgaccggaccgggaccccgccccgcccuuggaugccccuaacccagguagaccaacacagcccggagccacggaaggcacggcagcaugaccuggccucugcgcuuugggucccgcaguaccgccgucccgccaccaccuaacccaaggagccgcagcucauggcccccagcuugaucccgccucgcuccccgcacugcccgugccuccccucugcucccgagccacgcgcgaucaagccgcgcaccugccuauugcaacggcccgcgcugcccuccgagccccuagugcuccauaggccaaaacugccgcucccuccaaagcuggcaugcaagagagagacucugcacuccggaaaccuucccaggagggagauggcccgacuacaccucucauucaacaaagccuguugcauagaacagguuagagaacaccggaaaagugacagcaaacacuguuauguuccagucggaucuuaagaauaggaacugaacuauguaaacaauucuggaaacaacaaaauucuugcuuuaacuucuaccacugucauaagauaucgauaagcaaaauaauaauuaucuguagcuaggagaaauuauacucagaauaaacuaaaguucaggua

SEQ ID NO: 8452 - RNA, 4511 nt, Mus musculus
cagucacauggugggcuucaaggagcagggauacgagacagacucaagggaccaagggacgaacaucagcuucugccucugugugucccagcaugaggugcuugaagaagaagacccugcuuuuucuccucauuuuugugucccugaauguacacaggacuccgucacaggaagcucacccagccaggcaaagaaagccauuuuuugagaggcuccgucgacuagaagagcagguagguguacuacacuuggggaauugguuuuauaauaccaggagcagguaaagaauggaugucauggaguccgaugcucucugugauccagguacacagagagcacuugguuugcucuccuuguuggaagccaacgauauucucaccuguuuuuagaaacuaggcaagcguuugcuaggcucugcucugaaguccaacuagacagugugugugugcgugugugugugugugugugugugugugugugugugugugugugaagaugcaggagaccugaagaggugucuagaagacccaaagaacacagccuggguagcgacugugcaggacaguauucauaguugugggagcugugagggcacuggucuauuucaaagcagaacauaugcucugucccaaggauuccgcaggggucuguagacaguugcccaccccaagcacguccuguacugauccugguacagccagacaugguggaguguaccaguaauuccagcacuuaggcucaaguaagaguauugcuaugaguuugaggcuagccugaaugaggacauggugaguuccaagccacccugugcuacugacugaaacucugucucaaaacaagcaaacaaacaaacaaacaaaacaacaacagcaacaacaacagggccagagagauggcucagugguuaagaguucuugcugcucuugcagaagacccagguucaauucucagcacgccuuuggcagcucacaaucauguguaaugccagcucucacuccucugaguacugcaugcacaugacacacagauacacaagcaggcaaagcauccacacacauagaaugaaauagaacuuaaacccaaacagcaacaacaaagacugaaaaggcaacagcuguagcucagcagcacggggcuuccuugccuagaauguacaagauccuagauacaguccccagagcuggaaaaccauaaauaaguauaaauaaaugcauacauacauacacgcgcucugagcuggagaaauaguucagcaaccaggagcacuagguacuuggagaggauccagguccauucucagcacccacgugauggcucacaaccuauucauaacccuaguucaagcaccuccaaagacacgguacacacauggugcacauacguucaugcaggcaaaacacucauacauauaaaauuaaauacaucuaaaaaacuuuuuuuuaugagacaugguuuuccugugucgccauggauaccuuggaacuugcucuguagaucgggcugcccucgaagucacagagacccuccuccccugucucuaccaccacccagcucaaucuaaaauauuuuucagugcacucauacagccuguccugcaguccccucugaacacaaagguagccccgaggaucacaguagcaagaugucuuccagaguguugggaccagagaggaucaucacuagggucaugggucuggagcccacauuuuacacugugcagcuauggggccugaggacaguuaccugcuuuguaccuggcccuuugggacuagucaugauaaucuccacacauguccuagcauggugacaaggaucaaauuguucaauuuauaaacagaaccauccauagacuuggauguagauagaauagauacuucugaaguauucuuaggguagccucagccuaaccccauaagagcuguguucucuuuacaguuucagagauuccaacaggugaccuuaacacaccuucagaacauugccaacaacuacaauguuuaccacaauauggauguucgcuuccagagccugguggaacagagccaagccguagcucuagcgaugaaucagucucaagcugccauacaaggagauguggcccauuuaaagaccugguauaggaagagccagcgaaggagccagaagguagaugcccgacuucaagccuuggaccucucccugagcacaaagagcaggcaguggguagagaaggaaggggagcaaaaggcacagagggaggcuauugcaagccuggcccuaagcguucaggcacuacaggaugcacuggccagccuuacacagcaaguccacagccagggugccaggcuugcugcucuggagggacagacacagagggccuccucugguacuguggcccugggguugaccacagcccccaaccccacccagcuugcucagcgaggcccaggauccuugcaacuguggagggaccgccagguagccaagucuucaccccaacacaggaguuccccucaugacgucacuguccacguucaggagaugcagaaguuccaaaccccaagcagucaucaagcagccccaccaaggaccuaccaaggaccaggaaacaguaagugacacaaaccugucaccucccuaucaaguuccagguuucccuagcagugucugagguuauaaugucauuccugacaccugucaccccaaaaucucuuucccccaagggccacauaccuaacaccauaagagagaauggccuccagcaggucaggcugcauagcagaagggccucuauugaagugacugaaccaggagccucaggaugagucuugcuuccuauuaacacuacugugacuugggaagccaaagagagauaguugaguuugcguuugugcaggaguccaacaccggccuagaacaagggcagaacugaucggugcauuguuuggcacaaaacagugacuuucacacucccaaccacacuucccugccuccugaauuccccuuggcugaguuccucacuuucgucuuaucuagcauaguccccaccccaaauccucccggggcuugggaugcaugcucuuuccugagccugggcucggucacagaguugauauuucaguguaaaauaaacuaaaaagugcucagggagguaccagguaccagcuguggcauagggaagagaggggccgagugcugccuauuuacuugagugagauucacugauaaguacuaaaggaaccucagacugaaaacgauuuauuuccuauagaauaacccuagauuaucuggcugauaauagucaucggaggcuagagaggaaggcaggagagccagagcuggaugacacccgaggacagaggcagaaaauaagaggguggacuguggaaccaggggguagacgggagccaaggccuucaggacuaccacuuccaaacacaaggaggcgcuggaggaaacugaccacggaacacugggucuugaacccugggagagcagguucagguuuaugcccuccaaaagaaagcugguuuacaucaauaaacccauagcaaagucauagcagccacagagagcauacacaaaggcuucccuggucucgaggugcuucagagacagacagauagacacagaggauucaucgacucccugagaaguuauucucaguucucaccugugcagaagaaggguucaaaucuugagugcagaaagggugcugcaagcacucuccggagaccuuggggucacgcuguagaugagagcaaagggcaggccugcagcaggaugcuucugaucugccucaugcucagagcugacucucuucccucuguuuccaguuugcaacacggacccagugcugauuuuccccaacaccuccaccgaaaaugugaucuuccuuagcccuggcuuccucaugccccuacgagcccuguccuucugcaguuggguccgaauggccaccagccaccugggcacccuccuuuccuaugccaccaaagacaaugacaacaaguuaguacugcauggccgaaacucccuggucccugguuccauccacuuugugauuggggacccagacuucagggaacugucccugaaaccacuccuggauggccaguggcaccacauuuguaucaucuggacauccguggagggcaaguacuggcuccacauagaccgaagguuaguagccaccggcucccgcuucagagagggcuaugagaucccucccggagggucgcuugugcugggccaggaacaagacacuguggggggcgaguuugacagcucugaggccuucguagggagcauaucuggcuuggccaucugggaccgggcacugcucccuagagaaguugcaaacuuggccucuggaaaagagcucccaacaggcgcuauucugacgcugaccaaugucacuucuguggguggauuugugcagagagccaaauguaccugccuggagcaguguccauaugccacaccgugacugugucacacacagucaaggccaucaagaacaagccucacca

SEQ ID NO: 8453 - RNA, 651 nt, Mus musculus
uguauuuuaaauuggguugauguuaagcuguguaguacuugggaccagugauucucuucuaucugccuccacaguauugggauuacaagguugccuggcugauucugacgaugcagagcuucaaucagcuuccagaucaaaaggccaggugcacguuagcuaugggaguguaauuucagaaucgccucccuguaggcuguccgagaucuggucagccuauggucuacacagagccauuuccauucuuccugaaggcaaauggauucuggggaccugggauagucuagguggaggugauguuucuacaagccuuuucaaagggacggccaggccgggaggcguuuaaggcgcgaggguuucccgccuccgugccugagagcucggauggagcgcuaagacuggaagaugcgcucauggagaacagggaccaagucccucccggacgaugguccuggaaagaagccagcagaugccacggguucucaaguccuugggcaucacacuaaacagccucgggccaagcucuucggagaaccgagucugcuucacuuucaauccgccgcgccggaucaggucucaauggaaggacccagaacgacacaaacccguaagucguccagauagugaucagggcgaggccggagacggaag

SEQ ID NO: 8454 - RNA, 46501 nt, Mus musculus
augcgcgcugcauuguuuugacugaaaaugccgucgguuucgaaagcggcggcggcggcgcugagcgggucccccccgcagacagagaaaccaacccacuacaggucagugccugggcugcgguccguggccuucugggcgcugcggcgcaaagcagcggcccgcgugcgccacgggccccggugucgccgcugugggugcgccccgcccgcgcccgcgcccccgccgccagcucuugcgggucacgccguccaggcgcgggccgccgccuaagguggaguggcagcgcccaggguuuucggugaccccuggcuugggggcuggacuugcuccuggucuccggcgaccccgcgcgccagacuggagucuggggaacagcgccugcguucguagcucagggccgcgccugggcuggaggugggcgcacggccauccggacucgagcagucgcugccugagguugagaggcgguuccggggucuggggugaccucugggcugggggcggagccgcaccuagaguccgguggccgcuugguugugagcccgggggucguuucugcggcgcagaagagggguugcgccuggugugggcggguggcgcuugcaguccaucuggaaccuaugaagguagucgagcgggagaccgggacugaggauugagagguggcuccaggggucagggacuagaagggggcagagaauggaguguacuucuguagaguuaccugggaucagaguuggugauggccugcuaagaggaggucuaugccucguguccgggaaucuucuuaucuggggacugggaagugguauuuggggucagggaacggagagucugccugacuggaguuaccuggucuccgaguugggaagugacacccggggugcuuuuaaaaaaggaggguaccgggccauggcagucaggaucgcucaguguguguguguguguguguguguguguguguguguauugccgggggugggggaugcuucucgucugggacccugccccgccgcaucccaggggccuccagccggcgguggcugcggcccgcaacgcuguuugucuuuuuagguaucuaaaggaguuuaggacagagcagugcucccuguuuuugcagcauaagugcagccagcacaggccguucaccuguuuccauuggcauuuccuaaaucagcgucgucgcagaccgcuccgacgacgcgauggcaccuucaacuacagcccggacauauacugcuccaaguacgaugaggccaccggccugugucccgauggugaugaguaagugggguuccgguggguggcucauggucuuuccucaggauugguguugacucucugaucaacagguuuuugagguuucugguuuuuuguuuuuuugagacagggugucuuuaugaaggccuggcuguccugaaacacuguauguagaccagacuggccucaaacucauagugauaccugucuuggccccuuaaagugcuggcauuaaagguguaugccacuacacuggucuccuugcuucuuuuuaacacccacuaccuguagagggaaccucauuuuuauucaagacuucucggggucaguagaguagugugcuugagggguucccuguuuguaggcuaguuuccuaaaagaugauguauguguguuguaggugaaaaucuuugguaauucaaacugauuuugauucacuuaccaccccaccccauccaaugcucuacuuuaaaacuggcccauguuuugccagccaucugauuuaaaacgguuuuguguggucaguuguaagugugucauguguaacauguaaguguggaauauuuucuugcuuauguauguauuuuaaagaagaguagcagaacuguuauucugauaaggauuugugaauugauuuguggacaggagcccgugaucugcuuauguaggcuaggacucuuuaacacugugaugcguucugcucauuuguaguuguuuuuuuguuuuguuuuguuuuuuuuaaugguaggaaaguuguuuuauuugcacguugucaguuauguaacacuuuuggauuuuaauaagucaagguuuuguuuggguuaguuuauauuuuacaaguuuccuaaugguguuaugaacagaugucuuucuuugugugcaugugugugcuugugugugcaggugcagaguguggcggcucacgcgccagugcguacacacacgauuggaguucucagguuaaccuuacaugcuguucucaccuuauuuuaaaacagggucucucacuggccuggagcugguuaaaucggccagacugguuggccugccugcaggugccaggggccagcugucucugucucccuagcauugggauuacaagugugugccacugugaucagugguuuugucguuguuguuuugucuuguuuugucuuuaaucagaguucuggggaucagacucaggucuuuuugcucucgaggcagguauuuuacugaugggcucuuuguccagcuccagacaucuugguuuugaaauaaugaagacagagaaaguccaagugagacuuuguguucaaagggagguggaaaauaauaucaggaggugcuaaguucuuccuuugggcaguuugggggugugggguuagcuuccuguccugaggugaaguauuggucugucuguuuuugguuuugguuuuuuugcccccacccccacccccagacaugguuucucuguguagccuuggcuguuuuggaacucuguagagcaggcuggccucgaacucagauccacaugcuucugcuucucaagugcugggauuaaaggugugcaccaccaccgcccggcuaagauugugcacaugagcguucaggacaaagacuggaggaucugcuagcccucaaguuacagauaguugugaguuacuuagugugaauucuggaagcucagcuuggauccucugcaagagcagugcaugguccugacugcugagccaucucucuaaccccaaccccucacagaaagguuuuaaauguauauauagcugcuguuaauguagcuugagggccaagcuagauaaacaguguagccugcugagcuucaguuacagugguauagagccagcaguauaguucagugagcaaacaacauuuacugccaagugaagauugacuuaaacuuaaugacuuuaacuuuaucucagggacucgcauaguggaggaagaaaacucauacacguuauccucugacuccuguacauauguuauagcacauaugcauguuugcacgugcauucacacacauacuaucuaaauacauacaauguauuuauuuuuagaaguagccuuuaguccuggcugcucuggaagucacuauguagaccgggcuggcuuugaauacacagagauccaccugccucugccuccuaagugcuagauugaaggugugcaaccaccuaugguauuuagucuaccaaagcugugcugcuuacauccucuugaacuggugguuccuuuaaacauguuguuagaagacaggugacugucuggcugagacccaggcucaguuccuaguuuuccauguucuauuggucaccuugggacugcggcuaccugagccuggagcuggaagacaggaggugaaugaugccagccuugcgugcgccaccacgcccagcccccaaugauaaucuuaauuuguaaaaagaaagcauguuuugcuaaaggguuggcucagugguuaagagcacuuccagacgacccggguucaguucccagcaccugcgugguagcucacaacccacuuaggacuccagauccagggaaucuugacacucuacugaauucugcaggugccaggcacacacacauuagacagagaaacaugcagauacgacacuuaaacacauauaauaaaaugaaucuaaaaaucagucaugucucagacaguuugcgguucugaaacucaguuggccugguauuggagcaugucacagcugggcacccacaguguguccguucuuccuggaaugaagugugcugcacucaguaucaccuacagcugguccuccuuagcuguguacaaaugguaaugaaccacauacagucagacauguuaacugacauucugugugucugacacuucagcgucaggggugucucagggaagauuuuuguuuguggcuucucuggagcacauggaaugauuugccccucaggaagcauuugacaggcugccuccacugggagucugugcuuagugauuaccgagggcuuccccaucacugcacaugugggauggguggaguuuuucuuccugaauugcacuucuggcucaugcuggguugccauaggaaugauaaauuagauaggacccuccagaucaaugaugguggggcuuccccuuuauaucagggucgugaauuuauuuuauuuuacuuuuugcauagguacuaccaagcaauuaauaaacacuuauuguaguacugaaguaaaacccggguccucacgaaagcuaggguuaaccuccgagccacaugccuggcccuacaaauaaauuauuuuaaaacaucgccguuucucagaguaaaggcccuuuaaccagugagugguagagugagcacuugguguucuugauguggggucaucccggggcuccggaccuguuccaggagggcagcacuggagagugucucugugggccucuucuuucuauccucgcccuuuccuucuggcuuuccuacccucccugaccucaaugaccuccuccuucccucuuucaucucucccuguagaguucucccacuucucccuguggacacacccucuuugggaaagcuugcugucaaacagucucaugguuaagauucccagucgguagcugucuuaggguuucauugcugugaagacaccaugaucaggacaccaugaucaggcagacauugccuugggacuggcuuacaguuucagagguuuaguucauuguugacauggcaggaagcaugguagugugcaggcagacauugugcugggagaaggagcugagaguucuacaucuuaaccuguaggccgcagaaggagaccucagagcccacccccacagugacacacuuccuccagcaaagucauagccccuaauaguaccacucccugcuggccucugggggccaguuacauucagacuaccacaguggucagcccuugcugccuccucccaugauucccuuucagccuguccuuugguagcucuuggagcccuacaaacuacuucacugcaggauuuggcuccaaaggguacuuccugcuucaucccauccuggcugacaacuugcccuuuguucuggugggcauaaccuuuuccuaggaugggccuugcaugauagcucugggucguguguggugggccuugcccccgugggaauggccugcuuaguuaaguuagcuggcuaacuagugguggaucugucucccaagcccauuaggcagcagcuagggcaguugauagaguuacuuucaucucugugcacguccagcacuggugcucauagggcugcaagcagauucacugucugugucucugucugugucucugucugccuaucucuuuuucuguguuuucuugagacagggucuuacuaugugacuuuggcugacuucagacucacagagaucugccugucuccugucucugccuuccacaugcuuaaagucaugugccaugacaaccaguaccucucuuuugagguaguuucugaggaggagaaugggacugguacacaggcggaagcucuccauucuuaugggaggccagguguggcaccuccauaugaucaggugcacauuacuugguaagguuagguguuuuggguaugucuuccugaacuacagcaggcaaagagucuucuagggggccaggagugugucuucaugguuguuuggauagggaagauucacguggcccccacugcgugccugcuauuuucugacuuaagcauugucccuggccauguagcuggcuaaaagcuuccaucugucuuguuuacacggaaaaauuggacucagaaauuugauggaacuuugcugugaguuugguuuaguuugguuugaguuuguuguuguucaggcagguuuucacucugccacacaaagugggcuuaaccuuuuggcaguccuccugccucagcagcugugcugcuggaauuauaaaugagcucucacccggcuuguuuugccuuuucugagcagcaggccucauuucccuacuugguucaugggcaguccaccccaaccccaacuccuaaggacacgugaggcaucuggggacagagauguugucuagaugggcuucuggagcagaggggguguuuuucauuguggcuccugaugaaacuuuguauuggucagugaucuguugcugugaugagauacaaugaccacagcaacucuuacaaaagaaagcauuuaauuggggcugacuuaugguuucagagauuuaaucuauuaucauagcaggaagcauggcagcacacaggcagucauggugccgggaaggagcugaguguucuacauccagaucuaaaggcaacaggaagagaaaucguagccuuggcuuagacuuaaaaccucaaagcucacccccaguuacacacuccuucaauaaggccacaccuccuaaucccuuuuaagcagugucacucccugaugagcaagcacucagaugcaugagucuauggggacuucuuauucaaacuucaccuuguuggcaacuuguuggguucuauuucucuucuucuccuccuccuccuccuccuccuccuucucauccuccuccucuuccucuucuucuuccuccucuucuuuccuuucuucuucuccuccuccuccucuuccuccuucucaucuuccuccucuuccuccuucucaucuuccuccucuuccucuucuucuuccuccucuccuucuccuccuucucuuccuccuccuccuccuuccucuucuucuuucucuccucuuccucuucuuccccuucuccuccuccuucucuuccuccuccucccuccuucuccuccucuuccucccccuaagauuuauaaauuuucuaauuuauuugcuuuuauuucaugugaauugguguuuuccuuauguguauaucagucaguauaaggguauuggauacuuuguaguuuaaaacacuugugagcugccauguagguacugaggauugaauccagguccucuggaagagcagccagugcuuuuaaucacagaaccaucucuauagccucuugauuuccccuccccuccccuccccuccccuccccuccucuccccuccccuccccuccccuccucuuucuuucucucucucucucucucucucucucucucucucucucucucuuucuuucuuucuuucuuguuguucuuauuuguuuuuguuuuuguuuuuuuuuuucaaacaaaggguuucuauuuguagcccugccuguccuggaauucaaguuguagccuaggcuggcuucaaauuuagagaucugcuugccucugccucccaagugcugggauuaaaggaguggcccaccaccacccagcuugguuuuccguucuaauacuuagagcaucgagucuugucuugauggcuguggcaugcaguucuuacauaugaugccugcguggaaggacccuuaugcaguguuucauauacagaccuaugggagagcaguaguggagguguguguuuguaaucccagcacccaggagccagaggaaggcagagcucugugaguucaaggccagccugauuuacaaagcaaaguccagggcagccaggccuacauagugagacccuaucucaauaaauaaauaaauagauaaauaaauaggaacacuugugaggccugaggccuacauagugagacccuaucucaauaaauagauagauagauagauagauagauagauagauagauagauagauagauaaaauaaaaaggagcacuugugaggccugaggcuugugugaaagcuagccuccuuguaaguugaguguguccugcaaacuugugcgugaguggaagcaugagcaugauggcuggagaacugcauguaggagccgugcugccacuggcuuuggagggagcauaugcucuuaguggcuccaggaugcucaggguaauggaauuacaauccaagcacaugcugggauaugcaagggacucguguaaaacgugcuuccaaggcugcagauucuaggcacugagcucagcaagagcuugcuugccuuagaguagagcaggggccagaggaggugacaggaggaaacuccugaaagaugucagcuuggaggacagagacaucagcuuaaaauauguguaguugugaauaaauugcaucuuucaagaugaagucucuuggaggaugucccuggaaggaccauuuggcuugucgaaugucccuguguuuuuaugugcaguaaucccugaggaucucuuuugggagauguccucugcaugccaaagccagccaccgugagcuuuugaguuaaauuaauugcauugaauuaaauauguaaaucagguuggccuugaacuugcaaugucuaucucccaagugcuugagacuaagacaugcccauaaucgaggccguucuuuuugcauuugguccaaguucaacuuugaggucguggaguagugggcaguggcugccuggcugagcagaaaagagugccagguagugggagugcgacuguccuagggagaaaucucagccugugcucugguugccauggcaacgguccuagagcaucaaggugccccucagcacaaggguaguuaaguugucucugcaauguggggaccucucuagagcccugucucuuuggagugauguuuuucugucccccaucuucucugacgggauggcaguuggaaugaaagacugcuagaguggaggcaucccuggguacugcacagguagaugugggcugcaguggaggcgaggucauucauucuguuugaggacuugucuguaguauugucuucaucugucucauacacaugcgcaugcacacacacaggcgcgcgcacauucagugugaggccucuuuguuccauucuccuguuucuguagguugcuuaugacucuucugggaguauauggucuugagccuguugugugauugugacaugacauugcccuaucucuuccuguuugccccagguccagccuuggcuguuccugaccaggucuguggcccuguuaaucuacuaagacuccuuucccucauuccuggaaggcaucaggaugugggcccaggggccacccccaccuucucugauaauaacuugucagaaagaggacaagccugugugcauggcaggaaugcacauuugagaauuuuauucagggcuaagaguguuaguccacaccuuuaaucccaguacucaggagacagagucaggagaucugugaguuugaagccagccucaucuacauagugguuccaagccccacagaucuauguagugaaaucuugucuaaaaaaauuuuuuuuuaauuuaggacagaugaaguggcuuagauaaagguccuugacaccaaagaacauugugaauuaaguccuggaaauaacagacuuggacacauacagaaaauaaacaauguaauaaaauauuuuuuagaaauauuuuauuaauuaauauuaguaaaaauuuagaaauuaaaauuuuaauugaaaaaaauaaguaaaggccaggccuaguggcacauaguggaguuauaucuguaauuuuggcaauugaggguuagagauagaauuaggaguucgaggccagcuugggauacauacaaccugucucaaaauacaaaguaggcaggaaacuuuaccuuccaguuugagagaagagaugggcacagcuuugacaguugcuugcuucuucuguaguguagcuccuagagacagugagaucucccuccaucauuccugacugugugcuggcccuuuagugcuuauuuauaaucagauuaaaguuucuuggagauacuuuuguuuuaaagucagcaaaggcgggcaggggcuuuaguucagugcucagagaacuugucuaguaugacugcagcccuggguucagucccagugcuuccaggaaaaaacagaaaacauugacuuaaaguuaccucaacaaccauaagauuaaauaaaauaaaaaucuauaaagaagucagacggugguggugcacaccucuaaucccagcacuugggagggaggcagaggcagguggaucucugaaguuggaggccagccuggucuauagagagagccuguaauuuucucgagagucaagucucugucuuuaucugaugucauggauuuuggcacagcaauuagcaguaauaaggauaaugucuuaguuugcuuuucucuuucugugauaaaacauuuugauccaaagcaguuucggggaggaaaggguuuaucuggcucccuuacaucacggccaucacugagggaacgagggagcauaagccgcugaaagcagccaucccagaaaaacucugccuacagucuugcuuucuguggcuugcucuguuugcuuuguuuuucuuuccuguuuguuuguuugauacaagguucagaccuggcuguccuggaccagacuggccucuuaacucagagaucugccugccucagcuuccagagugcugguguuaaaagcauacaucaccaccaucuggcuuaguuugcuuucuuauacaauucaaacaugcucagggucggugccucccacagugggcuggauccucccauaucaauugucaguccaaaaaaaccaaaaaacccucacagguuugucuacagggcaguuugauccaggccuuuucuucucucuuuuuuuuuuccuuuuuuaucuuuuuuucuuuuuuuuuuuuuuaaagauuuguuuaucauuacaaauaaguacacuguagcugucuucagacacaccagaagagggugucagaucucauuacggguaccugauuacccuggcuugugucagauugauaaaaaaccgaucagcaccaguagcagugcacggugugaaauacggaaaggucgcacgcacgccucggagcuaccauuuuggccagcagcuuauugugaggugaaggcaaauagucgcuuugaugggagccagugguuuucgauguguguuucagauucgggcugagcacuuugcggagggugguagagucggggacagguacuuguugaguagagucauuucuagucagagcagaccuuggugugcaagaauguagaagcagcccuccacaguuggcagugggaagccgacggagugcucagucugcuaaguccgcgagagcuagucaguguguugaucccucugcuucccagaugcccuuaccugcaucgaacaacuggggacacggagcgcaaguaccaccugcgcuacuacaagacaggcacguguauucacgagacagaugcacggggccacugugugaagaacgggcugcacugugccuucgcacacgggccccuggaccuucggccaccugugugugacaucaggugaguugguguuuaccuaggaaccagcucacccaccgcuacuuccggcguuauuguuucaaagcaucucuuucugagccugcuuuggggacaagaucuccuguguaucccacacuggccucaaacucuguuuccacuugucacuccuucugaaguucuaaggucacaguuuggcaccacacccaauuuauguaggcuagggaauaaacccaggguuucaugcaugcuacgaaagcacacugccagcugaguuccgucgguggccuccccacguguucucagugcacccuuguguauugugagccacaaaaugggugcagagguccgaggcuuucuguguacaccagugguucccggccuucuugacacugccacucuuuaauccagucccucaugcuguggugaccccaaccaucaaauuauucucagugcaacgucacagcuguaaaguugcuacuguuaugaguuggaguguagauauuuuuugagacagauuugccaaagggaccuggacuagacaggcugagaacugcuggucuagaaagcugcuucccgagcucacacuuauaguagccuaacacaugggaggcugagucaggcucagcugccgugaguucaaggcuggucugugauguauguugacuuaguaaacauuaggacauucugagcuacagcugagagagcccucuucuccaaagacagacagacagacagacaggaaugugguuguguacaccuuuagucccaguacuugggaggcagaagcaggcaggucuccuuuaaguuuuagcacagcccggucuacauagcaagcucuaggacagccgggagggcugcaucgacucugucuaagggguggggaacuggggcagaucuuuucuaaugaaccagcucuacaguuccaguuugcgauagaacugcugucagaagacaaggcugcugggccugcugcugcugcugccgccaucuagcucuaaacccucagguaguguuagugaggugacagaccaaguggcucuggagccauggauucugcuggcuugccccaccuccgggaacccucgggcuauaacugcuguacugugcuguugguugcagggagcuucaggcucaggaagcccugcagaauggccagcucaguggaggggaugguguaccugaucugcagccuggggucuuggccagccaggccaugaucgagaagauucuuggugaggacccucgguggcaagguaagccugggguugcuggaguccuugcaggggcgagccauggcuuuucuccagguaccugcuucauccgagaguucuuacacuagagaagaggacagaugggaaagucagguuucucagcccacugcuaaccgugagccauuuaggaaacagguggccaagugggauuggaaccuagccgccuggucccagacugugcugagccgucacacuaccuugguggguaguauugguugguuguggggcugagggaaguauucagggcccacaacaacuuggaggcggccugugccagcgcacuguauauuacauguaaaauaauagggcauguaaaaaagauaagguaggaaugugaaaggaagaccucuggcucacacaugugcacccaaggaugugugcgcacacacgcaagucaccaucuuaaagggagcaguuguguuacauuagguacauucacagugugaaccaacagagcuaccuaagucuagaacauucucuucacccugaaaggaaauuccauauucaaggguagucaugugcgcccaucccuuuuccucauguaccacauggccugugaaaguguuguuguuguuguuugguuuuucugagacaggguuucucuguagcccugaccauccuggaacucacuuuguagacuaaacgggccuuaaacucacagagaucugccugccucugccuccccagugcugggaucauggauguccgccacuacugcccaacuucuggguuuucuaguuuauaaacagugcuuccaaauugcagauaguccagcugugggucguuugccugcagucuuccucucucauuggauaagaugaauccagcuagaggccagauccauuagcagcauggcugcggagcuguucugacuccauguuuuacugugauccuccauugugcuguguggcacucacacugcacgcucuucauugccccgccuggcugggugcugauaaguuguggcuuauuguaacacuauagguuuggggaaaggagaggggaugccacuuucccagucucucuguuccacagggagacuugcaguggccugucccaaagucagggacaggguguaauaaucaaccauaggacagaguggcugcagccuccugucuggcuuugugucuugugucagccuucugcgcuauucagcagccucccugugagcaugcucugcucgucuccgagcggcaucugacccagugccacgggugggaggcgagaaccccaugucucuggaggguagauuggauuuggcugaauaggacaaaagaaaggaagugauuuuuagagagaucuuuacucauguuuuuguuuguuugggguuuuccuuuuuugacaaagggucucacuguguagcccagacugaccuugaacucagagauagaccugcuucuccagugcuggaauuuaaggugugagccagcacagccagccucaaaguuggggugcuauuguuguuauuuuguuguucuuuuguuuugagguagagucuuaugauguagcucuggcuuuccuggaacucaccauguagaccaggcuggccucaaacucguaaagauccaucugccucugccacauaaaugcugggauuaaaggcgugugccaccacgccuggcagaauuaaccauguuuaggcuggaugugauaaagccacuuugugagucuaguacucaggaggcugaugcagggugaucaugaacucaagaccagccuaggcuagauacuaaaacuguuucauagauuggaugugguuaguauauauacaccuguaaucuuaugucuuaggaggcuggcuuugagcaggauugcaaaaucuaggccagcuugaacuacggagcaaguuuaaggucaguccgggcaaugaaugggacuuucucucacaguagagaguaaaaagagcuggggaggggcggagggggggggcuugggcucgggcuagaccgcuugucugggcguuagguccccggcucaucuucaguacagccugagcagaagcuuggugacucacaccuguaaccacagcacuggggaggcaggcacagggcauuaaguuugaagcuagucuagguuauguguaaccuguuuuuaaaaaagcaugaagauuuuuuucccccgggggcuggagagaugauagcucagagguuaagagcauugacugcucuuccgaagguccugaguucaaaucacagcaccacaugguggcucccaaccauccguaaugagaacuaacacccucuucuggugugucugaagacagcuacaauaaauaaauggcagggccggagugagcaguguugaccaagcaaccaaguggggcugaccagagggagcagagguccagaaaucaauucccagcaaccacaugauggcuggcaaccaucaguacagcuacagugcacucacauacauuaaauagauagauagauagauagauagauagauagauagauagauagauagauagauagauagaucuuuuuuuuuuuuuaaacacccccucccugccccgccgccuccccuagacuggguuuuucuguguagcccuggcuguccaggaacucacucuguaaaccagccuggcuuugaacuuacagaucuaccugccucugccucuugaguacugggauuaaaaggcaugugccacuaccacucggcuaauguuaaguauuuuuaaaaguaggaauuucgccgggugugguggcacacaccuuuaaucccagaggcagaggcaggcggauuucugaguucgaggccagccuggucuacaggacagccagggcuauacagagaaacccugucucgaaaaaccaaaaaaaaaaaaaaaaaaaaaaaaaguaggaauuuuggaggcuggagagguggcucagugguuaagagcacugauugcucuuccagggguccugaguucaauucccagcaaccacaugguggcucacaaccacuguaaugggaucugaugcccucuuuugguguacagcuacaguguacccauauacguaaaauaaauaaaucuuuuuuuauaaaaaguaggaauuucuucuccuccuccaucaucaucaccaucauuagaggugggagugggcaugcaagugcuuggguagaaaccaaaggacaacuuucgggaauccguuuucuccuucuauugugaguuccagagauugaauuugagcugccagguuugugcaguaacugcuucuaccugcugagacuucucaguggccuaaaaguauuuuuagagcaguucuguagucacagcaaagaggaggagacccagauguucccugugcaccccagccuuauugacagaguucagaggacaggccugcguuguccuguuguuacccaagcccauggagauggggcuuccguuucacuagguugguuuguuuguuuuauuuuauuuuuauuuuuaauuuauuauauguaaguacacuguagcuauccucagauacuccagaagagggcaucagauuucguuacggaugguugugagccaccaugugguugcugggauuugaacuuugggccuuuggaagagcagucggugcucuuaaccacugagccaucucgccagccccgguuuguuguguuuuuaugguaauagaaacagcauaagaaagagaagacaccccugagaauggagugugagcuggggacaagcauagucucaaaaaaagaucugugcuuuccugguuguuuauuugugugggggcguggauaugcauguggggggcaaguguuugugcaugugucucacacuuucuccucaugcauugauacggaggcugcauacccauuuggaguuuacgugaaugcuggggauuugaacucugguccucaugcuugcccagcaagugcuuaaagccacuaagccauccccucagccuaucagugauuuuuaauuauggucacauacuaaugugaccagggcuugauugacauuugauuuuuuuuuuuuuuccuuuuugagacaggguuucauuucaccaaggguagccuugaacuugccauguaacuaagugucuaacuugagugucuguuacuucugucuguaccucucaagugcuaggacuacgggcaugggucaccgugcucaugcaaugaugggacuaaacccaagcuugguacacacuaggcaagcucucuaccagcugaguuaucuucucagccaguuccuaaaggaauccuaucccaguuaacagggcuucucucaucuccuacuguguacagugucuuuugggcaguccacaguacaguagcucuggcccuuccucgugaaugaaccacgguugcuuaccuacucagugguguuggauggguggcuggcuguacuuugggcugcuaugccuaauguuacugugaaugcucaaggccagguuuucuugcaucuguuuuccagacaguaacuucguauugggcagcuauaagacugagcagugcccgaagccaccacgccuaugucgccagggcuacgccuguccacacuaccacaacagcagagaccgccgucggaaccccaggagguuccaguacaggugggcugggggacccacaggcaggaugacccugagcagucucccugguguuucccaucagaaguccgcuccggcucuagagagauacucugcuguagccacuggccuuagggcucuggagccccugcugccucccuuuaccugacagauucagggccaugaggcuucuucacuucuuugcagaggugggaauuuuugacuauaagcccaaacuggcaguggaagugcacccccaugcuagggaggggagcauguuccaugcgguugucauagagaugcucacucuuauguucucauugaggauguccugcucagcagugcugucacucacaggcaaggacacugucuuaagggacugggcuuguuagagacgaaagcuugaacaucuguugcucuguuuguuguaggggcgagugagguuucugcccucgggcauggugguucucauaguccucccacuguuggcccuguuagugauggggaucuuagcugggcacacgccucucuggccuguccagcaccuuguguguuuuuauuggcacuucugauaauauaccccccuuguaccguguaccacccugucaggaacuaaaaggggggcccuggggaagagggggaagggaaagacccacaccccaccagaguuccaccuauucucugucagucaggcuugggaaggcugccauacaccuuccacucagccccgggugagcauuuaagccucugacccacucuucggcagguggccaaaggggcagcccuaccugggaaccccggagcuacuuugcuuaagccaccaggguuaugggagagagggaugagagaagagguucccaacaccgacagagugagcgcaguggaucuugacuggagcacaggaaggccuuccauuagaaagauuagggagauuagaaacggcucauuaggagaaagccuaucccauccuccaagcacagugggccuugaugagcagagacugucuaugguuuuagagcuuuauuguagaaaggcagggggaaagagagaagguagggagugagagagagaaaaagagagaaagaggaaaggcuagcaagaaagaguaagagggagagaggagugagagaggagagaagacagagagaggagugagggggugagcaugagggauaagaaguaagagacugagaaguaagagaucgaggugagggcugaacagcccuuuuuauggucuuuacuguugcuagguaacuggggaguuuagccugaagguuagaagcuuggaacauugucuacuugaguucuagccaugcuucucuugugggggguguggggggcgguaacuuaggcaggagccagaguuccaggagcaugagggaacgccuacuguucaugaaggugaauuaucaccuuucaggguucagaccucagcucgacuagagaccagccugucugugcauagccuaauuccccacaccacccugucacguaaggacugugcaccacccaaccaucaucccaccuuuggcuuuucugggaugcaaggcugacagcagagcaccgaguccuggagacuggguucugggggugcugagcuccuuacccccccugaucuucaccugccucuggguugggguuccaucagccugaucguuccaucagcccaucuuccaaagcaucauguacucugcuccagccaccccugucuguauugcuggccuccggagccuuuggguuugcagucugcacucacgguggcccagguccuccguccccacagauuuccuuacagccuauauuuuuuauuugcagaggccuacccucuucucuuuguaguaaccucauguccccuugagugccuagggacacuguucuccucauagacaaagguaguggauuugugacuucacugcucucagaauagcuucagggucaagagaccugaacagaaaaccagcaaaaauaauaaauggugcugucacuacugccuggccuuaagaggaccagugaauaucuuucuaaaaaagauggaaaaucggacaaagaaaaaaaaaugaguuccagagguaggaauuuuugacccuaaacccaaacugacggugaagcugccagaaagcaugggaagagcguggaauguggucacuuaaccuaagucucagauucuacuuggcugcagaaggcagagcccugggccaccucaccucaugccccacagugugucccugagccagcuguuccucgccccugggaggcgugacuccuaugguggacacucagguucaucccguucgccuuugcaucccucagggggggcauggucacuguaggcucauuugccagauucuuagcacacgggguaugcuuuucuguccuaggucuacgcccuguccuagugugaagcacggugacgaguggggcgagcccucacggugugacgguggggacagcugucaguacugccauucccgcacggagcagcaguuccauccugagguaggcauuggucagggccagacaggacuacuggcagcucaagaggggcuggcugugugugggauccucacuggaagggcauguaggacucagaaacgccacaugcuaugagauguauuaaaucagccuuggaggaguuagggaaguggggugggagcaggaagacaggaaggacccgugaagugaaaacagcuucgccucccagacagggaguauaaccaggaagggacaguugucacuagagaguucccaccacuccccuggcacuggcugcccuauuucuaguaccuacugagguccagcugaucgaguguagcccacagcuccagccugggugcuaugugaguaaacugccugucccugagcaacagacuuucaguagugaggauguucagggguucaaaggucaccacauagaugggaaggacuguccuguggaauauucuagauagguguuuggcccauuccuuaugaguuccccuuggcugcucagucauccaaacagaaugcauucagauuugaauuaaaaugaaaaaguagggggaggagauguuugaagagggcugcaaucuagauguaaaguaaauacauuaauuaauaaaagaaugaauaagcagacaaaauguccuugggcaucuaagucugcagguaguggggcuaggcuaguggaacugaagggcauagcuguaugcaggcauaagugugcuagugcaggggcuguugucaugcccucccugagccuuuugaguggguaguguuguuuugguaucuagggaauguuggcuccugggugccagucuugucuucguucuuucccagguccccauggugaaguagugggcagucuggucguaagauaggugcuuguauaagcaccuaucauugaacaggcauugcucgagcuucugcugucuaccagacagacaccuuuccagagugucaaguagucuuugccuggcggucugacagacagacuuggcucugaccaauacauuuugcagagcggaggguuuuuaggaccaagggcaucuaggggcaaaugguaugguggccaucugucuaucacuagaaaggaaaggguuguguagcucaaagauuuggagguucccagucaugaucacaagcauaucucauaguuacaggggccuugcacuaggcccugccuugucaccgguccagcaucuucuggucuaagagccaggccuucaugagcuuuuggagacacugcagauuuguucugcagcugggaagugcucacucacucuguuugcuucgguguucuaagcggccagcugcgcuucauagaaaacagaucacuaagccaccauguuuugucugauuuccuagaucuacaaaucuacaaaaugcaacgauaugcgccaaacuggcuacugcccucggggcccuuucugugccuuugcacacacugagaguaaguagacgaucuucaggggggugugggggagggggcaccucagccaccauguggccaaggagcucacucagcagcuccacagucucacagugaccugggacuaggcaugucugggaauccuguauauaaugcccguugagauggcuggggugggggcagggagaggggagggcucaugccucauggcuggaccugccuugcccuuugcaccugggacagacuagaccugugaugcuugaaaggaccccuguccccggccuccuaggucccaccugccuccuggggauacggaucuguugucauucucgugcucaccugcuuugcugcuguccugcugggacugagugucaguggcuuuguagagucacuuucugucccuguagcuagaggugccaagauccuuaguugggcuuggccagcuggccucagacccuacggucauuuauugucacauaggcucauaauugauucucuaaagcugcucccccagcucaggagucugaguucuggugguuauaaagcaguugcaagcucagacuucauuuucuguuccaguuggaguggcagcuguuucugaucacacuugacauguuguuguucauguuaaaaaugauugaacccaaauagcacuauuuggggcuagagagaugguucaguaguuaagagcaugcauugcucuugcagagucgagagcugaauucccagcacccacaaccgcuagggaaucaaaugcacacucagggacccccggagcaccuguacucacaugcacacauccacacagaauacacaccuuaaaacagauguaccaaccauugagccaccucuccagccccuaaaaagaauuuuuuuuuuuuuuuuccgagacaagguuucucuguguagcccuggcuguccuggaacucacucuguagaccaggcuggccucgaacucagaaauccaccugccucugucucccaagugcugggauuaaaggcgugcaccgccgccaucaccacccagcaaaaaagaauuuuuuauuuuaauuucauggcucugugugggcuggccugccacccagaacaagggaagugguuacaacaucaaccgguccucuccaccuguccugugggccagcuggcggccccucagugccaguuucucuuuuuuuucucuuggcagagagccuggcuauggugaacgaguggagcugccgugaucucaguuccaacagcaccucagcuuauagcagccagccuggaaguguaaguggacacugcuuggaucagucccacugaggggacaggcauggggugagguuugggugguguggcugaaagcagccuacauguggaguugugauuccuccucagauagucuagaaaagucuugccugggcuggagcaggacaucaugccccugcugcacugcuuugugggauucggccuuagcgggcaucuggugccuugccagcccucgacuuggcagaucccuugggcuguccguccuaggcaguuggaggucaucaacaagugguaucugaugcagcaucucagucuguuacucggcauccccaugcuuugggugaggggcguccuguaucugaugggugugaugaggauggaucguucucggacugagaagucacuuccuguucgugccagagucagccacuagaguaggucccuggggagccaucccaggauagggacaggauguucaaaaacggauuuaaaauagcauuugguucuaaacaguuugugugacauugacguaguccugagguugcugggcagugugguuuaugcccagcauucaggagguggagguaggaggucucugaguuugaggacagccugguuuauaaagugaguuccagaaacccugucuuaaaacaaaacaaaacaaaaacaaacuauuaaaaaugaggggaaaaaaagaagucucccugaauuaguugaacagagccgcucugcucagcucaugcagucagggugucgcugcacuugguugcuaagccacuguuggacccugagucuguuagggcuccugagguucuguagguguuucuuuguggucuaggguuuagucacuuuuguucuuuggcccuucugccuaggauggucuucucuggcugguagggcaggcuccauauguguucuagguauggcaggcauccucugcugcucucggcucaggaggccccagucugugaugcucuguugcuggugucagugagcucucccgagagucccucucucucugagugaggguggaggagugccuguggaugagucaucucuacauucuuuccugcucugggccuggaacccugcgggcacucuauacucagaacuuuccacgucucuuggaauugucacaaaacccucacagggccacuugaaaugcugggagcucuucuccuucaaggaggcacagcugggccugucuuaggguuucauugcugugaagagacaccaugaccaaggcaacacuacaaaggacaacauuuaauuggaccuggcuuacagguucagagguucauuaucaucauggcaagaccauggcggugugcagacaggcauggugcuagaguagcuaagaauucgacaucuugaucggcuggcagccacgaguagacuagauuccacccuguguguagccugagcagagcagaccucccacaaagugacauacuucuuccaacaaggccacaucuccugguagugucacucccuauagccagacuuucaaacaugagucuaugaggcuaaaccuauucaaaccaccacaaccucccuugggcaauucugaacagacuuagccuuggugcuguuugggucaagcaagagaucugcacacaccgggcggugguggcgcacuccuuuaaucccagcacuugggaggcagaggcagguggauuucugaguuugaggccagccuggucuacaaagugaguuccaggacagccagggcuauacagagaaacccugucucgaaaaaaacaaacaaacaaaaaaagagaccuguacacacccaggccauuuuguugaauaacuccuuggcuugguacaugugucaaggccugucuuucccugagugauccaaaugugggaagagcuuuggguaccagugaacaggaacuguguaaacacuuucucaguguuuuguaggguuguugguuauuguuuugguuuuuugguuuuuuuuuuuuuuuuuuuuuuugagaugaggucuuauucuaugaccuagguuggccucaaacucaacgaucugcccgccucagucuccuuuguaaugggauuacaagcccaguccagcacaccagcuccagcauuuucuaaauuguaaacaaaguguaggccuauguguuuucaggagaugucuccuugccuuucuaaccugagcgggucuucuauuugcaggccaaaaggaaagacucccccucugaaggaagccagaaagcuacugaggacagcaagcagguacagcaucgcauggcuuucuguuaggccuuucuguguccgcacucuacugcugaguuaagcccccagucccacugccuacuuguucuguaauuguuuucuuucuuuugcucauauucauguguccuuuguuuuacuguucaaaauacuuaagacugguggugacagugauacacgccuuuaaucccagcacuugggaagcagagcagacagaucucugugacuucagggccagccugcagagcucguuccaggacacaaagaaacccugugguuccccacuccccucacccugaaaauugugaccuaccuugaaaacaaaaucaaagccuuguagcauuuuuuuucucugggaaauauaggcccuugagucagcugcagcgacuguagccaaguguuucaggcagaggccugagcagcagaacucucuuuuuuuuuauuuuaagauuacuuuuuuuguuuuguuuuguuuuguuuuguuuuguuuuguuuuguuuuuuucgagauaggguuucucuguauaguccuggcugucuuggaacucacuuuguagaccaggcuggccuugaacucagaaauccaccugccucugccuccugagugcugggauuaaaggcgugcgccaccacgcccggcaagacuuacuuauuuuuauguauaggaguacacuauagcuguacagaugguuguaagccuuuucauguggucguugggaccucugcuugcuccagucggccccacuugcuaggccccugcuugcuuuggcccaaagauuuauuaauuauuauagauaaguacacuguagcugucuucagaugcaccagaagagggcgucagaucucauuaugggugguugugagccaccaugugguugcugggauuugaacucaggaccuuuggaagaacagucagugcuuuuaacugcugagccaucucaucagccugcaaaagaacucuuauuuccaauuccuugagguuagagacugagcuaaagguggggucaggccuggggccucuccugggcccacagacauguguacucacuggcuucacaggguuaucccuuggcacaugccuuuguccucaucucuuacaaggacagugaucucauuauaaccuacugagucuguaaagauucuuggguccagauuagguuacacccagaugucuuggucauaaggguucccacauguggauuuaaggggcacuguuuagcccauccucccauguucacgagccuagcuuguuuauuagaguggacaucaguggcucuggggagccucccaucugagaauacaaccugucuguguucacuaaagcucccuagcaauacccugguccugugaugggggcuucaugugcccuuaaccucaaggccucuucccuaaccaguuuagcuuuucuauguuaguucggacuaaguugucuguuuuaggaaacaaauuuuugucuugauacagcugccccaaugacucaagaucauuuguguuuccuuacgccauaaaaggauggugaccauugcaaggcaacgcaauccaugacuguaaccccaaaucccaggacuugguaggccaagucagguucaugaguucaaggcuaaccuaggccauaggguagaacccuaucucaaaauuaauaaguaaucaaucaaucaguuaaucagcacuggcucagaacuugcucugagugaauugucacuuccucuccuuccugugauuucugcuguccacacggagccagggcaaggagaggaggaggugaggcguucaugggucacagggacaggguauuaguuggggaaauugaaggguucuggaaacugguggugaugguguuugcacagggugggugcauuuaaugccacagaaggguauaagaaccagguuuugugcucuggcacauaaaaucccagagcuugaggcaagaauaucaccgaguuuaaggccaguccggguuuauaguaagggcgugucuuaaagcuuaaaaauaaagggcuagauggaacucagugguaaagagugcuuauguagugucuuaguuaggguuccugcugcuguggugaaacaccaugacugaaagcaaguuggggagaaagggguuaauuuggcuuacgcuuccacaucacgcuucaucacugaaggaagucagaacagcaacucaggcagggcaggaaccuggaagcaggagcugacacagagaccguggagaagugcuguuuaccauugccuugcuugucauagcuuguuuagccugucuuaguuaggguuucauuauugugaagagacacugugaccaaggcaacuuuugcaaggggcaacauuuaauuggggccuauuuaguucagagguucaguccauuaucaucaaggagggaagcaugucuguguccaggcaggcaugaugcaggagaugcucagaguucuacaucggcaaacaguaaaagacugaaucucuucaggcagcaagagucugaaaucugaaagcccacccccacagugacacacuccaacagggacacgcccacuccgacaagggcacaccuccuaaucauaccacucccuuggccuagcauucaaaccaccagagccugcuugcuuauaaacccaggaaccugccuagguauggcaccaccccccaauggacugagccuggagagauggcucagugguuaagaacccuggcugcucuuccagagaaccuggguucauuucccagcaugcacaugaaagcucacaccugucugcaaguccaguuccaggggauguaacagauacgcaugcagguaaaacaccaguacacauaaaauaaaugcacgucauuaaaauguaauaauaauaauaauaaggaauguccuauaucuagaaaaaaauuucaauuuagguucccuccuguucaauaaucuagcuauacauaaaaccagcuaucauaccuagcaugcgugagcccuaagguucaggccucagugccacauagaaguguguacuuaagacugauuaugagccagcuagguaguucaacagguaaaagagcuugucacugcacggugaccuggauuugaucccugagacccacaagguuaaaggagaaacugaccccucugaccugcacacaugaguauucauauacauaccccugguaaauaacauuaauacaaacugaguaguuaaaaugauuacucuuguccuaugguuuuggguuuuuuauuuuguuuuuuguuuuuguuuuuuugguuuuucaagacaggguuucuguauauagcccuggcuguccuagaacucacuuuguagacuaggcuggccuugaacucagaaauccgauugccucugccuccugagugcugggauuaaaggugugcgucaccaugcccagcuccuauguauauuuuaagaacaaaaaagaaaaaggaaggaaagaaggaaggagagagaaaagguagguaaugaagcugccucuagaggaggccugauaacccuugguggugucucucuggcccuggccaggagaggcccugucugccucucucuuuggaaacucuuagguugacccauugugguuguauauuugugaccauugugacuuuaagggaaaggacaugaugauguuacuaauuuguagggucaaguagucuccuggaacacuuuaccuaggggacagggguguguccucugcugguaugacuggaggagccuugucauagugucugccaagaaaacccaugguaccacaugcacugaugagagaaccccagaugugacuauccccuucacaucugggaaggaccucgacaggucccaguaccccagccugugugucaguucucagauggggcccuggugucccacaguccaguaauauugcugcuguacuuagaaugucaggcaaacaucccucagaccaguauguugaugacuuggcaauaacacugugccaacuugcaaggucucugcguucuuggucuaggguuuaaaguccagaaagugguuuuggcuuuguuauuguuguuaguuucaauuuuauuauuuuaucguauguauauggauuuuuuuaaagauuuauuuauuuauuauauguaaguacacuguagcugacuucagacaccccagaaaagggcgucagaucucguuacugaugggugugagccaucauaugguugcugggauuugaacucaggaccuuuggaagagcagucagugcucuuacccguugagccaucugaccagcccauggauuuuuuuuuuuuugucugcauguaugucuaugcacuauaugcguaucugauguccacagaggccacaagaauuggaauuacagaauaguugugagcugccaugugggugcuggaaaccaaacuuggauccuuuggaagaacaacuuaauugcugaagcacuaaagucucagagugacagagcacucugagauuuuaggccggaauucccuuuucuacuaaacacaguccuuugggggugacauguuccccucuuauuugggaagagguauguacauuccuagugguacugaacuuaggugaagucuggaguuuaagguaggcagguggagggguuaguagugauuaugacgcagaaugcuggccucucaauugucuuggaauggaccucagcuugacuggcugggcccacuguugagggugguagcugagagacagcacaggucccuacagcuucugugccuguaccugcuacccacaugauggaaauaccacuaaguuguugguuuccagaugugaugugugaucugguggucuacugagagcugguucaccucaugcugguaaccauuucuuuuaacccacggccaguggcuguaacuuguguccucucucuuugacccagguucuucugucacuccuggguauguggucccuggguacccuugugggacucaugagggaugugggggcccugguguuggcucagggaacccuggugagguccaggauucagggacugcuuuuucucagaucaagaguccuagguucagcacauagguuugauuguaauguaaguguccauuguauagagacgugcuggagacccccacgugugugugcugcuguguucccugaaucuagcccgggccuguuuuauaucaucugacuuguuuuaucuguugucugucagauggagauggugccaguuuccccauuuuucacuuuuuuggucucugauugggugagaacuggggaggagcggaggggcuccugggaggcuggggaaaagggugggcagacccccagccccugggcugucauguccuggguuuugugaacagacagacacuuuacagauaugugugucuaagugacagcggggcagccuguuauggucaguucgugcuagugagcacccucugugacaccugaacuguuggcugucuuuacauccaucuggggugucucugcugcugcuguguucccagcagcaccugcucauaucgcguguguuuuuuaacagaaccaccucgcuguguucucaguggcucacccacuggcccacagcauaagcuccaguguggcauccagccuggcguccagcacuggcucgggcagcuccucccccaccacacugccuacccucccugcccgugcccuuccacuggaucccgccggcaacacugugggggcagucauaggugaguccacacuuguuuuccugggcacgaccuuucgcacuggguuguggauguucaggcugcgcugcucuguagaaaagccagaggccucaugauuucguuauuucucagugugaaccauucagugcuguguggugcucaggagggcaggguauguggagcccacaucauauacugcacaaaacaccagagaaucgugucaaguggauucuuugacacuagaaaaugaggcuaggugagaaauggaacuagaaaccgugaugaccuaagagugagggguguugacagggccaaggggagagugguaaugaagccuggaacaggucaacgcagagcuucagaagcagccggccucaugcagugagggaggaccagugugguaguagcauggccagcaugaugugucagggccugaacaggagccaggagucugggcagaaaggccgggaugaguuaacagauaggcugagaccaaggggccugaggaacccugggcccugugcuugugagucgcucgcaggcggcaugcucugggcugcugcagucucuggucacgagggucacagacuguagugagaaguucgguuuauuuaaaaacagaaauguuaugggaauauguuuuuauuuuaaucucagguggaauauggggcuguuucagauucuccacaguagcugaguaugauuugccucgugcucucuagcagggcugugauuuugcucacugcagauaguuuuugcgagugugugacauuuggaauucuagggacuuuucagaggcuauauaaaugcuagagccccaauagaaagaaggagcagguuggccagcuggugguuggaugcuguuuguggcaguuugucagcauguucgaagagaggaaaagaagcaauuagauauccugccuguaaagaucaaaugugccucaaggaacugacgccuuaaccggcaggaagugggcuuagccuguggccacccucauccccuucguuuuccaucuccucucuuuuaccuuucuucaaaauggaguugaguuuuccagggcugugcccuuuaaaccuuucuguaucucugugcguccuccucuuugacuugcucagcucucugugcuaauccaugcuguguucgcaucuuuucuaacagguccugcucaauucugcacucuuuccucaauucucuuuguuguucuucccaucuggguuucuccacuucaucaguuuuaccuuuuaccuguccccguuagcuuuggacacagccuuuucuacuuuagaagaaaucucuuccucaucaucagaugcaagcauuucuuuaaucucugccuuuugugaaacgucauccauguuuguugcgugugguuuggggcugaaggucugcacgcgucaucccuuuccugagcugaaagccacccagcucugcucuuccucgccauucugugcucgcuagggccuaguugacccaggccugacuuuuuguuuuguuuuuuagauguuaauuguuuuuauuuuuuguauaugaguuugccuaaauacaugucucugcggugcauacaugaguugccuguggaggccagaaaaggaggacaauuggauccccugaaaauggaguuacagauaguugugagcugcuuugugggugcugggaauuaaaccugggucauugagcuaccccuccaucccccaaugccuauaucucacccuccuggcacuuccauccuaccacaaggucauucucucccuugugaccuugguagaaggucacacacagaagaauaaauggcauuugugguuuuagagauguggaacuaggaagauaagcccuguagcuuugggacgguuauguugccuagggacccagaauacagguguccauauugacauacaaguagcaaaguggcaagcccuaccuagaggacauacagauguguacucagcaucccacaagacagcucuauccauguagggcagcuagaguccuacauuggauguagacugggaaugaugccccagugcuggcaaagaguucccuucaccauccucaagggacauuaaagacagccguguauuacaugaggacuacuagggaaucuugggaguuggugaugugcugcugaggcuucugggaaagcacugugggcuuggcaccacugcagccugaggaggaguuuguuguugcaguaugugcccuuaguaccuuuccagccuugauuucacucaggauagacucugcucucccauucuaccacaggucacuugucuaaaucacugcauagucuguggcuaguguggccuccuccacuggaagaccugaguuccacagggguucugugugggucugucucaccuucugaagaacccucuagaauucaggcuuaucuugcagcagguggccauguaggcagugggaaccaccaccucccuguuucugcugucggguucagggagagaagggagggaaguuguguagguccuaggugcuguguccacaggauuauugcagauggacauuagaaucuagagacuguccugcaguuacccucaggcguuugcccacucccucaggcuccuugaugccaaaagaaugccgcuggccucaggaccugccagcugccuuuugccucugguuuucuagcgugacaguagcaaugggaaggaggacaugcagcggaagaguggugaggggaaguuagaccccagccggagcggcaccagggcaccacggccacugaaagugucucagggguucagacugacagcugccuugacuacagaauucuccuagccaucauuucauauggaauucauggccucagccacaaaggcaaaaagguggaaaaugcagcuuucauuuguuuugcauugcaagggauaggacccaaggccucaagucugcuaggcaccuguuuuuguuuaguguauuguaguugcugcuuccugguuaaaacagugaacgaacauuuucuuuccucacugcaaauccccucgacccugcuagcugagguaugugaaucuagauggguacuguaaucuccgugcuugagaggcuggggcaggaggaucacuuuuauaucaagacccuuccugucucaaaccaguaagguuccuaucccuagccuugccugacacgagggggcagugggcucucuucccagugauggguauccauggcuccuaggcucgcgguccuugucuccacccaauagccaaccugacccauaagcucccaaccccauggcgucggcccucgcucgcucuuuuuuucuuccgguuauagauggcuggggcugaggaggggguagaagggguagacuggagggcagugucuuugugggggcaguuuccuuucauuuaaaugaagccaagugcagggcuugcacauuuaagaggugcaggggcagcgagcgggcuccgcuucugguagucagugugagccugccuccgggucuugacuacggaggacucagccuaugagcgcucccuuccuuccaccucccgccccgguaucccgcccccccccucguccgcccucccccguccgacccccacccccaccccugugcgcgcuccgccccucccccuccuccaugagucagccuuucuggaaacccgccugcuuuugcacaccuugguaggcaggggcguggcuuggugcugggggcagggugcaaagcgugaguguguguguguguguguguguguguguguguguguguguguguguguguguggcgggggggugggggggacggggacggggacugcugcgcaccggcagggcgggcggcuggcgaaggcggagcgcgaaccaggcagguuugaauccucugugacagacagccggcccuggcugcggaggauaugagucagcauugacaguggcugcggcagaucccggucucgcgucagcccagcaccaaguugugggucgucauuucuccgcgcuuuggaacgagcaugcguccucccaccuugccaggugugcgucuucccccaccccggugcggguuccccagggggcuucugcccuauacucacauccucccucccaggugguguuucccuuagcgugcaucuacccaagugguagacccccuugacgcgagucuuccucugagaucguucuggucggccagcguaaccccaggugaaguaaccccagguaguuuucuuucuaagugcaccccugcccagguggaggucuuggugcacaucccaucagcucauuucccuucaaaaugcaugucccucagggugcauguuccccggaaaccauguaccucuuuaacggugagaucaugagaucuaugccggauuuuucaggcugcagaaggagauuaacucaugugccugcuuuuaguuuuuguuggugcugcuuacccagagcuccguggccccugcggcuuuuguuuuuucucccuuguugagugguucccacaguuccucuaacuaccccaguucaaaguacagauauacugguuaccggugcuccucuguucuguagcugcagauagagaagguuuccauccuaucuugccuuuaaaaccuugcagcccaugugguuugucacuucauaugucccugacccuagaggacugcagcaccuuuugaaugugcugugucauauugggaccugguggugccugggacaguacccagcagaucucugcuguugcuguuggggaccaagugacuuuaggucauuugguggugcuaguucugggucaggaggcacagccuggccuucaaacacuugggguuuauguaaggaggcuggcucaccuagauucugucucuaaguugguuccuccuuuugagcaugauucagaaguccuggguggaucaucugguuuagugagguuggagagaagagccugguggacuaggguguaggauaggucccuaaacaacacucacaagagugagguagcaccuuggaacccugggcucugaguuaaaggcggacaggggccagaggcuuccccagacaagccuuuuuuguugauaucuugcuggguuccagggccgaggcucaccaccuugugcuaagcuuggguuaggguugguugaagugcgguucugagcagugugugcuguguagugcaggggcugccuuagcacagaagauggguucccacuccaugcuuuucuuuguuccuuaguucuucaaaauguguuuuugcaacuuugcuggggcagcagagcagcgagacugucucucuccuaguuuucgcaggcuuagcugcagaggaugccagucuagacuggaacuccuagauggccccccugcuccaaaucaggucuaaggaugggcuggggccucugcacuaggaccagcagaggaggcuagggcagguaguuguauggaaguagcugaugaaggacuggggccaggaaagacccaccagggagcuuuggcuaccucccugaggcccucaggcuugagaggcuagaacucccauacaagacaagacuuguuccuacaggcuauaggcaguacagggauggccagaggguggaugauaggagccgugaacacugccuugggucuuagcugguguuggguugagagaaagagcugugcuuagcuugcuguuauggaagaagagaccuuuaagcaagccuacuccugggagacagcugcucucugcaacagacugagagaugagacccugggggaaggugugguacugugggcagccaucuaagacauggagagggaacacgcagugugugagauauccaccagagacuacuccaccauggcuuuagaccaacagagagucuguauuagccaucuggcaacucuacugcauguucaggacuaagugcagucccaagccuuucucagagugagcuguuugcuugcuuccuugcuugcuugcuugcuugcuugcuugcuugcuugcuugcuugcuugcuugcuugcuuguuuaagagaauuucacuguguagcccuggcuaucugucagggugggcuuuuaagcacaaaaaccacauccugaguugacacacuucagucagccagaggcagaacugcagaaaccagaagcagggugagcacauucggggacuuucccagaacuauggacuuugauaggugaggucuuuuuucucaucuugggagguuugaauuuugcugccuguccccugauugguauuucugucauagagucaguuagcaacaacagucagccagaaggagaacugcuaagaucuuagggcuccagaagcgaugaccuugcauaggccgcaaggcucccaaagagaagcugaaggagucgggugcagagaugugggcuaggucaggaagagggcgcucuguagaaacaaguaagacaagagacagagcuggacagaaggauccagaaggcaaaggaaagagugggaauugaggaagggggguaggaaccagcaaagguggcaacagagaagcaggagcuggggauguacguagagaagcaggagcuggggacguacguccugcccaaagccagcccagcuuggcaugcgcucacagcaagggccaggcagcucugugagugcagggcagggccuggaguccacaggacagacauggucaggggauguacccagguagggucccuuuguuuuggguuaaauuguaucuccccaaaaagaugaaucuaguuuaguaguagggaaucuaguugagugguaaaguauuugccuaggcugugugaggcucaaguugaguucccagcauuagaggacacauuguguccucauuuggaaaugggaucuugaucaucaaguuaagaugaggucauuagaguagguccugaugcagugguagugugcuucuaagaagaaacauggacacacauguaggguguaacaguggagacugagugagucaggacucauggagucccaugcccggaaagaucuagagccccaggagccuuggaaauacucccuaagccaacagaacgagggcaggcaggucugcacacuuggauuuugaacuugaagacugcaagacugugggaugaugaacuucugagcugaagcuacucagcaagugguccucuaucccuucagguccaggauacccaugguccuuaucucucugucccaggcuauguggaaguggcaacuccuguagcaggagauacuuaacacaagaaggaccucagaagcuugggcagggcaggggcccaaccuggagacaaacaggagucagaaaagcgugcagcaggaggccugugccuuuuacucagcguagggguggcggccugcuuucuuuccacuuugcucucugauggcagaggguuuuccuagcagcuuguuuucguuuuccuuguuauucucuucagucaguuaucacaccaaugccugguuccauguccucaggacaucagggauuacagaaguacauccugggucugcccuggacuuuaucuugucacugcugaccuaagccuaccugauguaaaaaggcuuucuucagcaacaccugucauuagggugcuggacccacggugcccagugucuaggcuaggccugccacccugcucauucaccucuugucgauuacacucaaccuuacugggauggcuugucuuugagagcgguugccuguguauucucucacccuggcuggcccccugaggaguggagaucucuacacggaguggagcucuggcuccuuggcugagugguacaaggaggaaugguuucuuuugggugcuuuagcauccuggcuucagugcccugaagauuccucuugagacucuuguccaagugcguaggccuuuucauggcucugguaaugaggggccguggcuaggucagauggcgcugggauccaauuguaacagcagcuuagggggaauaaguuuagaaacaccauaaguaagccccaggcugguccacucuggcucaagcaagcaugguaagguccacacagccacgagggguuccucaggaggcaggagcauccagcuccugcugcugcuucuuggggccacugagaggcuccucgauagaggugcauucugucuuugggucagguggucaccaugaggcugagcagugcucacuggucuuaagaaugagaaucagagagaccaggaaaggacggacgguguggcuggcuuugggcucuagugggcaccauauagguucccacaacucugaagugcagcuggggcuguaccaguguugcccucuggcucucucucucucucauuauagccgcuuccauuccaagccacuauauuccuuggcugcagcuaaauugugcacgggccucugccuccuucacuuccuggugggugugcuucccugcauucuuguccuggcuaagaugugucuggcucugugcuagguagagacucacccuugggcuguaggaguguucuggcccaccuaaaugucacugauugagcagugacaguuuuuccugaggauuuucaccugaagucccugauggacaugaccuagaggauguggugacgugcuagacagcuggagacaaacagugaucccuggaguuuuaugccgcccugauacagagagguguccuuacagucggucggcugucacucugcugugaagaggcccuucgucuccagcaaggggccugcaggggaaguuuggguuuuuguugauggugguuuuguauuuugaggugggcuagcuugcgacauuucaggcuaaccugaaauucacggucauucugccuuggccucccaguugguggaauuacaagcauaugccagcacauaugccuugaaguugaagucagaguuccuggggacugacagggccuuagcccacagugcagauaagacugagccauauagcauacauagacuucacagguguacugugaagagucaucacagauggacacagggacagacacaguggcagcuacaaucucauugcuucucagugcaggucccuccauauuuaaguuggacucugacugcauuaagaaugugacacaaccuacagggcugcuccuauaaccaguccugucccuccucccuccccucaguuggcugugcaggccauccagagugucagcuucuccacuacauguucccaugaauggcagcccugcuugggcuguggagguguguccuggucucauccugggccugaaacucacuauguaaacuaagucagccucaaaaugauucuccugccuuagcuucugcaguacuggacuuacagguguauucuaccacgcccagcaacuucugccuuugaggagacugucucggggcucaggcccuggucuuagguccucaaggugucaguccuaguguugaaccucacauggccucagaaccauuucccugucagauugaccuccuguaaaauuuuuaauaguugaauuauuuucuuggucaaauuuuaacaaaugguuagaaguaaaaggagaagcagcugggccucgugguacaggcugcacggucccagccuugggaggcagagggugagaggagcucagguccuccguggcugcagagugagcugagguuaguuaugagaucccggcuucaaaacacaaaaggcaaacaaaagccaaaccaggagaccuuugaagcugagcaucugugggccagagcuaugguggguguggcuguggcaaggcaagugugguuccaaugaaacgucucuagcuguggaggagaaagcagccuuguuggucagcagagugaccaugugcuaccuucggguggcaggguggcugcucugcucagcuaggugcaugcugguggguauggggucagagggucuuucagagagguuucaucuucgucacugagaagugaguggguaaugcccgguuuauuucacagguucugccuuagaucuucgucuuagugacauaaacaucgcguccuuagauaaagacuuagaagaacaggaccuuggauugacaggugagcgcugaguuagcugcuccuuagucucugugcaugcugccuggguuacgggaggcuuggggaaggcgucugcugggguccucuuacaaccuccuucuugccucugccaccugccuguauggcucagcuuccugcugcuuccucaguuuaccuuugugugacaaagcaaccccuuuuugugacuuggccagggccucucaugaggaaacacaaauuguuuuuacugcuauguggcauagagagagguuccuguuguuucaucauuuucuacauccugaaaguuauuuucucuguuucaaaagaaauguacccgucuuagagcccugguggcucugugagugcuaaugaguuccuggcucuaccaggaccacuaccaggacacucuugaguugugggggucugaugacugcaccccucugggugcuggccugguuccuauggugugacccugcccuuaggucuccuugguguuuagcugccuaguuacugaccuacaggcuuaugggcaagugguuccauggcagaagcccugccugcccuuguucacucagccucccuccucccaccaggucccaggucgcuggcaggcucagcacccgucaccauuccgggcucccugccccgcucgccauccuugcacucguccucaucccuauccaccuccccacucagcucgcucucccagucccugucggggccacucgucuccucggccaugacgcccccccagcagccaccaccccuccggucggagccggcuacgcugggcucugcagccucaucuuacagcucuuuaggugcgugccuguucgaggguccuggaauaggcccuguccaauccaguccuggguauuccugacugcaggacugucaccucuguaguucugugucuugagaggcaccacccacuccaaccuaugugacauagcggggugaacaaacauaucuaccauggacagcuggcugcccacagcugggcauucucacagcgcuccagaucauaaccuccugcuugccagcucacucagggcucucggccaggcaugcauggagccaccuuaggguccccacagcauaccugggauuuauuaugacauaggcugugagaggaagcuggugugacagagcagcgggacucugucuucugcucucacaguuuuacuaagaaguucuuuacauuuucugucaucuguuaugucucagaaugugccucucuggacguguccaucuuagcugcuaguuaacacacgugggcgcccucagaucuacagcucuucugaaccuccagggccggcuauguaaugagaacugcuagggcuaggaacucuaaaccuaacuuucuguucacucugaucuugagccaagugggccucauuuaggggaggcaguccggaagcugaggcuucagcagucacaagcaggugacuuacaggguaccaagguggguggucaggccacaagggauagagccaucugcagacaucucagcccuuggaugcagcgugggcuuuaucauccccguuucuccuaaacucaggucugaacggcguucccgggagcaucugggacuuuguuucuggcagcuucucuccuagcccaucccccauucugaacuccggcccuucggcuuccucaagugcaaguccaaacagugcugagcuggcacgggucaggcggcagcuagacgaggccaagaggaagaucaggcaaugggaagaaucuuggcagcaagugaagcagguaagcguggggcaggagggcugggggugggguaggcgggcugggggcggggcaggggagccuggggacgaccaggcauggcugucuccuguaugauggcuuggguuucaggccugugaugccuggcagagagaggcucaggaggccaaggaaagagcccguguggcagacagugaccggcagcuggcccugcagaggaaagaagagguggaagccaaggugaagcagcugcaggaagaauuagagggccuggguuuguccucacugccagggcuucagagcuugggugacaucagugacaucccucuccccaagcugcauucucuccagagcaagcugcgcuuggacuuggaggcuguggauggggugaguccugcccuguaguggcugucacuuuaggggagggcaaaggggacuagcuagugaggggccugagaccuggccagacauugcuucuucuccuucccuggcuccuugccuggacucugguuggugcuucucgaaugugucccauugaccauggccaagguccaacugccacauacuuuugucuccaaggugcaaccucuugagcguuggccauuuucagccacaggaucccacuuaguaccuauuguggguacccugcuuucagccuuucuuguggccagagugacucugcuucaggaccuaguucucugcaaacacacacacacccucccucccuggggugggggucaucucaagggaaagugucuccuacugacuguucuccccugugggcccuuggccaaguguccauccuaggccugucacuucacucaaaggauuguggcccacuguucugagauaccgucauuugauugaucuuacccagugugaccuacagagccucguaccuugacucggcuaggggcagcauaaagaaacaacacagggacacagaaaagcugggagcaggcaggcugugagagcucugacgagccaugcgacaaccacugaaacccagaaucuuguguuuauuaugcacaucagagacagccugaaggaguuagcucguguagguaggagucuguaggugagcagucucggacgucugagaggaggaaagcacaugcacuugcuagugugugcucacacuggucagcuucuaaacucauacuuggaccagaggaaggcuugcugauuucacagcugaccucuguugaaaggcuguggucacaucugucagcuguauacacccacucaggacgucacuuguucuacacauucacucaggaccgccuuggcuccccacacucaccaaccaccucuuccccacaggugaucuuccagcuccgugccaaacaguguguggccugccaggagcgggcccauggcacuguccugcggcccugccagcaccgugucuuaugcgaaccaugugcggccaguaccccugagugccccuacugcaagggccagccccuaccauggugaccagagccagacccauuccuucccuggugagcaguauaaaggccugggcaugccacgugccacuacagugucgaaacuugccucugguaccccacgccaggaugugagcucacacccacuguccaacagccuuucauauuauuuucuucccugccaugucccaccaucggugucaagguauuaucgaagaaccucugaagcaccaccaaacccacugccuguccccuaggcagguagcaugcuuuuggugcccccaguccugaggcugcuguggccaggccaaugggaggucgggccucgucaaagcacuuugugaaccgaggaauuagauauuauaaauuguauaagcugcuuucuagguccauguuuuuuaauaugcgauaacaugaagcuuuauaaguauacugugaacuugaaguuuccuaucaguuugugguugacucauaguaaugguaacuacguuagauuucauacucugaaacuauuuaggaaaggaacauuuaucuaguagugaagcacuagaauuuuuacauuuuaaaauuaagugcaaacaaauaguauuuauaagcagagagugguuauugaaagacauauacauuuagauguucuuaauuuuauggaaggaacuaauuuuccuaaacaugugcaggugcacauguguguggaguuuuauauuccaguaucauagagugauauccagagcucugucgcgcacuuaugugauccguggccacuuccaagugccugugccuugcaagagaagugaaggaauugguucauuugguuuuuuucuucucccuugaaagacaauuucaugcuaaugaaaaacacagcaaaagagucagacauucagaggaguccaagaucuacuggaaggagcugugcucugaugucuuaucgucuguaauggcaacggugcuuuguaaccucugagucgccuggggcaccccagcuugugcugaacaaggggcugcgaaccugagacugcagucugcugcaccugugaccacccucaccuccagcugauccagaggggcccagaggcacgaguccaggacagucuuggcacacaucugguaccugagcugcacagccagauaguaauagaauucaucacaggaccagcaaacacagcucugcuacaguucacccaucaguuuccaaggugaauguggcugcugcucacagcuuggccucuggucuguggcucaaauucugcugagacuguaucgaggguggugacuucagcucucuaccauaaagacugggacuguuccuggaaaucuagggaggagacaucuguccaggugaccccucccaugguggcagaccuagaacaggguagguauccuaccuacagguucugcccaggccucgaagugguucuccuuccccauggcuuugccaaagacuuuuaauagcauuuuuuaagugcaaagugacuagauauaaaacauuuuuaucagugaccaaauuagaauguauuuaauauaguaggaaauuuaaaagcauuuuuuaauauaagacaaacugauagaaaagaccuauaucauuuuaaaggaaauggaucuucaacauuccacagcuagcccacuacuuaauaagguaacuauugaccugauuucagugacuuuuguuuguaauuauagugauaaugauuuauuagcucaguaccuagaucauguguauuuugugcuacuguuaucaugguuuaagauuguuuauuuuuauucauauuuaugaacuguuucccaugucaggcuuuuggucucugugguaacaggacaguguuugugauugauagcucaucgggacaauuucaaguuguauacaguuacauuaagcuuuagauuguauguaagcuacucugguuaacuccuccugggcugacauuccaggcuggggcugggcaguucuggggcuguugugauggcuggggaggcaggcgguagugcacccugggucccaucccaugcggggagcuuuccugagcaucugcucuucuggaaucaggcugagcucugaggacaggugugcaggggaggaccaaagaacgucccagaaggggccacuuuucccauccauuccagaccucuuaggagcugaggcuucuaggaucuacccugggugggaagggccaagaaggggagagagagccuuaaggcccguguguggguaauggagguggggccaugggucuaggaacugggacccaccacuguccugaugccuguugucgucuaacucucuaguguugaauaguaacaguauaugguagugucagagucuuguguaccugguuggcaggccuucccccaguauggaugcgcauguggauuaacuuauggaagccuuuguguucauuuguucucagaaauuaguugagaauguuaugugaauggaaucuucuuaacccagauggucauauuuauaauacauaaccauuuacuuuagugaauuguuaaaguuguuaacauuuguuuaauuuuuuuuacaauagcauuuaugcaaugguuuacagaagucauggaguuauuuuuuaucaguauggaauuaauuaaaacuuugaaucuuuauuuugucuggaucuuugggcacaacaaaggcuggccagcaggucccucuuguuugucagugacacugucugaucuagaauaugccaaaagaagccgugucuacaccacaccaguuuuguucacucugugaaaggacacucaaagcucaggauauuucuauucuucguggccaccuugcucacaggauguucccacguaguccugggucacuccgcagaugcucugcugcgauugcaccuauggggagcugcugacccaggugcugagagugagugguuucugccagaauggguagcaauaaagaucugccccagugcugcaggccccggaguggcuggcagcugaccagggcaggcagacugaccugugggcugagugugggggauuccaugcuguugcagcagacucgucagucuuuguaccuccugugacagcucugcaugugc

SEQ ID NO: 8455 - RNA, 2632 nt, Mus musculus
cggaagcugugcgagcgcgcacgcgcgcacgcucuugaacaaacgcuggagcugaggauuucaucucggauuucaucuaacauuaugggccgcaagaaaguugcucgcggauccaggaaagagagcggucguguucggcgacccucuggccgcucucuggaugcuuucgcugaagaggugggcgcugcgcugcguggugaguuuggagcagucggagcagcgggucgggccugggagcaggcgcugaggacccggccuucucucucuccuuguagcauccgugcagcccgaggaggccgaggaccagggcggcccgggcccugcggcgcugccuugugccuuggcuaugugggagcuuggucacugcgaccccaagcgcugcacgggccgcaaacuggcccgucugggucuggugcgcugccugcgccugagccaaagguuuggcggucuggugcucagcccaguaggcacugaguacgugucuccggcagacagguagacaccagaggccuggggaucggggaggggucggagagggguuggaaugcccuucccaccaucuugucuuuguuaaacugcccuguaucaggaguaucauuuucuucaagccuugcuuauuggucuuggauguccacaucuuucauaugagcagaguuguauuuaauuugacccuuuucauagagcagggcuauaguguagaaagccuaggagaaacauuuguuguguaaaguaaacacuguccagcuacccucaacugcuuccugaaggguucuuucuacuauugcaauaaaccauaacuucgaaauagcagagugaucucucaucuguagugaagccagucuccaaggaugugccuuauuuggggcccuagaaccuacccuacacucucugacagacagcugguggcacagucaggggucgcagucauagacugcuccugggccaaacuggacgacacacccuuucagaagaugcgagggagccacuugcggcuccugccuuaccucguagcugccaacccuguaaacuauggccggcccugcaaacuuuccuguguggaagcuuucgcugcugccuucugcaucguaggugaguuuugggucugacagaagccuggcaauggcagucuggaggcugacugcuugcccccuccuccucccucaccuggagacugggguuucuucuggcagagucugagcaagggggugggaugugaggagaauauauugggagccauuagaaaacagccuuugucuucagucucagugcccacauacagucuuaaccuuaugaagcagagguagaggcaaaauggaccacugccuucccuggauggugugugggcccaauggcuaccccguaagacacagagacuaggauaauaggacuguuucucagcaaaugagaggaaccuugggaacuguagaggaggugacagcuuccugagauagcaggcagggucaugcaguugugcucucuauaggugucccaggcauaucuuugguuuuuguuccacuaggcuuuucagaccuugcugucauuuugcuucggaaguuuaaguggggcaagggcuuccuggaccugaaccgggagcuccuggauaaguacgcagcuugccguggcccggaggagguguugcaggcugaacagggguacuuggcuagcaccagggacacgccugaagaggacaucggugaguccugguguuggcugggagccccagagaagcaaucaagucccuccagggccuuaggagccuagagccugaaaaucacuuagaaguccccuuccucucuucuucuuucuuucuuucuuuuuuuuuuggggguggggguggggguggggagaggguuucucuguguaguccuggcuguccuggaacucacuuuguagaccaggcuggccucaaacucagaaauccgccugccucugccucccgagugcugggauuaaaggugugcgccaccacgcccucucuuucuguguucagaucccuuugacguggacucagggcgggaguuugugaaucucaacaggcccguggccagcacccgguagguccugugagcccccaggugcuucugaaaccuugacccaguuccuccggccuugcggguguggccuuuugaacaaggccugguggugauuacaaaguguaaagcagcugcuugcugaaggggguugggcucagagccgccucugcuuuagggcuucucuagcgagccuaacagggacggucaccuugcucagggcuguggcuguacugugguccaucucacucccaggcuaccugaggacauggaugacacugaugggucugaggagcacagugaagauucugaggaggacagugaugagugugaggaaccaggaccuggugcuaauggaggagacagcaacuacucuggagcugaagagaccccagaacaagaggcucaagccagagacuccacugaaauuuggaaagggaucaagaaacgacagagagacugaaggucacaaacauauuauugaagcuggugugcauuauucagaaguggcaguaggaccuggggauggacgggccugcugggacaaccuuguuuaguguccugccuuagugcucucaauaaaaccaaggagaccccgcuau

SEQ ID NO: 8456 - RNA, 14116 nt, Mus musculus
gcugcaguuuguggaaauguuuuaauuagagcauuuguagauacagugguuaaucuguugcccacaauuccuuaccaaugaggcuucaugcugggauacccuccaccccacccucuuaacacaggauggucacagaccacauucuuauguuacaagauucacaucucugguaauccaaggacugugguacaaaaggaacacuucauagcuggggucacuacaguuugcuagaaacaucaguuacuuuagaauacuuuaacuauaaaauauauugaauuuccauauauuaaccauauacauguguaccuauuacuaaauguagucaguuguuacaaaauaagacauucugagagcaggcuacacacacacaccagccuaagcuccccaggugaggccuugugcugcaaacuguucauccaagcucggcucccgacuguacuggcggcuaaacgugcccacaaggcacuggcaacccagcccauccaggugccaccagcugugugagcacaagccccuccaauuccagagugaagacuccuggcugcagaccuggccaccccuugauuggucccugaacuugagccacuggugccugguucccaugucaggggucuuccaggggccucaggaacaagucugauggagacugaucacugcgccuauguccacugcaccucccuguguucuguaagcccuaagaucacagacccagcccagcccaggugggccacugccaagagcagcuucacccagcccagcuccagcaagcggaguauguggacaguaguaccugaggucauccugugccgaggccacagcaggcuggucuccugggccguagggcagaguugaaugcaggucaggagguguaggagcugugugcucaggugcucuagaggacccgaguuugcccgggccgguggcagagcugccucuuccagguacaagggcagggcaccaaaaggccugaagcuagcauucaggccacagcagggcccacuguacagcuaacaggcagggagaucaaugcaggccaguuuguccuuggcucucaccuggccucagccuuggucuggaucagccagucuuucaccuuucuggguuuacgaaggcuggaugcggauuccaacuucaugaggcucucaacgcugccugguaccuuaaggcccaaagauccagguggggagaacagaacacaucccuguacacaguccuauuuacaaagaaccagaugaagauggagcugcauggggccugggcauaucccuagcagaagcugagaccuccuaggugcugguccuggggcucagccuuggugccuggcaaggacugcagccaugugaggagggccagguguacugagauagauaccuccucacauuuuaaugaugauaaugcaacaaaaaccuuuauauaaacaguuuauuuacucuaaacagcaacacagacgaaacgccauauaaacacaaaggaaguggugcaggauggaaaugcuggccaacuuuggaucugaggcucauaagcaacagcccagguuucugagaaggacgaggguagggaaggagggacagugugguucugucacacagccagauggaagccagagcucugaacagugggaagcaugccugcauccgagcgcgacgcaaagaaacuagcugcuaggggcuuaccaaguacaaaaguuuaucacuuuacagcaguugaaauacugacaucaauauuaaaauaaaagcaaguuuuacuuaauaaucaaaaauacaaaagacugaauaugccaguggcggaaauggaaaauggcgcccgcucaacccucccaggcgacuaguaacuguacggagcgacuuagaucugcaaaagguuguaaacaaguucuugccaagccaaucccuuccucgucauggagcccagggccgcugcuuaugagggggcaaacuucuucgcuugugcucggacccuuuucucauauuccacucuguuuuggcuaagggggucaagaggaaaaaaagagaguuagauagggcggcaacaugaccugcuugcugagauggagagaacccacccagugccugcccaggagcagggaggcaaagugguugguuauaccagguggcccugugacaggggaggggcgacaaccucccuggaagguucuauguccaccucaacaucaggaacagaacauaggcaaacacaugggagacagaguguccucggccucuugcagugucacuacccaugcugugcugagccuuuugcuagauagagucagggcuuugcugcccaggcucgagugcaauggugcuccaguagacucccacuacugccuaguaagugccgucuguggcuccacugcugggaagccacgucaguggugaacucacucuaccacggccucucagcucaggugggaacacaaguguguauguccaccuagcaaacucaggaagccugcucuuagacagguggagagcagcucacuggcacuggguuuuguucaguucugaagacagguaagagcaucugugggcuuucacuguugagacuucagaccuaggcuagccugcacugugaaugggaacagaaaagugauguacgggaacaaugugaccuuaaggaccacagaacaagaagacauuuccaggcugggcuccuuagagcagcaguccuuaggggucacagucaauaguccuggcauagcaugagucgcaacacaucagugaccucgcaaagugucccuagagcaagccugagcccaaguugccuggccucggagauuacagacagaguggcagguucuuguaccaaggucaccucagaaaggcccaguaucagaacccaaacagggaggacauaauacuuagaagcucaugcuaguccugggaggcggcugacauuaccaugaugacagcagcucagcccucaaccaagaguacugccauucacuaaacaaggcuaugacagcaaggccacucaggaaggaggggcaagagcuucuacauacacagugaaagcaggcacaaaacauguuauugacagaaacccagaugaugcaggagagaaaccccagcaccaaggacugcacuaagugcuggaaaaacagagccauguuagcuagccgggaaccacaccuuaaggccaaccgugaacagagcuuggucuaaggcagagugcugcugagcaccagcgcaaugaggggcuccaagggcuuggcagaagcacaccgcuucaugagcugcauacuccuugugccugugccuggugcaggcagcacaacacaacacugauggagcugaccugucacagcaucuuacacagggucaggccugaaagacccuggagcacaggcagucaguacacaacauugcaccaauggguguaagcuacauucccagggaugcuagacaggcuugcccuggccaccagagaaggcagcacacaaguaucaagguuggauaugcacccaauuuucuucugauuccuucccugacaauacagugcacacccacuccuuccugucccacauaguucuaguggguugacagaccucccuagagccaugggcuaagacaggggugccugggacucugcucagaggaccucugcucuauuuccauuggggugaguaggcgguugguacuugagacacagggagaacaguggggucaaggucccugcaguaacacuaaucuuaggaaugaauuccagccacaguaacuuuaguccuugccuagauuagcaggauccucacagucagcaaggaugaagcgugagugugugcacucacauacucguuggaccucuauuuuaaguguuuuccgugcugccuacagaacuggcucaacuguuauucaaguccuaacugaucaugggagguuauucuccuucaguagauagaaaaagagccaagagcacucuaucagcgaggcuguguuaugcaaugggccacaaccuuuuauacaccuaccacagaucacuccaaauggcccaucagugcccacaccaccuguucuaugcccacagucacaucugggcccuguccuugcucagaguaagcuccguguacacauggcucuguuccugaccagucagacaugcaguguccuugguggcucuuguggugcugccacccagugggaguaugcgccucuuccccgggacucccucucagcucucauaucccagagcuccaaccugacaggcagccagucugcacuuccaggaaaggaagguuagccagcuggcaguugcuacuaaccaguaaauuguguaggccucugcuugagcugggucuugaauauuugguucauuuagaaguucuuguauuccuaauaagaucuguaagagaaacaaaaacaaucagcucgccgggcaugguggugcacgccuuuaaucccagcacuugggaggcagaggcgggcggauuucugaguucgaggccagccugaucuacagagugaguuccaggacagccagggcuacacagagaaacccugucuccaaaaaccaaagcaaaccaaucagcuuacauugagagggcuugugaaaaacacuguuggcuacugugaccaggacaaaccccuaagagggcagucaggugcuacuccauaccuguuugauggugauagcuggccuccaguccuugucuuccuccaggauggacaggcacacugugccagaaggauacacguuuggaugaaacagugggggcucaaauuuaccuggaggacagggaggggaaggaauacuuuuggaggcagaugcuguccccauccugugcuggcccugaccggucuuccugacacuagagcucuuuuaaaagauacaaacucagaaacucaauagcagaggguccagaaagaggagaguacgccuuuccuuccugaggagcugagccuagacaaagcagccagaagacaccauggucaggagccagagggacuaagccuaugcucuucucauguucauaggaagaggaaagaggcuagaaugcaugccccaaagaccuuuucaguguacacaggcuucaaguacaccacauuucucuacaauaguagaaaaaucuacuccaaacucagguacuauucuauagcugauacuugagaaggugccucacuuugaucuaggcaaccuucuuucgcuuuauuuucaaaccuguacacccccaaaaguacaagucuaaaggcagcuuguuuuuuaguaaaugaaggggucugggggggcggggggcagcucugcggcagcacacuucccugguauacaucagguuuuggcugaguucccaguacuacaaacaaaugagcugagcagcagcaucaacuacacaccuauaccaacuacucuguaggcuaagcaagaagauuaugaauggaaggccagccuaggcaucuuagugauaucuuguuuaacaaacaacaaaacaggggugaggugggguuggauaaagggcuuagagguuaggaacacuaacuguucuuccagaggaucggggcucguauggagacuuacaacuacugcugcucuggggagggaaugaauguuuguuccuucuuuucuuucuuuuguuuuuuaaaaguggguuucucuauacagcccuggcugaccugccuugaacucuggugggaugaaagaugccacccccacccccaauuuuguuaaacccuuacuguccucgagcuuuaaauaaaagaaaggugggaguguagugauggaacgcuugucuagcuagcaucugugaggcccuggguucaaucccaagcaucacaaaaugcuaauaaguuaauaagaaugagacaaagcaucaacaccagcauuaaggcugaauccuagaaaccucccuaacugcucugugcagacagaauggcucugaguuacugcaugccucuccaagcagagcugugaggaaggaccugagagugacuuaugccaugggcacaaugauaagcaaauggagaggguuugggugucaagaccccaaacuaauuucaucaguuccuccagcccaucugucucacaauugggccaggccuccacagaggcacuucuggcagccaccuuaauuuuuuuuuuuuaaaacccacugaagagugauugcacacaccucugaucccagcaccugguaagcagaggcaggcagaucucugaguuugaggccagucugguauguggaggaacuuccaggacagccaaggcuacacaggaaaaccuguuucaccccaaccccaauuuuuucccuguuuuuaauauguguagauauauauguuuaauauguguagauauauauguuuguggaucauguauguguagcgcucauggaagccagaaaagggugucaaauccccuaggacgggaguuguaguggaacugucaugggauguuagaauccaaccuugguccacuagaggagcagcuaguauucuaacccagagccaacacuucugcuuuaaagcucaccuuaucucugggucccuuacucaucagugauucucaacacaagucugcuccagcaggcaucuuuccaauucugggcucuucuuuguguccuuuaacuuguacuuugcaaacacaaguuuacucuuccuugccaaccauguuuacuucuaccagccauaccuugcaugaaucucagcuggcccaugagccccucccuguuuuuagccucacucagcaauagaagcugcuuugagcugcauggaucagacauuaaggaacccaccauuuugcugucuggggguuuagaugcuccaucuugcuucccuuuaaucucaauuauuucccaggcugcuacuaauacacaccugcaccaacucuuugacuucugauucuuaccaaccuggcuuccgugguguuccugucuuugugaacaugugugagcauuucuacugguaguucuacagaacaguggcaggucagcuuuacuggugacagcagagaucuuccagagaaacagccuucacauaacccagcaagggccaagagcuucugcugcccagcccuuggcugccucaggucuccuucucgauaacccagaagagccugacaaacguguacucugcuccguugcaucccuagcuggugucuucuaagacugacuuaacuccagggucacaauuauagccaauccccaaggccaacaccgaguacaagaccucucucccauggcauuugguaccacuacaacagcucaguuccaaacgucugcaggcuaugcuccauuucuucacguucaccuuuuuccuccuaagcaugcuucuugguuuuccuagccaguuuugagagacuugucucauuguauuugcucaggauuccagcaccacacgaaaggaaagagaccaacaacucugucuaccucaauccuagcuacauaccccuuaaaagaaaaaacuaacaaaagaacucaggcagacaaggaaaucccaaacagaacaggcaagacuccaucuagugguucccaauaaacuauguuuuaguacuccuggggaacucugcaucagguaacaucuauuuauaaaccagcucagaccuggccuuacuuauccugggcagaauggugguggugggcacuguacccccaagcaaguucugcugagcugaacagagaucaguccagccuucucuucugaccccauggucugaaggccaugagcaucccacagaacacagcagauggggaugaguaagagucuccucucuccuuuagugcucugaauggaacucagcugauauaugcuaaccacucacguaaucuaugggaacuuacagacucgaguucuccugugggcacaaaagcacccagaagcuucagccugacacaacucucccucugccaugugugguacauccuaauaggcugggauuagagaccacacuaauuacaugcgcaucuacccugggacuugucauccaagacaacucaccaggaccgacuaucccagcacuggcaccugccuacuaggccaagcacucacagacauggcucccaaaggguggugguagugcugggaaguggacugcaggcucuuugcacaacuuacauuuugguggugaggacggauagucaucuuugaaaagcauccguagcuugaacaagccuccuucccauggagucuguggggagggaaccaagguuagaccaguggcucacuugccaagguaagcccaggagaaguuuccugaaaccuggguccuuugggcuucuucucuaacugcccuacaccaccauuacugcauacucugcaacugagccuuguauagaugaacccaaacuauguuuuugcucagacacuaagcugaccuagaggucuggguuuggugaaugccugaaguuauaggagaccaucccucuuacaugugcuggacaagggcagacaaccggcugcacucaggcccaugaguguaaagaaacacggccuggguucuccaugggcaccucaccauuggggcuuacugcuuuguagccagcaaccuucaccugcucuuuaccccugaccccgggcuguucacugauccagugauuugccaagguccaagccuccuuaccaccacaggccacuccuuauccaggggagagcugugaccuggcaggcuagcuguggucacaaauaugcaaacuuaggucccuucuaguaguucugcuccuucagaucuguuaaguuaguaggugcaaagccagcagucacccuuacccccuucuuuccagggauagcgcacucccaguucaucagguucauugugccaucaggguucuuuguugggacagcuacaaagcccugagaaagaacagucacaaaacaaagcagcucagacgacaagccuagcugucccccaguggccacaggcugagaccaccaccccaucagaaagccccuccuacggcagacacagagugcuccuuacaaaagggugguccuuccuccaggcuuuccuuuccugcgcaaggcggcugagggcgauccccgacauauucaaagucccuggaacagaauccacacagggaggguuagggaaagcacacacagaccuccucuaagccaccccuaccuccuaccccagccacagagggcuguuaccaagaagcagguaaaugaggcuggaguccagcugggcaagcugcccuuggagcaaguguagcauuacaccccucaaccggccccucagaacgccuccggguguagggagagcaccaccgcugucucucuugugcuuuacaaacucaacugcuggaagggucagugagaagagccugcacaaaggcugucaccucccuggcaggcacugagcaucucuggagagacuuggcacccacuccacagucaaauccucaggacaggcaggaccucccagguacugcacacacuuaucugaggcuaagauguauggccagcuuagaaucaggccugaaaggaggacaaucacuagauguacuagugagaaaaaucuauaccacagggcagagcguggucaacuuccauaggcagacugccccaagaggccaggcuaucagccuauagcuuaccagcucauaguucagagaucugcccuaugacccuaggggaaggagggcaagauccaggucaggccagcagccucugccagagaccaugguggcacacuugacaaggcccuuaggugaacaccucucuaccuaggcccacagccugcugcuuugacugugaugccaaccuggcuaccaccugcuugaguuuuuuuuuuuuuuaaucugcacauccuuuuuaauauuacuuuaaaaauaaaaucacaugaaacaauacucaagagacucccaaacccacagagcacagggauuuaggggugugugaucacaagaacaugaccccugugaacaagaaucuagcagagcaauggguauuucacacugaguugcuucucagagguuccauauuugaccccagcuucaggcuuccauuaggcuuguggguaaaaucucccagcuggacuagcacuagccuagucucucguuuucagcucagucuucacucugaggcggaaccuccaaccaccucuagacaagaguaagauucuugccagagcacaucccugcuacagcuucugccaggcuucaagcagaccucccaugaguucuugcuauuuagacuuagcucaggcugcccauuuuaucugcaaagcugugacuacccuaggauuuacugcguguuccugacccagcuaggaucccugggcuacaggugggcugaucagauaugcaccuccaucuguaagcacaguuguucugaaccugaacagacagacccacugggucaaagcauucuggugaguccugcacugaaguuacagaugacuuguuuuaaguucagagucucacacuguagcccagguuagcccaaaacuccuggcuagcuccugguauugggauuacaggcaugagccacuacaucuggcuccuagaccacuuuuucuuucuuucuuuccuuuauuuuuggagacagucucaccauguggccacagcuggccuugacagucacgcaccacagcaccuagacugcuugugaugacuguacaaauccaaguagagaggggcugggacugccaucagagguacagcaucaccccagagcccagaguucaggaaauacuucagugggugaggucauuguaagacaaacacuucauaucagcauuuuuaauauccuguacacucuaagccaacaugaagaaccucuuuuagaagcacaagcugggacuggcgaaauuaagaguacuagaugcucuuccaauggguucaacucccagcacccacaugccagcuuaugauugccugaaacuccaguuccaggggaccuggaugcccucgaacacacaaacauacagguaauagugcacauaaaauauauuaaaaaaaaaaaagcacaagccaccaggacaagccuugacaauguuggcauuccuucuaagcauaccuggcucuaucaaacaucccgauuccuuuuuuuauaaaucacaacagacaguacuuaugcuccacaaacuccaauaccaaaucacaaaguauacaaauuaaaggcaaggcuccucucuuacagaccucaaguccaaaacagagaguccagcccaaacccaacugucuuuuccuagcacaggaguagagccugucuaggaacaagcaccaagguucugccacaaaaccccaaccugcccuaauagucaucucuuaggcaauuuacgacccagguggcgcucaucuaagagugacuggagcauagggcuucacuuccaaugugucccucuuuucaacuucucaacgcacaggccugcccaaucucuuucucuagcaucuuccacugaagcagcuauccucauccagccaaucagauggcagaagauggcaagcaagucugggcaggguuuccuaacagguuucucucuggagcccggggccagugcucuggagaaagaagccuggacaccgggccacacaaagcuguugggacagcuguaacugacuucaggauaaaguugugugcccagagaacucuguccuagcauccaacugcagcuauccuaagugagaagaaccgagaagcuagcucaacugcucuugccuggacacucaguguuaaggagacagaaccagggaaucaccaagaguucaagguuagccuuggcuacaagagauccugucucaaaaacagggagaagugagagguggcucuuaucagaacucuuaaaggccuuuugccccacggucgaggaaaaggaacccuaggagcacccuggcaaugaucuaggcagaaacuuggggggcagugcugcugcucccgcaagcacuccaaaagccacuuaaacacaacuugccuucccaggcaaacagucacuucacgagcuaaaaguuuugugaugcaaugaccaaacuaaaccaaaccaaaccaaaaaaccauuccccuccccacuacuagagacaggaaggacauacagggaugggucuuaugacuccaggcuuccuacaguguacaguauuugucuggcgacaccaccuacuucagagcuacuuaccggucagagagccugugcaagguugcuuaucuccgcccaccucggcagagggaacauggguaccaggcacuacggcuggcuuggauagggcgaagcggccucuuuuacucgaaugcacacuguaggcccuaaggauccuucaguaaguauaccacgcuguuuguuaaguuuccaguggcagagacagccagaggagggcaggacugcgaucacucacagccugaauaccuuuagaaagaaaacaaacuccccuucgacgcccguuuucugcuaugcaggcagguaacuaacucauccacuaaaacaacaguuccuuaagaauaaaggaagguggggcagagaauauacacaagacucccccacaaaaacccaagcuacaagccuagcgucucgguaacgaacgaagccuucugaugugacuccgggugcuuacaggccccgacacggcccaguacucacggccuuccgcacucucacucgccuaacuacggagcccagcaccgcccagaacgcgucugggagcuacugggaagcucagauuaucuguugcggggucggcggaacucaguucgccaagaguaggggggcagugggccgugcucccaacccuguauucucccguggcacagcggcugggcccuagugccccgaaggccgagacucggaggccgcgagcgagaggaggccgccguggcuccgcucggcgccucccggaagcucacugggaacggcggcgaguccgggcgaagaugggagugcgugcgcaggccgguggcggcucaccugggcgaccgcggcccggaccgucgcggcggcagaggcggcggcgcuccuuugucucgggacuucccuccgcgcccgccgcgcgcagcacggagcgcaggaccccagcgggcggggcggggccugagcugggcugcccgccacacgccugcucagcuuaccgucccucccguccgguggccuacgcgucuacuuaaacacgagcuucccgcagcccgcacgcggcugccgcgcccucguugcccgcgaccgccuaaggagcccgagcccagggcgccuguccaagcaggcggugcccugaacggccgcacucuuaaaggggccgcguccuaggcucgagggagcgucugcaaacuccucuucgggaugagcgcguccacucgaggacacaucagagagucgugugaggaaaaagaagcauagauucccaagggucauccggaugcucagagggcaccuucccgggcacaggcucuggagguauccuugggcucaaggcccgagucccgggagcaaagaucacugaggccuaaacauccugggaaucgucgcaguacggugacgauccccggaacuuagcgcgcugugacacuuucugcaauuggccagcucaggaacuugggcggggugaaccucgaaacuauccaaugaacuagccucauacaaagggccaaacgcaagcaaaaccgacggggagagaaauguggaugcucccuaaccuacgaguuagcccccuagugggggaggggaaugggccugcgccgugggggaggggcagcacccgcggacccccccccccgcgcgcgcgccccaggccucuucccugugccgcaccccacaccuuaguuccaccugaaaccccugugcggcuucugcuggccccgcuggacacgcuuuugucacgccguggccuaguccaguuuccucggccaguccucugcaacccagcucggaugcuuccucaccgacucaccgacgggacggguacuuagaaccgucggcuggcccccugguggccauucuggcgccugcuccuuuuuuuuuggcacgugcuggaggccuuucggggccaguugcagccaacaagggcuuccugggaauuuggacuauggguccaauugcugccagggacuccaguguucaucugucaguaucuccguccaucuacucaccacucucuccuuccuucguucuccucuuaccuuuugagguuguugggugccccaaaacaggaacuaaggucccaugccccuugcccacaauuguccaacauucccuggagcucacccuguuaauuccuccu

SEQ ID NO: 8457 - RNA, 1407 nt, Mus musculus
ugugugugucuuuuauucaagaauccacauggagccggggcagugguggcgcacgacuuugaucccagcacuugggaggcagaggcaggcagauuucugaguuugaggccagucuggucuacauugaguucuagaacagccagaacuacacagagaaacccugucucaaaaaaccaaaaaaaacaaaacaaaacaaaaaaaagaaucuacaugggauagucauaagaagugcuugccugcuagggagauuagagugauuugcauacuaucacuacaccauggcguuacaucauacacuccugcucuaaaccuucugcagugcccuguggaccacagaucaauccuuucaauaacuacauacgacuuccagcugccucuccacgcagucuuucccucagucucauuccugcagaaaauccaauauccgugaguccagaccaggcucaacugugacccuagcugaaaaguagauuccaaaguggaugugguacgauuugugcaauuuagggguggaaucacauagaacaggacuucaaggucaguuggaggccaggcagggauaaugcauaggacccuaaacuaaaaaaacaaaguaaaaagauuacugggccacucagagccaccggccacaaaaugagagcccccagacaaucugcugauaacuuuggucccagaugguacaauucacaggccaacaucccuaagugcccaggagccaccagacuuggaagcuguuuugcaggcugggauggauccaaaccagaucuguuggggguacagaucuagugugucaggaacuuguaucuaagccgaccuugucuacaacucagccccaaugagagaccaaggucccucaggaucuggugcucacugugaucuuaacucuuaaacaguacggcuacgaacaggaggaauuaacagggugagcuccagggaauguuggacaauugugggcaaggggcaugggaccuuaguuccuguuuuggggcacccaacaaccucaaaagguaagaggagaacgaaggaaggagagaguggugaguagauggacggagauacugacagaugaacacuggagucccuggcagcaauuggacccauaguccaaauucccaggaagcccuuguuggcugcaacuggccccgaaaggccuccagcacgugccaaaaaaaaaggagcaggcgccagaauggccaccagggggccagccgacgguucuaaguacccgucccgucggugagucggugaggaagcauccgagcuggguugcagaggacuggccgaggaaacuggacuaggccacggcgugacaaaagcguguccagcggggccagcagaagccgcacagggguuucagguggaacuaagguguggggugcggcacagggaagaggccuggggcgcgcg

SEQ ID NO: 8458 - RNA, 4688 nt, Mus musculus
augcaggacagacacaagaaagccauuuauugauguguuuaauuugcccuggacacuuauagguaucugguacaguaaaucauggcagaaaagguuugggcuauggggcuauuuguuacauuuuuauucuaagucacccuuugcuuuucagcguaagcuggaaacaaaguucugguuaguaaaguuguaacugcagacaccagggaugggaucugaaagguggagccugggaagaugaacacagaaaucagguggcccaacagugaguccccaucagcaucugcuccgggacauuaugucucacuuccgaggggaucaacagccguaggauccuggcauggagcagguaauggggaaagccaggaucaguguggugcagaguuccccagacaaauccaggcauagggcuagagacccaggugucuagugucagaacgagccuuuccccguccaccguagcccaugcugacacgaucaccggacuuccccaucccagugacagaugcugguaccuuugcugaaggcugcauggaguagguuuccacccagagaaagccgcuuacgauccccuaggagccuacugaggauggcucugacuucaaaaacaccaacugucgaaugccaaggaggaaguaccaagacccacuguauacuguuggaagucagcuccacccagggcccugauagggugaaggauggggcccagcuugaaguucaggaacccaggagcuccagaggcaugggacaaagcaguagaaacgauagcuguucccaacacaucuugggcuccgcacacaccugucacacggcagaggcuguguuggacuccagugcuuggguuaaauagagccccuuuccagaauccuuucagacugagaacagcuaaguagccggucccacccugcuguuaccagucucuuccaaagcggugccucccgaggggugucaaacaccaaaguugcugcugggcuggauggagcaugaccacacacacaacacuggagccagcggcaugcagggcuacagauguggugcugcagaaaaacugcuccuguaggucugagggauggagcacgaagcagcagugagggguggauagcgacacccuaucgaugacaauucuauugagggacuagcucugaucccaacugcagcuuccacugcagacaauucuaacaguaucccugagaccuccagauuaccacgggggugggaggcagugugcuuggcccaaugccccaagcauguuacugggaggccagccuucugggauugacaaguagacuuuaaaagcgccaacuguccaaucccuaggaggacccauggccucuuggaacccaguggucagggcagcagucuacaggagcucugcucugaguucacccuucaccaccuccacauuugucucuuuuaggcccgcaauuaaaaaucuccacggcuaugcagggaugcccugccaacugccugacauacagcucuggaugcaggggaagagggagaagcaggccaaggcugagggcacacaagccaaccucagguucacaggcccacuccauuacuuuucccaggcuccaagacugguccaggaaugggcaccugaacagaguucaggcaaugauaucuucacucuagaacugcaaagcccacgugacgauggggaagcccaggcguagggaaaagucauuuagaccuggguaaaacuagcagcagccaaggaggcaggugggggcaggaagaaaaaagagagagaaggaggaacugguccacaccuggacaagguccgaugucccacaagguaaaacagagaggcaguuucaauagcuuccacucacguuuuuaaagaucuguagauuccuguguuauuaaauacccugcgcuguccgggacuucagggccuuuugcauaugaugcugccuacagggacuauuguuuucuccuuuuauaguagcagcaggcuucagaucacagcuaaaccaucacauccuucuaaaagucuccuacccuacugggugcaucuugagaaaggacuagcucuuucccugcccucaauacuaggaacuccaggucugagaccaugaagcaguguccugaugauuugguccuaggaggcccugacaugaugcuguauuugaucaguccuagagaagauaugagcccacccugaauaacguucuuucuagcagcuacagcucagggucucucugguggcugaggaugugaaccaauuggcuugaaaggagucuaaagaccuggaggguguacuggucuuuuaagaugauccaacaaugagccuggcaugggcuuggagcacuaacugugugcccacagauuguacugggcucaauucugagcacagagccuggaagagcucagggcaccccuugcgugucagugcuuguacagagcggagcuggaugagcuccugacaacccauaguggucuauaccuguauaacaagggcugacuacaccaggguccgccagggcccuguccgggggugcuggguggggagggggucacaacagcccaagugacaggaagauacaaacuguagguagagccaccuccuuucuuccaucguccgagcagucuggggaucagacgugaguauauccacaaugggugaggaccaggaagagcugcccagagaaccuggaaugcccaauacaaacucagguuugugcuuucuuagaaacguggaggucucuguuaaggccugcuggucugacagcauggguccauggaggcucagaggguugggaccugagaccuuaggggucagguccugagaggauguaggccuggucuccguucucaacucugccgcuaagccuucuuuugcugggauggauggugcacuagcuagcaggguucuuuaugccucuaagacagcuucuuuccaagaggugggacccugaguggagggauccccaagggaaaggauugccacugcagaugugcagggaagggccuuucuuggcagguaaugguuaaaauauggagagaguucagcaggcaauggcagcuagcucuccaucgacacaacacacacacacacacacacacacacacacacacacagugagagagagagagagagacagacagagagggaagagggagggagacagagaggagagagagagagagagagagagagagagagagagagagagagagagagaacuagaauagaauaaggucaccauuaagguaguuucucuuccuuagccguccccucagcaggaagcagggacuuggaccuucucccucuguccagagcuguagaugcccuaaggccacacugcacaggacuggccuuuuccaggucugcagggaaagucugauuggaggcugggaucccagaccugaagguuagggcaccacucacggcuuggguggagauggagauuauuagagaccacaguucuucccugcagccgccuccacgggcuugggaaacagguggcuuccuuuaggguuaccgagcucucgagagccacagcucuaugccacccagacaagcuuaggguggcagguacaucgccuccuuugaguuuggcgagagacuccuagcugcacuuggagaccuccgggcugggaggcaagucgcgggggcgaccucgggcgcgguucggagucaggcuuggcucucgccucgggagaaacguccccucuccgacccugagcacucuccgccuucucucuaggcgcugaggagaagcggcccagcgugguuuccgccuccgccagaccacccaggcccgcccgccagggccuccgcgcccccaccacaggucauacccggaaggacccgagcccccgcguccggccccuccauccgccugaccgcccucagggacucagcagucacugccagagcagccccgcccagcgcccccgcccucccaccucugucuagccccgggguccuccagcucaccuaggugcgggaguuaccagggucaccugguggcucuugucauugcgccacccugcgggcagaacccggguuugguugcaauagcggauucgagccccacauuggagggagggauguuggacucaggaaccuuguggauuagcauccuugccugccgcccgaaagucaagccgugcugcugagauccaugcacugggcagucagucacccuuagcccucugaccccgccucagccgagggaucaggcugcggggcgccuggcccacgugguacggaggguggagcggggucgcaaggcuucuuuggauucggggcggggcauacaagcuccgccuggggaggaccugccaacccggaccgggaggggcgggguuucgaccacggcuuaaagaaacuuguugcgggucccagaacugagacugagcuacugcggcggaggagcugcugcugggccccugcggugaggacaaagauuggguccugcguggcaaccuuggauucuagaguguccuuccacagagugaccgggcgcgaccccugcguccauccccacugagugccccuccgcgcguggccccgaugcuggacaugagugaggcccgcgcccagccucccugcagcccgucuggcaccgcuagcuccaugucacacguggaggauucggacuccgacgcgccaccgucgcccgcgggaucagagggccugggccgcgcggggggcggcggccgaggggauacugcugagg

SEQ ID NO: 8459 - RNA, 2652 nt, Mus musculus
caagagugggcggggcggcugccugggcuccccggacucggacagcccagccucacuccacagaucccucggcccuugucaucucugcuuuugcugucuccuccaaaaguaaguccgaugaacagaaaccucacacugagggggaaacagacuccagggcucuagggcuugaccagguggggccccuaggcuaauucuaacuacugggaccagggcaacugccuccgggccucaggggcggggcggccgacagaucgaguccagcggcgcaggagccaucgcugcgcgacgggggcgcgucuguccugcgccgugcgcgccgcccgcagugcccgugugcgccgccgugcgccuggccgggggcgucucggggugcaccggcggccgggcuccggcggcggcagcagcgcagguagggccaguggugggccaugcccccagcccagaugcucccauuuguggaggacccgcagcugauccuccgcccacgugccugucggcguguggggcgcgggagaaccuagcaggguggggcacuguaacuugggggucucugggaaagguacucugcagguggccccacacaaccaggaauacuagcccacccaaccucucacugguuccuugcgagcccugccaggaccucuuuaggaugggccacucuaaaggcuggguccuaggcucuccccaaggccagcucagcucaguaucccgggauggaagcuuagcccggaugugucugguacucggugccagaccccucucaaggucguggaagcugugauuggagggagaaccagagacuuggucuuuuggagugcaacuagcuagggagggguaaagggaggcccguugugcuccaacugacagcucucccuagucaggucagugacuggaucugaaaacacuggucucaggaaggcuacccaccucccaaguccugggcuugcugaaaggccuguguccccagacauucugcacauaccccacccuacaugcaaauugcagacaaauccucccagccccgagauuaacuuggccucucagccucuuuacccaugcaaaacaggcauccaggagggccaggcagcacccagcaucucagggcucucaucgcagcacccagggucugaguuagaagugggucuggaaggggggugggggcugcccuggguacucagaaguccaucuuuuaaccucccuaggcagggaugagucuguccucccaauccagggcugggccuucucaggcucauuugcccagccaagaacggaaaguuugcucugcagcuaaucagccccacuggguagagaaggcucaggggucuuguuagugggucccuguggcccucuucgggcucuuugccaacaucacuccagaccucaggaaggaccaaugggugguauggucccaggaucucccucuguccuggggcugaggguggcgugggggugggggcugcagacccagcucuuuucgcuucuccugcccaccagccucaggcuggcuaccaccgacgcccccgacgccauggaggagugggaugugccccagaugaagaaggagguagagagccucaaguaccaacuggccuucaagagggagaugucguccaagaccauccccgagugagugccccaugaugucugucauuuaccugcccagccacugccccuugugugaaccaggaccucacacccccaguaggcaggugccacgggaaugaccgacacucacugacacuccccacucacaggcuucucaaguggauugaggauggaauccccaaggaccccuuccugaacccagaccugaugaagaacaacccuuggguagagaaggccaagugcaccauccuaugagccugacccacacucucuguaaggugugacuuuauaaauagacuucuccgggugucucugcuuuaguccauucccugugggagccagugcgaucugauguccuggggcaguggggcuacagcaggucccugauguacaggcugcgccgaacagcauuugagacgcccucguugaaccggaaccacaccucacuccugcccacugccacacccaugcgccacucguccgcguccuucuggggggccucaaccucugcagggaccaaaagguuugcaccucagcagaccccagccuaugucuccacccccucccuuccuucugugacccauacacaccucugcucgggacugccacuuuccugaugaccacacguccaaagaagucccucucaggcuagcagaaaagagggccgucagcuugccagugaacaagcaggcacaccuaggccuuucccaugugagaggagacucccaaggccucugagcaaggccugcgacuaggaggaccucuacuaaccacugcccacuuucugagagcaacagguggcuccuugggauuggggcaagccccacccuccgguaaucaucuugcuccagcccuacccccaacacacacacaccugcuccugcacgguugcucucgucaugauguguucuaggcgcugcucaugguuacgugggacaggcugccuuguccccuuuuccccacugucuguccacagacuugcaggcccugaggagcccugguccaccugaauggaagcaugagagucggcuagccaaggccaaa

SEQ ID NO: 8460 - RNA, 2652 nt, Mus musculus
uuuggccuuggcuagccgacucucaugcuuccauucagguggaccagggcuccucagggccugcaagucuguggacagacaguggggaaaaggggacaaggcagccugucccacguaaccaugagcagcgccuagaacacaucaugacgagagcaaccgugcaggagcagguguguguguguuggggguagggcuggagcaagaugauuaccggaggguggggcuugccccaaucccaaggagccaccuguugcucucagaaagugggcagugguuaguagagguccuccuagucgcaggccuugcucagaggccuugggagucuccucucacaugggaaaggccuaggugugccugcuuguucacuggcaagcugacggcccucuuuucugcuagccugagagggacuucuuuggacguguggucaucaggaaaguggcagucccgagcagagguguguaugggucacagaaggaagggaggggguggagacauaggcuggggucugcugaggugcaaaccuuuuggucccugcagagguugaggccccccagaaggacgcggacgaguggcgcauggguguggcagugggcaggagugaggugugguuccgguucaacgagggcgucucaaaugcuguucggcgcagccuguacaucagggaccugcuguagccccacugccccaggacaucagaucgcacuggcucccacagggaauggacuaaagcagagacacccggagaagucuauuuauaaagucacaccuuacagagagugugggucaggcucauaggauggugcacuuggccuucucuacccaaggguuguucuucaucaggucuggguucaggaagggguccuuggggauuccauccucaauccacuugagaagccugugaguggggagugucagugagugucggucauucccguggcaccugccuacugggggugugagguccugguucacacaaggggcaguggcugggcagguaaaugacagacaucauggggcacucacucggggauggucuuggacgacaucucccucuugaaggccaguugguacuugaggcucucuaccuccuucuucaucuggggcacaucccacuccuccauggcgucgggggcgucggugguagccagccugaggcuggugggcaggagaagcgaaaagagcugggucugcagcccccacccccacgccacccucagccccaggacagagggagauccugggaccauaccacccauugguccuuccugaggucuggagugauguuggcaaagagcccgaagagggccacagggacccacuaacaagaccccugagccuucucuacccaguggggcugauuagcugcagagcaaacuuuccguucuuggcugggcaaaugagccugagaaggcccagcccuggauugggaggacagacucaucccugccuagggagguuaaaagauggacuucugaguacccagggcagcccccaccccccuuccagacccacuucuaacucagacccugggugcugcgaugagagcccugagaugcugggugcugccuggcccuccuggaugccuguuuugcauggguaaagaggcugagaggccaaguuaaucucggggcugggaggauuugucugcaauuugcauguagggugggguaugugcagaaugucuggggacacaggccuuucagcaagcccaggacuugggagguggguagccuuccugagaccaguguuuucagauccagucacugaccugacuagggagagcugucaguuggagcacaacgggccucccuuuaccccucccuagcuaguugcacuccaaaagaccaagucucugguucucccuccaaucacagcuuccacgaccuugagaggggucuggcaccgaguaccagacacauccgggcuaagcuuccaucccgggauacugagcugagcuggccuuggggagagccuaggacccagccuuuagaguggcccauccuaaagagguccuggcagggcucgcaaggaaccagugagagguugggugggcuaguauuccugguuguguggggccaccugcagaguaccuuucccagagacccccaaguuacagugccccacccugcuagguucucccgcgccccacacgccgacaggcacgugggcggaggaucagcugcggguccuccacaaaugggagcaucugggcugggggcauggcccaccacuggcccuaccugcgcugcugccgccgccggagcccggccgccggugcaccccgagacgcccccggccaggcgcacggcggcgcacacgggcacugcgggcggcgcgcacggcgcaggacagacgcgcccccgucgcgcagcgauggcuccugcgccgcuggacucgaucugucggccgccccgccccugaggcccggaggcaguugcccuggucccaguaguuagaauuagccuaggggccccaccuggucaagcccuagagcccuggagucuguuucccccucagugugagguuucuguucaucggacuuacuuuuggaggagacagcaaaagcagagaugacaagggccgagggaucuguggagugaggcugggcuguccgaguccggggagcccaggcagccgccccgcccacucuug

SEQ ID NO: 8461 - RNA, 8496 nt, Mus musculus
aggcuucucaaguggauugaggauggaauccccaaggaccccuuccugaacccagaccugaugaagaacaacccuuggguagagaaggccaagugcaccauccuaugagccugacccacacucucuguaaggugugacuuuauaaauagacuucuccgggugucucugcuuuaguccauucccugugggagccagugcgaucugauguccuggggcaguggggcuacagcaggucccugauguacaggcugcgccgaacagcauuugagacgcccucguugaaccggaaccacaccucacuccugcccacugccacacccaugcgccacucguccgcguccuucuggggggccucaaccucugcagggaccaaaagguuugcaccucagcagaccccagccuaugucuccacccccucccuuccuucugugacccauacacaccucugcucgggacugccacuuuccugaugaccacacguccaaagaagucccucucaggcuagcagaaaagagggccgucagcuugccagugaacaagcaggcacaccuaggccuuucccaugugagaggagacucccaaggccucugagcaaggccugcgacuaggaggaccucuacuaaccacugcccacuuucugagagcaacagguggcuccuugggauuggggcaagccccacccuccgguaaucaucuugcuccagcccuacccccaacacacacacaccugcuccugcacgguugcucucgucaugauguguucuaggcgcugcucaugguuacgugggacaggcugccuuguccccuuuuccccacugucuguccacagacuugcaggcccugaggagcccugguccaccugaauggaagcaugagagucggcuagccaaggccaaaccacugauguuguaugcugucucaacaccggggacaaacuuaccugggggccacuucgagcccaggccaaagccucugcccugcgcaucuucuccauuucaaucucccgagcaauaagcugcuuagccugguaggugaggggcuuucgggcagguaguucagggaagcggcagaccucuuccacauuccuacccaggugggugaggcaagauaccacgguaccagucagcagagguagucugccuguugcaccaagucuaagagcuaggguguggggucaguaagagccagggucugccuauggcaccaacccauacaccaaauucaagaucuuggguguagggcaagguccugacaaugcuacagccuaaccccauggcagcuggggguucuccaacuauaaguggagaagacaaggaacaugcacggggcuaaggagagggagcaagaacaggcagggacaccgggacccucacuaaacugcaggauaccaagguugcugcugcugcugugccuagagcccucuagaaccccaaggagcuacagacacgcaggcuauccacccugggauggacagagguuauaugaacccuacacugaaacuuggaaucaaaauugugucugaccuaggaugaggccuagugccagccacauuugugccaggccuaaauuguaacccacaacaccuuggauaccucaccaagaccacacuggcuuuggcacacacacacugcauguccccagguguucccccugccccaggcacaggggcacucacggcuccagcuuguagagguacugcccaucaggugugcgcuccuggugguaggugagacuguaggcaagcaugguacccacaaggcaggacaacugcugcuucucaugggcacuguacagcugugugcucaccuagggucaagagggcacagguugggcaacucggcaaugcccagagccaccugggccacaaacuccacccuuuccuccguaucugacacucacggggcgcagcuugggugcgaggacauccaggagcaggcagagaguaucuagaacaagggccugugguguggcccggcuacgcguggucggugccauaccugacaccagugucuguaugugguuccuugucuggcucauccgagucugggccuaggacagaaagugagccggggccaggggagcagaaaccccaccaggggccagacccuaagcacaaacucugcagaugacacaccuccugcuggcugcuggggaaagugauucguggcacauggcuggaggcaaagagcacguggaaggccgcaggcacgaagggcaaguagcacagcaacuggaagcucuggccacggugggcagccugcuccagcaggucaucaaaggccagccagucgagggcacagcacacggugcuuaagcuggagucccgaagccgaaggcguagaaaguugucaaacaggcccuaagagugguaagcaggucaugaacccugcaggaguaggcaggcccugacccucugacgcccucaucuccccacagugugugugugcaucagucucaggacccucccacuagcuccugcucugugaaguccaagggguagggaucagcugccaaaaccagggaaggaccuacuagucuaaugaaggcccugaggcaagugaggagguggcaugugcucuagucccccacccuuccagaaguuagagcagaaagcuacacccucaaaauucaggacauagcggccccagcuugccugugcgaguccaguucccacuggccauaccccauacucaacacccccucuaaacugcucauuuccagauugucaguggauucccaacuacuaauccaaagcugcuuagagcuggaagcagcuuaagccaggccucuggggaguaggggaggcuaugccacuugcucaagugcauaccucucuaccugcucuccauagcaugggcacccuccuuccggcuaguaucuaguccccguaagcccaggccccagcauggaccucacggggcucuccagaugguucccaguuaccagcucaaaacucauccugccuucugccaccuccaacauuauuccuuuaguucccuuuuugggccugaggguccuuguggcccauccuugauccuccccuccccucagaugccugacacccguccauccacacccuuuacuuuggaacccaccuaggacaucuccugcucaguaucuacucauuuaguacuagcgucacgagagcugaggugggcacagguaccuggacaaccuucucaugcucgcccgcagagguggucacacgcaggaugugguaaaagcgcugggaggccagggucagagagcccuugucaccauugcugagcaggagagcgugggcuggcagcaucagguccuggcccacgauucuccugaaaguagagggugcugaggcuggggccacgcccagugaaagcaaaggugccggcagccauccuagccacauucugcaugcuuggagggaagcccuggcuggccuguuuuauaucacucugaagguacaagagucuccaagcagagccaucuaggagcaaaagacucucccugaacugacuaggguaaggucagggagggucgcccucuaggccacagauuuaggaagcucuagccaacuccccuugggguagaaacugggcccccaacccaagucaggacccuaccaagaggacacagugaagccaaacagcuguccuggcagugucaggcggugucuaagggcccuaggcuacagagacauccggaccaaggcuggcccacucauaucaccugggcuaccuaccuuugaguccugggcaacuggaagaccucuugccacacagagaauagccccuugcgcugguccuucaggccgacaugaguggucugcacagccuucacacucagcucccgccggccccucccauacagaaacuggaaaagggcggaguaagcagcagccaccucaccccacccugccucacccaagccucgcgcccaccugcaggguguugaugcaggcacggaugucauugucggucuucucacagagggcaaccagugcacccgggucagagcgcaugccaugcugcagggagaucuagaggcaggauaagcacuagagugucugccccugcugagaggacccaugcccagucuagcacauccucagagccaacccuguggcacgaccugguuccccggaugccgguaaacagcucugugcugggggcagccagagggugcagggcaggucccgugauaggacuauacuacaacccgacagcucaauacaaaacagaaccaggaugcucagaggggaggaacauggguggggagguugggauagaagcugccccccucccugcccugcugaccuccuggagccgcugcaccagccuggagggcagaguuggggggacguggagcagaagagccugcugcuucagcugccucagagaaggugugaaccugcagaacaggaccugcggugggccacacgagcggcaggccagcggacccuucugccuaugaaggccccguacccccaccgcacucacugaucauugcagaugcagaugauaggccugguuaggagaccccccucggcccugcgccgccgccccccugcggccacagcugugccuccuuggucggccuccugcggacccuugcgauucaggauacccaaaagaacguugauggccgccuucagggaggcacacaagaggucagugagccgaagccccagugugcucagccugccugaccacccacccacguaggcugcagagacccaccgugggggccccgucgaucucaucaauaaccaggcaguugggccucccacccacacccagaaccgacuccauuugcguagcugcuucaaugcguguacggaaggccuccgggcuacggucaucacuggaagagcaaggccaagaguuacuagguagcaggcagcgucccagcaggaugcuaugaggcgcucacaggauguagcuaccaccaacuucagugagccaugaaaaacaugucccaaccccagccaccuacauccaauauccaggacccuagccccacccacuagccaggguuugagaacugcacccacagguucagccucacagaagccccagucgagggucuccucuacucaccuugcauucaucucuaccacgcaauacccugcaugccuugcgaccacaugugccagcguggucuugccuaguccuggagggccacacaacagugccaccuacagucagaguggaggacagacugccgauuccuuagucuccagggagcuccuggccaguagccagguacuggaaagaagguggucacuguuccccauacuccagccaucacaugagaacacccagaacacucaguaggagaaaacccugugcaugcagcagguuauguggggaccugacaggaacggaagcccguccccugcugcccagcauccugugcugacuuuaucuaaacccuuaggagaauggauuuaacuucaagcucacaacacuagcacuugaugccaacccugaugucauugaacccacagacucuagaagaguuaaagaugccucacaggcuacccuccccccaaagagacgauugcaauagcacuggcuacccagagggcaaagcccuuggcucagauaggccagguggguuuaccuucugccgaggccucuggcuaggguccaguucagcuucuagcaucuccuccagugccugcucauggcuuuuccacuugccaggggcuguagccuccuucccaacccggguggucucuacaccaggucugggcuuccgggcaggucucucacggccaaacaccacaaggucccauagcuucagccacuugaguaggcagcgguugguaaacuguaagaacaaagccugaggggggcccugccaagcccacacuuuuuuuuuuuuuuuuuugguuuuucuagacagauuuucucuguauagcccuggcuauccuggaacucacuuuguagaccaggcuggccuugaacucagaaauccaccugccucugccucccaagugcugggaucaaaggcgugcgccaccacgcccggcaagcccacacuuuuaacacagacggcaacacugaggcucagaaggcccaggcccagcuuaucaacaacuucacugaggccucaccccaggccaagcuggcaccaacugagggagagcaagaggucaggccaggacagugcuucuuaaccugugggucacaauccccuugggagucaaugacccuuuuauaggggucaccuaaggucauuggaaaacacagauauuuacauuacaauucauaacaguagcaaaauuacaguuaugaagcaguaaugagaauaacuuuacguuuggcggucaccacaacagagaaaguguauaaagggccacagcguucagaagguugagaaccacugggcuaggacauccagaccucuaacaaagcccacagcaggucacagucaacuagcaguaaaaagguuuugugcugacucagagucccaacaucauccuuagcaaccaauggcccaccaacacaaacaucaacuggacccuugacucuuccccuugcugauacagcaagccagucacccgugagugagaaugggagcucacaucgucacugagcaguuccguguaaugcugaggugcaaacucauccacccagaggcagugcugagcgguguucuggccaggggcuggcuccuccgcagggggcccuucaagcacagccuccucuccuucagaccugaggcugaagagaagcaaguccugauucaccacagagggaacacagugaccaugcccaccagauauguccaaacugaaaaggguuccuggggugggacaugugugagucaccuguguagagugucugaaagcuguugggcauccuccagcaguuguugccgucucuauaaaaacaggauaggcugaggucaggacaaguccagccagcacuagacucaacacauaaacuccccacuccacuaaaccuaccuugcuaucaacuugcuccuucagggaggcgaaggggacacccagcagguccaguuggccacagccucgccaguggacaucuagaagaggguucugggcaagacagauuuaucaucucuauaacccucccaggucauggaggcauccacagugcccuucucuccccaccccccaaaaaaggcugacagagggacagaaaugaccuuuccuaauuagagaggggauggauauggcccucagaugggccugguccaagggaagucagcuuuaaggugaagaggaaaagaaaaacagaaagcuaauauaugggguacaaggcggcacucuaaggccacguagccucaaaaguagcacugcuguuuccaacacuggacuaccuggcgugccuguuucuagcaauucagauaggugaaacuggccucagaaccugcugagagccuauuggcaacauaaaagaaccaauaccauggcaaaccccaugcuauggccacacaccugcaccccagggccuaugaggucagcccgaagcaccaaaaaggcccguucuccacuuguggaugucacauugauauaaucuucuaagauaggaggccgucucaggacaggauugcgauuucggggacuuggcaaugucugcaugaggucuuugucagcauuagcaucugaauaccuaggagagacaagcagcucccugucacucucaaauggggugcuugacccacacucacuccucuugccgucccauagacauccacuuccagagccucaugcagggacaggcagcuuuccaagucagaauuacaugcccuuaagcaacacacccagcauccaacaucucagggaagaccucuggacucgguggagggguaauguccccaggaggggaaucuggauauaagagcuccuccauaucuggcucaaaguucagcuucuucaccacguccaaccugggucguuugaccauggggccugcagagacagaggcagaaagaggugaaagaauagaaaacugauccucagaauuccccgacuuuaagugcucaguccccaaucggacauacuggagggcgcgggcuggucccuacgaacauucuuucuaguauugcgguugacauuuccuggcgacccugcagggcagggacgcgggacaguguccccaccagcgauggccucuucgaagguuagcggagggcggcucgcuggaguuuggagggucccaggaggagccuggucccguguuccugcugagacagagguugauagcagcaacacacauuaagaagcgaacucccagccguuaccaaucccauccacacagcucuccaugcugcagcaggaugcagccacgacccaggacccgcgcccaccuuccagcucagccagcacuucgagcucagcugcgaacugguuuuggaaaucauccuccacaccauacagaucuuccucguagucuuccauggagccagaccacaacucccacagcucagagucccucagaacuucccgcgccgccgccaccgcgcgcuaccccgccccgagag

SEQ ID NO: 8462 - RNA, 8496 nt, Mus musculus
cucucggggcgggguagcgcgcgguggcggcggcgcgggaaguucugagggacucugagcugugggaguuguggucuggcuccauggaagacuacgaggaagaucuguaugguguggaggaugauuuccaaaaccaguucgcagcugagcucgaagugcuggcugagcuggaaggugggcgcggguccugggucguggcugcauccugcugcagcauggagagcuguguggaugggauugguaacggcugggaguucgcuucuuaauguguguugcugcuaucaaccucugucucagcaggaacacgggaccaggcuccuccugggacccuccaaacuccagcgagccgcccuccgcuaaccuucgaagaggccaucgcugguggggacacugucccgcgucccugcccugcagggucgccaggaaaugucaaccgcaauacuagaaagaauguucguagggaccagcccgcgcccuccaguauguccgauuggggacugagcacuuaaagucggggaauucugaggaucaguuuucuauucuuucaccucuuucugccucugucucugcaggccccauggucaaacgacccagguuggacguggugaagaagcugaacuuugagccagauauggaggagcucuuauauccagauuccccuccuggggacauuaccccuccaccgaguccagaggucuucccugagauguuggaugcuggguguguugcuuaagggcauguaauucugacuuggaaagcugccugucccugcaugaggcucuggaaguggaugucuaugggacggcaagaggagugagugugggucaagcaccccauuugagagugacagggagcugcuugucucuccuagguauucagaugcuaaugcugacaaagaccucaugcagacauugccaaguccccgaaaucgcaauccuguccugagacggccuccuaucuuagaagauuauaucaaugugacauccacaaguggagaacgggccuuuuuggugcuucgggcugaccucauaggcccuggggugcagguguguggccauagcaugggguuugccaugguauugguucuuuuauguugccaauaggcucucagcagguucugaggccaguuucaccuaucugaauugcuagaaacaggcacgccagguaguccaguguuggaaacagcagugcuacuuuugaggcuacguggccuuagagugccgccuuguaccccauauauuagcuuucuguuuuucuuuuccucuucaccuuaaagcugacuucccuuggaccaggcccaucugagggccauauccauccccucucuaauuaggaaaggucauuucugucccucugucagccuuuuuugggggguggggagagaagggcacuguggaugccuccaugaccugggaggguuauagagaugauaaaucugucuugcccagaacccucuucuagauguccacuggcgaggcuguggccaacuggaccugcuggguguccccuucgccucccugaaggagcaaguugauagcaagguagguuuaguggaguggggaguuuauguguugagucuagugcuggcuggacuuguccugaccucagccuauccuguuuuuauagagacggcaacaacugcuggaggaugcccaacagcuuucagacacucuacacaggugacucacacaugucccaccccaggaacccuuuucaguuuggacauaucuggugggcauggucacuguguucccucuguggugaaucaggacuugcuucucuucagccucaggucugaaggagaggaggcugugcuugaagggcccccugcggaggagccagccccuggccagaacaccgcucagcacugccucuggguggaugaguuugcaccucagcauuacacggaacugcucagugacgaugugagcucccauucucacucacgggugacuggcuugcuguaucagcaaggggaagagucaaggguccaguugauguuuguguuggugggccauugguugcuaaggaugauguugggacucugagucagcacaaaaccuuuuuacugcuaguugacugugaccugcugugggcuuuguuagaggucuggauguccuagcccagugguucucaaccuucugaacgcuguggcccuuuauacacuuucucuguuguggugaccgccaaacguaaaguuauucucauuacugcuucauaacuguaauuuugcuacuguuaugaauuguaauguaaauaucuguguuuuccaaugaccuuaggugaccccuauaaaagggucauugacucccaaggggauugugacccacagguuaagaagcacuguccuggccugaccucuugcucucccucaguuggugccagcuuggccuggggugaggccucagugaaguuguugauaagcugggccugggccuucugagccucaguguugccgucuguguuaaaagugugggcuugccgggcgugguggcgcacgccuuugaucccagcacuugggaggcagaggcagguggauuucugaguucaaggccagccuggucuacaaagugaguuccaggauagccagggcuauacagagaaaaucugucuagaaaaaccaaaaaaaaaaaaaaaaaagugugggcuuggcagggccccccucaggcuuuguucuuacaguuuaccaaccgcugccuacucaaguggcugaagcuaugggaccuugugguguuuggccgugagagaccugcccggaagcccagaccugguguagagaccacccggguugggaaggaggcuacagccccuggcaaguggaaaagccaugagcaggcacuggaggagaugcuagaagcugaacuggacccuagccagaggccucggcagaagguaaacccaccuggccuaucugagccaagggcuuugcccucuggguagccagugcuauugcaaucgucucuuuggggggaggguagccugugaggcaucuuuaacucuucuagagucuguggguucaaugacaucaggguuggcaucaagugcuaguguugugagcuugaaguuaaauccauucuccuaaggguuuagauaaagucagcacaggaugcugggcagcaggggacgggcuuccguuccugucagguccccacauaaccugcugcaugcacaggguuuucuccuacugaguguucuggguguucucaugugauggcuggaguauggggaacagugaccaccuucuuuccaguaccuggcuacuggccaggagcucccuggagacuaaggaaucggcagucuguccuccacucugacuguagguggcacuguuguguggcccuccaggacuaggcaagaccacgcuggcacauguggucgcaaggcaugcaggguauugcgugguagagaugaaugcaaggugaguagaggagacccucgacuggggcuucugugaggcugaaccugugggugcaguucucaaacccuggcuaguggguggggcuaggguccuggauauuggauguagguggcugggguugggacauguuuuucauggcucacugaaguuggugguagcuacauccugugagcgccucauagcauccugcugggacgcugccugcuaccuaguaacucuuggccuugcucuuccagugaugaccguagcccggaggccuuccguacacgcauugaagcagcuacgcaaauggagucgguucugggugugggugggaggcccaacugccugguuauugaugagaucgacggggcccccacggugggucucugcagccuacguggguggguggucaggcaggcugagcacacuggggcuucggcucacugaccucuugugugccucccugaaggcggccaucaacguucuuuuggguauccugaaucgcaaggguccgcaggaggccgaccaaggaggcacagcuguggccgcaggggggcggcggcgcagggccgaggggggucuccuaaccaggccuaucaucugcaucugcaaugaucagugagugcgguggggguacggggccuucauaggcagaaggguccgcuggccugccgcucguguggcccaccgcagguccuguucugcagguucacaccuucucugaggcagcugaagcagcaggcucuucugcuccacguccccccaacucugcccuccaggcuggugcagcggcuccaggaggucagcagggcagggaggggggcagcuucuaucccaaccuccccacccauguuccuccccucugagcauccugguucuguuuuguauugagcugucggguuguaguauaguccuaucacgggaccugcccugcacccucuggcugcccccagcacagagcuguuuaccggcauccggggaaccaggucgugccacaggguuggcucugaggaugugcuagacugggcauggguccucucagcaggggcagacacucuagugcuuauccugccucuagaucucccugcagcauggcaugcgcucugacccgggugcacugguugcccucugugagaagaccgacaaugacauccgugccugcaucaacacccugcaggugggcgcgaggcuugggugaggcaggguggggugagguggcugcugcuuacuccgcccuuuuccaguuucuguaugggaggggccggcgggagcugagugugaaggcugugcagaccacucaugucggccugaaggaccagcgcaaggggcuauucucuguguggcaagaggucuuccaguugcccaggacucaaagguagguagcccaggugauaugagugggccagccuugguccggaugucucuguagccuagggcccuuagacaccgccugacacugccaggacagcuguuuggcuucacuguguccucuugguaggguccugacuuggguugggggcccaguuucuaccccaaggggaguuggcuagagcuuccuaaaucuguggccuagagggcgacccucccugaccuuacccuagucaguucagggagagucuuuugcuccuagauggcucugcuuggagacucuuguaccuucagagugauauaaaacaggccagccagggcuucccuccaagcaugcagaauguggcuaggauggcugccggcaccuuugcuuucacugggcguggccccagccucagcacccucuacuuucaggagaaucgugggccaggaccugaugcugccagcccacgcucuccugcucagcaauggugacaagggcucucugacccuggccucccagcgcuuuuaccacauccugcgugugaccaccucugcgggcgagcaugagaagguuguccagguaccugugcccaccucagcucucgugacgcuaguacuaaaugaguagauacugagcaggagauguccuagguggguuccaaaguaaaggguguggauggacgggugucaggcaucugaggggaggggaggaucaaggaugggccacaaggacccucaggcccaaaaagggaacuaaaggaauaauguuggagguggcagaaggcaggaugaguuuugagcugguaacugggaaccaucuggagagccccgugagguccaugcuggggccugggcuuacggggacuagauacuagccggaaggagggugcccaugcuauggagagcagguagagagguaugcacuugagcaaguggcauagccuccccuacuccccagaggccuggcuuaagcugcuuccagcucuaagcagcuuuggauuaguaguugggaauccacugacaaucuggaaaugagcaguuuagaggggguguugaguaugggguauggccagugggaacuggacucgcacaggcaagcuggggccgcuauguccugaauuuugaggguguagcuuucugcucuaacuucuggaagggugggggacuagagcacaugccaccuccucacuugccucagggccuucauuagacuaguagguccuucccugguuuuggcagcugaucccuaccccuuggacuucacagagcaggagcuagugggaggguccugagacugaugcacacacacacuguggggagaugagggcgucagagggucagggccugccuacuccugcaggguucaugaccugcuuaccacucuuagggccuguuugacaacuuucuacgccuucggcuucgggacuccagcuuaagcaccgugugcugugcccucgacuggcuggccuuugaugaccugcuggagcaggcugcccaccguggccagagcuuccaguugcugugcuacuugcccuucgugccugcggccuuccacgugcucuuugccuccagccaugugccacgaaucacuuuccccagcagccagcaggaggugugucaucugcagaguuugugcuuagggucuggccccuggugggguuucugcuccccuggccccggcucacuuucuguccuaggcccagacucggaugagccagacaaggaaccacauacagacacuggugucagguauggcaccgaccacgcguagccgggccacaccacaggcccuuguucuagauacucucugccugcuccuggauguccucgcacccaagcugcgccccgugagugucagauacggaggaaaggguggaguuuguggcccagguggcucugggcauugccgaguugcccaaccugugcccucuugacccuaggugagcacacagcuguacagugcccaugagaagcagcaguuguccugccuuguggguaccaugcuugccuacagucucaccuaccaccaggagcgcacaccugaugggcaguaccucuacaagcuggagccgugagugccccugugccuggggcagggggaacaccuggggacaugcagugugugugugccaaagccaguguggucuuggugagguauccaagguguuguggguuacaauuuaggccuggcacaaauguggcuggcacuaggccucauccuaggucagacacaauuuugauuccaaguuucaguguaggguucauauaaccucuguccaucccaggguggauagccugcgugucuguagcuccuugggguucuagagggcucuaggcacagcagcagcagcaaccuugguauccugcaguuuagugagggucccggugucccugccuguucuugcucccucuccuuagccccgugcauguuccuugucuucuccacuuauaguuggagaacccccagcugccaugggguuaggcuguagcauugucaggaccuugcccuacacccaagaucuugaauuugguguauggguuggugccauaggcagacccuggcucuuacugaccccacacccuagcucuuagacuuggugcaacaggcagacuaccucugcugacugguaccgugguaucuugccucacccaccuggguaggaauguggaagaggucugccgcuucccugaacuaccugcccgaaagccccucaccuaccaggcuaagcagcuuauugcucgggagauugaaauggagaagaugcgcagggcagaggcuuuggccugggcucgaaguggcccccagguaaguuuguccccgguguugagacagcauacaacaucagugguuuggccuuggcuagccgacucucaugcuuccauucagguggaccagggcuccucagggccugcaagucuguggacagacaguggggaaaaggggacaaggcagccugucccacguaaccaugagcagcgccuagaacacaucaugacgagagcaaccgugcaggagcagguguguguguguuggggguagggcuggagcaagaugauuaccggaggguggggcuugccccaaucccaaggagccaccuguugcucucagaaagugggcagugguuaguagagguccuccuagucgcaggccuugcucagaggccuugggagucuccucucacaugggaaaggccuaggugugccugcuuguucacuggcaagcugacggcccucuuuucugcuagccugagagggacuucuuuggacguguggucaucaggaaaguggcagucccgagcagagguguguaugggucacagaaggaagggaggggguggagacauaggcuggggucugcugaggugcaaaccuuuuggucccugcagagguugaggccccccagaaggacgcggacgaguggcgcauggguguggcagugggcaggagugaggugugguuccgguucaacgagggcgucucaaaugcuguucggcgcagccuguacaucagggaccugcuguagccccacugccccaggacaucagaucgcacuggcucccacagggaauggacuaaagcagagacacccggagaagucuauuuauaaagucacaccuuacagagagugugggucaggcucauaggauggugcacuuggccuucucuacccaaggguuguucuucaucaggucuggguucaggaagggguccuuggggauuccauccucaauccacuugagaagccu

SEQ ID NO: 8463 - RNA, 3756 nt, Mus musculus
gucacucucaagauugaucacugaacauuuauucuuaauccuagacccuagcuacagccagggugcuguggcuguguuguggcagacaugugaggcccagaaggcucccaggagaggacccgaaggcuggcgcugauaaucuauggcuauguggaagccaggcagguggugacaugucaacgcuccagcuaggagcccauagaacagaagcggcauccauggcaggcuuagaggacugggcaugcauggaggaugccucuguagaugccccaacacacucccaugcauuggggccaagcgcuagaugcaggcagaggaggugaggcccuggcagaguucaggaaaggcaaaggcacaugacaguggcgggcagcaagagacagguugggggcugcaggugacccaaguccagguaggcuaaugccaggaugguccuucucaggcacuguggggcccugggggauccucguuccuggccuugcccuuccuggcuagggguuugggcaagccuggggcuaaagaggcagaaugcuguaccagaaggaaaaccugagcuuccucuggagaaaugccgagcgagagaagacuuaccuacugggcaucucucccacugcccgaaaacccuguccucagcaaucauggcugccuagcugcuggauggugugguucucaacccccaaagcccagaggcccuuaguuguccggcucuaguguccacucugauagccacugcaggcacgaugcucucugugccucagucucaggagggggccgaccuggccugggcugugggguggaggggcugcagggccuuggcccuccacucauagggucugggucagggucaguccucagggccuggaugagcuguucaagggguugaacacagguacugggacuccagcaggcaucgagggcaggcaggaaggggucaggcguacaggccuccacgcgcucugccuguguggggaugcguagguagaaggcgugcagcaucaugcggaaagguugguccuccugguccucagccuggccauaagucaggucacccacgauaggguggccaagggcacugcagugcacacgaagcugguguguccggccuaugggaucagggacgggaggucaggcugggaggaaaaccauucuuugucacaucccuugcucuuacaguauccaacaaguucucuggguuggcugcggagucuccgggcagccccccggcuugcugcuguguguuacaguguugaggaauaaacucucuucuuucuccuuuuaaaguuuuuuuaaaguauauuuuaauuuugaguguguguguuguguuccuacaugugccugcuugaugcuacacuguugaaguaaaucagaagacaacuuuuuuuuugagacaggguauauauauauauauauacauauuuuuuuuuuuucuuuucuuuucugugcagccuuggcuguccuggaacucacucuguagaccaggcuggccucaaacuagcccuggcugucuuggaccagaugggccucaaacucacagagaucugccuguuucugccucccaagugcugggauuaaaggcgugcgccaccauuucacaaugcucagaagacaccuucuaagauucuccucucuccuuccaccauguuugucugggacuccaacucaggcugucaggcuuggcagagagcgccuucguaguuaaaagauagguaugaacuucugaucuuccugccucuaucucuagggugcuacaaaugcuaccacaccugcuuacccagucuucuuuuuuaaaggauggaucccuugcuagucggucauggcacacgccugccuuuagucccucuggagagacagaggcagaggcaggcagaguucgaggccagccuggucuauagagugaguuccaaggcagucaaagcuucacagagagaaaagaaagaaagaaaaaaagaaagaaagaaaaguacgguucucuucugauuagcugcuuugcagaucugugcuacugcgaaggaagggcagggcaggguggggcaggcccuugguaugggauucauuauauuucuugcuacaaaucagacauugggacucaggucaagagauuggucggggugggccgugagggcacagucagggagacccuugaucuagccagagagaucagcuugacagccaggguacaugcaaacaccagcaaagaucuugcuaucggcucugcccgcacaccuaguauagacccaggcaggccacaaugccuauaccucgggguccuuucuuauaugaugaacuccugcccuggacauaccuguaaguggcuuuagcagcacuuuggacacagggucaccagcauauaggccguguuccaggaccagcagcucugugaggcuuggcuuuggguucucacaaccuagaugaaaacuaaaguguaagggcccacugggccagcccuagagccugagccaacuccaauuuccaccugucuggccguucccauucacgcaggcuuuggagacaugcccauggcccccacaacaaaccacuauuaccaugagugcccucgaugcacaugguaugcguccgccccuccgugcuauuccugccaauggcauaguugaucgucacuuggcuuuccuggacauggccucggaccugucgagcaaggacaucacaugcagcucacugggccacacugucaucucugagaggaauguggcugagcucuagauaggcacauaagccuggcacggagcuucaguugagaggccugcuggaguaggcugugagccuugggucuccacacagcaucccaggaacuggccaggacuuaccagugccagguaggcuuuggugacucgccguuccuugaagcauuuauaagcacugcccgcagcugccuuauucagggcuacgcacagugccccacugguggagaaguccagcugguggcagaaccugggaacgggcagaagagcagcaguggcuggacccuguggugcucugguuagcaccuuuguggcagaguccagugucccagcauccuuuggaaggaugcugcaguggggcucuccauguuggcuguguaccugaacccauagcaggugucagggucagccagcucugggaaguggugucggagcugcuucuguagggucagggucucccgccaggucuugcuaucaaugcgcaggucccagugcuuguucaccaccaggaagucgcugcucugguacacgauggacagauuuuccaugcugccaggcuccaugguggggcugcacgcaggugggagugagccugggguaggagggugccugaccuggucuucaaguacuguacacacuuacuggggccagaaccugcuggaacccuuuaugucuuccacaagggcccaugccaggggugucagcuccggaaugggagucuggccaaggucaggugauucugacuugccauggacucaggguuagggagcucucccugacuugaaguggaauaaacagccugguuguccagcucacgccuacacacuucacgcuagguuauugcccaggaccacccaggacuucaagcgcucccuaacuugccucccaccagccugugaccacaggcagacccuuuaggacuuaccugcaacagggccaagggaccaggaugucaauucucagcucugcauccaaccucgcuucccuauacuaggaaccaggucuuggccuggcuggcgcgcagcuccgccuuuucacccugcccauuccacuuucc

SEQ ID NO: 8464 - RNA, 12183 nt, Mus musculus
aggggaaggggagggaggaggcgcccgccggguucccugcaaagcggccuuauuuaucugggcacagccucagccuccccggugggaggcucagggcggcagauccucucccaccggggagcuccgcucggaacucugcggagagggcccuggcgcggggcgccgggcgcggggcgcagucgggcccugcuagccaguccagcaccucggccgccuccgcgcuaggcggcucgggugcugagcuccccaugacgcgaggucgcccggcggacagcguggcaugagccagaagcccuggccgagguaaggugugugugcgcgcgcggccaggcugcggggaggggaggguccaggucgagccacugccuccgcgaaggcuacaaugaggagggggcgggguggggacuugggacugcgccgcggccgccgccgccugagcagggcuuacguaaucgcagccccuuccccaccucacccuucggccgcugagccagcgguuccgcagccccuaacccuaguggccggccugauugcgccccgcucgcuaccggcagcgcggucaggcuguaucuccguaccacggaauugcugagaggaagcacgguggcugcgaggacgcggaacugcaggccgucagcccccacuccuucuggcuuggcucugggcucuccccacuccagcccuaugagccuccggcggacuggaggacgugacagguguugauacaauuaaaagggaggagccauguggauauguggccuagggguccuggacgccuucuggacaugagcugguauagagcugccgcccacagcucuauaccagggagugggcuggcaugucuuugguucuagaaaaagaaaaugggccuuggccaagauuggaaggcuucaaaauggggaaugggcauccugagauugcugagcagggcuuccauguccuucuaggauguuagucagugggggauccuccccacccgucaucccaggagagaaggcugcacuguugaggccuggaucuggccuagcagcccuccugcuagccccucccagcccgagccagcagcugaccucccaggagcagauggcagaugccacuucaccugcucccuccuggaggcccgacuuccacugccaucuugucccagggcccacugaccagggucuucucaggccucccugcugccccuucgggacacgggacccucuguuccagcccaacacuuugaugaagugcuggacagcagccucaucgcagcaggggggaggggcggggggggggccgguguugggacaggagccuggaugauuaggggcugccuagaucaggucagaggcaugguggagccucgauuuccugccuagacguggccugagggccgggcugggagccauugggagaagagagggaaagucaagguugaaaacgugggugauguugagauagcccaagauucagcagccucauuuccugccacccucacuauuugccuccccagucacccauacuguaaguccaggacacguaugcacucaccuguucucccaaauacaccugaacaggucccgucucgcacugaugaaguuaaaacaagugcaucuagguagcccugagagauugggcucucuauuucagaggcacuagaaggggcuucuggugggcaucacucaaccuuccugaccauaagccuucaccucugagagucacugaugaaccuuccgggacuggcacuggggggggggggaaggcagcaaagcaaggucaggaggucagugagcagcccugaacuguccccauuaguggucagauggccaaacuggcugcagagagugcaggugggccucacuuggcaggugucuaaaggagccuuggguuuugaaggucucauauucuacagaacagcgggagggggggcgugauaagaugaagccugucgugacuauuugcccuuaguuuggucacagagcauuaguuugaucuucuggagcauugaccuagguucaaccugggucuguuuaccuccugggccaagggucucccuauccccaagucccuggcacacacacaccccagaggcagcuccagcaggggguggaagaaaagugcugugguugacacgugcaaaguggcagggaugugaaugugccugagucacagcacugucacagaacauguugccugcucugugcccccaaucucagauacccuggucgucaccccaggccacggggcugccacuacagacugaacuggagauggguguuuugguuguccuuuucaaaccugaggagcugaucagggcaggugcuaugcaggccagaagccagccuccaagguggccuucauccugaccugugcacagacucagggaaagagucccuagacugagagagaugacgggugagacauuggugaguguguaguuggcggucuuuaagauuucaggguaacagcagugaccccgcuggaagauagcugugugcagaggccacuagucaaaucauaggaaaacacaggacccagugaggcagaagaaaaagacacaagguacaacagauguguuccuagucugagugcuuuggggucuugggacaaguggcaguucucugcagcaucagaaagauccaucccuuucugaggcuuguuuugaacgguggugcucuaggaagucaugaggcagggauguuggaggaaggcaucuccuuggugacuccugucucuuuuuccuaggaucaggucagauuuugggggucagccagucagauuccuuagccaugaaaccccagaagagggacuuagccaaaagaucuccucucccugaguaccugcaccucaagaucagcgggucuggggagcuaggugcuggcaccaaucuauuucuuuugaacaaaugcugaccacaagcauacccggaguuaaauucuugugcuucuccugccccgccaaccagccaaggcucucagccucgggcagcugcaccccugaaccugaaugguucaggugaccauuucuuguccauuccuucagcaguacccagaagccacacacucauggugcuauuugucuucaaggaguuaccaggccacggguagaaacagugaugacaucuccaggugacaccuggaggugcuuuuucagaguacuaggggauccuaucuauggaggcaggcagcaagcucggcacugagaaagccuaugagacaagcagggcaccgccacuuguccaggugagggggggugggagaaugaagagcaggggucuggcuagggaaggaggaauggauggagaugaggccaggagacucuuuugaugacuggauauacaaaagaggcaaguccucgugguucagcaucagacucuguggaaugccaaucuggaaaucaccaaguacuggaacuuucccaggagacccauuguacccuccauguuccuuauguccacaaugaguccucuagagagggcaaagacuacagucagugcucccggagagcaccuugaugagacgggcugaugaagacacagcagcugaggaaguugucacugucccuuccuagcccaggauggaccuagggagucccaucucaagcuccccugcagucuagagaugacccagaauucuacuccaaaccaagcacaggacauacugggccuggggcugagugcugugccaguucggacaucauuccagaaggccucuccucaguauuagcuccugaggugcuuguccgugaagggagagacaaccugggucacuuggccacugauccauccccccaccccccuccuaggaagcaggaguugcagcaucauuaaggagcucuagcuaggcauggcaguacauauuuguaaucccagagagguaggauggcuguaaauacaaggccagccugggcuauagaacgauaccugggagcagaccuuaugucaucaucuggugagauggcagggccagguggagugauccuugcuuagaaccccucaauaaccucuugcucaccuggcaagaaaguuccagucuuccagugugugcuuagcuuucucugaaagccucagcccuugaguucagguguaacuguuuccauuuuuggacgccugugggguucucaggcuugguuaaugucaaagagaaagaauaagugagaaccucucuaaucacaaagcgagguugacuuuguggagaugaggcuuccaccaaggacaggggccuggaugggggaauuagacacugaaucuggccuggauucaccuaugugacccaagucuggaaggugggaagggggucgaucgugugcuucuggaaacgugaaucuccagagcugcagagaggggcagaaaggagcccugcagaugcccggggcauccacgugcaucucccccccaacccccagcaacucaggcgcuccacgugcacacccgcggcugggagcauuuucagccuaaaucggcacagcucuuggauuauuucuccccuggcaccgccuccgcagccuccuccagauccuagccaagcgggcggcuucucccucugccucuuccuguggagcuggguuugccggagccaccgaucauuccuccuccgcuccacugucucuggugcagaaagcccggcugaccacauugagcgcgggagcuguccguggugcugcuugcgggguuccgagagcgcugauucugcgccuaguggcugagguuccaugggcagucuagagguagaccaagacuuaguauauggcugguacucaggcuggggcugucucuccacccucagcacaguucccaggaaugcgggugguacuggauaagaauuggagcacauaaggaagaaucucauccuuucccaucauggaugcugcugucccgcaacaggccagcuucccuauauugcuccagggaauugggguaaccacacuuuagacuucccuuaccguagcaugcaaacuauaacucuucagagccucggguucuuaugugauugaaccagugugcauuuggcaaguguuagcauugcuacuugcuauacuggcuuuuuuuuuuuuuuuuuuuuuuuuuuuuuuuuuuuguagcuacuauugccuguucuugagcacaaagagcagccaaggucugaaaccuuuagggaauagcuggccuacuccccaggucuuaagagucauauugagaaagggaguaaucaggagacaguacugagggccuuaggguggacugccaauggccauccuuagacacagaacuagguucaucaugaggaccauguucuggggagagcuuaacccgggacuuucccuucccagaggugggaaacuagcacagauugcaugugcaauauagggaaccauagagacagaauugcaaaauaaaggcagaagguaguucuugucuacuucucuugugucaagccagaguauaagaaagaguagccaauuuccuuggcccuguagcuccagaaaggggucucaaccuaaaggguaacaugagucuuucucugcugagggucuguguacuucagugcccaccacuugggaagcuucuucauguagcccuugguauugcuccaggcucccuggcaagguuaugagccaccaaagccagguaugaagguaugacugaagguuugguagaggcuuuuguugacucccuggagauuguagggcaaaaacugacaauucaugugugcauccugcucauccugggaucaccuauacacacagaaagggaaacccugccuugcccuugggucagcucugggacucaggauuuacacuaccauagacugcaaaucccucccacaggaaggaguuuguggugucaccucccagauuucauguugaggaaauggacucaccagaggcuagccaagagcacucauuuauagaaggggccaucuggaguccagaguauugccuuugaauguuuuaaguguugcauugagcauuucaucugcaggugaaauccauggaaaaaucacauccuucuggaugcugggugguggugggugugaugucuggaaugcagagcagacagagaucauggcauuaugagagucucacugcucuuucccuccgugcuguccacucacaguguccucugcaacccagucacaggccugggagucugaggggaacagggagggagugauucagacauguuggucaugcuggccuuccauaugaccuuccuccuccaguucugauccgaauuuuagcucuaccacuuaacuaucggccaugagcuuagucagauaguucucuuggucuuggccucuacuuccuugguuguacagagacagcacagcacuguuugcguugacucgggugggggauuagagcauguguccagcaggcuggagaagugccucagugcuugggugccugcugcuuuuacagaggaccuagaggccuguaacuccagcuccaggagaucuauguccucuucugaauuccacagauauguaugugguacacaugcaagagaacacccguacacagaaaauuuuaaauuuuuuaaauaugaaaaagcauguguccaaguaucacugugcugguagcacagucagcuauacaggggaugcgacugagccucagagccuuuuauagggauacagauuuuuuuucucuuuugagauugggcuccucuguguaguccuggcuguccuggaacucucucuguacaaggcugcucuugaacucagagaucugccugccucugccucccaagcacuggcaugugccaccacugacuaggugcacagauuuuggagagcuggucugugacucagggcuauucaagcaccuuucuucucuggguucuccgauccuaguccucaagauaaacuccaggaaggggcaucagaggauuggaggugaaaggaacaguuaaggauuccaucuaccaccgggcaugguggcgcaugccuuuaaucccagcacucgggaagcagaggcagacagauuucugaguucaaggccagccuggucuacaggacaaccagggcuacacagagaaacccugucuucuugaaaaacgaaaaaaaaaaaaaaaaaaaaggauuccaucuccccaagccucgaugggaaucagagcaucagaaagcaccuuugagcaaggcaggcugagccagugaauaggacagagagaggauguggacacuugagcuagcugugaauguggccagcuugccucuugugcagacagagaaaggcgcauacuaggaucuguucuguuaagugguccuggaaaugcuuugggugaggagccucgaggaugagaaaagguuagcucuccaguuccuccagagccuggcacacuuauuuguuccuccugucucauccacagagcgugcaagaaaaaugucgagccccgguaucgauggugaccccaagccuccaugcuugccucgaaacggucuggugaagcugccuggccagcccaacggccuaggugcagccagcaucaccaagggcacaccugcugccaagaaccguccuugccagccaccacccccaccgacccucccaccuccaagccuggcuacaccacuaucccggguugcucuggccggggggccaugccccccagccaguggaccagccucggguccagugucuggacccccaguggagcggccaccacuggccacagacgagaagauccuuaaugggcuuuucugguauuucucagcaugugagaagugcauacuagcucaggugugcaaggcuuggcggcgugugcucuaccagcccaaguucugggcgggccucacgccugugcugcaugccaaggagcuguacaacgugcugccuggaggcgagaaggaguuugugaaccugcagggcuuugcugcuagagguuuugagggcuucugccuaguuggugucuccgacuuagacaucugcgaguucaucgacaacuauucucucucuaagaagggagucaaggccaugagucucaagcgcuccaccaucacugacgcuggucuagaggugugucccaaaauuggcuaugaccagaugggucugggucuggggagggggguggggaacaugcagaagcaaccuuauggacaugggagguugaggggccuggaagauacucagguguauacaggauaaaaagcagcaaggaugguauuucggggccuaaugcaaagugaaaaugugggcuuguuaaaaagugauuaagaugucaagguuggugcaagagaguagucaauuacaugugggugucugcuugcuugugaagcugccuuggugaaugggcugcugggcugguguguggagggguagcuaagagucuccuagaagcacccugcccugccuccccacaccccuggaccuggauuguaauuuuaauauucaaaucaucuguucuaaacaccugcacuggccacacccuggcuuguguccccugugcccugccuccccccuuggaauauugggaaaguauaacaagcaguuuaagugcauuccuuggaguucagccugaugcaugcuugcacaagcccacgccugagagaccaccgcuuccagaaucccagaaacuucuucgggcaggcgugagccagggagcugacuuagucugauuuguaccugccuguaggugaugcuggagcagaugcagggaguggugcgucuggagcugucaggcugcaacgauuucaccgaggcuggccugugguccagccucagugcccguaucaccucccugagcgucagugacugcaucaauguggcagaugaugcaaucgcugccaucucacaacuucuacccaaccuggcagagcuaagccuucaggccuaucacgugacugacacggcccuggccuacuucacagcacgccagggccacagcacccacacgcugcgccugcuuuccugcugggagauaaccaaccaugggguggucaauguggugcacagucugcccaaccucaccucacucagccucucaggcugcucuaaggucacugaugauggaguggagcuuguagcugagaaccugcgcaaauugcgcagccuugaccuuuccuggugcccucggaucaccgauauggcacuggaguauguggccugcgacuugcaccgacuggaggagcucgugcuggacaggugcacacaucccuacacuccaggcggguacuggugggaucuccaggaacuggaagccuagaguggguggugcccgguucacaggcuucggggauggggaaaaccacauagaauagagugcccaaaacuggaggaaaagccauauuccaaaaggggaggccacggggugggaccaggggaagaauagggcauugguguguggggcagagacuugcucuagggacaccucugaaaaggggggaaggaccuagguggggaugggguaaagugauuuaaaggugggcagucccccuucuggugcaaccacagguguguacgcaucacggacacuggucucagcuauuuguccaccaugucgucucuccgcagccucuaccugcgauggugcugccagguaccuccaugcccccagggaucuggaaauuagagcgugguugguggcgggacaggacaggguggaggaccaguacagauuauccuugaacuucaccccgccucauucagaguccucuagaaccagcagccaaacuaagcagaaucauuggguuccagauuccccaaggcccucuuggugcuuccagucuacggggggugggggugggacugagaaaucuccauuuugaaccccuaccuccugccccucuaguggcuccaggucccaagcaaguggaaauaaguuaacacgaccuccucucacucccgcccaggugcaggacuucggguugaagcaccucuuagccaugagaaauuugcgacucuugucucuagcaggugagacaccccccacccccgcaugccucaugggcaacgaugcccacucacucugacccccacccccaucagguccuuugugcagauagauucauuucagguuuuggcaaaucgcaucccagguagcggguuagagggugaauccaagcccuguuggugacgcccugcucagaucuacccugcaucaggccaagucugaacacauccuucccugguggaggucccgcccauccugucagauucccaccccuccacgcccgguacaggucccgccucauucagcaagcccaguagaauccaccccuagcaggucauuguccucuucagccuuucccaccugcccagcccaguccaguccucccgccaggcggaacugaacugcugagcggcuguccccgugccucaugcuugcaggcugcccgcuccuaacuaccaccgggcuaucuggccucgugcaacugcaagagcuggaggagcuggagcugaccaacugcccuggagccacacccgagcucuucaaguacuucucgcagcaccugccgcgcugccucgucauugaauagcgcaggcuucccgacccggccgcgggaaccggccacgcccugggcaguagcccuucuuccaucccugccggagcaucucuucuccgcccugcgcuggaggcggggcaagcugagggaaaucccgccccgugccucccuugcuccucugcucaacugcuccuucccugucuggggcaagaggcagaggggccagccccacgcacgcacgcacacucggggacuuugugcaugccccucgugcccgcacugcacgcccgcccuccaccaugccacagccgccgccaucacucgcccgccuucugggggucuagguccuuuuggggaugcuuugagugcauaugcccucacuggcuuccccacuucauucugcucucugccuccccucgcuguccccccaucccgggcagggcccaaggggauggagggauuggucccccaggacuuaggggccuggaagagcccccaagggccucccacaucuuccacugcaccgcgccuggagcccuccaaaggguaugaggcgccacaggccacugccaaagccauggcccccugaggagcccaacuccccaugcccaccugaccuaguggcuucccuucuuccuuguugccauauaggucaguucuuguccucuguauccugcgccccuacccccguaucuccuucuuucccccuggccuacagauccuugggcccuggccagguugggacagcuuuaggaggacgcagaccuuggaacaaucaacauuagccuaaccggugcccauccaccuaagugcaaggguggaauaggcaccuggcagaccccaaucuggagccacccacagggcuaucaggccuugggaucagcccacccauuugagccccuaccccagcugagcucaggccucucagcacugugcuucucccuggauaggucuccucagguggaaucugcagagggccuggccaugagucagggucaguacugaccagcgauucugaucucccaguggccagcacccccuucacaccccagggaaggagggcuccuucccaguccuccuuuaguucucccagcuuccaaaaccuuugccugcccaaaggguuugugaccauguucugucaggucucaagaaauuuggaaguccuaggggauccuggcauauaggugacaauaccgaggaagggacugggaaccuucccucccaaccuugaaccccaggagacacagcacccacaacuaaucuugggacaccccuaucugguuggaagagaguaaacuaauucccagagagccagagggagagagagagagagagagagagagagagagagagagagagagagagaggagagagagagaugcuguugacgaaaaguaaagauucaacagcccaaagaguucccugccccugcaguguuggccagggaggccccaggcugaaguggucaggagccagauuugucagccccucuucccacagucccccaacagggagggggaagcuguccauuugcccaaaguauuaaugcaacugaagcugugauauuuccaaugacuguaggaggaaaauuuaaggggagagaggaacacaaacaaaaccaaccaaccccuaaaaucauuuucuuauuguacauaacgaccucauucuccuguauaugcggaagauauaaccuuauauuugguaaguguuucuugugcuauuuuaucacgugaccuguuuauaaaaauauauauuaaaaaaguuguaaaaacacaag

SEQ ID NO: 8465 - RNA, 2903 nt, Mus musculus
ugauuaaauagggauguuguguggauguguguguguguguguguguguguguacaaugcgcuuguaugaagaaggaggagacuuccaaggccggcuggcuacugcuugcagguagcuacagcaguccggaugauaagccaauggcuugugguuacgcaagugucgacagaauucccagcgugcugcgcgccugcacccguauguucauggcggcggcugggcggcgcggucugcuuuugcucuuuguacuauggaugauggugacugugauucugccugccucuggcgaagggggauggugagccauaggaaauggguggcgggagggagccugaacuuaaagcuuugacuggccugaccuguugucccugcaggaaacagaaugggcugggaauugcagcagcaguaauggaggaggagcguugcacaguggagcgucgggcacacaucacguacuccgaauucaugcagcaguaugugugccugccccaagucucagcaugauucuaggcauacuaccaaucauggucuuuggcugcggaggucucacugccugguguguaggagaggccccugcagaguucaaacucagugcaacauucuccucuuuccccccagcuaugccuuccucaagcccgucaucuugcaaggacucacggacaacucggugaguauucguacccugugggcaacugcuucuguuuggccaagugcucaguuaccuuauccuucauccccagaaguuccgggcccuguguucccgggaaaaccugcuagccucguucggggacaacauuguucgcuugaguacagccaacaccuacuccuaccagaaaggugagcuacacacccugcaagguuugccuucacaucucaaaggcagaacugaccagucccgacuggcucccccuucuuguaguggaccugcccuuccaggaauauguggaacagcugcugcagccccaggauccugcaucccuaggcaauggugagccagacccaggcagcggugggagugggguacuugggagcccacuguugccaguacuccugccuaucacccucucugcuggcagacacccuguacuuuuuuggagacaacaacuucacugagugggcaucccucuuccagcacuacucuccgccaccauuccgucuccugggaaccaccccugcuuacagcuuuggaauugcagguaggggcuacuucaaaacaaacuugggggagcccauauauauuuuguucaucagcuauucauaacugaccccacaggagcuggaucugggguacccuuccacuggcaugggccugguuucucagagguuaucuauggucggaaggucaguacaguguuauguguguguuauguguguguguaaaucuggugucuauaguccauugcacacauagugaccuuacacuccugccuccagcgcugguuccucuacccuccugagaagacaccugaguuccacccuaacaagaccacauuggccuggcugcuggaaauauacccaucucuagcccugucagcacggccucuagaauguaccauccaggcuggugaagucaguagcugguagguggggguugggcuaacucaaaaagccaugaaucaaaauuuuuuuuuucuuuucucccagguacuguauuuuccugaucggugguggcaugccacacucaaucuggacaccagugucuucauuucuaccuuccuuggcuagccagacaggcaacuggcaagcccacugcaccagcacaugccaauguagugcucacagacuuuauuacaggacaguggcagcagcagcaaccucagcccacccucacccacucuccagcccagaagggggacaagggaggcucaugguccagcaagggguaugcugagaaggggagcaguucagaacccaucagcagggccgaugggggcaggcccagggacacaaacuauacagggacuggagcuuccgucuccagauccuccugggccagggugccaggcaggacauggggccucaauaguccucuacccagccguucucagagaugaaagcgucaaugacuuccuucauggccaaguuggggaugagcuguuccugggucagagggcuccgggucacagggucaaaguggcccacacgcugcaacagagucaagaguguucaauggccugaguauaccgauccggguaccaaggcucuccauggcccggucuccaugggcccuccuuaccugcaggugcuccucaauguccuugcggucauaggugauaccacuggguguaaugcaggguucccgcaucagcucaaagcuaaucuugccacacaaguagucagggauaucucgcuucuauagcacaaggggaaaaugucuagaacuggagggggcugugggggucaccauaccagcagcagccgaugagcuuccggggguccucaccuuucuuuucucguccaccugagagaagagcucauccauaucugccauguauuuauccugcagaguugagugccaugugugggcaacuccugucuccacacagacacacacacucuguccaccagggcacucaugucaugcaugggccaacagauccaccaaaggcuggggcacuuuucaugccacacacaaacacacacacaaugacccacauguggacuaggggcacccucacgugcuuggccucaaugcaggccugcugggcccggauguggccaucaucuucaugacccucgugguuccgcugacacuccuccaguucccugaggguuaaccagaagcuaguuggugauggcccugaccaggaaaucacagagcccgccccaucucaggccucuuuccuccugggcuucccauguaccgguuguuguccuucaauaaaaacacuugugcuggugac

SEQ ID NO: 8466 - RNA, 5073 nt, Mus musculus
uuaaaggggccgagccucugggaccgcaaagugaagcugguggagggugccugaucuggccgcugccaggggcgggcgggacggcgcaccauguacacuaucaccaaggggcccagcaagcuggucgcgcagcgccgcacaggugcgcagggcgggcgggcaggcgggacguccugaccgcuggcucgcggcggcugacagcgcccuccgccccggcccgcaggucccacacagcagcagguggagagcaggcuuggcgagcuccugaaaugccggcagccggugccgccgaccgcgcuacccgcgcaccugcagcccucggcacagacucagggacccuggccccuugcaaggugagccaggccgccgggcacgagggugaccuuggagaagguugauggggaccacgcguccuggugggcagggggcggggcgcaggcaacucgugcacuucugcucgccggcuacuucugggcccagcuggcuugaguggacccugguggccacguggagccuugagggcuuccgaccaaucccgccugucaaggaccgcaaguacucaaaaccgagggaccuggugaccuugggccgcuaacuuggaccccuugggaaguggucgaggucaaaguuggggaaaguugcccaaggcccuggcucucaaggacuucaggcccuguccuugcagagcagaagaagcgcacguguucccgcuggucuuaucaggucccugcccuucacuaacacccugggacacuggagcccuccuccccagcaguugcccgcgccuguggguuccaagaguuuucugauuuuccuaacccgcaaugugucuagggaaguucagcccuagcuacuuggauuucagccagugugaccuggaagugaucccacucaaccaaggcugaaccuuuuacuucuuuggcuccauuuacuguuuccuguaucgguagacuggacucugcaggcauguaggcucuacucugguagagguggcaugugaaccgguuaagagagagcaccaaagagaccacaaucucgagggaggccaagaguuagacucgucucagcaggggagucuguguggcuggcuccaccccucuuagcucucagcuacuaggcuucggaagcuauagguaggagaugccuguguggccuguguuugcccuaggggacauccguaugacaucgguuuauguccuuauugcccuuaugucucugggagaacucuauggugcagauguauaaccacaaagugguuacccagacagggaguuuggagcugccuuggugacuggccuaucucuaccugggaaacaccccccccaccccccaccccccacccccaccccagagacaggguuucucuguguaguccuggcuguccuggaacucacucuguagaccaggcuggccuggagcucagaaauccgccugccucugccucccgagugcugggauuaaaggugugcgccaccacacccggcgggaaaacaccuuuuaaaguccuuauuguugggggacaacacggacaggcuuguggcaauauuugggucaguguccaggaagaggagaagguaguaacacucuccagaaugcugaguugcaagagacaccacacugcguguuuccucuaaaaaggcuucaguaagauaagcugaugugaaggccuggacucaucugucagcaaccagggagaacaccugacgcccgggagauugguuuccuguccugaguucugggaacugaggagauaggcuaaggagucuucccuauguccucugagguggcccuuuccugggcugggaacucccaucuccaauaggaccuucacauggaauuuuaccucuaguccuuugucuuuucaaggccacccaucagucacccauguccaccagcaucagggaacacaggaggcacuggucauucuccugcugcuguggggcaaaaucaugaagcuuucaacccacuaaauggcuaggcaugggugcugccaguuaugguggccaggccugugccucugacauauucuuuucuccuggcggcaagagacagaugggggagacuugagaugcgaccauguuaccaccuaccccaccaagagcagauugagaaaauguucagggaccacugggcagaagagccuugggacagagucaagguugggaguacuggggucagaauacugcuaaaucuugaaauauugauuuugaaucuugaugcccuucgcugugugucacaggcagggagaucccaggcugaaagaugagugaccggucaccuugaggggguaggagaguacaugagaggaugucuauggggcacuauggccuggugcugcagcaggcagugggccuagaaguggauacaggugcacucugggauuagugcccuuuccccuacagagccuggucuuauauaaccacggccucuaagcagaagcugggcagggcucagcaugguggugcagcacuugcccucuggggcccuuuccagcuccagggccaccaccuuaauccacagccccuggcugggauuuccuuuuguuuguuuuuuaaagaaucaauguaaggcacagguaggugugcuacuacacacccaccuauguccugguacuuaggaggaugucuguuagucuagaucccgccucaaccaaacaaaagacauaaaaagacucaguguccaaucccaacagcucgcucgcauugagcuucagcccuuucgggggcagaggugguugcaggcaaggggguggggguuuccauuuggaaugccuuuaugcaccggggcaugguggcuugagccuuuaaucccaguacuugggaggcagaggcaggcauauuucugaguuugaggacagccaggucuacagagugaguuccaggacagccaggaccacacagagagacccugucuagaaaaaaauaaaaaugccuuuaugcccucuaguuuaccaaauacacagguacccguggguuugggaggaguccugccuccucuggucuccacuggcacaucuaaaauuuucuguagccaccagaccuggccagaccuggggcuggcaggacccuguaccccucaagacccuccucuuuauuuuagugccccucucaccugaggaggaacccagagcggcguggggcaccugagcccaggaaggcgagcaggccugccgggaccgcgagugccuggcggaguggcaggugcagcccaggacucccaccuccuacuguaggugcggccccauucccuccguggccccaccccaggcuucacgagcacagggcuuggucaguugccgccagucaacagagauggcacauuacugcccuguacugcccugcacugcccugcccugcccugggccugcuuggccucaccccugggccuacaccccuugauauagaguacagcacaggguuauggggugggggagcaucucauucaauuugccccuuuucucuugccuugaggagugggucaggcuuaaggucauguuuuucccaaagagacagcccagcauuuuguguuccucucccaggggucugggggcagccggggacagggacgaguaaacgccgauccauccuuguuuggucuguguucaacaguggggggugucauugaggacaucucuagaagaaggggacuaugcuugauggguggagauggcaaaagguucugaucauguugaggucugacccagacugcuggaagccugccugguggggauugggagugcagaggaguggucucugggaccccugcugaaggucuggauacagagcuggacucuuucugacuugcaaucacucaccuucccugggcccagagcuacagagcugagcugcagucagcucagggucugaaagcagagaggccuuguuucgaagcagcuaagggcagcugcucugguuaaggaagggucuaguuugggccugggccuaugcaggugcaguggguauguaccagggccgcucuugaacccugcaagguagcuccuggacauggcuggugccaacuguaucucucuccuacccucccacaguucugggccaagacuuguauucaaucgaguaaacggccggcgaccccucaccaccuccccaucccucgaggggacccaagagaccuacacaguggcccacgaggagaacguccgauuuguguccgaagguaguaagggaccaggggguguggcucaggccacagaauuccaguacuguggccauggcuuggccuuguccuuccccacaauacccugacuccuagcaggucacgggcuagacuuuuccuuggcucucugccuggucauguccauuccuugagcugggcuggagugcaagguggcccccaggugcuggggugggagggacaccaggggcccgguucauucuaacuguuccuucccccacagccuggcagcagguagagcgacaacuggauggcggcccugccgaugagaguggcccacggccugugcaguauguggagagcacuccugauccccggcuacagagugagccuucuccuaugccucaaaucccuaaagaacccucuauaccagguagccucagguaguuggggaaggaggugcugggucagagucuccuguuuuccauuaauugcugugcuuagaguccagauuagggggugugaucagcuagagggcagagguaccagccagcuugaaaagcagcaucacugccugacauuuauucuacccacagacuuuguaccuauugaccucgaugaguggugggcacagcaguuucuggcuaaaaucaccaacuguuccuagcagcuguccgggaaggaauguugccauaguggacccuuugccagaagaggaccauggugcgccgauccaccuuguggccuggcuggguaccggccacaccugaagugccaacauuuggacuuuugcaccuguuguucccuuggcuuggcugucccaagcugccagagccaggggccaaaccugucuaaccucaguccugcucacugugcccagggaccagccccuggggcuggcagggaggaguucaggcuaauaaaguugagaaacugcccuuu

SEQ ID NO: 8467 - RNA, 2046 nt, Mus musculus
ucuugcgacccggguucgauucccgggcggcgcauguucuuuuuauuuucccguucaucucugaaaaggaaggaugccuugcaaucuuaaacaccauuccaaaaaaggugaggcgcaaacgcaacaaaugagcuuuuaaacaaauacagcugaaagacuccaggaaaccauagccucuacucgagccuuguuccuuguccgaagucaccgcuaaaucccggccgccggaaucaguuucccgcagaugcaaacccuuuuaggaguugagaggccuccuaacaguuauacuguugcaagcggcuggcccuuucgaccacaacucccguagugccccgcgcaggagcuggaccacagcucccguggugccccgcgcgcauucuggcuggggcuggccgcaccgcugcgaugaugauggcugcggcugcugagagaaacaaggagcccauccuguccguacuccgccaguauguggauccugcccagcgcuguguucgcgugcucgagguggccucgggcucuggacagcacgcggcacacuuugcacaggccuucccgaaugccgaguggcagccgucggacguggaccaacgcugccuggacaggugcggcggcgcggugucuuucccuugcggccgcuuggggcugagugaacggcggggcuggcagaccggaaaucaggacaggccuagguuugggugccagacugagguaguagaagcaaugggcuguagggucgacaaagauacccgcuugcugcuccucaggacuuuccccccacaccccgaucacugaggggccucgucagcccuugcccaugcgcugcugcucuccacagcauugccgccaccacccgagcccaaggguuguccaaugugaaggcuccgcuguaccuggacgugaccugggagugggagcaauggggcggcaucccaccccgaucgcuggaccuguugcucugcaucaauaugauccacaucagcccccugaacugcacagagguggggaccacuguggagcccagcuuucacguugcaaagaggaaagcaugagucuccagcucccggcuuacugugcccuacuugccuuccucugcaggggcucuuuagagcagcaggacaccugcucaaaaccaaggcugugcugaucaccuacggggugagugacccuaccuuaagacaccccuaucagccuuggguguuuccccacucuugaagcccagggcccgggaccuagcuagcccuuuuccuucuugagugcagaaaaaaguuauucuuucuauacuccuauggaaagaacuccauccuauccugcaaacuagcugugugggaacgacugacuuugggccuauguauugugucuuguucucacagcccuaugccgucaaugggaagaucucuccccagagcaacguggacuuugaccugacccucagaugcaggucagaucuggcuaggagguagcuuggcucagagagaggguaggcgggaucauaaccucaacucugcaaaugccuucuaccuuccuccccaacugcaggaacccagagugggggcuucgugacacaguccuucuggaggaacuaggccaggccaguggcuugguccuggagaggaugguaggcagggcgauguggggguggggagccucccugugauuaagagucacuccagccuggcaugguggcgcacgccuguaaucccagcacuugggaggcagagugaguuccaggacagccaaggcuacacagagaaacccugucucgaaaaaaccaaaaacaacaacaacaaaaaaaaaaccaagucacuccagcaaagcguuuuuccagguggacaugccagccaacaacaagugccugauuuuucggaaagaauagcaucucugucaaaaguugucacgguacaagcuagaccucagccccucccucaguccuugggauaaauuagccccuccuggucugguggccacagggcuguagagaaccuguucugaaggggccuuaaaauaaauccuuuccagcccacugugggcuaucuauaccacauugcu

SEQ ID NO: 8468 - RNA, 3233 nt, Mus musculus
ucuuuuugagacaguauguucuuauguggccaaacgggccuggaauuugcuauguagcuaugggcuggccucaaucuggauccuccugugucccgccuacccagugcugggguuacaaguguguaccacagaugccaaguacccuagggguuucuuacuccaugccagugggaaaggugccuuaccuauaguuaugacagguguggcccuuggcugccuuuggagaaaaucuagucuaauagcuggggcuggacugggucccuauccaaccucacugaauaggacacugaagagcagaggacaaaagccgaaauuuaccagcccugccccuccucccugaauagagggugggagggucuuuaaggagacuuugaucccuguugggcuccagcuuguagagggaggggcucagguuacagcaucccccucccugauugagcuggcccuucuccgccccuuggugacccuaguggucaguugcucugggcuucagggccucuggccccuccccagcccuuccucuucuucuauucccaguccuaugcugaccagagccugggagccacccacagugguugggagagggccagccaguauuuuguggacagguucugagaggccccagaauaacuauucaggguucagagaagagcagcaucaccugugagcucaagccuugcgggguccaagagucccaggagaggguccuuugagguaggggguagugauccugggcccaggacccuauaggguggaugccuauagggagucucagcugguggccacacacucccacucccuggcccugugguccccaugccugccccacagccauuccugccucugcucuuugucuucgugcucauccaucugaccucggagaccaaccugcugccagaucccggaagccauccuggcaugugccccaacgagcucagcccccaccugugggucgacgcccagagcaccugugagcgugaguguaccggggaccaggugagcacuggcauuucaugggauccugggccccacccuaguucuuuccucaguggggggaguagaccccaacccuaggagucugcuuccuccaggguuccuccacacucaauuuaccuggauuuguggccaugaccuguauguacauggggcucaaaggauaccccuaccuuuuuguccucugaagaacaagaacaucuccaauucccggacugacugcaaccucaccaauccugucucucacgugccugagcaccacuuuuuuucuuaagucaugugggcccaggccucugaccuaccccugcaaauggcaucaucaccuucccagcccuggccugucuguaguccuuuccucauaucccagacugggaaggggacaaagagcucccaagguggugcgcccucugauggcagagcauuugccugcacacuguuccaccuacucaguaggaaugcuaaugagaguugcacaggggccuugaggauucagcgggguugacuaaggugacugggguugacuaaggugacugugugaccuuaguacuccuacuguucaaaaugcacagccacaguuuuucacaggggaggaagcuuugaaaaaggcagcuaccucucccaggauagagaggcagaguagugcauaggcaaggcuggguagggggucagggcuccacuaaacugucccugucccucaggacugugcggcauccgagaagugcugcaccaaugugugugggcugcagagcugcguggcugcccgcuuucccagugguggcccagcuguaccugagacagcagccuccugugaaggcuuccaaugcccacaacaggguucugacugugacaucugggaugggcagccaguuugucgcugccgugaccgcugugaaaaagaacccagcuucacaugugcuucugauggccuuaccuauuacaaccgcugcuacauggacgcagaagccugccugcggggucuccaccugcacguuguacccuguaagcacauucucaguuggccgcccagcagcccgggaccacccgagaccacugcucgcccaaccccuggggcugcucccaugccaccugcccuguacaacagccccucaccacaggcagugcauguuggggggacagccagccuccacugugauguuaguggccguccaccaccugcugugaccugggagaagcagagccaucagcgggagaaccugaucaugcgcccugaccaaauguauggcaacgugguugucaccaguaucggacagcuaguccucuacaaugcucaguuggaggaugcgggccuguauaccugcacugcacgaaacgcugccggccugcugcgggccgacuuuccccuuuccguuuuacagcgggcaacuacucaggacagggacccagguaucccagccuuggcugagugccaggccgacacacaagccuguguugggccaccuacuccccaucauguccuuuggcgcuuugacccacagagaggcagcugcaugacauucccagcccucagaugugauggggcugcccggggcuuugagaccuaugaggcaugccagcaggccuguguucguggccccggggaugucugugcacugccugcaguucaggggcccugccagggcugggagccacgcugggccuacagcccacugcuacagcagugccaccccuuuguauacaguggcugugaaggaaacagcaauaacuuugagacccgggagagcugugaggaugcuugcccuguaccacgcacaccacccugucgugccugccgccucaagagcaagcuggcucugagcuugugccgcagugacuuugccaucguggggagacucacagagguccuggaggagcccgaggcugcaggcggcauagcucguguggccuuggaugaugugcuaaaggacgacaagaugggccucaaguucuugggcaccaaauaccuggaggugacauugaguggcauggacugggccugcccaugccccaacgugacagcugucgaugggccacuggucaucaugggugagguucgugaagguguggcuguguuggacgccaacagcuauguccgugcugccagcgagaagcgagucaagaagauuguggaacugcucgagaagaaggcuugugaacugcucaaccgcuuccaagacuaguuuuaugcacgauccccaucccugcccuccuuccugcugaauaaauguccuugccugugggag

SEQ ID NO: 8469 - RNA, 27442 nt, Mus musculus
cuccggguucccagugccgcgugcgccccugacgcgcuguagccucgggccccggcugggcgccacgcuacggaagcagcguaaggcguagcggguaggccgggcgggacggcgggcgcuagcuacggaggcguuuguaagguugccgggccgagacggaucuucgcggccaaaacgcgcuaagccggcggagcaucgcggcuggcgcgaaggggcccuuggugcccuccggucgaaguugugggucaaccgacugagggccggcacuagggccgcgcccgccuagaccgaucgcgagcgcugaggaggcgccgccggcucgcuaaggugaguuccacgguaggcggccggccagacggccuaggacucguagagcucggccucagggcaucagccgggaugcuccauguuuguccugggagcaguagccuggcuuguggugagcgggaaggggagggggaagcgcgccggaggugugggucacucgaggccagccuaggaaccucagacgcaggcgacccucggugccugccuguccuugagugcccucuuguccggggcuaagcguuggcccacuguacgaagguauaggucgugggggcacugucugcagaaaccugcagcugccuggggcggcagcaagaguaaagcguccugugugcccccucaucccacacuucuguuuuugcgggccugucagcaggccgagaaaguuacagagcagccccuugacagcugcgggauuuucuuuuuguuuucugaaaaaggggcccuuccacgucugauuugggaacccuguuguguggccagaugguccuugcuaggcuggcucuuagggucccugaguacagauacugaaacaggaccgcgaaacaccuagccucgaaaacaggauagauaccuccugaguuucaggagaaccugagagccuaccugaguguuugcugcugacccugcaguucagcaauaaaucaggaagaacugcuacucaguaagaaacugugagauuaccccuccaguggcaauuuccccuuucccagucuggagaacugcaagucacagauguggagcuugccucuugaguuucucccugcuuccagagucuagcugucagggaugcgcucaggaccacaguucugcagucuagggcaauugugucuugcugaacaguagcuugccuccaugggguaguagauucuguuuccuuugagguccuucugcuccacagagaugcacccauuucuuuucuaacaucuaagaaugucuagagcugucugacugguagacaggucauugaccuccauggaggaagacuugaacccugcuggauccaaggcucagaaacuguacaacuuaacugcaauggaguuaucaaaaucucugcuggccauagugucugagaguggcccuaacuccauaucuauguagaagccuagguuaguccucuguggguaaaggguuccauuguggcccauccuuggauccaggcuuugucuacucccaagcuuuccuggccccuguuguacauuguccaggccuuaaggcaaaacuuguaaggcccauuuuacagauguggaaacugaggcuguccgucauccauugacaggagagggauagacagaguucuaagucuccaaaccacaagcauuuuuuggucuccuuccacauucucacugguggcucuugagaugagccuuuuuggugaccugaaaaccuucaguauacaugcuauugaugagcugauaaguuaagagccuaagaaaguuagaguaguccuuuguccaucccuguggucuuuaguaucaacacugccuuucacugcacuagacaauugcuggggcugaaaaggccaaaauuaaacuuuuuaaaaauaauuuuuaaaaugauaaacgaaaaauguuaagcucuuugaaaaacaccagauacggagagacccaggaucacuggugacuugucucuuuauuuugucaugauuucuaaacuguguggccugggaggcugaauuuugagaaauacagauauggccuuaagacucuggccuaaaggacacuuccuguccccaccuccaccccucccuaggccugggggcgggguguggauuguucuccuaccuggcuguuuaucucuugacuacccuguccuuccaguccccucugguucuaucaccucacacagucugagcacccugaaguguucugugcuccugcuuucagaagcucuaauuagucccuaacuccucaggcuggauacaccucugccauuuggccuucacacauccucaguuugucucggcugucuggagccauuugauuccuagaccuccaauaucuuucuagccuauccccagggcucuguugggggcagcccagcuccuggugucucccagacucaagacguguguguuauuucuuggcaaguccugguaaccaacucaguucacccccacacugaucagguagccaguaagcauccucaauugacugcugaccucugguagccuugagucgauugacuucuaagguuaaagaguucuccuaacccagaaaaguagcauguggucucuguggaaacaggcaccuggcuuguuucucagucugagaaguaaacuaccagcuuaugacccuugcauaagugucgcugagaggaggcagaggagacuggguugaggcuuggagaucaugaggcuuagccacaugauugucauucuguggaccauggcauggcuguguggaaaccuugugaccaguggaccaaagaguaucuugguguggacagcauauugccuaccagacugguccuacuaggcagacaguggccagggguggcauuauaggaggacaguguggcaaugcaggcgugguuagugugggucuuaggguaaaccaucauaagguguugggcaguccaacugcucuguucuacucuucugcacaagcugucugucaugugggaaaccagugauauagccaucacugcguaagaacucacugggcaccagagcaggcuugcuccauuucaggaaaacaagugggcacuugcccuggccucaacccucuuguacugacaaaggcacagucguggcucuccugcaccauauuccaugucucagcuucccugaaucugccauccccauuucccuguggccaagcuggaggaugagccuggguagaguguugggauauuggaaggaaaacaagucgauagcggcuauuugaaaaugucaggguacagccauaccugcugcuaacaggaugggaaggcugcagaacgcucacugauggagaaggugcccucucccguugccuuccucuguccuuaaaaguucuuaaaaguuguguuuaaagaagucucaaagcugggcgugauggcgcaugccuuuaaucccagcacucaggaggcagaggcaggugcauuucugaguucgaggccagccuggucuacagagugaguuccaagacagccagggcuauacagagaaacccugucucgaaaaaaaaaaaaaaaaaggagucucagacuucugucccuugcuuguucuugcugaccauacacaauuuaauggaaaaaucaauauguucuauagcuuucuggagccccugcccuucugcagagauguugaaaggccagagcucuaguggggaaggaagucaggggagacaugcuauggccccgcaugcuccuaaucccggccaccucuuuggagcuggccaugagcuugagugccucaucccaugacucuuguucugcugauggcagggccggcaggcugcucuucuaccuucucuuaaaaugguguuccacauuaaacaacacagcuugugaacuaaaaacuuaaauccuuuguuuuccuggcaauaccacguugaaaaacacaauuucuguucucauaauguauaauuaagcuggugugcaauucccucuggauggucacagaaggaugcucaguggcccuuucccuguuaggaugcagcaggucuggcauguagaugccucaagaguugcuguagcucaccucagcaggaucagugugucucacuugcucugaauaggcguacagcuggaggugccgcuacuguucugagguccagccucagcucaggggugugugugugugugugugugugugugguuacauguaugucugugcauguguaucugugugcuugugugugugugugugugugcguguguguguguguguguguguguguguguguguguguguggcuggcuggcuggcuggcuggcuggcuguccguccuggacuuacuucagaccaggcuggccucagacuaagaaaucugccugccucugccucccgggugcugggauuaaaguuguguggaacuauacccagcuucagccugacuuuuugacuucugcuugugagcuggagaccaggaagcacuugacacaaauggaaaaauggacagccuucuucuuaaggcuuuuuguccuacaccuggcucuuagaugggcuuuuucauuuucaguauaaucucugguucacuuuuugaguucagcuugcacacugcuucuuguguguagguggaggguggugaccaccaucuccaguauuguucguacgagggggcaguggccaagugcguguaggagguugcagugacucagaagggaaguacaggaugaggacaugugaauauccuaccuggcauggcagcaucuuccauggugagcagcugcuuagaaaagcagagcuuugcagcucaaacaguggcuccgcauuggcaggcagcuggaguggcugagcagugccagaacccgaguccagggaaucuugauggcauucuacuguuucccugagcccugccccaaccugggcaugguucccuggcaguaccuagacagccuaggcuuucuugccaacuacuacugaucuguggcccuggugaugcacucugcccaagagcagaaccaaggugaggaacaucaagacaggaucuugaauaaccuccuguauuguccuuaccaguauagaauuagccacaggccuguuugacuaugggacaaguugguuccugugacagagguaguuaagagccagcaaaccuuguuguccccuguggucucugucuguggaauaaauacaacuuguuaaaggacaggagucccugaacagcaugugcucaggugggacaguaaucaauccucugaaagguucucacuguagcacuguacaagagggcagggccugagccacauggucagucaggacucauuuguaggacuuuggcuugugcagauaaucccagaggcugcacuuggcauuccugagccagaguccaaaccuugauaaaagggguaugcucucuuggugaggauugcaguggucagcuuuuucagaggcccuuuccuaaggcagcaacucaggugugggcacacuggcaucucgucaggugagcuaguuaccaaaugguguggcuuguuuguuggauuguuugauggggcagcagggcagaaguaccgagguggcaggaggaaccccuuucucugggccagugcccaaggucucuggugaccagcccucugcccugcugcccugcccuaccaaccugguucucugacuuugcggaaaauauuuucggggaagcuaugcuaguggcauuuggucuugccacuugggucucguacccucuuagauguaccaccuaagaugucuugccuguggccugccaaaggcucaaagagcuaaggggguaguacacuccuguggagacacucccccugucucuuagagaaugcugcucagccaguuuucacaggguugggugcuuccuugagguagaucuuagccuaguuucuugaagggaggguuuacuuccuguccccaggccauuuucucuggagcuggccuugauagcagcugcuuuuggacagaauugcauuccagcaguggcuuacucuuggcuucacaucuggacuugcugccuccugcacugguggguacaaguauaagauauggggguagcuaugggagucaggugggggcuagacacugcucucccuugucauccgcucucuuaagaggggagugacaugggguuacuguaauuaaagugggagagagaugguccuuuauaaaauuacccagaggagggccuugugugguagauacuuuaucaauuguuauaggaaaccucguucuacucuuguuuuacugggguugggcaccgccccagauaggagauguaggaagacauuguacuuccuacaccaagagcccuggaagcacaaggugcaguaggucucccuggccuugacuugguaaaauccccagauuguccuggaaaugagacaucccacaagucuuugggagcucugggcaggaaauacugacuuggcugugguaguguaggaccaagggacagccuauacaaaggguuugcagcccuuagacagguuuuggggcuugugagagccaauccaaccuccaggccuaagcaccugugaggaagagccaugaaucugaccuaccugaaguauacuaagcaucuccccugcaaauggguccucagagcugaaagugaagcuguugaugccauagcuaggacuuggccuccugacugagaggacacccuuauguggcuccaugcagaaucuaauggaagugucauccugucuucucaugcuugcccuggguggauaccccccagcuguccucaacaaacacaccaaggcuggggacaugcuaaugcagcuugauaauuaauacuuugucuuuuagagcaguggcagucccauuccuugaggccagaucuaggccacugucccauuuaaaaguggaacaguucccugaugaaaauaaaggagguacuggcugguaggucauggaguugggaaggcauagcuaugcuccuggguuaagaggaugggagaaccuaucucucaaaucuuguggucuuuacuguccccugccucuucugccuccuguuggaggcugaugugguuacacuaauucauguagcagugagacaaugucuggggcagggaccucugagaaucacuacuugcugugcccaaccuccuaaagcaaccugacucaaagcacaggucaacggguguuugcugggcacacagaggaguaaaagaaugagcaaguggaguauucucuagaguagcggcaaagcgaggacagcacuugagguaacucaagccuaacacccaggguggggggccgugcuggaguacagccuaugcaaccagaaugugaacaaagacuggauccaccuguguuggcauuccuuggugucccugcuucaccacaugcuaauuaugcugguguacucugggcuagaugggggagaccugagagggaccagccuccuucacucagagaagaccugguucccguguccuuggccaaguugcuuggguggaauaauugcuuuuguagagggcuggccaagacagagaacaacuaguccucucuagggcugcugcuggauucccauucuauucucucaguggccccugauugucagacuccagaaggaaggcauguagaaccuuuuacccagcugccuacauacauguggacuugccaacugccagcguugcuggagaugcuggggucuauaguugugccugaaaggccagcagaaagaagguggguuucaagaggcacacaugaacagcuaugugguaagccacacaaucuuacacaggaggaucaggaauggaagaacauuguugucuacauaguguuuugggccaucguacgauacaugagacugucucaaaacaagcagagccauacugaugccagcuucucaaggugagaggaccccguaggccaacuaagagcugguagucaaguggcucaugguguguguagugggguuaagguaggggucaucaucucucaagccucagguggcccuuagccaggacagaggcuccugagcacaccaaagggcucucuccuccucgauagcagacaugauugggguuuugucgcauggagaguuccuggagucauuguucuuucuucuuuguucugcauacuuaccaaauaagaaagaauaugcuguccccacccucccaagagacccuaugcucaaagaaaguguccccagugagcgagcacaaaggcaggaggaggaugugcucugggcaggauuggcaagaaggguaggugaggacuauaggaacuguggggcaagcagcacccaagcccaugcacgucccuaguaccuuccuggaggagcagguaaucuuccuguaggcagaugggcagccccugaauauauuuccugcuuucauaguaaaugugggaaagacccuguggugaacaauuuuugccccaugggcauuugugcuaagccuaacucaauacucuuuccucccucuccccaacucaguguuuggguaugagagagaagcaccagaaaugcugggguacauuucuuuucuuuuuuuuuuuuuaagauuuauuuauuuauuauauguaaguacacuguagcugucuucagacacuccagaagagggcgucagaucuuguuacagaugguugugagccaccaugugguugcugggauuugaacucuccggaccuucagaagagcagucgggugcucuuauccacugagccaucucaccagcccugggguacauuucuuacgggaggcucccauguugccagggcuugucaguuugaggguugcuguggcacugacaaccacaggagacacaggugacugggugacuguuguaacaugggacugauggauaggagcauguuuugcuaggcacccugccaccaacauuucacuguaguuagaauucuggaaucuugauuucuuaaaaaaaaaaaaacauagaaauauaauaauauuauuucacucuaaucccagguguggggauguggggauauggggcuguuuugcagcagcugacuaugauuugccucgugcucuagcaaagacgggguuuugccaacugcagauaguuucugcaacauuuggaauucugggaacuuuucagaggguauguaaguguuagagccccuacaggcauuguuggggaauggagauugcaguuugacaguagucaugauccaaaaacaaaaaaacaaggugaagccuggcaugguggcacacgccuuuaaucccagaacuugggaggccgaggcaggcggauuucugaguuccaggacagccaaggcuauacagagaaacccugucucgagggaaaaaaagggggagggaauuagauucagaucucugccaguuccccuucccucacaucccugccuuccacacucucucucucucuccccccucuauucuuuccuguuuagugauauggaguaaaacuggugggggcgcggauaaaggguagaaaaacaaagaaccuauaaaguagcaaagaagaaacaaaaagaaauuagauucugagaucuuuaucucucucuuuccucucuagucuuucucuccugucuagugauagaggagaaaccaagggugggaaaaagaagaauucaccaaaguagcaaaaaccagauacaauucacugaugccccaaacaaagccaccagcacaggagccuacugugucccaugaaggggcaugucuauacugagcuagaacacaguccagagaucuuaaccagagccaagugcauuguauuacuccagaaacugaggcaggagaaucaggaauuugcuaucagcuuaggcuacauuguaagacccugugugaacacaaaagcaguaagaaugugagguuagcugagguuacuuuguggcacccugagagggcuggggaguagggaagggcaccuugaccagaaaagggauaguaguauuaacucaguacugucauuugggaugauuucauacugacaggacaacagucuauagacaauagauuacacaaaguauacuagcaucuuuuuauuugagcuuuguuuuuuguugacuuauugguuuuuugguuuuuuuuuuaaguuauuuuauguauaugaacauuuuacgugcguguguguguguguguguguguguguguguguauacccauggauguuagagaagagcaugucagaucuacugacacuggaguuacagauuguugugaacugucacaugggugcuaugaauccaacccagguccucuacaguagcaacaagugaccuuaacuuuugugccaucuuugagcucccugcuuuguuuccuuuugagggguuucaguauguacuccaggcuggccuagaaaccuugauucaucugcuuuaguuuccccagugcuggauuaugggaggucacauaaccaucucuaccuguccuucuuugccuugcauuauuauuaauuuuuuuaaagauuuuuuuauuuuauguaugugaguguaccauugcucucuucagacacaccagaggagggcgucagaucccauuacagaugguugugagccaccaugugguugcugggaauugaacucaggaccucuggaagaacagucagugcucuuaaccgcugagccaccucuccagcccugcauuauuauuauuagggcagggaacaugugcccaccugugaagaucagaagacaauuuugggaauucuuccaugguggguuccagccagaccucuagccuucucuuaguucuuuauacccuuuguguggguugcagaaagucugaaccugggcuuugcugccuggucgaagccagccagcucuccucaauagaacagucaggagacauuuguggcuucuugagcugugugaucucugaaagaagcaacagacaacauguaaauaaaugagcauggucuuuuguguagaaacugaaauuugaauuuucuagcccagugugauaucuuaugcuuguaaucacagcaccugagaaguggaggcaggaugcggagcuuaaaccaaucugugcuacauaguaagacucucucuccaaaagaaaaaaaacauggagggaggcaugugaaauguucauugcacauaaguucaguucuccuaccuccccuuuuguuuuguucucuagccauuuccaaguaugaauuaaaagccuucaaaucucaaagggccauccagccaauagcaccaggcccucugcaaaagcagccccuggcaugcuaacucagaagguagugaggaaagaaacacuguuucaugggaaaaguagcugguucugauugaaaccucaugguguaggguugcagaacuaauuuuccccaugccuggguauguuggagugggacugggcuuggugcuggugacccucccagguaucaggugcuggcucucaaaggcacuauacagacugucaccugucaagcagaacugcaccccuuaugucagucuccccucaucuguaacccaauaccaaugucuguguuauagagacuuacucagaagccagagaaagugcuauuggugugugauaggagacucggguaggaacugcugaaaccagacaaguuuguggucuaaccagucaaagggcagcauagagaccuccaccuacauagagaccuccaccuacagccagaagagggcuauaaguuauccugugagugucagucucgcagcugccaaguccucggguuuauuuggucucauuagcacucccuuagccaccagguguggcucuccugcacucagcauggauggucucucaggcucccugggauuguccaggccuaggacuugagggugagugugccuuuacacagucggcugcugcccuuuuaaaggcagucugacccuggccucuuagagcuuuaagugccauccugcugugcccucugcccugcauuuuuuccuuuccugugauuuuuuuuuuuuuuuuuuuuuuuggguuuugguuuuuggagucaggguuucucuguguagcccugacugucccggaacucauucuguagaccaagcugggcucgaacucugaaaucugccugccucugccucugccucccaagugcugggauuaaaggugugcgccaccacugcccagccuuuccugugaacuuaaugucuccuugauaguugucuguaaugaggcagaauuguucuccuaauugaggaauaaaaccuuuguagacuagagacaaguuugagagggaucguggguuuuucagacuaggguuauuuccuaaaaccuuacugugccucaagucagggagcagcaguucuguggagcgcuggccuugggccucugaccuguauccuuuguggagcuugucuaugggaugugcacuacagugcugaauacuuaaagucaugcccaggucccugaaccucauuuuccccuugcauaccccaaggcaugcugggaaacacacacacacacacacacacacccgggggguccuagaguuuucaucugugugaguuacacuguuucuucucucuuucuauucuguuuauuuuuguuguugugucacugaccagccggcugcccuuucuccggugugggcacucuccucucuccaugcuuccauccgugugccaccggccagaggugaccaggcccggcucucuacguggccgcugucaggggggccauggggagcuccgccuccucccuggcugccgagacggagucagaccacggcuucccuggggggccacccuacccagggcccccagcagcagcuggcugguguaggaguggcccuggggagacugucuggggaagugcucuggucaccagacagcauccacgacccagggcccaaagguaagaagguggggaggggcaacccugaggggucauggccaggagaccuccuuuucacuguguccuuccuuggcguagaugcuugcuuagagcaggguuucuguuugucacuauuuccuggcaacucauuuucccuaaaggugcaggagcugagcugaucugggguugcugcucuuggcugccaggucugagacuuuccucugccuaggauugugcuguagcaugcuguugagcagcacucacccagcgccugucguauuccuaugaaaguugucuggagagccccugcuaggguggcuagcaccgcaagcaagcaagccgagugcuggcuagcuucacacaauugucagaguugaacacuacuucccuccccuaccuaaggugccuaugcuccaguguggcugccucuaaggaugccauucugccuguagagaaccacaggggccuacuuuucccuucaagucauccuuucuaagccaugugugucaucagcuuccuuuagagggguaucugacacucccuagacauccaggacuucaccucagagaggauguagaccuaguagcucuguucuaguaaaccuaggaaacucuuaacuguccucugcucagaagccaugacacacaugacacacaugacaugacgcacuucacaaacagcuaccaggcauaggaaauuaucugggcauaaaacuguagacaggagacuaccuucugaagugacuuugaccuggcuggggugacuuuaaggagauacuggcacugauacuacuggaaucuguaggaccacguuacucuaauggucagaagauauugggaacccaaggucuggagagccgugacaagcagaaugggacccuucaagcaaguggggauggugcacugauucacaugagggauuacagugucaguucccuuugggucugcaagacgcuccaggcaauaccuccaaguugagguuuaacuccuuuuaagcaguuuuuuuuuuuuuuuuuuuuuuuuuugaaauaagaccuacacacugucuuaguuuuucuauugcugugauaagacaccauugaccaaaaucaacuaggggaagaaaaguuuauuucaccuuauaguuccacagcacaguccaucacugaagaaacucaggaagggcacuuagaggaagagcuggugcagaaaccauagagaagagcugcuuacuggcuugcuccuugugucucacuuaguuugccuuauagcauccaggaccaccagcccaggggugacacugcccauaggaagcugggccuucccacgguuauagucagucaugaaaaugcaccauaggccugcccacaggccagaugguggagacauguucucaguugagggaucccucuuccaaaaugacucuagcuuguaucaaguuaacaucaaacuagccaacacacacaccaucaacuauuauuaguguacaagucauuuucaaccagucauagcuuugaacaaacauuguuauaaacuuguuuacacuugaaagagauccuguuugcagucauuuggucccugcucuggccccaggcagucacugcacugcuuccugucucugugcuucccuuuucuagagauuucaccugugaccuggcucugucuggcucaugucacaagcacacugcccucaagguucaucccacugcagcuuugucaggaccuccuuccuuuucacacaucaguaguaugcugucuuaagaauaagcuacccagccgggcagugguggugcacgucuuugaucccagcacuugggaggcagaggcaggcugauuucugaguuagaggccagccugcucuacaaagugaguuccaggacagccagagccucacagagaaacccugucucgaaaaaccaaaaaaaaaaaaaaaaaaaaaaaaaaaaaggaaaaaagcugcccuuggcucucugcucaugaacagaugucauuuccacuuagcuuuugugugaugcuucuuaugcucauucaugcuaaagauuguuugauuguauuuuauuuuuugguugguuguuguuguuuugcuuuguuuugguuucgguuuugguuuuuaagaaaaggguucucuguguaacagcccuggauguucuggaacuugcucuguagaccaggccugucuguagaucugccucugccuccagaaugucacuaugccuagcuuuuuuuguugguuugcuuuugguuuuggguuuuuguuuuguuuuguuugcauguuaaagguuuuuauguggauguguguuuaauuguuguuuuggguauaucccugggcuggggcugcuguauauggugaauuuaucuaacauucugagaaacacugcugucucggggcuggcccauuuacauuucccauaacaguguuggcaggguucugcuuucccugacuuugacgaugcucacugucuucuggcuuugauaacuguccugcagggugugcaguggagcuugauuugauuugauuuacauuuuucugauggcuauugguguugaacauuccgugugugugcgcgcgcgcguguguguaugugugugaguguguaugugugugugcguguguguguguaugugugugaguguaugugugugaguguguguguaugugugaguguguguguguguguguguccugaggaaauuuaagaguagaauugcuagguguaccuuguggcuuugagugcuaaggcuauauguuggacuuccuucucagucuuguaagucagucagucgugccccagcagagaacaucaccauacaugugucacauggguggaugacucuccuacuuucauauuuuacuaaauucauauauguagaugaaaguuuacuuuuguuguugcuucauucuuuuuguuguuguuguugcuucauucuuaaaugaguuuugggggggggcagggugagagauuguucagcguugugagcagucacaucuagacuacauaauuuggcacacugaggcaagaagcaaaguaggauuguuaagaguuugaggcaggcccggcaaugguagcacacgccuuugaucccagcacuuggaaagcagaggcaggcagauuucugaguuagaggcuagccuagucuacagagugaguuccaggacagccagggcuacacagagaaacccugucucaaagaaaggauuugagggagagagcagggggcuguggagagauggguaagcgguuaagaacacugacugcaccgagcauuauagugcacaccuuuaaucccagcacuugggaggcagaggcaggcggauuucugaguucaaggccagccuggucuacagagugaguuccaggacaaccagggcuacacagagaaacccugucucauaaaaccaaaagaaaagaaaaagaaaaaaacaaaacaaaacacugacugcucuuccagagauccugaguucaauucccagcagccauaugguggcucacaaccaacuguaaugauaucugaugcccucuuuuggugugucugaagacagcuacaguguacucauauaaauaaaauaaauuaauuauucuuuuaaaaaaaaaaaaaaaagaguuugcagcagccugggccacauagugaguugcaggccauccagggcugcucagugagaccgugucucaguaagcaaagcagcacaagccauagagauggauggugccgguuaggagcacuugcuucucuuccacaggacacuggguugaguuugcuuugcagcacauaaccaucuagaacucuguuccuggggaaccagugccucucugacugaccucuagggccuccagcauauacacgguacauauacauaaacucaggcacacauaaauaaauaaauuaaagccaagauuuuugcuggguauaauggugcacaccuuuaaaccuagcccuccgggacagccagggcuacaaagagauccuguaaauaaauuuaauuaauaagauauucacauccagagcucuggccaggcauuguagugugugcuuguaauuccaagacucuagaaguagaagcaggagaauaaggaguucaaaaauagcuugagcuauguaagaaaaaaaaaaaaaacuaaagauguccagaaugguuuggauggacaaguaggauaacaagauaaucccaagaccugaggauguguuguggcuccauacuacucuagcuuuccccugaacuggcaucuccaauauguauuaguucccacuacagauaguccuaggacuuaagugggcaguggacauccaaguugaaucaguaauagauaguguuaaugaucuagaagaauccauacauauccagacuagaggagauggaccucagaggguuacucagcuagacagauggaagaaaaacaggagaugacacucuuguguggucaccugucaggacuccuuucccacauaugugcauacagucacaccgaaguaacacaacauaagcaugugaaacaggcagccucuuucccugcucugauagggcaguaguggccugagagaagcauggggcauggcaguccucauauuuaaggacugccaccuccagaauauuagguacucuccuuuagggaaacacccaguaaguggaugaaaagacugcucacaccaccugagccaaggagaccaaggaacagugacucucccuccucugcccucucgugagcccaguguagaagcccucuuaagcccagccucaccuggcugguuaaucaguacacaguugauuuaggcauuggcugccugaggacagagacaaggaggacacacccauccagaaagguugaacaggccaggcugaggccaagccagcagaguagccugguacauuucccuguaaagguagacacuccccucacccuucuuucuauagcucaggacagucuacccugaguaugagaaacuagcuaagaaacuggcaagggugggcccagagcugcucugcugggcagaggcagccaucuuucaucacugaauuaguagcuucccagggcauccuuccucagguuggcagguuauggguucuuccuaaaaggggaaagacuucuacaaagugcacagccugaugugacaaccucuaaguccucugggugcucauuucuggugacucggguggacucuguuguggcuccagagugagcagauuucucuggcaguugucccaguuugcucucuguugugagccaguguccugacggguugcaguuauuucugugaacucacaugccauaguuuaggaguguuucuguugagaaaucuagauaaagcccaaaacccuuucuauggauuuuuacuucaggaucuaagggucaaacccaguaucucacacacaugcuagucaagugcccugacagccagcaacacucuaucugucaugcuaagacguccucaggggucuugccaaagacuauaaaacaguuuuauugagucuucagcuguucagccugcuuuuacugcagacuuuugugguaguaaaggcuugccuguggaccccaguccuugagcccugggcacaggacuggccauggacugugagcaauagccaagugaaccaaggagggugaaggauaggggucuugugaggugcacagcacggagcugaccagagcugcccaaagagucuugauagguuuucugguuccagaagacccacagcuuggccucugaccaguuuguccuacuucccaggacauaugugaucuguaggcauuguuugguuugcacuggaguuguccuauacuacagauggagucuucugacuuggcuuaucuacugagaguuucuauguggauuuuccuaucccccugucuccccgguugauugccaugcuuuagguucagcugggccaaagccagacacuggccaccgcggcuguuuccugagaugaauugccaccuggacuucuccugguauuugaaauuuguauuaguagucuuucuccuuauuaugacacaauaccuaacaaagacagcuaaggaaauaaggauuuacuuuauuccuucuccaucauagaaggggaaggguugccagugggagucagggucagagggaccggagugaucugcuuccucugccugcugagugcugcuggacuuauacucaugagccaucacacccgucucaggccaacauucaagucagugucuuaauuaugaagcucauauaguucuaauaauauacaguggcauagaguaaacauaccccauucccaaagagagcaaauggggcauagcaagguaaaguagggugaagaaacccaaaaccccaacuccgaagcucagugcccugcaccuguggcacuguaauagucuccccuugugucguccacagcagcugcacuccauuccuacagcuuuccccagagacaucccaugguccuggcaccccagaaucacggggugguuguugcaucuugguauuuacucucacagcgauauggcuucccauggccuugcagacauucuuacuaggaauccagacauauaaacaagccuaucacggaagguaugcuguccacgguucaaggaaagcacggccgugggagcagggggcagcuggucaugcuaucugcagccaagaagcaaagaagcucaagcucucuccucuucagauauuaauuuauguuguaugugcacacucacgcauaccguggcucaccuauggaggucagagaacaaucccuggaaguuagcucuguccuuccaccauaugaguccccacauaucaaacucaaaucucaaaucaucagauuauaguuugauuugguuugcuuuuucuuuuuucuuauuuucuuuuuuuuuuuugggggggggggucuuuucgagacaggguuucucuguguagcccuggcuguccuggaacucacucuguagaccaggcuggccucaaacucagaaaucugccugccucugccucccaagugcugggauuaaaagcaugcaccaccacgccuggcugguuugcuuuuucaagacaggguuucacuguguggcccuggcuguccuggaacucauuuuguagaccaggguggccucaaacucagagauucaccugccucuaccucccgaguacuaggauuaaaugcgugcgccaccagcaccuggccagaucaucagauuuaauggcaaguauguuuaccugcugaacaaucuccccagcccuucuuuucccuuguaauuuaaucugggaccccagucuaugggauaguauugcccgcauucagaguaggucuucugggguaggaauagagggauauguuguuaaucccagcacuuggaagaggcaagaaagucucuguaaauuugaggccagcauagacuucagaaugggucuucucucuucaguuaaaccucucuggaaacacccucaaagaugcugccagccagaggugcaucuucugugagauuccagauccagcuguguagacaauagacguuagccaucaucagcaucccucaguuuguacgucaguggccuagagccgaaucagagagcccuaaguauguugcccaugagacauuguggccauagaccucaaaggagccauacuaauuagguccuucccuugcagccacacucauucuccugggucuauggccacaguuggggagugguccugugcacgcugcaccuuccugaacccugccggccaacgccagugcuccaucugugaggccccccgacauaagccagaucuugaccagauccuucgucucagcguagaggagcagaaauggcccugugcacgcuguacauuccggaacuuuuuaggcaaagaggcuugcgaaguguguggcuuuaccccagagccuguuccuggagccccucugcugcccauuaucaaugggguccugcccaagccacccaccauacugguggagccaaagggcagcgguaaggaggaagcaggcccagugcggacagcagggcuaguggccacagagccagccagagggcgcccugaaggagaagaagaaagagaagaaagaggagaagaagaagaaaaggagcaggagggcgagggggagagggcagagccuggcaguggcugggcaugccagcgcugcacacugcauaacacaccaguggccagcucuuguucugccugugggggaccccggaaacugucauugccucgcauccccccagaagcccuggugguucccgagguuguagccccuacuggcuuucaugucguuccugcuccaucccagccuguccucccuggggaaggugcugaggcugauucuccuucuaccagccagggucccaccuccacugaccaggagccacccaggguaccacucuucagccccuucucacccacccuacagaacaacccuguacccagaagccgccgggagguccccccucagcuucagccaccugugccugaggcuguucaguccucagccuccacaagcuccaaagggccccagcagggcccuggaagagcugcagcuggggccucccgccucgcugagcuacucucaggcaaggagcugcugccaggcaagcgacugaguguguuggaggaggaggucccagagagcagcccugcccgcugugagucgugcagugaugucauugaccuagcuggggacauugugcgcuacacaccugccagucccuccagcccugacuucaccaccuggucaugugccagguguacacuuaggaaccccacaacagcccccagguguucagugugugguggcuccaagcugcaugguuuccaggagcacagugaacccccuacccacugcccugacuguggugccaacaagccuggccccuguguuggcuccuguggacgagcucccucagcacacaaggcuguccgucucuugcccgaucgcccgggucagugggccugcccggccuguacucugaucaacacaccucgggccaagcacugugcagccugccauacaccacagcuucuggugacccagugccggggggcuaccccccugaggcgcagggagaguaugcauguggagaagcggaggcagacagaugagggcgaggccaaggcacucugggagaacauaguggcuuucugcagagagguaaguagcuuuguuuuugaggcugagaaccagcuuugcccaagguaacuuacguuuaucuccacuacucaugucacuuccccucagcucacgugccuaggagcgucccagagcucccauguguaagcucacagagaugaggauacagugaggcuguucuacacagggcagcauggagacccuguuaaagcucaaggcuggggcacccuguguucuguuuaagcugcagagccugggaccuaggugacaucaccauugggucagcugaaagagcagcuggagccaugccauaccaggcuaccaugcucacuguggccugcuugccacuggccugcagugucauagucagggaguacagguguccccuugcccacucaggaucauccugauggugagcccuucaaaccuccaaaguugccuagccccaagguugguuuaaugugcaagggccccaccccaaccuucugccgcucccuugggagggugggucuucccccaaaagguagagugggauuauucugggccugaggcuguccugcccagccugagugucuggccauggucccugcagaauagugugaacuuuguggaugacagcuucccccccgggccugcaucugucggcuucccagugggcgacagcguccagcagcgagugaaacaguggcugaggccccacgaaaucaacugcucugucuucagggaccacggcacuccguggucagucuuccacacccugaggcccucugacauccuacaggggcugcuggggaacugcuggugaggcuccagguucccgucagggccagacaggcucaggggaggauggaggcugcugguccaguugugggcauguugugaaguugccuggcucccuccagguuccugagugcguuggcaguacuggcugaacgucccgaccucguggagagggugauggucacacguagccuaugugcagagggugccuaccaggugcggcugugcaaagauggcacguggacaacagugcugguggaugacaugcugcccugugaugaggcuggguuuuugcucuucucacagguaggacagcaaggugggagguaggguuagagaaaccaggccaucuaugacucucauccuuccccaggcacagcggaagcaguuauggguggcccucauugagaaggcacuggccaagcugcacggcuccuacuuugcccuccaggcagggcgugccauugaaggucuggccacacuaaccggagcccccugugagagccuggcgcugcaggucagcuccacuaacccccgagaggagccuguugacacugaucucaucugggccaaaaugcugaguucuaaagaggcuggguaagaagggcaggcacugccauugucuguggcauugggaggagaggcggagcugugggaggagugggugcccuuucacuguaucugcaucuaacaaggugcucuugugcagcuggccauagccagaaagcagagcuaguacauuuuucuagguagccacacugggaugagucuagaucucauuaccucccacuuaggaaaagacaggcaagaguccacagagggacccuaaggagugggaagagguguucugagacacaauauccugggcagcuuugugaaccuugacaucccucucccaaggccuaggagaguauagauccaaagacuuacagaagcccugggccugagagaggauucuaaaauccauaccuacagcugaacuugggcaguacuccugcccaccgcuucaggccuaagccuucagaagcccaaguugcuccagcccaugccuucucaccucauccagagugggccaguacuuccugaaagcaugugucaugugggucacagcacaccgcauauucaaggagggcggucuccccugcuguccauccauuucaucagccagggguuacucugcccacacagguuccucaugggugcguccugcgggggagguaacaugaagguagaugaugcugcuuacgagagccugggucugcgcccccgccaugcuuacucugucuuggauguucgugauguucagggcuccagguaggggcccaauuggcugaggguggauaaguguguuggcacaaggcacacagcuuugguucucaguccugugauccacaggcuccugcgacuccggaacccauggggccguuucuccuggaauggcaguuggucagaugaguggccacacuggccagggcaccugcgagcugagcucaugccacacggcagcagugagggugucuucuggauggaguauagugacuuuaucagguaccugcaugccucacccauccuguggcuagagcaucugggagcuggucuagauaagcagcuugucugggucccagcuccugcaggccucugaauggcagcuccuggucuacccaaggagcucuguguaagucauucugcuucuugugguguccagaaaaugagucaguuugcuucacugugacacacacuggagaggaacaauuuaaaacuaguagcacaccacuguaauccuaguguuccaaugccugaggcugaggcaggaggaucccaaguuguuccugaaggacuuagugaguuccaggccagccugggcuuuaugaauucccaucuuuauuuauauauauauguguguguguguguguguguguguguguguguguguguguguguauuucacucguggcuuccaaguuucagcacaugaucagcuaacuccauugcuuuagauauggugaggcagaaggauguggcagagcaaaguugcucaucccaucgccuccaagaagcagagacagacaggaagagccauguauacccucuguuuccugcuugcuucaaccaggcaccaccucucgauagcuuuuccauucaacuaugaacucacugauggcuucacccaccaaugagguuaauucccuccuggcugcaguagccccagcagcuggggagcagacacuucacauacaaaccacaacagagcagcagccuagaggcuugccuccuggccagagaaccuuuucuggaaagaugcuggggcuccuggggcagggagggagugguaggagacagccugcuaugagugcuagaagcugagcaccaagggcccuggugugagugagcagggcaccccagagcagccccauuggguugugcucugcucagucacucuuucccucacuguuuagguacuucgacucuguggacaucugcaaggugcacucagacuggcaagaggcacggguucagggcuguuucccaagcacugccggugggccugugggugugacagcacucacagugcuggagcgugccucacuggaguuugcccucuuccaggagggcagcagguagguaacaggauggccacuauaccaagcuaggaguccauggcuguggccacaugagcacccagccuauuguuucuggcccucaggcgcucggauucaguagacagccaccuccuggaucugugcauccuaguguuccgggccacuuuuggcacugguggccgccugagccugggccgccucuuggcccacagcaaacgugcuguuaagaaguuugugaacugugaugucaugcuggagccuggggaguaugcugugguaugcugugccuucaaccacuggaacccugcuccaccagggcccccugcccaggguaagggccccagccagaugaggcccacacccuccuucccaaccuccgagccccaaagcccacccacgggaaagcugcuggcucccuuauccacaccccccacagccuccagccccucagcaggggucccccgaggugcccccgagccacccggccacguacucgcaguguacagcuccaggcuggucaugguggagccgguggaggcgcagccaaccacacuggccgaugccaucauccugcucacugagagccggggcgagcggcaugaggugggugggguccugaugggggagggcagagggugggcaaccaccagcccuggcccacccacccugugccugugcccagggucgagagggcaugaccugcuauuaccugacucauggcugggcgggacucaucgugguaguggagaaccggcaccccaaguccuaccugcaugugcaaugugacugcaccgacagcuucaaugugguguccacacguggcagccugcgcacccaggacaguguaccaccccugcacagguggguaccugcuguuuucuugccuacccuaggcccugcucuuccacugguccucaucagcccucuccugcaggcagguccuggugaucuugucucagcuggaaggcaaugcuggauucucuaucacccaucgccuggcacaucgcaaggcagcccaggccuuccucagugacuggacagccucuagggguacccacagccccccacucacaccugauguggccggccuacauggaccccggccacugugacugcaguucccuagggcaagggcugugugcagaucuacccaccugccccccuacaugcacuuuaugagggagacccccaauggaggaugcuugaaccagaaucucaggacccugcccagggagccgccagccacagggugcagccucccuugggccucccuccccuccuaucccaccccaaguacccucaguaccccaccaggccucccagcugccaugcagaauaccucgaaccgggugggcuucauuccaguacuucugucuugagcccuggggacagcuucagauggccaaggcccaaagggggcggcccugugaauauggggucacuuauuauggagaggcagcccagauaaauguucgcagaaccaguccggguuuuagaggccaugcccugcucgccgugagaaccugggcaacccuuuguggggcucagaucugcugcugcuccccuuguuuguucccaagcccagcucccugcccuaaugaucaggguccugauagcccuggcauaugagcagugcauugcaggaagcagaugccugguggccaucggccagggcuuggggacagcuacaccuccugcaacacuaugcaauuccuggagcaccugccaggaucgaagccaugauggagccacaggacaggagccagucccagcccugcugucuggagaagugcuuuguccuuaguuucccuggccacagucagcucugcccauggccucagucuguccacaaagagggauacccccuacuccgguccuaucacaggcacauguaaggugugacugacuacucccuccccuagaugagggagccaagcugcccaccugcccagcauucccucagcugcuugucaaaaucagagcccuuaccugccacauggacgccugagucauuuccugggccacuguugugcagcccccuagguaggggcagcucccaagcccacugucccugccuccauggggcuugcuaggguuuuuauaccuagagaaacauuccccuucccucugggccuccuuuuacucugagcugugaauauuuuuaacccuguaaauaggaccagcucuucgaacacagagacuauuuuaucagcugucagucccuuccuuguucgaugaugcaccccauaggccauuuccacucaggcuccacggaccaaauaaaaguguuuuguuuuguaagaagcuugcau

SEQ ID NO: 8470 - RNA, 5218 nt, Mus musculus
ccacgucuuucucagaaucacuggcugcagaaaucagcucugucucccgagaugagguaccuugccccgccuugguauaacccuaggccucuuucuccuguacaggccccuuccuuucccugcauugacccucugcuuuccugcagcucauggaagcaauccagaagcaggaggagaucaauuuccgccugcaggacuacauugacaggaucauuguggccauccuggagaccaacccauccauccuagaggucaaguaguccaucuuagcccaguuugggcugguuagagacuccacagcacccaggaguggcccugucuugccacaaagagcccgaccagcagguccugcagcuuaccaagcccaggguguguggggcccucacgcaguucgacugggaaaauacagaagggcugcagaggcaauaagaaggaagaaagggaaguccacggcaggcaaaggguguggcuggcucucugaacaucaggaaaccagggccucccaccacaagccagccucaccaacaacaccaugucugcucagcaguaugcagauauguggggauagucucucaggcuggcaugggccccuuucugcuaugcgcccuauuaggaagagagagagagagaaagagagagagagagaaugaguccucccucaguugcugccucucacuccuggugacauggugccacccaagcuuggccauucccacauagucagcaagcugaggacccaaaguuggacacagaaaugguaguguuggaaagacagacaggcaaagacggcacacguugggucugcuuccaguccauaggccaccaauucuccuugcgcugcucaggccuucucucaccagaugggcuuccauucaccuucggacccagggccuccaagccacacagcuauucuuuggccagacccucacuacaguaacucaucaacucuggcucuuguaggggcuggagcagcuaguucaugcugccuguggaacucacuuccuggacugaugagcacggucagccucuguccccacugcaggugcugcuucuccucagguguggccuaccuaggcuccuggacccacacccuccucaggcugacuuuacugccuugggagaagucuacauuucccagacaauagucuaggccucuggaacaguuuccuucucugcuuuugacuuuaaaucccugggugucccccaggagucaguuugcuaguggauaauggaggagguucuacacugacccagaggcauaggaaggcuugcugucugcccugcaccacccacagagcugcggcacccauagcagcugggccugagccugagcacuagccggagucugggcacagugucugagaccacaccauaggcugcgugagugugaguguguauggaagugugugcgcaagugugugcgcaugcaugagugcgcacacaaguuugaguguaugaauucuugugcccacacaugcugcccugcaucccuucacugccuaucccccugcccccgccucacacuacaguuuaagauguugccucguauuguacauuuuggggaaagccuuguguguaaaucaguguaaacuuggaggagagauuuuucuaucauguagaguagguauuuuuuauagauugaagguugaucaauuuuuuuaauacuuuccagagagaaaacuaucuguguauacauaugaaauauauauauauauauauguauaauauaucaauacuggagccccgccuuucugugcccagguccaggcccuguguaagggcuugcagccugucucugcuguccacccugcagugcucacuuuaaacacaggucucuaggagacccugggaaacacaccaaucaccaacuugcucaugacauugcuucagcucccugagaaguagcucuuccuccagggcauggaaggaugggaggccagcaggacccugccccaugugucagcuaccacagauuaaagcuguuaccgcacacggagccggcuucuuucuccacaggguggugggguggguggcuaugggccuugcuuuuaucucccucagguuucuagggagaugacguuggccauuuaaguacagaccaaagaaacccacuguuuucugcccugaucaggucaggccuacccugaggccccaggauuucuccucuaggaugggcagagucuagguccugaagugaguuguucaauugacagucacuucuaaaggcaaguucccgaugaccucccacagccccuuagugguaagacuugugcccugaauacagcccagaaggacuauaggagccucaguugagguugccacacaggcagaggggaaaguauagauguggaucucacagaucucaggcacagugcucuuaccccuggccuacacauccuguguccaagagaaaucacuguauuguggucagaggguauagugaaauauugagagccaucgagaaugggaggagguauauuaugaagaguuuaaguggcacaguagacccugacacuacacaucaucagaacagcaaaccacguaccuauugcacucccaguuagguucuagccaugggaauuuaauugacaccaaaaaggcgccucugccuaggaaaggcuagaaauaaaccaggagcacagcgcaccaaagccuggcagcuccucgguguaucucccagguaagcguuguccauucaacccccaguggaagauucugagggaacugagccccaggcagacagcucugcauuugggaucugcuguaaagggaucucauguuugagauggguuguuaguagaaacauuccaggaaaagcuguccaagaauuuucuguaugggcccaccacuaugccuagaggauaaucccagaaguuggcauccucuagcagacuccucacuauacuucugaugguggggguguggagggaguggccacaggacuugccaacucuugaaccuucagcaaguggaacgcuuugcccaaagcaaauccugucuccaguuggccucugacauuguuuuuaucuuccuggucuuggucaguuaucuguuagagaacaacauagaugaagcuuagccucugcaaauuuaaauugauacuagacucccugacuacccugaggaauuguggugagcccggguacuuauacauaucugcucugaaccugcugacauuuuggaaucuuagaagaagcccagagcgugacaggaauuuuagccgggaaccuccacuuacauuuuccaugagguugguguucugacuuguguguguauaugucacuuguggaaaucaagagaaauuuagacccaaguuuuagaccugacuaaccugccaguccugucuaaagcuuucuggguguucacccaauggggaccuugacucuguaauagcuucugagucuuacuaaaccuagguuuucacgcgugcuaggcaagcacuagcugcacuguggcugcaguaugcaccuuuauaaguguaccuuuguguuuuguuuauugagacagggucuuaugugauucggccucaaaacuuggagagaucugccugccucugccucccaagugcaagagcugugauuaaaggagugcaccaucuugacccaccccucuacuuuuugagacaaaaccuugaacuuucuagcccaggucaacuuugaacucaugacccuccugccucagucuccuuagcaacuaugcaacuauaccuaagcaacuauaccuuuguagcuguggccccaaaacuaugaggaauaguguugggucccaucugcucaagagucagggugguugaucuauggcuucugucccugcaaagcucucucugcccuucuugaccucugcaggguguccuguggucugugcacucaacagggugucugucuucuggcccauacuacacuagcauagaucagggcucagccaaccugggaugauccagcuuuaccugcugugugaucaucuuacuuagugcagugauacaucauugcacuagugaugacccguagugaccagagauacuguccuggauccagcuuggccauucuccugaucauggguaucaccuacugaugaaugagcagugacuucaccacugucagggggcucaggaagacagccucugcuccucuccucuugccaaaauuuggugucuuccccauucaggcauagguguccccacagcauccugaauucaauggccagucuuuagcuuucuagcuucuggagcaugaaugauuucccagaaacauuaucuguagucucuacugagccagacucagguuuucuggguccgggggcaaauaguacccaaucucucacacaacauucagagugccggguguccuuuugcuaugugcuauguuuuuuuuuguuuuuuguuuuugguuuuugguuuuugguugguuuuugguuugguuuguuuuguuuuuugagacaggguuucucuguauagcccuggcuguccuggaacucacuuuguagaccagacuggcuucgaacucagaaaucugccugccucugccucccgagugcugggauuaaaggcgugggccacaacgcccggcuagcagccugauucuuaguuagcuuucaguugcagaggacaaguggcuggaauuaaguuaauucgggggagccaaagggcucuaaugggaaauagcuugggggcucuugugaacauaacucaaaggacugccucagaugccaguguuucucuagaaaaagugacgugccuaucuagcacucgaguaaacacagaccucagauggaguaaccucggaaggagcagugccagcacgguugcugcuucagaccguugggaaagaaaccagaagucgcuggaagagguagaaagcagccaaggcagcuagguuggacuguaccaccuacugccccaacgcagcagacaaccgguucagaccuuguacaaaaucacgacccagacucccgacaucuccccuggcgcaguaacacucgaaccccguggacgccuaccggagcccaaagcccaucuuaaggggauccugggagcuguaguccguucucuucccggauccagcgcgccacaucaaacuagcuugggaguaccaacugcauccgugaacugagcgucuccggucacguugggagggcgaaaucucagggaaagaguagaggguaggaccauucauggacuacaauucccggcgugccuugagccgcgucgcucugcccugug

SEQ ID NO: 8471 - RNA, 9129 nt, Mus musculus
cagcaggcugcgcgccaccgagggcgggguguccgccuggucgagugggaagggcuggaggcugggaguugcgggagggucugugauaggaaggcuugaagggcccaggcaccuuuuugggguggggcgccccugucccacccccgucugaugggcggcuugaugugggggcagaacuuugguccuggaucuuucugggcggagcgagcaaccugcagaacgcugcguuuugcguuggaaagguagaucugguuccugguuccacuguccuugccaucccggacacgcagcaaucauggcccagccgccgcccgacguugagggggaugacugucuuccugaauaccaccaucucuucugcccggaucuucuccagugagcuaaagcagggaaccagggggcgauccagacuuggggcacaggguuuaacgaaucugccacuggaugugacaucacagaggacagaugcucaguacuccguuccugggcaaucguagaccugaaguuucuugggguucuggaagaaugggaugagggacugaggguggaagcugcucacuuuguuuuguuuuguuuuagagacaggguuucucuguauagccuuggcuguccuggaagucacuuuguagaccaggcuagccucgaacucagaaauccgccugccucugccucccgagugcuggaauuaaaggcgugcgacaccacgcccggcgcuugcucacuuuugaaaacaagucucucuugguaacuuacuacgcagaaaauuuuaggcuaaauaaacuccuucaccuccgaacuucuagggagccuaaaaauaaccgacuuuaaagauugcaguuuuauggcuggggauuuaugucuugcaaauucauugaguaccuguuuagcaggagcauguuuuccuucauagcgaaacuggguagaaguucauggagugaaaguucuccacgggccgcuuaucuauuugagcuugaguuaacagagaucuaucuaucuaaagcucuucgagaugagguuucucugugaagcccuggcuguccuagaacucucucuguagaccaggcuggcuuuuaauucuuggucccccugucuccacuucucacaggcuggaauuacaggcaugcaucccccaucaagcuaaaacaugguuuucaaagaagaguuuagggacuagagagauggcugaauaaguucagagcacuuacuguucuugcaggagacccagcauugguucccagcauccacacgaggacucaacucucuguaggcacacaggcaaaacacucauacugguaaaacaaauaaauauuuaaaaaugacuacauuuucuuguuuuugaagggacaaaguggccuuuaucacagguggugguucugggauuggcuuccggaucgcagagauuuucaugagguacacacuaccggaacccuuccugccaccuuacgucccuuugucuggaucuugguggauuugggggagugguugaaugcugucuuggggagaggucaggaccuuuguggucuccuagaauuaguugagacugugugugacuagccucacagccucguacguugacggggugcugcugaugugggagaagagugucccuuggacacagguuuugugaccucauugagaggauuagcagcucgauaccaaagcugguggaggcucagaauuguggagguggagguagaagaacccuucuccagucuuccccagcacucagcuuuucacaacuggacgugagucccacaagaaucgacugaggcuccaaguaguagauuauuauucagagcugguggcuuuaugaaguuucuucuaguagaacaaagcccugucuauucagagucgggaagauuaaauaagcugguguagcuucuaugaaaaccuguggagcaggucauagacacuguugucaccggguggcucccccucucaaaaugggcuccuguucuucacuccagugucccagcagggcccugcacagauaugggauugacaccaguaucccacuacacccucucugccauguacaugguaucugaggcaggguaccccaagccagagacacaccacagacaccuaggagugggcagccauggcauccagaagucugucuagacuuacacaguugugccugcugccggucaggccaagaaacuaagaaacuugggggaguuccuucuggaguagugcuugcugggagccccccaggguuugucccucaucuuuucuucucaggccuacuaucugguuuuauaggcauggcugccacacugucaucgucggcaggagucugcagaaagugaccacggugagaagaaagcuguggggaggaguccugagacccagaggauagaaacagaacaaaaucugucucuucuugagcagaggagcucaguggaaauggagucucagagauccccuggacuuuuuuuuuuuagaaguuugguuauugggucauguuuuuagaaguugucugguuccagaauggcucaguaggaccgucaguguuaaaggccaucacuccagccaucuacccuccaggccaggcggaauguaggcagaagguggggucugggaugggugacagauuauagagaaugcaggcugucuuaccaacauccaccaggggucuggacccaggaugucgcuauuuucaagcuaagucucccuggcagguaccccaacaaacuugggguccuaauguaauguagaugagucauucccaugaaguucuuaagggugugcuucuucaggcugaggcugcuuuuccaggcuaaggcugcuucucugggcugaaaaugcuucuccaggcugaggcugcuacucugggcuuaagcugucauccagcucucuuucucucugcugucuaggcugcuaagaaguugguugcugccaccggaaagcggugccucccucugucuauggauguccgaguucccccagaggucaugacugcuguggaucaagcgcugcaagaauuuggcaaaaucaacauccucauuaacugugaguguggcuuagugaggccagagucugcugauagguuagaagugccguccggaagcuccagaacucugguccaagggcagugaugugacagagccuagguguuugucuugguugaacuaucgccucacaaucgguucuggcccagcugugaccuuucaauuaggacaaucuagaguaugcucugcccuggacuguuuccuacgucacacaggucagcaaacucuaagcuacccuggauguccucuggacaugacuaagucacauacaggguguuuuguguacugaauuuuuuuuuuuuuuuugguuuuucaagacaggauuucucuguauagcccuggcuguccuggaacucacucuguagaccaggcuggccuggaacucagaaaucugccugccucugccucccgagugcugggaauaaaggcgugugccaccacgcccggcauguacugaaauuucuacuuuaaaaaaacaaugggaagagaggccccuuggucuagcaaagauucuaugccccaguacaggggaaugucagggccaggaagcaggaauggguggguuggggagcagggcagggggagggcauaggggacuuucgggacagcauuugaaauguaaaugaagaaaauaucuaauaaauuuuuuuuuguuuuuuuucgagacaggguuucucuguguagcccuggcuguccuggaacucacuauguagaccaggcuagccucgaacucggaaauccgccugccuaauaaauuuaagccgggcggugguggcgcacaccuuuaaucccagcacucgggaggcaggggcaggcagauuucugaguucgaggccagccuggucuucagagugaguuccaggacagccagggcuauacagagaaacccugucuugaaaaacaaaacaaaacaaaacaaaacaaaacaaaacaaacaaacaaaaagaacacugauugcucuuucagaggaccuggguguucaauucccaggacucacauggcagcucacaacuaucugaaaugcccagaucugacaccaucacauagauaaaaauaaauaaauuaaaaaauuaaaaagugggcuagccuggcaauggugguaugccuuuaacuccagcacuuaggcagaggcaggugaaucucuauguucaaggccagccugguuuacagagugaguuccaggaaagccagggcuacauaaaccaugucuuaaacaaacaaaacaaaacaaaaaacagcaguaacaacaaaaccauggaauggggagauggcucagcagcuuaggucugaguccugucccuggaaccaugugguggaaggacuggauucacuagcacaggucauccuuuguccccuacauguaugccguggcacaugcacacccacacacaucauacauacauguguacauacauacaaacuaaauacauguuaaaauaaaaguaugggcuggcucuccaggugugguggcacaugacuuuaaucuaagcacucaggggcagaggcaggaggggcucuaaguaugaggccagcuugcucuaccuaguaaguuccaagacagccagaguuacauaaagagacccugccucggaauuaauuaauuaauuaauuaauaauaagcaaaccaauguaauagauauaggaaugaagcccagcaugcagaaagcccugguuacuaucauuagcccagaaaaaaaaguugauuucauaaccuuacagaauaauuaaguagauaaaacagaagucuauauaauuacuucacuguaucugcuauuaaucaaauguuacaugccaaauaauugauauuauuaccguguaucaagguucaaucuuauggccuccacaggcaccagauguacacaugguacacaagcaggcaaacacucuuaacacaaaauuaagagaccuauauacauauauauuuguaaaaguagacagaaaaauguaaacauccuguauguucgcuuccuugggaugaacaagugccacaaacuugguggccuuaaagacuagguacaauuccucaguucuagaggccauugcaagcuaaacucaggugucaucagagcgcuacucucugcaggcucccaaggggcucacucuguggcuuuaucucagcuuucagaguuguaccaaguuuuagugccccuuagcuuguggcugugucgccccaguuucugacuccaucuuccugugacccuucugugucuuuguaucuuuacguguucucuuucugccugccgauugaacccacagugcugugcaugccaggccaguguccuaccccugagccacaccccaguuccuccuaccucuucuuagagaaagaaaucaguuagugcugaaccuaacucagcaccaucucaacuugauaauaaacauucuauuuccuguuuuugugggauguuuguuuguuuguugagacagggauucucuggcuaucccuggauguccuagaacucauuugguagaccaggcuguccuugaacucagagaaaucugccugucucugcuuccugggaauaaagguguguaccaccaugccuggcuaaaggcucucuauucaaauaaagucacauucacaaaacaaaaaaaaaaacaaaaacaaaaagaaaacaaaccaauaaacugucugucaucuauccaucuacccauccaucuguccguccauccaucucccuauuuuugugaaauagaaucuccuaucuucuuuggggucaagcucacuauguccauugaacuucugaucuuauugcugcugccucccaagugcugccuucagacuuggucuuaggacuccacuucuuggcauauagucuucuauccugugucuguugagugcguaguguccuguccugucuagcuuagacuacuuuaagggucuccauacucuuuuuuguuguuguuguuguuguuguuguuuuuuuuuuuuuuuuuuuucccgagacaggguuucucuguauaguccuggcuguccuggaacucccuuuguagaccaggcuggccucgaacucagaaguccgccugccucugccucccaagugcugggauuuuuaaaggcgugagccaccacgcccggcgggucuccauacucuugcuguucucagaacacuccugacaaggcuuagcucauuagugcccugucuucucagagccacaacccaccagcuuuccccuucuauucucuaggugcagcuggaaacuuccuaugcccugccagugcuuugucuuucaaugccuuuaagaccgugguugacauugacaccaucgguaccuucaaugugucuagugugcuuuacaagaaguucuuccggguggguauccuccuggcaagggccuuucuuccucuuggcuacuugcucaucaccaucccuuauauguuucaggaccauggaggagugauugugaacauuacugccacccucaguaugagggggcaggugcuacagcuacaugcaggcgcugccaaagcagcuguggguauguguguccccugugcacuccuuagacucuccccagaggcugauaaucuccacaugaacuugauccuagcuguggacacuguagagcucacacugauacuugggcuaccucagagcggaacagccucacaguuuccccucccauaugcauuucucaugcagaugcuaugacgcgacacuuggcuguggaaugggguccccagaauauccgugucaacagccuggcuccuggugccaucaguggcacugaggguuuaaggcgauuaaguaagucucccugggaguuugagacacccaucaaagcuucaagaauuguugcaguacuuaacaauucugucuuacuggguggugguggcacacaccuuuaaucccagcacuugggaggcagaggcagguggaucucugaguucgaggccagccuggucuacagagugaguuccaggacagccagggcuacacagagaaacccugucucaaaaacaaaaacaauaaggacaacacaaccaucaacaaaagucuucuuauucaagucaagaaguuaucuaaauguuuaaccuucuacccuguugaacuuggccuacugugagggucuccaauguccaucauguggguucagugucagucugcuguuggccuugauagagcaaccacuguuuccagaucugggucagggagagagcuagcuggagagagcagcagacacuguggcauagaggcuuacugggaucugacuuccuauugcuuuccaggaggcuccaaugccaguucgaaauuaaagcauuuuucaaauccuauuccaagacuugggaccaagacagagaucgcucacagcgugcuguaccuggccagcccucuggcuuccuaugucucagguaucgugcuggugguugaugguggaagcuggaugacauuccccaauggcaucaagcaacugcuagaguuugaauccuucucugcuaagcuguagguaagguguuguucccacuucucgggauccccauguccuuggaugccucaucuuuuauucuacuaagugcagcuauaaacuacuagucauguuuucauaggagcaucccugccccuguccuggcacagaggggcccugggccaggugggcaagacauggucuccaagaaugugaaggaagugggcucuaugacacuggguuuucccagaccuuauccucgucucuauuggagaaauacagccuuaaauuugcaauuuuccuaucuuagccucuggagugugagaguacaggaguacaugcuaggauauaacuuuuucuuuucuuuucuuuucuuuucuuuucuuuucuuuucuuuucuuuucuuuucuuuccuuuccuuuccuuuccuuuccuuuccuuuccuuuccuuuccuuuccuuuccuuuccuuuccuuuccuuuucucucuuucuuccuccuccuccacguucuucuucuuucuccuuauaacuucaucucaggucaacguuuauucagugaugauuaaugauuacuuuucuauuaauuaaugaauuaaucaauuuucuuuacaucaugacugaagcuuccucucccucccguccucccgucccccaggggaguccucccguggauauccaccuucuucuucuuugaagauaggaucucauguacacuauguagcugaagaugauuuuacaaaagagccacccugccaauuuuugcaguguuugaagaucacacccaaggcuuccagcagguucaaccagcagaaucaacugaucuguacguccucccccggggaucuucugacacauaaacuucguacucaagauaguuguuuugaggaggcaguguucuucauggggaaugccuccugccuugcauaggucuauagucacacaggaaguguugagucugacuuggaaauccgagcccacuccccugccucugggaucaagcucuuugcaagcucugccucuccuccgcccacaucuugaguaggaauaacccgaucaugcauagcugaaacuugcuuacaguaucugaggaauuccuaugguuuuaccagaaaaaaaaugcauuuucuuguaaaaaaaaauuuuuuuuuuugagacaggguuucucugcauagcccuggcuguccuggaacucuguagaccaggcuggccucgaaaucugccugccucugccucccaagugcugggauuaaaggcauucgccaccacugcccggguuuuuuuuuuuuuguuuuuuguuuuuucuacuauaaaaauagcuaugaguuggaauuuguaaaaguuucuagagggcuggcaaaaugguucagcagguaagagcacugacugcucuucugaaaguccugaguucaaaucccagcaaccacaugguggcucacaaccaucugugauaagaucuggugcaucugaagucagcuacagugaacucauguauaauaauaaauaaaucuuugggccagagcuagcaggauugagcgagcagagcagaccagagcgagcagagguccuaaaaauucaauucccaacaaccacaugaaggcucacaaccaucuguacagcuacaguguacucauauacauaaaauaaauaaagaaaucuuuaauaaaaacguuucuagacagaaaaaaaauugacugauucuaccaugga

SEQ ID NO: 8472 - RNA, 411 nt, Mus musculus
gccuucgccguugugccgagcccgcagaggagucgccaugagcaaagcccacccucccgagcugaagaaguuuauggacaagaaguuaucauugaaguuaaacgguggcaggcauguccaaggaauacugcggggcuuugaucccuuuaugaaccuugugauugacgaguguguggagauggcaaccagugggcaacagaacaacauuggcaugguggucauccgaggaaacagcaucaucauguuagaagccuuggaaagagucugaccugugcucagcaagcaguguccacaucccuccucaaaggccuguuugauugugauguagaauuaggucauguacauuuucauauggaacuuuuuacuaaauaaacuuuugugauacucaaaaaaaaaaaaauaaaauaaaau

SEQ ID NO: 8473 - RNA, 10572 nt, Mus musculus
aggucugccugccuuugccuccccagugcuggaauuaaaggcacgggccacaaauguuuggcuuauuuuuguacgcauguuuuuagugcauuguuuuacuuuuguuguugcaucgaaccccucugaaaaaagccucaacuucucuuuuugggcuuucaguuugcaaccacaucuuuaacauguuuggaauauaucccuuugguacccagaguaguucaucugacacugacaugaaacucgguuacucaaagugcaccuucccguuuccauuuggucucuuauacuuuugcggcaguuuaugguuauggugugagggguccugagagcagcuggagguucgguucuuccaggcaaggucagagugcaccuucgggcguauaugucacguauacgugacaucugucgucugguaccccaaagcguucgacaggacccuucauccuuugccgcccacccccucaagcugagugauccccagugaauccguguccccuuccaaugagaccuuuucggcccccugcuguucgccuccacucuggccaaggugacgcgguccagcauccucaggaaccuagaccgcaggccggcucccugcggggcggggccucggaggcggaagugcccggggcgcuggcggcaggucuaucggagccaugggagcuccgggcagaggcaguggcggcggccgcagaggcggcgggggcugcccaggcgggggcgagcggcgcgggacgcgggagggguagcucgggcugagcgccgagccaugggccggguuggggccgggggcacagcgcgggaggcagcgaccgggucacugcugcugcugcugcugcuccuggcucggccuccgccugccgccgccagcaacagcaaggagagcggugagcccgcgggccuacagcgccauccgcggcgcgggccgggggcgggcgggaggcggggauugugacucacggggggcaccugugcguucaccuggcgcggcguugaaacgagguucucaucuuggguugcgcccccugcggggcauccgggccagaaaaacccccaugcccgcuuuuccguuccgggcccgccgaguucgcucacuuggagcggauucuaccgguccgucucuccugugcuuuagagacgcgacuguggcacccaagagcugggagguagaggaaccuaucuccgaagaauagcugaaccguggugacgcaagggacaguaucugguagaaggguugagcuagagaaaguugggcagacccuggacuagggggggucuaaccagcauuauguuccuaauccaaucccaggaaggucacucuugauugcugauuuugcuucucaccgacugugcugccagcuggcccuagagaagcuggcugaccagaauggauguaaagaaaggguacucccuuauaggggagcuuccuaacugcuuuuuguuauuucugcuccgcaagugggaacgcacuggacuacaguuuaaggaggcaguuagaucuuugacccucuguguucugccuacccgcagacauuuagaaauaggaaagaugaguacuuucccuucucuugcccggcgggaaacuccccgggagaccuuugugcuaccugguguuccuuggaccuuuccggauguugacuguaccucccauuuccacccccuccucccuuggagcucuuguuucuuucuuuuuuauuuauuuauuuauuuacuuauuuauuuauuuuuauuauauguaauuacacuguagcugucuucagacacuccggaagagggagucagaucucauuacggaugguugugagccaccaugugguugcugggauuugaacuucggaccuucggaagagcagucgggugcucuuacccacugagccaucucaccagccccuuguuucuuuuuuuaaagauuuauuuauuuauuauauguaaguacacuguagcugucuucagacacuccagaagggggagucaaaucucacuagggaugguugugagccaccaugugguuacugggauuugcacucaggacauuuggaagagcagucagugaucuuaaccgcugagccaucucuccagcccggagcucuuguuucuuugaggguuguuguuuuugguuuccgaggaguugguauaguuugaaaugaaaggcaguguucccuaaagaccuucugauagauugcuccauaccacauccuauuuguuccuccuucuccagcccugggauuaagcccaagugagaguugauggcugggugggggacaaguggcucuguggcccuggcugcuuugacguguggguaguaucucugacaguugcugggguuuggaagguguggggcagaguaccuuugcuuaaauucucagggaaaguucaggacuuucuuuucccacucucuacucaaccuuaugccaaugggggugguguguggggcaggcagggcucacccuaccaugccaguugucuaggucauauguguucaacaaaguaagugugugucucaucaaggaagucuggagagguuauuuagacaugagaguuugguacuugggucucaucuagguaucuaaacaucacagaugucagcucuauuccaagugucccucccuucacaaaggcuuugugggguccaagggcuuuucccuuagcagguuaagggugcugcuguacgcuguaggguaaucucucccaccgggccgccucagagguuuggauaccugccuauccaagaccgcacaguccuaggggguggggaaccuguucugccucagcugagagagcaauauucugccucacaguuuauuuucugcuccauuaucauauuaccauguagcagcuccugguauucaguccucaaccuggugaaugggaccugcagcuagcagagagcguggaguucaccgagggagcuccccucugcccuccccaugccagccuccuuugcagcuccuuugcucuccuccagcaggcugcuagcuuuucuccaggugccucuguuuggaggagucacaugucuggcaagaaagccagcugcucaccugacucccucuccucucuccugggggaaccaggcaccacuuucacaguggggcaaagggaggcuuccugagugggaagggcgccaaauaguacuguguuucucuuaaagcacuuuauuacucauuaacuucaaagggaaaagcagucugcuuuagacuacccauagggauccaggaaucuagagagguaaggggcacccaagaucauacaggcgcaaggccugagcugccacuggguaugggguaggagucuguaagaugaugcagggccugaggccacaugaugcccuagucugggggcuuuagggaguuugucugccuggucuucugucauuguaccuccaugcaugggugugugcccugagggcauuuggagaucucacccauuuggaacagagaggccaccugucccuugguuccaggcuucugaacuacagucccucaucauggucuuuuacuggguagggaucuggcuguguccuaagucauaacaaguuggagagacagccaucuucuggaccuaaaccucccuaccugcccaugugguucugggagguucagaggaguugaggugggaggagccuuugcuguggcccugaguucaagguagauauuaacaggggagggaucuccuuccagacugcccccccccccggggccgccccccccccucccccgcugucuuucaggcuccacauuucuuggccuggauguacuagaauauagugcaaggguacaaauaacuagcucacaaaaagacccaccaugggaggguccaucugaagguggugguugauagggcuacugacuucauuguuuacacguugcuguagugugagaaagcagaguccccugccaucuagagagaggaggccaaggauugacugcucaguuuuaagagaaacuguugaucaccgcaggcagaaggcgcauuuucuacuuuggcuaaggacaaaguucagggugggacaaguacuuccuggagcccaugcuuccugugugccugccccaccuaccugauugucaccuuuucccuguagaggcuggacugguaucugaacacuucucccaggccccacagaagcuguccuucuacagcugguauggcagcacccggcucuuccacuuccgcgugcccccggacacugugcugcuccgcuggcugcugcacgugucccagggaagucccucaugcacugacgaagagaucacaguguagguacccaguauucugcacccccggcaccuaugcccggcagaaaccccgacucucaccccugcuugacaugaucucuuccaggcauuuccgcuauggcgccccuccugucaucaacccucugggcaccagcuucccugacaacaccuugagccacgccuccuuccauaucagggcauuguugagcaccuugaugcuggacaacaccucagucaacaucucccacccugccccuggggacugguuccugguugcucaccucccucccuccucccagaagauccaggugaaggugaggggcugaccuccggggauggaggcugaaccgcuugaugcauggaggacccagccucuugucaaugucugggcagaccuuacucucagcuacccgacucuagauucaacuccgucuucuccuuuggccuauguccuaccuucucuaaccccuaucacuuccugccuuauucuccccucagggcuuuguuccaaccugugccuacaucuuccagccugauaugcugguaaugagggugguugaagucuccacccuagagccugauguuccccucccacagacgcugcucuccuaccccagcuaccucaagugaguggaucagggaggccaagucuguccuguagcugcaaaccuuuggguuuagggugggugguaccaccaucucaucuugcaggugagaaagcguagagacgcgcugggaagagaagucagauaucucccuguaagcauguuaggagaaauaagugcccagugcgagcuagcaagucugagucaccaccuugccacaggaucuuugucccugaauacacccaggagcuucgguuggaacugcagggcuguguguccagugugagccccggcugcccaguacgugucacagugggggcaaccacccugccuagaaacuuccagagggugcugacuugcacuggccucgcuccauccugccauuugcuacuguccucuccacccuggggccggugguuacaagugacauuugagagccuggcugaaccucaugugacagugggcuuuacugcuaaagcugucuuuacaggugggcuccaugggaggggaguggggcgggguggacgggcucugucuaccucccccagagcucugggcuuucuuccgguugagccccuugucuuuuugacaguauguaggccauggagugugaccauccaucaucuuauacaaaacaacccaaaccagacuuaugauaccucugcaauccagcugucccaaagcgcuguccaccgggaccugggcaggaguagcaggguggacaguggccccuucugucuccugaacuauccaguccugagggaggacacagauguggugucuguacacuuccagccccugaauggggccuucgugcuagugcauucaagcaugccuucuguaaugcagcuccgccuugauacaggcauggacagcggaggcuccuucaucaucguccugaggacuaacaagguauccucuggaagcccacugaagcagucuacagcugcugguagccugggcuuggcucaggguacagggugacuucagcucugagacuggggugaagggaccugguaggugauagcaugcuaucaauagcaugggccagaaggggauuccuccaagauaaaagacuuccccuacccgaagcccugucccugguagaaguuauaauuauaucugugcaaauggacagggaaauggccagaacaggagacagcugaagauaauucagcugaagaaaauuuggaccaugaugaacuuugggcuagcaggcggccucccuccccucaaaaaaaggacccagcaugaccgagcuaaaguacaagguggggaggcaaacugcuccuuagaugucuuugaggggugacaauggcuaaccuacccuacuuccccuuccagacagaggucacaaauggcaccuugguagcagcuugugugaaugcugccuccccuuuccucagcuucaacacuucacucaacugcaccacagguauucugggcaggcaguuuugguggagagacugacuggccccucuagccaccucugacaggcccucccaccccaugcagccuuuuuccagggcuaccccauguuucugagagccucaucucacauggccaaccucaucaugcccuucccggagacagacaacugguaccucucccugcagcuugugugcccugagaguccugaguaugugaaucugggccugggcaacaugacaugggcugguagcaguggagagugggaagcaucuaugaguuuggagggguucuccuuuuccaccugccccccaucccacagcagcacaagcaggggaaaugggaaucccagccauuggagccuggagggcuuggcucuaggccugggaguccuagugguagagccaccaacaggagcgcuacaaccagccuucucaggccacuucuuuguagggauugugaacaggcugugguucgcguggagaccaucuuguaucuggugcccuguuugaaugacugugggcccuacggccagugucuccugcuccguagauacggcuauguguacgcaggcugcagcugcaaggcaggugaggaugagcuugccaggccaagcaggggugacacucccucccacuccuucucacgcuccccugcuaacuugggacccccagucuagguguaagggacacugauuuguggggggguuggggugcugccuccugacuguggcauugcuugcauccugccugcccuuacccacucagugccuacaguugucugccuuacccacuccugucugagcuguguccuacugcucacguuuuguugugacuacauauugauucacacuuuuccucgacagucucuacgucuguccaugcaugccacacuggcuccuacguguccacauaucucuacaucugucccuaccaacuuaucacaccuguccgcccuuaccuacacguacugguucacacagccuucuccaugugccugcucacagcagaacacacuuggccacgccuaccugugucuacacacacccguccauaccuguuucccuguaccaacuaugcuuaucccuccuucuccacuccugaccaugccugcuauggauacacgugcucguccagacccucccgugccuacaugcaucuuccacuuuuguccccacuugcccgugccugcccacucuugcauauaccaguaucuauuagugccgauuuccuccuccuaugcccguggauucccucaggcuugucuacacagcauccucugggcgaggaagggcccuaaaguucagaagcucaugccuagguauugcguggcccccagguuggcguggguggagcugcaccgacaacagcacagcgcagaccguagcccagcagagggcagcagcgcuucugcucacgcucagcaaccucauguuccuggcccccauugcuauaucccugcaccguuccuuccuggucgaggccucugucuacuuuuacaccauguucuucuccacgguaggcuuggcccuaacccucucgggaacucuggguggggaggucaggucugcuugcucaucgcuucaccucauaguucuaccacgccugugaccaacccggggaggcaguguugugcauccucaguuaugacacgcuacaguauugcgacuuucugggcucuggggcguccaccugggugaccauucuuugcauggcccgucugaagacaauccugaaacaggugaguggccucugaugccaagccugggcuccagggaagcaggggcccucacauacaguacaugacguggcagagagggauagaccagauaggacuggguaucggaucucacaagagaacucgucauccacuacuggaggacguuguaggaagcugugagggaaagguguagccgucaggacgccaggaaagaagauggggaccgggacccuaaucucaaagaggagucagggcaggccucccugagaagcuggagccauguuccuggguuccuugucuaagggcacuuggggauuuuaugcagcaucuggacaauagaggugacucuucggugcuugugagcuguguccucuauagccuggguacugcccaucaggggcacccauaucaucucaaagagugggaggagaaaguucuggaauuuggagauccagcaggcugaguguggagggcaugaacuuucaggcagugggcagauagaaacuuaggcauggguccccucccagguugcaucuaaggccacccugcuuguagauccuggaaggcuugguaugcacggucaugcaaguguguacaagacugcccauuaggaguggacaucaucaccuaguccuccaaagguccuuuggacacaguaaagggacuagaggaaggguacuucccucccaggggcugagcaggaacggggcagagucuuaagaggagccgacagaggagaggagccaggauguugggaagcugaccuggguaaucagcgccccugaccccagcgccugccuauugugucucgugcuaucacaggugauuccagccaaaggcuucuauggccucacaaaccacugugucucuccuagguacuacuuguccucggcacacucgucaucgccauguccuugcagauggaucgcaggggcaucuggaacuugaugggaccuugcgucuuugcuuuugugaucauggccuccauguggguaaggaacagggcauauagucuccuguucagacucauggagaagagagccaggcccuuaauuccaguuaugcugggagggcuccaaaacuccacaucuguuuagagucgguagcagcuacccauagagccccagucuggcuaugugccuuaggucuugugccgauaaccacuaggcaugaggccauaugcacuucuccugcccagaucuagauagaccccauaccucuuggcucugggucugcaccaaccaaccaacucccauguggcuauccacucuagauauaccgcugugggcaccggggacagugcuacccaaccuccuggcagcgcugggucuucuaccuccugccuggcaucuccauggcuuccguuggcaucgccauguauacuucaaugaugaccagugacaauuacuacuacacccacagcauuuggcacauccuacuggcugguagugcagcauuucuucugccaccacgagaggaaaaagcuggguccugggccuguuugcagaaguucccuugucacuaccagaucugcaggaaugaucgggaugaguuguacacagugaccugauaaggcugguucauggacaccugaaacucuaaugaccucuucagcuaggacaagcgagagaggugcuugucuagccccaaccagguuuccaucugaauaaaauuguccugagacgcuuggcuucuuucuccagagaagacccccuccaccccaaaaaaucuuuauggcugcugccaauuccucugaaggucacagcuguuuccaccuggagcccacaggugccacgugugggcugaucacgcuguuauggauggggauacagauaagggauuccugugguccccuuccuuuggaaagccgugauaugagacccacaagcaaggaagucugagugcacagaggucacucacugucucugacauccuguacccuuaaugccauccugccuuggcauggggauacccuccugcugcaguugcuaugguagaguccagggucaucagagagcugauuaagaccuggagugcugugugcugucccucccucauugucuguuggagcaggaggccuucgggagagccugagguagcaggcugcucagcuguaugaggucuggcuccagaaggcacacaaugcucgcuaguguucccuucucucuuaagggguccaaggccccagucuggugagcauucuccugugcuggcccuagacacuuggaugaggcugaccccuacuggaucaacugaggauuaaggaguggguucuggauccccagcccaaucuuucuggucuccuggggucacugagcugguagugcugugugcccaggccauuugguucccacugugaggcucaucugcucugaguacugggauugcaggugugggcuucugggcuccuucccaagcuacuaacauccuuuauuuggcaccaaagcacacuuuagccccugaaaggggaaauguguauauucuguuggggguggggggcaggugguaaaauguuacuguucuaagauaugaaggcauauuuuuauguaauuggugaauuuaauauucuacaauaauuuuucaaaucaaau

SEQ ID NO: 8474 - RNA, 3115 nt, Mus musculus
cuuccaagcaaaccaacacacuuuacuguggcgcaggcugccucagacuguuacuuauuucagcccaagaacuagaaggacuugaccagcuuggacaggcaucugcuccgcuccaggcuuccacgaguccuggcacagaaggguucucugaaaagucuaccacaggaacugugugcucggcacaugccaagugggguucgcccacugcccacaggggaggcugagcccagugcucaggcguggucaccggcucucuucugcaccacugcgggccuggacagaaccugcuccugaagccgcuggaccagcuccucuacguagaccuugaacagggguacaggguccugaaggggagagggcaugguaaggcucaacguagcccagggauggcgcccuaaggagggugacagccagcugcuucuggcugaccauggggagaagcaggguguagaaggacuggggauguugcugcuugucauccuggagggcauuugaccgccaaaagaggacugcuuucccuuggucacacaaacucacaugccuacccuuggcuucccuguaacugcuggccgccacaggcucuugacuauucugggaaacagacacaaauggaacauccuaggggcugccaagggauuaagaaaacaccuagugccgggcggugguagcgcacgccuuuaaugccagcacuugggaggcagaggcaggcagauuucugaguuugaggccagccuggucuacagagugaguuccaggacagccagggcuacacagagaaacccugucucgaaaaaccaaaaaagaaaggaagaaagaaagagagagagagaaagagagaaagaaagaaaacgccuagugccaaagauccccgagcauucagagaaagagagggaagggcuucacgagacgaagcaugccaugcaauuucaaaauggaaggaaccaaacguauggcagcauuucgguguggcagacccuaaaagcuagccuucccgccccccccaucacucaaccucaguggccugagaucugccgguacacagguacucaccuuuuccuccagaagccucuguuucuccagggccuccuccagcgucaggccaacccacucggccucugccucggggaugacaaagcucugaauaagcaggagaggaggcuggcaugaggugugggggcugggccaggagccucgggcagcaagcaggauggggaaacucucacccuguacuugucauagauggcugcucuccgcucaggguucucaggguggagauggggguccuggcgagcaagccucagcagcaucccucgcuucagguccaugccaaacuuggagcccagguccuccuuaggggucuggcagaagguucacauagggucgggugcuacagcaggcucaccaccccacccccccacccugucagcugacccuauggguucuucuucagcugcuggcagcccuaagcuagaccacagcagaacaggcauugggaucagcgcuagcauccaagccuauaugggucaggcccaaggcaugcaugguggcgcacaccuuuaaucccagcacucgggaggcagaggcaggcagauuucugaguucgaggccagccuggucuagagugaguuccaggacagccagggcuauacagagaaacccugucucgaaaaaaaaaaaaagaaagaaagaaagaaaaagaaauggcuacaaccauuggacaagucagcgacucacagggaguggccucagcaagacagaaagcuucaggggcugcaccaacagggacucaguccuacuuguaauggcuacccuggggugccccacacucccugcccaugcccaugcagugcacucggcacuucccacgagucugacaagaccuuggagugcacuaaccccugcuugccuugagaauauagaagucaaauccauaggccucaucgaugagauccaggguccucauggucacagucacggugaacuucuuguccaggauuucacuguaaagcucccgagugaacagcuguggcuuccacaccuucuucacccucuuggagagcuaagggugcaagagaaaccucccguuuuccuauagaccaagugggccccaaagcacccuucuggaaccugggcuacugugagccaggcccucucccuuccucagacgcuccucaggaccacugaugcaggucagggccccugagcuggcucuggacacccacccaccuagaugucugcuucacucaggcuagcccuaaugcuacugguauauguuccagauucucacacagcugaaacccaguagccacaggcaagugaaugacacccuggaaggccugaaacauacucucuccucccacagggcuugccuaggagcagaguaucaccagaagagauagacuccaggcagucaucucggucuuuuugauuuuuauguacuaggagcaaaguuauuccguccuaaaaaugagggaaaugcgcauagaaacuagcaggugacaagcagauuucacuucucccuccucuucggcacaagcuucgaaucuauccuuccuccuuccuuuucuccaccacuguccccacucuguccuuacuuuugauacuaucugauccaggaccaccccacuucaggacuagacuuugcuaucggaguuagcuugcuccguaaacaaaacgcuuguguuagucugguugaccguuuguggcgcccagagcagcgccugcucagcaaagcaugcagaacagccgagaugguccgcacccaccuugucguuguuggcguaucuguagccuaaaaucaagcccucuccaccccacagucccugcugggacucuggaggguagugaacuggaauggguacguccucaacgcgcucgcgcugcccauucuugggguugaucuugaacuuggucccgugagguuuguaguguaccggggucggcguccguucuucuuccagugagcgcaagaagugggcgggcaagcgcgcacagaugcccugccgcagccgcagcuucugccacaggugcacaggauaccugugcagcggcaucgcgcgacccucuacuucuaggagagcgcgcccgcgccucccggaaccggaauagcgucacc

SEQ ID NO: 8475 - RNA, 4870 nt, Mus musculus
cuuagcugcucauguacucgcucagugcagaccauagagcagguucuguggaugggagaagguggccauaugacacaguuauuuuccuaggaagagcuguaucuguugaaaccuuagcucaggucagcuacacugcaguuccaucuuguuacuuaaguggaauaaagacauagaugaccugcuaaucaagaaguccuugagggagaguuacagcuuaggucagguauucugggagguuuauacucaagacaggcuaacuguuacccccugagcauuuguuguugcucacaaggaccaaugccuuaagaccaaagugaagcccaaauagaaaggaucacugaauaggaguugcuucccuucacuugucuuggggagggaggcauuacaguuuguuuuuggagggaaccuuaguugguuguguuaaaugaaaaagccuccccuucuccaugcugugcuuguaaaaacuuagaugcuguucuugagcuguugauuugaugguuacacauaggaucuugugauuuuguaauguggcuccuggugaugcugugaacucccgucugcaggaggauguauguggguaccugcucugcugguauugugaaaacaggcuuuucuugaucagcugucuccauaugcaagaaaguaggguggacuaucucuggaggcacuggggcuccguaccauauacaggugccguguguagauuucauucaccucuagucccuuggccuccagguggggcucaguuuagcucugcugacuuccuggaauaagguuuguaccugggcuucuuggucccagguagacauuuugacuagcugugaccacuuaugcugggcacauuuuguuucuuggacucuuuugggccuuaacuggacaguccuaaccuuagauccaacaucagcaugucugguuuggaucccucucuaaauauaaauguguguauggagaaacagcuguuuugcuuuauuuuaucacagaguaaagauucuggaaacauuucugugccauggccuguaguacccacaggaugaucccuggggucacgugguauacaacuacaacuacuggguacaguaggcagacccccugcuuacauggcaucuuuuugaguggucggcuuucccagucucuuguggagggugaguuuuacaaggauguuguggcaaaaguuuuuugucgguuuuugaaccuuuucuggaaagacagucuugucugggcagacuuggauuucaggacucaaggcacacuuguuucugucccaaguagcuguuacuaacaagugucccaacaugccuagaugcuuuuuuuuuguuuguuuuuugucuuguuuuuguuuguuuguuuuuuguuuuguuugagacaggguuuucugaauagaaccagcuggccucaaacucagagaucuaccuuacucugccuccugauguuuuguuaacuuuucuuaaguggaguuuccuguaauuuagguggacauagaugauaaccagagaucuguuugugguguuguugguagcucuggacauuaugcaagaaaucauagggucccugggcagugguggcgcaugucuuuaaucccagcgcuuggggggcagaggcaggcagauuuuugaguuccaggccaaccuggucuacagagagagacccaggauagccaaggcuacacagagaaacccugucucgaaaaaaccaaaaaggaaaaaaaaucauagggucuuccaucuguaacccgaggucugacacagguacugauuacgaagagcaagccuccaaggaagaauugggagagccaguaguuuucaaaaacccaguaaccagucacccaugggcccagagcacaggagguggguauccagcucagagagaguagauacacccuuccugggcccucuuguucuuucuaggcuuuugguguugcccagugcacugagugaagagguuggagugcacugaguguuggaggccucuugaauuucccaaugucccauggucauuguaacagguaaaaggcugggucuucccuuggaucugugacucuuggaacuuggcccauuguauugaaagaauagccacuuaauauccagauaaugagggcagaugcagguugcgccucuuggaggacccauccccaguucagcaguacuuggaagucaguaccugagucguguggcuuaggaaugucacugucugucaaggccuguauggugagccagaaguauccagagugggccaggugaagguuaacaagcugacaauugcuucaggaagcucugggaaaacuugguuauccugaugggggucccaacagcaggaucaguugucugcguuugacuuuacucugcagucugguccuagaaugugugagcucuguuuguuuccaaagguagcuguggccuggcagcuuuaagcuuaccuggacucuaaagccucacauuuuauaccuggcaugcacuauuagaauacacugaauuuuaguguguacuuugucagugucuucugccuacucaguucuuaacacacuuccuugggucuaaauuuaaauuuacugcuaaaaugaaaguaauucucaagauacuguuguuaggugugugacuucuagcacauguuuuuuucagaacagugauauuuauagaauacugugauguauuccagugauagcaaaaugcaacaaagcuucuuauaacaaacucccauuauagccacuucugauggguauaagucagugacauuuauguguccaguguugugaagugaucacugauacaaaguugcaggauguucgauccagacagaaacuucagcccaccaguugaaacugacuagcuucuccugagcccccuggcaaccaggaacccguuuucucucuauaguuugcucauuuggauauuucacaaaaauggacucaugcacuggguggccuuugguguguuggcuucuuccacucaagguuucuacaaaacuuggcugugugauguaaucucauuacuuuuaugaguaagaaauacuccauucugaguguaagcuacguauuucucacugugaugguuaacuugcuaaacucgaugggcuuagaaacgccaugagaacacaccccugcguaugucagugcagguguuuccagggaauucagugagagacccaccaaggaugugggcggcaccauccuaugugcugguauccuagaaugaagaaaaaaggagggcaagagcugagcaccagccaucucucaacuuccugacugcagaugcaaugugaccagcugccuuaaguuccugcaaccaugacuucccaccacaaggacuguacccuuauacugugagccaaauaaaccuucccucaguugcucuugucagguguuuugucacucgugggcccagggaaaagagacucugauguuacugcccagaauacuaagaacccugauguaguucuuggcuggauucauuaccuccaagguuuguuuuugucucugucuuuugagacagaauaucacuguauagcccuaaacucacuguauggccuacaaacccgaggauuuauaugaaagcuguguauauauuggugcuaaaccugauaaaccagggccugcugugcaggguggauuuacaucuaaggaagcauuugguuagccuuccaccucugaaugaaaugaaagguagcaguggggagagaaaaugguauuccaguaaguucauguugaaggcugauauaauaccaaggguaggagugaaccaaacgaggcacuguagggccaaugguuguccagaaaccucaggaaaaggaccaguuggccuucucuuuccuccuuuccuuuccugcuuggccuuccucagcauagggacccaggcaaggaauguaucccccuagaauguagggcguacaaaaauggucuucagccagcauguugugacucauuuggggucuuaaaguauccugcauaucagguauuugcaguugcuaauaauaguuaugaagaggcaacaaaauaaacaugauugggugucacuacaaccacauuaaaagguagcaggauuaggaaaauugagagucacugcuuagagccuagagguguccccacacuaaacaugacaccuuugcagaggcagagaacacaggcuucuuacccaggcuguauucaaaggcuaagagguacagaugcaagggagggaagagggccuggccagaagguagggcuagcaggcgguagcucagcauggugcucacagaggcaaggaauuuguccagaaaggcaugcaccgcaggggugaaaucagcagagugguggauagccaaggucaccaguaggcaguggcucaggagcuguggagacaggaagggucagugcauaguagacaccuggggccucugcuccccuuccuggaagcacuguguucccugcuguaggcacgaggaucacaagcccuccauaggggucccagaugccuccugcaaggugcuagcuaauaccuugaaguuggcgggaucuacacacagcuugugggcaugcaggucacucagaguggacagggcaucgggcaggucauugacaugguuuacagcaucagucagcacauccauuaccuucuugccgugagccuggaccuggggggagcgcuggcuuacaucaaagugagggaaguaggucuuggugguggggaagcucucaaacaaccugugaaaaagagaaguugaggucacaggaaaucaggagcugcccacugagucccaggucuguugaggauccugugaucuauacagaacaggguccugaucucaccguccuauggcuucugcgccauagucagaaugaccagcaaucuugucccagauaguccugagguuggcuuugucuuccugagagaucaccaug

SEQ ID NO: 8476 - RNA, 2925 nt, Mus musculus
gcucaauagaaacgucauaauuuauucuguuguauaaaaaaagucaucccaguaacaaaaugucuucucagaagaagaaauauauuacuucagaucauaaauaaacaaacauacaacugucgauaacugaaagcuacaaaccuacacuggcuuugucugucagugccgaaagcaaaccugcucugggucuauuuacaagauaguacaguacgcaaacacaaaauugagguauuugguucuucuaugaguagacaaugacauuugugaaggcagaccaccgaccuacacaaaaauaaauaaagguaaaaacucucauacgcgcaugucaucgggaaugguuaauacuggugggugugucaagcaugaaguuucuagaaaaaaaaaaacaggcaagcgaagaaacugccucaaacagaguccuuucucuucugcccuguuuugucagagggacuugauguacccacaauauauuggucccgaaugugccgaguucagcaaaugucuugcggucaagucauuguugugacugcuuaggaacucaguggaacucaggaggaguuggggggugagggggguguuaaauaaauaaggaccagcucccaugagccucucccagaguuauugcauugcuccucccacaggaggaguggcgacccgguggcaagugaaacuccacaccuccccuugcccuucagcagcuuggagagguggugauggggcuuuuaagguaguucagggcacuguucgugggguggacggggauggaaacagggaaguugaagacugugguaguagaggugccccggucaaggacagccauggcagggcucccagcuucagcagagcagugaggggcuagcacuugggacucaaacugcagcagcuggcccaugaagcugaaguucggggagaugauacuccgccucugcuucacaaacucaaaggccucguccagcuuuacccgguuaguccucaugagguaagcaaggcagaugguggcugaccgggagaugccggccuggcaaugaacaaacacucucccuccagcauccuugauggagucuggaaaauaaaguuauggguuacucaaaaacucagaacagcugagcccagaucaaggauggcuaagaaaugucuuguguccuguccagaaauggccagggucugccucuugcagucaugcagacccuauguguauacuaugcaaaggauagcaggggauuuaaacccggacuggguaucuacacuuauaauccuggacaagacagucaguucaacugagucucagugaggaggaaggcuugggugaggaucauuuaagcugccacccaaaagacugggcucaguggcuacaguagggacagaagcagagguuccagauaguuauuccauuuaccuaugaagucaauagccucguugaaccaggagcugaugucugccuugugguuguccuccacagggaugcucuuguacugguagugacccucaaagugguuaggacaauuggcugagacguugaucaaggcggugaugcccaaggcgucaagcauauccuuccgagaagcgugauaggcacugcccagguacaggaaggacaggaucuccacugggccccccugaagucaaaaaaacaguccagcauucgucaagcucguccagcgugagcaccaguacccaugcccacaaaaacuccccgcugaaaacgggaguuucugaaacuggugaccucagcacugcuguugacauauuaaaauauucguaaagaaucaagcccauuggccuggacagagccaacaagcucuuccgugccagcaacugggagacucagcuccauccaauugcuucaugauggacuaaagauccucguguccccgcuaguauaaauaaagcugcagccgcuuucuauauccuccuggcacaauccuccuagaccucugccagcucugccaccucccugcccugcauggacccggacuccuacuaaccugaucguagagagggguacuacaggagcugcauccggauucugcacugucaggcacacuaguacucagggggaggcugagccccguggggguggacuguuugcugcacagcucagggcaggaagccgaaaacgcuucauauccuccugagaauacaaagguacauauuuucucauuagcaccaccgacacaguaccuggagacaagccacucacccaccaggggcugcgaguuuacaaggaaggcuuaaggaagucuuuguuaugggagugaaacaaagccacugacaagccccuggagacuggacgccggcgcccccauacuccaggugggacgccccuucccuagcugauggcauaaguccugccagagcuagagcguaccuuggagaaagaagacuugaguggagcgcgccucucggcagagcgcgcccgcggccagggccagggugccgucgcgcuuggcgccguccagggaggcgcugcgcucguccagcagcaccacggcgugguaggcuccggccagcaggcggccacgcaguucagcguugggcacgauaugcuccaggcccauggcgcccuuggcgcggcgccgcacgauggugcugaagcgcacguucacugagcccgcgauguggccggcguugaaagcgaagaaggagcgacaauccaacaacaggcacugcgcggcgcccucucgcagcagcgcgcgcagccccccggcguccaggaugcccaccuccaucaccauggccagccccagcgaccccagcgugcccguucugcgguucuccagaaaaagucggucgaucuugugcgguguccuguggcccuaaguccccaagugcucgcugcuccuaaucuggcuucaccgcgcuuuccucccgccaguccuucacugcgcgcucguccgacggagcgcgguuuuauguagccucucg

SEQ ID NO: 8477 - RNA, 95452 nt, Mus musculus
cgaguggcgagugucgggcaggcuggcgggggcggggcggccgaggaggcguuggcagcgggcucggacccacgcggcgcugcggcccgccuggccugcaacgcucccaccggcucggcggcacgaugcccuuugacuucaggaggugagugaggccccgggcccgaggcccucugcagccggcgacgaccaccccccaccccccguuacgugcaaaugcgacccuggugcacugugcacgccucggcaggcccuaggggaccgcggccuuccucgggguucgagcccuacccccaccccucgugcagcccuggcaagcccucgcacucuguuuuccacggcgcgguguccccagcuugccccugacaucuuucauuccccucccccaaccugggaaccaaaucuccucccaaaucccaaauaaaaggagcucaggcauccucaggcuuucuccccagucuucccuaguggacccuguccuggcugacagguggggccgcgcgccuggcuuugcccggugggaucugagggcugcagccccauucaaucuggcagcaguuggagaagcuuaguucuucagagccugagaauccucuaccuaccagauguggaggccuguucccgcaagccauggggacagugcgggaagaggaggaugcugggaucucgagguucugcagaagguucuuugccuccuggaacaccauuguauagggccaggccuucuggaagccugcaugggaagggccuccccaccagacauucccuugacauaagacgcucugagaugcucugggcuguugggauacuuuggagcaaaaggauuagaagccuggcuguaccucucuacccagcugcuuaguagauucucaauguuagaagcaaaggcuuagggugcagccccucaccgcucagcuggcuaaccccagcaggugucugggcaugcucaaaauauugguuucaccucuugcaaauugguacuaaaaauaaggucaccaccugaaagacagggauuguaaggcaccccugacccagucuccaucacauggaacucagaaguagggcaucugugacugaggagaucugugagcgcuccccacagccagagaacggguauuccuccauuggucacaguuuccccucauccucccccucuuacugauguguauagaggcagaacagagugacaaccaaucuaaaaacggcccaagauucggaucaugugguggcauaugggcaaccuggggucagggcccagagaggacauugguuucagaccucuuaaccagccaaagugguuuuuagcucacucugggcacugguacuaucuggcaaaccagcuuccugcuugcuugagguagccccgggguccauaccugggcuuagacaaaagcauacagaccaugguagcuuugaaccgagagggcuuugagccaguuuuagggacacccauuaccacagugugcccaugcagaaagaagggcagugggcacauccaggccccccccucaaaccucccagggcugaccggaaagggucccaacccuccuguccccacacgguucugcaaguccuagggauuuugaguuuguuaaagaaguaacuguucugguuacuucaucuugucaguucucugccccgccugcaugccccgccugcaugcuggaagggcugggcagaucugggcuccaguuggaaguuugggggcugggggcaggugagaugaaaaaaaaaaaaaaaggaaaacagcuggggccagcuuuagccuugucagggccugcuuauuacugacuaguuuaaggcauugauauuuaaggagcacaccgcucaacuuucggcugcuacugccuuggggcuuucuggaugugucucaggcccugagugcccgggugccacaggguucccacuaaugccaguugagaaaguccuugcuugcuggggcucacuggagaccaguaagaauggauuccccaccguucgaucuccucacgcagggugagcuguggguccagcccaugucuuucuucucuuucagacguugacauagcagagcucuaggacucacugugaaggaaggcuccgccguucuacagaccuuuaccacauacagggccacucaucggcuugcugaggguuguacccaguguuuagccaccugccacuuggacuaucauuaggggauggguggcauauggcacaacccuguggaauugccagaggaguguugcaugugugggggggagggggaacgugucacaugacuggguucuaggaguagccacuauauaagcaaacuugacauccaucccuuugucacugaagagagugaaugagucuuccuuuuaaacccuggugagggugaccccucuggcaaaagcacuuugcauggauauagauaaagcuggagucggaguuuggccuauuggcauugaagccuuagcucuggggcacaaggggaaucuugaaaagccaccacuuugucaaaccuuuuaauaguggggagcacagggggcguacagugauuagaacauccccauuucccaccaguucaagaccaaggggaacccagcuuccuaacuuggguguguuuuccugccuaggaaauggguaugaucgacauccucacaugagaccagguggcaugugggaccagcaagcacuguccucugccugccgccauuauuguacccuuugaccgaggcaccugcucuguaauuagcgaauucugccaucuucucuucccuuucaucaguaucugaccuccuaagggccaggauuuauauccaguuuguaugugguugcgucugcagguggaaugguacuugacuagagguccccccuugggcaaaacacaccucuccaguuuguccagugugauugcaugugccagcugcugguggagaauucugcaucccucuuuccuguuuuuggugcuuggaggagaacccaggacucgugcaugcuaagcaaauucccacagagcugcaucccaaggcccucucuccucauccuugaauuggcccuuucugaguuuuagggguuaagggcggagguugagccuuaaaugauuaccguguuugcuuuguucccguugagcgguuuuacugauacugaucauugaacucacagaacuggcuuuuguuaccuagguccggggguguuguucccaguuccggcugacugguggcacuugcugccuguuacuccagaggcuuugacagccuccguccccagagccugagccccacuuucaggagagaggcaauggcuagcucugccacaguggcaguccccguguugagaccccaugaucuaagaguggugugcuccuccccuggcuagcugugugcucacuucaaggagggagggggaugugugcugccugucgggcaagaaagcuguccuugcagcgcagagcccagguucagaugcugaucugggggacccagugcacaaugcaaguucaguucuguugagaaaggauagaguuucaguaugggugaccccgagugacagcgcaggucauuugauuguggugcuggccccaucaugacuugguuuggucuccuccacugcuuacuguagcuuuccaaaggucuucuccccucaggggacuugaguggaccuugcaaaagucucucucucucucucucucucucugucugucugucucugucucuuguguuucccucuuucuuguuugcagugcugggaauggaacccaugaccuugcacaugaugggcauguauuuuaccacugagcuaccccaccugggucccagcaugacccucuugaaguuggcuugagguuuuucugcacccuacuuucagucuucaaaugagugauguugaucugagaauccagucugguuuccucagugucugacaugccuuccccagugggccuugcugaaagcugaagucccuuacucucugugguaggcuaagcugaccaaccacugaggcucugacaguucacugucaauugagggaccaauacaaaugcccccauuucuaccuuggcauuccaggaagagccagagaccgauggguuaguccacguacuucacggcauguuuauaaaaauauuacugaaaauucagacuggaggcggaaugaccuguaaaacccagguugaguuuauugagcuuguccaggugcugagcccuguugagugagcugcacugggggagucucacaggggugacucguucacacauacacacacacacacacacacacacacacacacacagagugagcugcacugggggagucucacaggggugacucguucacacauacacacacacacacacacacacacacacacagagugagcugcacugggggagucucacaggggugacucguucacacauacacacacacacacacacacacacacacagagugagcugcacugggggagucucacaggggugacucguacacacacacacacacacacacacacacacacacacacacacacacacacacacacacacugcaggcccugaagacccuucuuagucaucccaccuuagugagcaggccugagggcauuugcaggagcugauacaacacugcuguucccuuguagagcagccgcucugccccaugggcuagaagcgcucucuuuccuggucccuagauucagagagaggcaaaaccuccucuaagaaugcaucuccuuccuccuugcuaacccugccccagcgugcuccucaugaaucuuuuaaccgucugcaggcacuccaugcuucccuuucuaccccuuuuccucucuucuucucucuaucaccugauuccauaaucuucuaaaauuaauuuuuugcuaaaguccccaucccaaacguaaauguaacuuuuauucaucagacgugauuguugucuuggaggcuuacugcuggaauaaacuuacccuuucuagcucuuucugaacucuuggcuggcugauucagcucaguuguuuuggcccaaacuccugucuaagcugacugauucaaacuggcuccucucagcuuuggacugaauugcucuacuuggccuuaaacuaacucuggcagucuguucuaauuuucuggguccuucucguucucuggauaauagccguguucaugcacuugccuggaacagucccucucuggccauuuggauuccugacucugguaaggaaggcaggcauucugccugaggcuugccuugcaccuccagaucagugaggcagcaccugguugcccaugggcauugcuugaaaucagaacagagcuagcugugggucugcuaaagcuuuucagugagugaugccaacccagaggugagaaggauugcucugaguuggaagagucacaagcagguggguuggagcccucagggagcagggcauuggaggagcccuggugggcaacccuggagaaaagaguucuggcccuaccugacccuccuguuugaucuuaaacagucugguuuucuacuucuacaguggccaauaaagagagccaggcucagaucucucucucucucucucucucucucucucucucucucucucucucugugugugugugugucugugucugcuggauauuaaguguagggcauagcugguauucucccacugaguuauacugucaccccuaauauuuugagauaggaccugcuaaauugcccauacuacuguagcauccaugaagggcugcauggaaggaaccagggccugggucagcccaguuggugccagaugugugaucuaaggagcccugcugucuugugccuggcaccguuucucagaauacaguuugaccuguuaaggaagggcaauuagccuagucaucuguugucagcuugaguguguaggucuauuaaccuaauuacauugguuauauaugugggaggaguacaggauaggcagcccuccggcacuccuguguguuuauucugaaaguucgugacccacagggaaagcaggaagaagccccauaaaagccaccucauccgcagaggcugcugcaccuacuugucuuguuucacagccauggagaucgacccccagacauuucagaucucaaaguuggucuuccaaggaggcccuuggucccaagcgcaccagaaggcacagacuccuuguccaggaacaccagcugcccuccaggaaccugccugaagccuagcuggacaggaagcaagggcuaucugaaauguucauccaaauagugggaacucugcccgagaugagaggccuggcaguggccaaacuucuaaugcagugaacucacaggccuuauguguaugcaugcauuuuugugcuuauaguuggaacgacacauaacccaauuuuaaagaugcacaggggaccuaauauacagcucucaaagaauagucaggugguuaguggggaauugaguaguucuacaucagcccugggaaauaaaaacugaaacaguuguagcugccacucacaccuggcagcugcugccugccugcuggucuggagucccagcagcuccuucagccucccuucuugcucccauuugaggcugagucuuggaagugauguuucuugaaguuucuuaagcacugagccaguccacacacaucacggacaaccgugcaggucccaagagacagacacaggcaauaagacuucguugucuuugccuuauuugcgucuguaauaaccacccaguaaaauuggugguuguguguauguguguguacuucuaaugauauauaagacaugcuugugaagucacaaccgccauguggauacagaacagguccaggacccuagcaaacucaugcugucacuuuauagucagguggcguuaaauugaguuuugaaaugcaggaagaauacuugagaucugcccuccugagacacucaacauguuagcuguggcagaugucugcagcaggucuacagaagguaaccacaguaucugaaacugucuaugggacagcucccucugucccucccuagucuguggcaaccaccacucacuucucugagcuugccuguuuuuaagaguuuacggagaggagucacucuauguuuguccuguggcugguucacagcauuuaacauuaagucccucuacaggaccuccuuuuuuagugcugcguaguacuccgauguguacucacaaugcugucuuaucuccucaucucucaggggaccuugaaguuguucccacagcuuggcuggugugcuuaauccucagcgaacagagauguggagacacuucuucaugagauuccgacucaaacuuguggagaguaauagaugccaaguaacgagguugcugguucagguagucuguuuuuaauucccacggugguuaugcuguuguuagucccagcaaccugacuccuugcccucaccagccuuuaccuuuugucuuuagaugucgucaugcagggagauaugaggugaagcuccaggacuuguuuguaaccaugaacuuuuccauucaugccauuuuguucccccauuuuguugguuagacucuaagauuuuauauauauauauauaugaauaaaugccuaggcuaaaagccuuggaucuuucccugacuagcucauaccuuaaaucccuuuauucuagucuaaguucugccagguggcugugaccauuguccucuguccauggggccgaaucuucucuuggcaugacugucccucucccagaacccccuccuccuacugggugucccaccuucuaauucugccucaacucauuggccaauaaacuuuauauugacaauugagucuuucagagagugcacaagagauuauccccacaccuauuugccuuguccccucugcucagaccuucucauggggccacguguacuuuugccguagagaugaaggacucccuguacgucuuggauauauucuccuugucagaucugugguuggagaauauuuucuuccauccccuagguugcuuuuucuuuccaguaacuguuuccucugcugauuccauauuagaauaggaaguuagagcccagagcugggaaguaacuggccaggcacauagcuaccaaguugugugcaagucuggaauuucagagcucacucauaggauguccugcuuuuccagacacccugagcauacugguucucaugaauccuggugaggccuugucugcgucacauucacaccagaaggaauuagcuaaaacguccccagagagcuuuuggaguccugguguugcuuggccugcucugauguuuuccugggucccaaaguccauucaugguauacagugucuccagaccucccaggaaugugacacagagucugggccaggaugcucuucuccauugcaaaugccccagaggauaccuggcugcucuaagcugccccaagcccuucccguguggcagaucucucgugauggcucuuuucucaccauucaguagcugggguacccuggaccacugcaggccuuaguuuuucccauuuguagauuagagugcucuuucauugcagggaucuggagaggcccuggcccagcagcuauuuaaccccuguauucucacugggacugguagaccacaguggcugggcacauggugugugaccaugggaagcagggcccuggcucugcaaugccagugaugcacaccugagagucccugggacagguuggaucugggcuacccuuugcagcaaccauaggugacaucagugugcuugccugagaggaaguauugcacugagauaauccaagagcugccuguggcuagcuagaaagcugugucugugugcaaagguggcuucagugugucuguguagcccucaucuuuuaagagaugacaaaaaguuuaaaaugauguacagaugauuggcuacagacuccaguuuuguuucuguuaacguucauugugagccuaacaagucucuugugggacacuggccauguacaguccugugucccacuuucuggccagugugaucagcauguguucacuggauggacaaggacuuugagcagagccccugcgacucuugccccauggccagagggguaugucaggguucuguucccacaggguggucuagaugaggggugaggaugucucuugagcuccccuccgagcagcacuggagguuguagccaaggcuagccagcucucuccugaggggugugcccuuccuccacuccgaguaccaucagcgcccagccaucaggcucccuggggcugugcugcacuggcacguaaugugcccacugggcagcuuauaugugggcuaggccagaggcuugccgugggucuccucggugcagaggcagggaggaacuuggucccugcuggcuugagaaaggacuguggcuaagauagcacaggggcaggugacgcagccaagacuaacgugccugugugacguuagagcuggcuuucucagcagccucauauucuggaagacguguuaucacuuuauuuucuuggggggcggaucccacagaaaccccgagguuggauguuaucuacucaguuguauuuaugguuuguugcuauggaagcuggggguggaggcagugguaguccaauggugaagcuugagugacuauuuccugucacuguggacaucuuuggguaggaaguuaccauugagcacugcuaaggagccgcagggcaggagacaggacuucccgggugggcuugcagagugccuuccagaggccgaaguagccagguguggggagcuguucacuggucacuaggaccuacugugugccagguguucugggaucugaggcgcagacaaaccccugucccugacuccuuggacuugauuuuaguucugacauuuuauuucuugguuuuuuuuguuuuguuuuuuuuguuuuuuuguuuuuguuuuguuuuuuuguuuuuguuuuuguuuuuaaaaacucagugaacuuucaauuuugaacuaacuuuagguuuccaagaaguuguagauaaggcagagcugaccgcuguucccacugugcacgcugcccauugccacaugggucaucccagcucaggaagugacaauggcauagggucagugucccaugcaggccuccacgugccuucaugcugcaacuccaguccccacuggccagggccauugcacaauccuugacuuucaugaccuuggcugucuuaagagcucuccaggggccaugcaacauauuuccccccugaggccugcugaccuuucuuaccaguagacuggguuguggggcuggggaagcaaccagagugagcaggccuuucugggccacccucucaggacaccagaaccgcauggcaugcauucugaucucuaccuguccugucuuucuuaccuagcugcuaauaaacauucuguugggaagugacaccccagggccaggccaccuugggugagucacauggcaguggccccacaacagugggccgcuggauuacuuuguagcugugcagcuaugagggcacaggugaggggguugggaggcacaggcucagucaggaucuaacuuccauucaucgcaggucugcaggcugggacguacuaccagggcugagaguggggaagagccaguaacaaaggguauaggaacuaaguccugagaaaccugggacccaggaguggugacucugggcaugugaucuuagcccuuggaaggcugagucaggaggaguacuccuggucugaggucagcauggccuauagaguaaggcccuggcuuagaacaaaaccaucuguaaccgugucuuauuuagcacuggaaaguguucuaaggagcaugagacggcagcucuuacagaaaacaucaccucgaggcaucacccagcuuccuucacgugacucucuggaagcaaauuaucucugucauaucuuaauucauagccacggcaaagaacagcuaugaccuuguauagcaaagcccuguacacgguacgccgugugugucuucauguggucuuucucaggggugcucaccacauugucugcuuucuguuuucugacucauccuucucacccagcccugaccgugguaaccgcucuccuuugagcguaguggguucuccuucccuucacaucugcaguuuguuuuacuucaccuaguuugucuuucaucuagguccuuucuggcacaaggcgggaucucucucucucucucucucucucucucucucucucuugaaggcugaauaauauuccacugugucugggagcugcauuuucugugucccuccaucagugguggcuguuccacauuguggcuuuagugacuggugcuguaaucaagggugcaccuuuugggauuucauuuccuuuggguaugcagagaagagagauuacuggguuguucuacuuuugauuccuuguuuaucauaauggcuaugcuagucuacaccccugacccagcugugugcaagcauucuccuaacucucccccacccacacuuguugcguuuuggauccaguggccgccaugcuaauggcuguguggugguaucacagaccauuuuaguuugcaucuccuugacaguuaguugaugucaaccaccuuuucgguguguucuuggccgucuugcucauuuuugaaaaagugucucaaaugcccacccaucugccugcuugucugcucauuaaaucuuggguauuaaauccuuuaaucagauacacagcuugcaaauguuucucccugauuaucagccgccuuuuucauuugucuccuuugcuguguagauacagaguucgcuguagucuuagcuauguguuuauuaucugugacacauuauuacucauuuguuacucuuguagccuaaucuggcugcucuucaauaagccauauucugccaggugcuguggugcacaccuucaauucuggcacccaagugucagaggcaggaggacuuuuaugaauuugaggccagccuggucuacagagugaguuccaggacagccagggcuacacagagaaaccgugucucaagccucccucauccccugcccccccgacgucacccccuaaaagucauauuccaaacuagugauuucuuccaggaaaucuugugguuucuggcucuacauuuaggucuuacgguuuguuuuucuuuaauccacaucaggaugauuuucacauguggaauaggacaggcauacgauggucucacccuuuuacauguaaaggggcaggcuuccgggcaccguuuacugaagggauuaucuucaacccuuguguucucuugaugcccuugccaggaugagccgaccaugugugaucugccccccagggccugugcguugguuuuuauguuggaaucauucugagcucauuacuauggcuuuguaguauaauuuuauaucauggaguaggaagucuccaucccugcucuagcuguuuggagucuuuuguggcugcaaacaagucuuagacuuucuucugauuucugugcagucucgggguuagaggugccuuggcugccuuuuucuuccuuucucuuucuuuucuugccugacacgucugcugauccugaguggagguguggagagcagcacccagccugcugccagauuccaucagcuguggaguuuucauagaugacucucauggcaaagaccuugcccucccucaaggguagcugcuguccccaagcuuguuaugcaucaggaucguguggguccccucugcgugugaugcuucucaucggcugccagggcagaccagccucgcagaccagggcuggagugcgcaccucgugaccucuugugugcgugccgggcagguuucuguccccugcguucaccacgcacacuggcuugucacuuuccugugguuccucuggccaggcauuagggugacaucagccucauaaaagggucucuuaggaauaacuccucccagccuucuuccuuuuuggaagagcugauauccuggcaucgguugacucuuuuugcagaggccagagacuucagcugugaagcugucuugucugugggcuuuuucuucauugggagguuuauuuauuuguuuaauccaauuucaguaucuuuuauuccuggcuucuuacugguccuuacuguugacaggguaacagguuuuucuaagcuuaucccugaggacuaggagguaguguugggcuccaaggacagcaucucacuaccucugcugccagcuucagguaccuccuccuccaggaagccuuccuccccauucccccccaacacuguccaucccugacuacuuggcccucggacagccucagcucugugcaugugucucauaggcccugucacuuccuuacuagugggcuuccaaggccgugguaguggcaggcuugugcuguccuuagcaggaccuggcugagagccuugcacacaaucaggugguagcccccaggugacaugcucagcagaggcacggggauguuacagggcuagccaucugcuucaggucacagugaaucuguaccucucucagccucagugaccucguugaaagguauaggcacaaugauaaucauaccaggacugccgugaguacagagugagcacucugaugucuuaacauggggccuggcccccuugggugcucauaaccugucuguuguaugggaagcaccagcacaccaggcugcugggggggaugggugaagggcagacgcccagaggugcugccuuugcugucugucagcuucuuccagaaaggacccaagaagcuuggcgucuucgugccacacacgcuuauuuucuccccguaaaguccaagcagagucgacgcucugccuuuguggauaccgggagaccagguucguucacucaaaguauauaaccugcaagguagguuaggguaccacugucucuugaagguaaggaagugaggucuggccaugugcccuagaggagaaaagaugcugucaucucugucaccaugacuccagucagcgcuaucugccucucccuucugccaucuucauuauuuugagccaacuccucaacagaugcguuacuuaaaauguuucuuuucucuuccuucauugucccccacccaccuaccccccucccugcugagacaggguuucucugaagccccaccuugucuuuggagcaaucauguuucuuuuaagucaguguuugaaacacucugacugaugagaggugacuuuacacaucaucagagcggagaagcagaguccccugcauagaugcagucccagcugcagcgggggccgggguccgggggccgccggaucggcucuguuuaagaggacccagugauccuccgaggccccagugcacaccuaagcgugcugguagaguaccaucccccacaugcccugcuuuucuauucauacacaucucugguagcuucauucauaaauuagagccaagaaccgcaacuaagaauaaaauaaugguaauugugcaccgcaccggaaggacguuacugaguaaaacacgguuccuugagcauagacccugugaaucuuccauauggucggucugauaacucagguacagcuggugugcuuggcucacagggcaggagucuaggcuccucccauguucucaacucccuuccucuggggucugucuauccacuccaaguuagaacaucaccagcccuguucauugaaagcccacucauugcuggcccugccagaagcauggauucccacuguggguaagaagugagugggguccagggugugcuugcccaccuucccucucucucuccuuccucccucuuucauuggggcuucugagaagcuaggacugcuucccccaucagcuguucuagcugccaggaggauggguagagccacaauaugaguggguguuuuccacgcaaguccugaaaaaggaaggagcagguggugauaagagagagcuaacagugacguguuaacgaggccucuuucucagaaggcagccucugggcuccuuugggcucucuggcuccccuucucuccuccccaguugcugccaggcucugcaggccacugcgcuguuacuugguacaaaacaaugguccacuuuucuguucagcugaccccugccugcccuaguggggaacacaccugagaacacaccaaguccacccacuuagggggccuggcgcuggaccugggcucugcaccucuaacccugugggagggagggaagagacacugacaaccuccgucacacagcccugaacccugcagcccccacugugagaggacaccucccuccucagggauggacuggguacuuuguggcuucaucucucuguuuagaucauguuccuagcuuucuccucaggguguaagcacacgggagugguuggucauggggcccugaggaauaggagagucagugacugggaccccacacucuaucaccuucagucuacaggcuuccuuugaaauguccgaugaguccccagagucuggaugaggaagguuaggagagagaggacaccucacuuuccacaugcaccccugcuugagagcuggacuuccuuguaacaggaggaaccagaggcucggagaggucaagcuuggcccagagccacacagcugggaaagucauagagccaagcuguagagcaacgcucucugaagcucagcuuuuggcuagaucacuugaccucgaaauccauguugcuggguugggaacucagucgcuauauuaguaaucuggcauucuccucaguugccugggggccgcgcugccccuggagggucugcuucagcugacccaggaauccacaccuuuaccagcugacugcaaaaguccuuggccaagcagucgggggcccugaacugggaccaccuuccuguacucagccucaaaaacagccagugggacuugaaaguuuccaaaggccuuugaagacaauucggagucuccacagauaaggacuuugaggccccaggggagggcgaguggcacuuuggugccacacagcuggaaagaguggucacaggaacacagauuuuccucagcugaugauguaggaauccuguagccauguugcugagggcucagugccagcuuccugagccguggaucauagcgugaacuuuaugcaggcuaccuuugcacagcugugaucuagugaagugucaaaagugagcugucacauucagcaggugacguguguuaaaaaguacucggaagccgggcguugguggugcacgccuuuaaucccagcacucaggaggcggaggcaggcggauuucugaguuugaggacacagagagagucugucucaaaaaaacaaaacaaaacaaaaaaccaaaccaaaacaacaacaacaacaaaaguacuuggagauagacugggugccgugugcuaaggaucugcuauuggaugcuaacaacagccuggucucagguaaggaggcucagguaacuugucccaggugacaaagccagcaagugguagagcugagagucucccaggcugccugccagggcucaugguaagcggaggugcccacuugcagaugcuugugacagggcguagguuuugacugcucaguuucaggaagauggaagggagcaguguggugacaacagugucaucauccagugcaaauggaggaccugucacugugcuugggucucacucugagccggcgugggcugaaggugcuucuuagccauuuccuugaccaagaacgccggguggagaguugcugugcacagcuccugcagucgagaauccgcaaguacagaagccugagagggggugcaacaggcagcucuugguuuccaaggaagggagcugagcuguugaaaaaacauggaguccuuguccagauucaccagcaagccgguggcagcaaccggcucuggcuuuccucaccuacaaaacugggucaaacuggaggccaggugguuugucacauaugaguuaaccccgagucagagaggguguaagaaaguuugccgccugggccagguuccucacuguacaugucagucaccucugccugcucccucaugccccugagcaugacaagucagccauccaggauucugugcugggacagcuggggugggguaagguaggggguggggaagaacccagggcuucucgugggccugggucccaucucugcacuccacuugcaguguuuccaugggcuccucacuacacucugagcugguucacugggcugcaggaagggcugcuugcagagagcagaagcuggcggagcaccggguuccugcggcuccuaagccaaaguuaggacuucucuuuucaugaaaccuccagauagacuugaucuagcaggaugcaaaccaggacccucgagcuuauaucaauaaaggaaauuggcuuaaaugcaagcauaugggaauauuuuagcuuugauuucucacacuuguuugaaagugagccuugcugaccacugacuacauggcagucaguagccauggcugaggugcugcuggauccucccccaaacacacacacacacacacacacgcaugcacacacgcacgcacgcaugcacaugcacgagcggagugcgcacacacgcccuuacuuccugaugggcugguuuaugaacaugacagaaucuagggguaacgaacucaggcaaagcucuagcacucugaaaguggggagguguagcggggucuguggucaauucagggaccuuaguugcugcaagggucugucuggaaugucagaacuaucauuggaucaaacugaaucuacaguggucuucaggagccugggugucuaagacagacucugggguaaaaauguuuuugcuccaugacucaaagcaagguauauaaaguuccugugccccccuuuucucauuugccaaacaagcaccgugggucacugaugugagaugcauagugccgagugcccacagcuaccgcugugcuucagugcuaagagugcaauccagguccccgugcaugcuggcgcucuuccacugagccauaccccagcuggagaccaaaagggugcuccugagguugcuggugagaguauccgagacuccaggugguuuuccugguagcugaggaaggguggccgaaaccucugauuaucaucaccauuugauggcuggggacgugaggauggggugugggguuguguuuuaugucuuuaccuugagugccucccuuaaaagugcaacaguggccaagauacagaacaauggagugaggggggauggcuucugauuuucuagaucauagguguggucugcucugguguccuuaggcagagauuagccugcagggccuggauucugucagcaguuauuaaaucaaaguggugacagagugucuagcacgagccaccuccuuagaaggggcagcagggacugggcugggguggaggugugugucucucuauggaaggagucgguggcuaucuuuggggaagauaguauggacuagucacuaaguucucagugccccaguaucagggaacacucugucuugaucaccauuagguccuuggggucaagggacaugccaggggcacugaagacacagaagaauguggcagggcuauggagugagugugcaagcccuguccuauccuggcugcguagggaccuuccuucucaggacacuggaguuuccaugagauaagacuugggagcuccucagcccugcauccaaccaugauggacagacagacagcauagaagugucaggcauuaugguuuuacacaguuauuucugucucuagcccuucauacaggcuucuguaugauacuggagucuuaugguaaaggguucagcuauccuuucagaauuuucccacuaccuugugauaauggcuuagaaaagagagguacaugguuccaucugagguggggaccuuauggggagccaucaaauguccuacaaguacuuaugugcauguaugugcacaacauaggaguauguacauaugugaggcuguguacuuguacccaucugugccucaguggucucacagcuaaggcaucccaguguggaacaugggaccugggcuucauguccccuuucaccaggugccuaggugcuauuauuucagauaauugcccagaaaccaugcaauaugcagugugccacaggaccagcuaucaugguaacuugauuggccucagggucuccucuugcuucagggagaagcaagcagagaaguccuggccucagcccucugcugcaugugcuggcuuuugaugucccccuguacuacccggguccagggaccagagaagggccagaggcaucugccuagacgugucucauauagugagucaggucagccuggacuaaagaguaagacucuuaaucucaaaagagccagaaccaagccgggcaaugguggcgcaugccuuuaaucccagcacucgggaggcagaggcaggcggauuucugaguucaaggccagccugguauacagagugaguuccaggacagccagggcuacacagagaaacccugucucaaaaaacaaagcaaacaaacaaacaaacaaaaagagccagaaccagcuggaccugguggggaaggcccauagucagcagcauuggggaaggucaggaguucaaggucauccuagguuguauagcagguuccaggacagccuggugucucagcaacaauagcaacuccuauucccauuaaauagcaccacuguggguuccaggcccaacauggagguguggcauggugcagcggcaagcaugaacucuggaucucccaggcccuggacgcccugcagucugccuggcuggggcuuaguccuucacuucucuguccuuuaacuuccuggcuuggaaauggagggaggccuggauccugccucucagggacaccgaaaaguccaggccaggcucuugugugccugguguguuggaaguauucagccauugauuguugcuaagggaccacaugggacuuaccugaaaagcaauuuaagaaacagaaaccaaagcccaggaguguaacuucauaaugguuucccaccuccuuuaaaugacuguucuaggugggaucugcacaugugcugcuggagucagacuugcucagucucccuucccgccaaagaaaaguuaacuucugagaggucacuugacccguagguacucgaccacuggggcuccuaaaaugaagccuuuaaagagcugccugggguauugguguuggacaaggccacuauggggcugacugcccuuaguggggcaggcacagcgugaguguuacaggucacugcaucagcccccaccuccccuaaagugccauuuccuagauuccuacagcaugaguaggaacagaagacaguaagggaaggacaggaggacaucaccuugccucuucauucaugcucuccaucccguuccccaggcuugugcacaugcuuggcugggcgaaaacuucaaugcaaaucaaaucuacuaagccaacucaaaucucagccaaacgucccaaacgucacuggucuguuuaucacucacgcauugacagcugcaugccacugaucaggcagaggauggguguccacccgaccuuuguggacauggugcccacccugcugaggcuugcuuuccacaggaguccaugaccaaaaguuuucuagcaagaaugcccagagcuuuaacuuuguucaggauucuagaagguucuuccauggucuuuauucugaggacuuaaugauaagcagggcugguuuggugcuggaacagaaaguugcaggcugcucuggaggaaaaggccguuaugagugggucuucgugguggguaagcaguucccugaggccugggaaggagcaugcccuccgggcuucauauagccaggaccagaggucugcaggccagggauucucaggguggaugucugcacaggcucagcucuaacagcaacccaucagacuggcagcagcuggcucugcuagcagcuggucugacugccaagaucucucuuugauucacauuuuccacauugaaagauguuuugaaaaccuugaccuucaauucaucacaugucccuuauuaaauuguaagucacauccagccaguuaaugaaaagacaaugggcgggugacgcaguacaaggcaucuuggcaggagcucaccaaagcgcucuagccacagaagaccugaccuagugauaccccuguuccagggcagacagcgugucacaacuaugaagggcugggcuugagagaguggcaaggcugcaguaaggcuggagaagcggggacaugcugaacauucagcagggcccaggcagguagacgggaacccgacuuaaaagaggcagagcccaccgggggagguggggaggagucacacguuugacuggaagagaagcaagugguagaugugugagggggucaguguggcaggggcuucuuagacgcgggcauguagacaaaugugaguuggagggaagagauggcauugugacauuguaaugucuguccccagugaguacugugaggugggagggcagugagagauggaauagacagcugagguggaccuucacaugcuggucacuuggugggagccacagaagguucuagaacagaugucauucugaggaagguaggagcagcugcguggagaaacacguaggcgcagaagaaaguagcugaaggccugguggcauggguaggcccaguuucaaagauggcagagggugugcucucccuucuaggccgacuguccgucaccuugccucguucauggaggcggggcagagaacuaagacugaguucuagcuugccuccuuggccucacuccucacuaccuccacuuaccaacggaagcagcguucugccucccucagggguguggcaagagugaaugaagcacugcacauagagaauguuaggagaguacugggugugcagacagcucuaggugagugucaccaagggccagagagccuacauggggacacccuagcuggggaacuuaaaaguauuggagucccccgugggccaguagacuuuagggccauguugacauauguccaugcccauucacacucucuguguugacucuugcacuggugagcaagggagccuguggggcuucaguuugcucauugugaaaggggauggaggccagugccugguucacggcacuguugcagagaugaaguggccugcuugaugcuggagaaggacuuagcgaugggcauggcuggggucaguccucauucacauccagguuguugccacuuccauaguagaagcaucauuuccuguccagugcuuucaggaagaugccucuccucucuuccugucacuucccuguagagacucuggaccggagacuccucuccucccccagccccaaugagucuugaagacuuggccagacuuguguguaguagggaauggucccagccugggcuccaccccuugcuggccgugggaaguugugucggucugucaucacuguggcacugccuucucaucuguaacauugggcugauaauccacacauugugugagggcaaagcuguguggcacacaugaacuacugcgugugccaucuccggggccagaagccucuuguagcauccucuuaggcagaagaggauccugguucacagaagagucgcagguucaaggacaguaucccaggaucuugagcacagagugggcuggaggcaucucagcuaaguauuccagggucgugguaugugacagugucaacccagcccagacgcaggaacagcuguccacccuggccagccagugugcacacuggucaaaguuuguuaucuuagccuuuuuaacacccugcgaauaugggagcagcaaucccuacuguccaagggucgaagcuguugcaggcuaggcauguggugagaaagcccugacagggcauuugucaguagccugugggacauacccaggaagucuguuugugguccucuucuccauaccuuuccuuauagcuucuuaggcugcagggcugggaggcaguguguggccuacauagaagacucugcaccacaccagagaauuagcauggccgacccuaaguucuucucucugcccugcauccccucuauaccccugcuagggucacagcggggccgaucccuguaaauaccaguccgcuuacaugugcauuuuuccucugugaucuuccuguuuugaugagacacugccuuuggccgcacggguucccuaggggacugcgguccugaggcccagcccuagccagucauucaggaauucugcuuccuggcgccccacacccugcacauuccaccagggcuagcgccuccugcucugcgugaauggggucugccuuccccauucccacgguucccauggccacuuccuuaucacccucuccagcugacugaaaaaggccacauuccagggcaaaauuagacucacccucccuuucuguuuuccuccagcgggcaggagaguuugcuagaguagacuggcgcuggagcccacggguacagggaacagacuugcugcuuggcguguccccugaaucuaucacuucguuucuuggaucauuugaggaaugcacugggcuucugcuguaugccaagaaaagccccagggacugggcuuacaaacagugggguuguacaguguagcauggguacgggccgacagcugcugggcuuggggguugagcuguuuucauuugcuccauauucuagauucagcugaugccuccauguugcuucuaaggcgucauuugauggcguuucaaggugucugcuuguucgugccgugcuggggauggaacccagagccuuugcaugugugcucuacggcugagcugcaucuccagagggcagaauggggguuacuuuaagagccccccuucuuucuagccgaggcagcacagagccgcaccugagcgccgaugcuauguucuucaaaugccccaugcuuagaaccacaggccagguaaaccucggggcagaacuuacccaaucuguuagagccacaagaggugacaccuggcagcaucugacaaacccaggcugggaccuucuaaaaacuaccagugaaaccaggggaggggacagacugcagcagucugaagggugcccuucagaggccuccuccacucaggaaaucccuugauuccuggcuucacugcggagaagaauuucaugaugauucaacaugaagagaauuggaguucacgagggguuuuuuuuuuuuuuuuuuuuuuuuuuuuuuaaagauuuauuuuauuauuaauauauguaaguacacuguagcugucuucagacacuccagaagagggagucagaucuuguugcggaugguugugagccaccaugugguugcugggauuugaacucuggaccuucggaagagcagucgggugcucuuacccacugagccaucucaccagcccacgagggggguuuuaauguuaguuuuuggcccaaguacuaaggggaaaugagguguuugggaagagaguaagacaccagagagccugggugugggcuucucugagggccacacgccuuugucuuuacaauggacagguacaggauuaugguggauuuaaaagauaauaucuucaaaggguuuguuaucugcuaagaacccgagugagaucucuggguaguccugaagggcaccugacagggucgcacuugagacggugggucacaggcaguuggagauccccacugucagcaauguuaauaguccugcuuaggagagucacagaugauguccaguucauuaccauuuuaacaauaucucuauauggguaaauuauaaaguaucuaucucauuuacagucaucuuuuacuuauuguaggucuaucauccauacauccauccauccauccauccauccauccauccaucuaucuaccuaucuaucuaucuaucuaucuaucuaucuaucuaucuaucuacugucaaccaucugucuagucuggcuucucagccacuuagaggcuccauggagacuucagagucaggggcccuuuuucauuucucacaucucuaugauuuccuugucuuuccuacugcagaaaguugaggaccagucacagaccuggggggggggggcuccaacaacugaaugcagugugguaccugagcccagcagaaagacaagagagccaaacccugagaaaguugguggccuaguugaugggaucaugucaaguuucuuaguuuugagaauuucaguuacaugagauguuagcaucucauccaggaagcuggugggaaccugcagucauguuuauccucuggagauagaaauagucagccaggcgugguggugcacgccuuuaaucccagcacucaggaggcagaggcaggcggauuucugaauuugaggccagccucaucuacaacaugaguuccaggacagccagggcuacacagagaaacccugucucgaaaaaccaaaaccaaaccaaaccaaaacaaaacaaaaagucuaaagugcaaaguuuaugcugaauuucuuuccauccauaaaaagaagaaaagagaagagcaagaggagaaaaugugaggggccuaguggcuugucaucccagcuauuuuggagcugaggcaagaugaucacaaguucaagaccugucuggugcacuuagggagagacuaucucuggaggagggggagggggaggaggaggaggaggagggggagaggaagaggaggaggaagaggaggaagaagaggaggaagaggaggagaaaaggaaaagaaaaagaaaaagaaaaaagagggcuggcagucugucuccgugguagagcuuguucgcaaugggcccucugaaccuacaggcuguacauucacagauucagauaaccaugggaaauacucagaaaaucaugucugucuuuacuguguauagauuucccuguaugguucuuguuccugaacaaugcuguuugguauacucaccaacaguguguucuuggguaagucacugagaagucauuucaaguauauggaaggauguaugaguucucuaccuaccauauacauucuauacaacacauuugcgugucccuggaguuucugaggaaggaaguccugaagcuaguccuccaggauaucugggacaaccguacauguuuggagaaaggcuuaguggaggauggcguugggaagguagacgcuuuccaaguguaaaauuaucucugugacaauucuccccagcagguuagcuggccuuguuaucugagcuagagucagagccuggcccccggcagcaacugacaaccaagcuugaccaccauucucauuggucuccguggaggucaguguggccacauuggaaaaaggaaccaauaaggagacccagcagccucuguugagggcuccugaugggagauuuagguuuaaacagaaggccagaguccccaucaaagugugccccgcucuucuuccucugggcugcaggcucuccugcuagguggacaaguugggacucuggaaugucuuucuggcugguaccaggcuccaugcagccuucuccagcaugagguuccugggggagauuccaauuccuugagcuauauggacucaauauuccgauagccgaagagagggacacaugugucucuuuggaauguauucacucuugccaggaauagcguuuccuaaugggggucugggccgccccucccgagagggggaguaugccccuugcuggugucacuggcucccagcuaggaaacggggcuuguccuaugauccuuuccaguguggcccacacagcagccacucuuggcacccucacaguguuugcugcgucugucacacauccaccacccuaugcacacagcauauuuuacuugaguagucuucguuuuuuuagaagcucaaauggauggauuuucaaaggcaaacauugaugucauccccacaaguggaaaacaguccucaccagugaauccccggcauccuuaagugagcagggagaaggcuugagcggggagaaggcuugagcggggauuauugagguuguggguuggagguagcuccgagguagagugcuugccuggugugugugaagucuuggauucuaccccaagcacuguuauauuagauuguuuucgaauuauuuuuuguuauuuuacaaggaauacgggcuuauauuuuaaaguugcaucuucgggaacuagggaaauggccuuguggguaagagcauuugcuacauggugugagggucugaguucaaauacuuggcacucacagguaacuucagaacuggguugcuagggcucagagacuggaggaucacugaagcucgcuggccacuagcuugacuccagguuuagugagagacccugucucaggggaguaagaugaagaguaacagaacaagauacccagggucuuccucugaccucugcaagcaccuguacacaccacauguacaugauacacaucuccaauacagaaguggacugcugggcaagguagcuugcaugagacgcugcucccccucccagcgacucuccaccaaagugagaugaucagauguucaaaggucugcugaugccaggugagauuuucuuuuaagauuacugagacaccugaaagagaaaugggaaguauuugcugucuuuucuggguguccacaugaccacuggccagauccgccauuggcacaacagacuucgauaucaggcuggggacgccggugcucauguggcauggccugccucuuccaggaacucgaugcugguaguucuuagagguccagccugaagcuacuuccuucuccuccacaauuucauagcauuucuuaaaaagccaaaaguuagaucuguguucuucuaagaaguauggggguuauuuuccaaugugguauugcucuugcuuaauucugagaacuggauuuuggcauauugagucaaugcugucugagugacagauguguguuagcacguguguaauccuggcguuugggaggcagagacaggcuaaucacaaguguaaagcuagcuggggcuacauaaugagacuaucucaaaacaaacaaauaaaaacaaaacaaaaaaccaaaccaaacaguaagccaaacauuuaaaccucaauguggcagaggguuuuuccccccuuuccugauuauaauucacuaauuuaaucucugaccuuacuaacuugauuucuaaucccacuaaguccuuagaacauguguuugggaaagccuccuuucagaggguuaaaguuagcaccacauuaacauggcccauuaaaaacaacuaccuacugugugcugugcacaguccuuuacucugccucacuuaaucccagacacacugugugucaggccaccaggucucagagaggaacaucauuuugcccagcuuacaaagcaacuggucagauuccagaaccugggucaugcugacuccugcccauguccuggccucgggggacuuccuccacacaccugcuguggcuccuuauucaggcucuuccuauaggcgguguggucagcaugugugaggggaagggucuaacaacaagauaguggagaaagaaaaucucuaacauaacccuaggccaggcaaaggagucccagggcuggcugaugauuauaaaagagagaauuguuuccgaacuuucucgcuguguuguuguguucuauccugugugucacaugugugaaguuacaguuugaaucccuuuuaccuuccugaucuguggccauaacacaaguggcuagcucaggaauccauucuuuguuguagucauagugauauucuuugugguguucuaaguuuuaaauauauuuguguguguguguguauguuuccgauauauaucauauauauauuuccaauacacacacacacacacacacacauauauguauguauguguguguauuuguguauauauauuggaaacauaaaaccaugcagagagccgggcauaguggcacauaccuuuaauugggagguaggggcagguagaucucugaggccagcuugguauacagagugaguuccagugaguucucaguguuacacagagaaaucuugucuugaaaaccauaaguaaauaaauuagauaaauaauaaaauaaaaaauaagaauaagaacacccagaaaauaacauacacucaucuuuucucuuaaaagcagaccucucccgacauuugucugugcauuugucugucgauuucuaccagaggccagcagagccaguucaggacccacgaccaacaggguggguuggcuccuuacuuaggagucuuuaacagauuguugagugaaugcauuugcacacgccaugcacauggacaggcuugguuauuugcucuguuucauccaguuaacuuuugucaaugugcuaagacauucuuggaucuagugccucacucagcucugggcuaucgaggggcaaagcugagaaggaaagccuguccaggaagcagcaagacucgggcagaaggcagagagacccagaggcagggagggaggggggcaggcaggagugaccuguagccucaagaggauccuggauuaccagggcuccuugguuucugucugguccugaauccacugggaacacaaccugcacauauagggccucauuuccugccuccuuggauacuggcucuugauuaaguuaguccuccaaaggacugggggucaggacaccgucuuuuggaauguccacauauucuggggaagcggaagaacucagucaugggcucgcagugugguuuguguacuaacagagacuuucucagagcagucccccugccucugccagcuggagaaacugaggcacuggacagugaaguaaguuccucaaggucacagcuagcagaugcuacauugugguuucuuuaaaagacuaauagagagccgggcgugguggugcacgccuuuaaucccagcacucgggaggcagaggcaggcggauuucugaguuugaggccagccuugucuccaaagugaguuccaggacagccaggacuauacagagaaacccugucucgaaaaacaaaacaaaacaaaacaaaacaaaacaaaacaaaacaaaacaaaaaaguaauagaaauauuaugagacuaugguuuuguuuuaaccccaggugugggaucuggggcugcuuuagauuguccacagcagcugacuaugauuugccucgugcucuagcagggacaugguuuugccaaaggcagacagucugccauugugugacauuuggaauucuagggacuuuucagaguguauaaaugcuaguucccugagaggcaggcuggauuguuaguuauugauugguugauuuuugguugcugaugggugugcuuuguuauauagucaugacgcagaagaaagaagaaauuagguauccuggggugagaacaaacuugaugccccugaucagcaggagguagucuaacuauaacauugccucuuuuccucucuaguguuaggggggcugaaagggugaagaagggcggaagaaagaacccacagagcagcagaagucagcuacccugccccaugcucacucuaggcauuuccacguuucauccucuuucccaugaaucagggucuuacgcuuccuuccaucuuucagaugaagaacccaggcgguucagagacaagugcuucuaagccacucagcuaaggcccaggggauggaaccugggccucgugggcaguagggauuaaaaaaacagguaccuggcuguguccagacaauggaguaguauuugguccugaaaagcagugagcuguaaaggugggagaagacauggagggcccucaggacaugucacugaguguaggaagcuggucuacaaaagggccagagccauugaacaacauuccagacgaguuagggcagugucacuacccaucuguccccagcucuccaggcuuaucucaagagaggagccaccucuggucaauaacacaaggaagaaaauuuaauuuuuuguagagauucaucuuauccaugacuucuuagagacaacauuuuucuaaacagaaaggaguguccaagccuugacaaagccaucggcuccugccaccuuacacacacaagcugcccccaguuguggacccagagcuggccaagcgaucuggcacagagagugccuaggcccacugagugcucauggcccaccucuggcccagccugccucucccaugaaugaguaaugccugagacuucaacaugcuggcugcccgagcuccaguugaacuuggcucuugagcaaaauguacuuuuccaaaagacauugauucaacuccacauguauuuugcaaugccuggcaggagggaggcccgccucuccccugcccccaaugccagcacaugcuguccuggggaguggggcccacagaacacaguauaaucucccuccuccacccaucucccaagccucccccuggcauagcccuauuccuuaugccagccaucaccugaaguaucugccgccugccucucuccaggcccugacauagcacauacugcugaacuagguuucagaugacaccacaaaacuggcuuggaaggagaacuggccaagacaagccucaggcuguccugacuuagccuaucccaccggggaagccuguccuguagagccauggaaccaacgaugugggugcaggaagagcagguuggugacgucccaagaaccaacaugcacaccguggacuugcucucuucaaagcacguuacuuagagugggaguugggguuugaaacagcuucacacaugggaccaaaggucuaugaccauucuacauccucagccucuaaaaagaccauguucuuaagagaaccuacagcaguuuaggguuacagcaaaacugaguggcggguagugaguucucaugugugccugcugcaucagcauccccagacggaugucacccaaaggccaugguucacuugcaucccauguccccggacgaaccacagauggcacuccaguuucugugacuuugccauuuggggcagcuuucuggaccucuuaucgaccuccccccucccccaccaccuuuaaaaugggucugaguaggcaugaccaugcacagcuauaaucccagcacuagggaagcucagccaggaggauugagaguucaaggccagccugggcauagagugaauuugagggcaguguagugaguucugcuucaaaaacaaaaauaaauaauccacaaacgcaggagcgcuugcaucgaauucgccucagugaauaucuggaaggugugccucacguucccaugcuuguguccuuggcagacauuacuaauccaucucagcaugcacacaccaggucagggcucagccucagcugcagggcuucuagaccuguagacccgaucccuuucauggaaacuucccuggacuccaaguccccauugagcucugcggcuuucacucaagccucugcucuccuacugccuacagugcagugcucccuguucugguauaaguguguaucguugucaagauucaaggcugaggucacaagcugauuggcuguccucaagccaaaucugaugcauagauauuugcucagcaguucuuuuuauucuuuaaaaacaguaguuggcagacuguuuuuuaaaaauaguagugccacauaagaccuccaggucucuggguuucccagaucugacaauucuagggccucuccagucacuucagggccugccuggcccauuucuccaugaccaggaccucuggagccuuauucuauaugcucuacuuuggagacgugaggugugguuggcuugauguuucuagagggaagauuacucuccucucuaaacgcuucucuggggaauuagcacuaggcuucugguuucccguaugguuuucuucagagccagagccaggugagccggaagcuguggagguaagugcaggcuguagugacuggccugcuuacauugaugcuaucugugacugucacugccagcagggccggaaacugccaggcuccaacacucagagcucuguacguucccaggcacauguggcucaguaggccguuaguugcuucaagaugauauuccuacuucaagacugcuggggggccaggugugugugugugugugugugugugugugugugugugugugugugugugugugugugugcuggagagguggcacagcaguuaagagcacugacugcccuuccagagguccugaguucaauucccagcaaccacaugguggcucacaaccaucuguaauggaaucggaugccuucuucugggugucugaagacagcuacaguccauagcuuugaggaugagauaccaccaccaguuuaaguaagacaacauaaggcuaugcuguucauuccugaacacaauacacggguuuaaugacuacauagugaaggugaugacagggcuggggcugcaucagaagggacaggcgggucagcuggcuucagcugcaggaggaaugugugagcugaguuuugaagaacuaccuuggacauuagucuguuccucccguuccaccugagucugccucccugcauugcaggaaccuuccaggugugugcuggccacugggccuuuggucuugcuguccuugcugccuagaauguucuccuuagauaugcacuuggcuguuggccuguguaauccgggucucuauuauuugacuccuugucagacuuagcaggcaccucucuccucacuccugcacuguguccuuuuucuucaaacgcuuaccagugcugacguguguucauaucugauuguugucuuucucaccagagcucagaugacucgaaggcaggaaggugacaucgcuguauucccagcacccagcccugugccggguccauagcagcuacucaguaauguggaagaaaggcagauaggagagagagagagcgcagauggggugcagagggcacagccagccauguagaaaggccugagggucuuccagagacaagaguauagguggcaccaugggacagagagaagggcagaccaaccaggccuccugagacacagccuagcuaucuucauuuucucacagauaaccagccugucccaggaaguggacauugcuagccacccucauaggaaagagcucuccagaaccggcagccaggccugugcagcccacuuccuuccuuccuuccuuccuuccuucucugggccccaccacagaggauugugagaagucuccucacaguaaugugaugggcaaauuuuucaaguucacaguuuccugccaggccccacagucaaccaucccagcugugaaggcugaccccagcucacugagugaccgugagccuuuccaggaacugcccugugcccguggcuccucccacucuuuucuccagacuuguuucuucuugucuuucuagaaucaggaucuccaucugagugucuucuucucuggguuuucuaagccuuacucuuauuagaaauagggcuaagucuguuuuuuuuuugugccuugaauugccaucuaguuuugaagaucagaugaggcaauaugaguuaagacucaagcucaguagacgucauucacuuccagguuaaaaccuucaucuggucuuuuuauccagacccagccagacucgcccuucaguuacuucccaagaucacagaaugcuguccaaagguuuucucagcaacacugagcccagugacagacccaaaggacgugcagacuccacucaagggcaccuuccgaagcuauuccuacaggcuacccuccccagugcccuccugaguaugagaaauacuauccccaggccccaccauccagccccuguuuguugguuuuaaaccuguuggaagcccgccccuggcaggaagccacaagcaugagaaucuaguccaggaauagcgcucccugcucagcauuuaaaugcugcuguauuuuuaccccaugaugggucacuuuugaaagcccucgcucauguucucucccucuaagaauacauuuccauuuauagcgucuguccaggggguguggggcucaggagagcauccuguuucacuucaggggauuccuguucaccagcaggaaaccugaauccaggccaagccccaggugucuuucuacuuccagggucugagcuaaucugacuguuacaggcugggagacagguggggguucgggccgcuugccagcucuguacugccugggucuccaggcaguacagcauugugguucugccgcucugggguacucuuucuccuucauucacccaccaaaugcucacagcuuucuguuagcacagguucuguaaggguacaggaggaccaugcugagcaggggcagugaaggcccuggaggggugaaaacaguuagggugugguugggaaaaauuaucgcuuugguuccucgucaggcuccaguccccauucagauucugugagccuagacaagugauuuggcuucugugaaccuccugcauuuguuaaugguguucccuggguggugggcaggauuaagcaagauagaaacaaucaggugucuaaguaguaguaccuggcccaggaggugggaguguguguguguguguguguguacccuaggccccucccauauccgacuguugacuaggguaacucagguggguuuaggcugaaggucuuaugaaggugggugucuguuguucucagaaaugggugugugcuaucucaaaugccugagccccuccugaacagcacuuagugacccucagcccaccuugcagucaagcccagcaucugagaaucugaugguuuccuggaagauucugagggaguguguauggaccccacuuggaggugugccaccccuccacccaccuugcacuugucucucggggccucuguggggugccugaggaucugggucucacaguguagcccagcgguggagucaggcaguacacauguaacugcaagcagagagggaagaaaagaguggagaggagugacacagagcgguggcugccuucccggaaggugauguuggaaugcaggccuaggugagagagugagccaugcuaccgcacacuccagauacaggaaguuuuguuuacagaagguuguuauugguucagaaauauugauuggaaaauuguagccgugauucguguuuuaaacaagucccaaguagcauaaugaaucugucacccuaaagucugagugucccucugucuagagcauucacccguguacugacagcccacuaucacuuaguggucacccuagucaucugacucagugucgugguaucacggggucuguugcaguuaaccauuauauuuuuaauaauggcacuaaaacucaugaacagugacaguauaauguuauaacauucuguucauugcugcuggcgucuuccuguggcugcuuuauaaauucaauuucucagagcuaugcuuaggaaaggguaccugguuucagggacucacaggguguccugugggcagggagacugcagagggugggguggggguggggaaacacgugcccaaguugucccacugaugcacggaaguaagaagacuucuuacuucuguaucuuuuauguuuuaucugucaagagaacccaaguggaaguggcugaauauguuuuguuuuucuaauguaacauaaggacuggagauguuagcaguuguggguuuugcuccaguagcccaaggaugccagcgacuuugucucugcugccucagcccugggugucacauccacaucuaagaugggaggguagcaaucaggauaguguaguuagagcaaggaacaccuggcccuuugagucuauaaucuaaaguucacaguccuacaauacuucauagcaaaugucauuggcugggcugcuggagacauggcccaguguagcauuaaggugccugucaggcaagccugugguccugaguuugaauccccagcauccauugaaaaacuggguguagcagcaugugucuacaacacuagcccuggggucagaauaaaacuaagagaaucccuggggcacccuggcugaccuugguagccuaagagaaccccugggacacccuggcuggccuugguagcugaggagaugagcaccaagcucagguugagcuguaucucaaaaaauuaagguggugagggaucaggaaauguacuugccaccgucuuuuuccccaucaucucuugauuuaugauggagaucuugucacuuguucuguagaguuccccaugauccagaggugguuuucuaaguccucuaacugguaagcucaggagccuuggguggguccaagguugguucucuuaccaagaaguuuuucugguagugcugugcuuuugcgcuggugucccugagacuugcagugauggcacaguggccuggcuugucugucuaagguucccaugcuccauggguauccccuggacaggagagcuugugcaaggucaaucuucugauccucauaggaucugcauuuacucuuggaaauccuucuggaagacagaacuuugccccgucaacuguuccaugaccuagaaauagauauuguaaaagauucggaagaaguguuguuugucuagcagguggucuaccauuguuuguucagcauggcugugguuuggaaggccuggauuauauuacguuauuugauacauuauaaucaugaccguuauucaauuuauuggccugaacaugacacauaguuaugugucaccuauuauugcugugugcauaccauuaugucauccuagcccagaauguguccaucacuccugagagcuuccuuauauccccaccugcagugaucuucugcgacauuuuccagaaucuaauaugaaugaaauuaccccaucugaacccaguuaacuuuacccagccuccaugcaccuacccacacacuaucccacauuguggaugguccacacuugaugugcauggacaucuaggucguuuuccucuuugaccaacauaaggaaagcuuccuggguguuccugacuguuccugaguguuccagaguguucaugugcacaccccuguguauguguaguuuugcaguucuccuggcacacgccuagcauggcguggcuggguccuacagugaaugcgagcugugguuuuacuacaguuuaacuguucauggcuuaugaggcucagcucuucggcaugcaggugucaggacuggcaggugacuaaggcccuccacuuagcaaucagccagugcuuuccugcagcguggaucaguucuucugugacuccaggaagcgggucuugaggcucaggcugcuuuugugggaauuaguuaaggucuuaagggacuguauucccuaaaacagagacugcaugaucguaaaggaacuugaccccuuucugucugucucucucacacacgugcuucuucugugcauaccuggaaacuucuccuugcuaugucucuacugugauucaaucuagcacaagguccgccagcaguggaucagauguggccacaaugucaugaauggaauucuacaccccaauaaaccucuuuucauaaauuacccaguacuucauucaguacagcaacagacaguagacuaaaacagcggacuuuuaacuuuuuaagaccuugcugaauucuucucagauggccacacaguuuuauguucuccauggcaacacacgagaguuccaacugcuugauugguccauaguuccagcucuccugauaggcauagugacagcucaccaugguaccaguuuggguucucccaagugacuuugaugcuagcuagcaucccuucagguggacuuugaugucaguaaaucuuugaggaaguaucagaucaaacccuuugcccaaucacacaguguagggcuuucaguuaccgagguuugagaguucuuuagccuggacuugucuuuuaucagacaugugauugacauggggugugugugugugugugugguguauuuuuccauucucuguguuguauguguucuuuuaaaacacaucucuucuucagagaggagaaguuuuuuuguuuugaugcugccugauucaucagcucguucguucguggaugugcugaugcgagugugcucuauggugucucauuugaaaagagcuccacccagucuuaaaucacaaagauuugcuuacagcuauccagggcuauguauguaaacacccagggagaguuauuuauaauggccgaaacagggaaacaaccccgauagguguucauggacacagacauauguacagaacauccaugaauccgguacuccuuagaccaaagggaugcggggcugacaggugccaaggcagcaugggucagauagugugagucuguccccggcagggcuggccaugucuucuagaagaaaaugagcagaucuuugugagccucaggacguccuuccuagagucacagaagaacugauccacucugcagaacuggagguuuuguuuuuaaggcaagacuccauuuugccccccuuuuuagaacuggaucuuugccuguucuaggaccuuuaccugucagugugagucuuagaaccauccugucacugucuguaaacuuggcuuguggugguuuggguuggaagugaauuaagcacagagaucaguuagggaggaagugaccuuugcuaacacugacccauugccuuaguguguacauccuucuuagucuuuaacaccccugcgcgcgugugcacgcgcacacacacgccuuacacuucagucagguuuguccugaauuuuuaacauuucucuuagaacucgugggcgugaucucucaggacuuaugggcguggucucuuagaacgcaugggcguggucuccggacucgugggcguggucucucaggacuuguggguguggucaucuguuuacacuucauucucaccuuaaguauaaauugcccucagcguucuccacugugcacccgacucccacaccacacagcccuccuuggcugcuuccuuuugagcuuuaggaggauccugguguuccugagagucccugugccccuugacugugccacccuccacguuauggcugcucucuagccugggcucugucccucucuuuugcccuggggguuuggccuugcuucagacauucacuacugcaguacgguaagcaggcuucugcucguaccauuucacauuucagccucaaaaauacucauuaacgggugaggccuugcaagacccaaggaagaguccaggaugaagcaaaccuggcccagcauagccugcugggaggcuuguagggagcuguguggcugccacagcaacaccucuuccucuucagccacacuugguauuugugggaagggaggaggagaaaggccgggacucggugucacaaagggaguucugggacuggagaagucaugugugggaugauggggcagaaguggaggcugcuaaagcugguggucuugcagaggcuggagggcuucauguggguaccaggugucaugacaauagcucagagacugggcuggagggagaaaccauauccgucuuagggaccacacagcgacuucugcuggacaucauaccaaaccuuccucugcccucagccuguccccuccuccaggcaggugugcggcagcccagguagaaggcagauguccugaggcaaacugagcucaaauucuagcccuacaucagggacgagauggaaagagacacaugaccugacacauaggguuaggaaaugaugaaauagugaggcaaagucugagccuggagcacaagugagcccugaucacaggggaggugggggagggggagagggaggggugggggaggggccagcaccauugugaugauucuuaucaucgcugcuucucauucagccugggcugucuccugccaggcugugucccauccaguggacacgaugguaggaaugcauauuaccacguagaaugucccuucaggguuccuguaguuacagcgguuccaaggcucauucucaccaugccccucaggccuaggccugcccauuuaccugugugugcaucguguucacacaucccugccucacugaugcucugcaaggugaaggaaugacuaaguguguauguucggccucacucccuggccccacgccaagggcuuugccaggccagucgacagggcugaccaggccaaagguccagcuaaguguuuuaacagcuauuuuggggaacaaaugacccacuacccaaugaccugcuccucaauagaugucauauaauuucauuaagcuuuggaaacaaugacauccugucuuggagccacccacauccagggaagcacagagcuacagagauuuaacugcaagagcagggagaagcgaggcccagggcgugcaguuaaauagcucagcuaaggcauugcacuguggaagggagucacagaugaagucagugagcccuugcagcaagcgcuucccgccgggguggagaagucgcacgggcacucguguguguguuuugagucaggcuguggcccccucccucaggcuggagguggacugcagucugaauuucugugaguaaauccucuucccagugcugauguuaacguauguucccacggcaccauuuccuucuuagcaccgagggaggccuugcacagugcacuguaaaacaaauggcacgcauauguaaccgugccuucauggcaaggcggaaggcagacccaggcuguuugaccuucuuccuguagguuucuuugcucaguuuuuccacauaaacuuugccuuuuccgauacagagugagaaagaccaaaaaggcuaccuaauuccaggaucauggugucugugggaccgacagggccauagcugugaguucacuagcaagagcagaugcccugaagccucuagaggaggacacaggguggguggggcaugagcccauuucuugcuguucuauucugcaaagaacaggcguuuuuggccacaggccugcggacagugguuauagccauucucccugcuggagcugucucugcagcuggaaagacaguggcaucucuggccuccgcacacuaggugauucccugggaaacacagcggcaccuuuguuccucacagauccccuggcacgcagcuucucaaagacacagaagcugcugguccuuauugucaguuugaugggauuuggccucgccauggaaauacacacaucugcgugugucuuugaagaugcuuccaggaagguguaacugagcagggaagacucaacccugaaugugggcagacagcaccauccagaaggaccagagaucccaaacugaauaacaaagagcugagugccaacguuuaucucuuccugccucuuacacgauagcuuccuuacagaggacccaggauuuuggguguguacuaccaugccaggcccuguuuuaaaugcuuacccuggguaggcuacucuucuuggggggccucuggucucucuucuaauuugagagguaacaugggguaacugcaggacaggacguuucuagagcugagaguggugacagguguuuggggcucucucagcagguggucacaguccugucugcccaccucucuacccacuccaggucuugcucccaucccauuggcuucugcacccaggcugggcuuccuucaguucagguuggccuuuugcuuuaauaucauguuauuuugccuuauuugagaaaaaaaaaauuccucaaaccucuaucaaaugaugaccgugugugucaccuuggcugccacugacugcuguggcugccuaucguguuucagggccuugguugauuuaauuuugguguuguuuuauuuuguuguuguuuggcugguuggguuuuuguuuguuuuguuggcuuguuuuguuguauguguguguguauauaugugugugugugugugugugugugugugcacgcgcaugcgcauguguguguucacucucgugggugucugagaaggccagaaguuggcauuggucaccuucucaaucuguuaccuccccucuuucauguguuugugugcugguguguguggguauguaugcauggccaugcuggaggguauacauguguguguguguguguguguguguacacgugugugcauggagaagcccgagguugauguuggguaucuuccuccaucagccuucugucugucucuuuugaagcagaaucuagagacuggaaugagaggugaaccaccacgcccccaggauuuauguggguucuggggauuugguccuuuggguugugugguaagcacuuuaacugcugagccaucuccacagcccaagcuuauuuugugagcucucucauugaaacuagaacucuuuauuuuggcuacacuggcgaaccagcaucaagaaccaccugccucuguucgcaagggcuaggguccagguauaaacgagcuuggcuucuaugugcgugcuggguuugcuggcgugcuggguggcugguacccugagccaucuccccaggccccacuguuuucuuugcugggacaggguuuugcucuguagcccaaguugaccuggaauguauccuccuccugccauagccuccaauguagacuagguguccagucuacaaaugcggaccuuccucugggcucccgggcagccuugggccucauccuuuugauggaaagucucauguagccacagacuugcuauguagcagaggaugaccuugaauuucggauccuccagccugcaucacacacuugauauauacggugcugggucagggagggaaagccaaaggcuuugcccacaguuuguuguuguuuugagacugggcugcucuguggcccuggcuguccuggaacucacucuguagaccaggcuggccucgaacucacagaggucccaucagccucugccucccgagugcugggauuauagacaugcaccauugcgcccagugccaguccucauucuuguguuggucuguucauuggcugaaaggcuaagacuaagaaacucccaggugagacgcgggcaggaaaugaaccugcucuucaccuuucucuguggcggcugagcagugacagaucgugaaccuuucuucugaaguagaaucagugagaaugcgaaaggcaucggaucccucugacguccuuccuuucugaccuccaucugcaaaaugagagcagaccuaacuccggccggugcggagagucagaugggagcacagguaaaccucaguacauaggcagcagcaaacauccuguuucucgccuguauucuuuacccuuuccuccacauucucugaggcagaauggcuaagacugaucgcaucaccacugcgaggaccugacuaauccgagccagagaggaugcacagcucacuuccucaucugucacaugccugggcuucucacuagccuccuggugggccaguuucccagggacagucacuccugacucacuuguuuugugguuaccucugaaaccagacuccuugucugcucucccuuuaccccauuaccacucuccaauuugggucugaugugugggaauagaucucugucacuugucacagguggccucggcugagggcagggaccauaucugccuuggccaguuccucuuucccagccuucuagaacacugcugcauaugaugccuguuuacuguguauuugcugaacaaaugauggauuucugaaguuucucuugccuaccgugcagcauccuugggaaaguaaaugauuuaagccuugagaccuuggucuggcccccagggugugggguggggagaagaugauggcuuggagacuccacuccaggcucugcuucccaggagcucagugacauagggauuucccaagagagugggacaccaguagucagagagguggguacucacaacaaagcuaaguguguaugguaaaagggaccaaccugggcuggaaggggccguucagcaucacgauuucuagaacuuggcuuccugugcuuuggucugggucucaccucccuguuacagcuuaauuggacaucucccugucccuggucccccaacaggccauaaaauguggcuugccccacagcacacagcaagcuugguaccucuaauucgggugcccacggggaccaagcuucuucccaaaacaacuuuugaguggcagcuucauuugaauuuuuuuccaucugaauuuuaaaaauaaucucuauucauugugaaauaauuuuauacuuauccccaaauugcaaaaauagcagaguucucauaugcccuuuacccaaguguccccaaaggucagcaucuuacaucauguccuggacugggucucuaauguccccagaggccgugugcuuaagggcguggucuccagcacagcaguguuaaagcagauuggaugaggacuccagcaucaucccuggacucaaccacuaauggcuucagagcucaaagcuuuugggaugaaaugggagguuuaagagcuggagcugagcaggaggaagcaagucauuggggguuguccuggaagggaaucuugucccugguccccugcccucugucucucugucugucugaugaccaccuuccucugccaccugcucccaucacugaggugagaugcccuacugcacccuaggaccuaagcagcagaagcagccagacagacugagaccucugaagccaaaacagaccuuucuucugugaagauggucuucuuugguaauuuguuaccgccguggaaagcugucccacauaaccauaaugccaccaucagaacacaaacagugacauuauguggugcuaucagcgacgccacagggcuugcucagugucauuuccagcguaggaaaucuaucgugaucccacaccaaguucaguuaucaugucucauaagucuccucuauuugggacagugcccagguuacuuuuauaaccuuccaaguggaagccuccuauggggacucuguaccaagucccucacgggaagguuuuucuuacuugucaguaguagcccugcauuuauagacaaggaaacagaggccacuagaaguaaaaacacacauggcaaggaagagcauuuaagauuuaaaccacagaaauccagauuccagaguccuaaccccuaccugacugagaacaagacagggugagaauucaauuugauuccaaagccccgcaaucccccaucauauuccaggacuucccugguccuggugauguguuuaggagagaaaagcugggguggacaaccagaagcagagccagccuuaccuccagcugacccuaccuuauccugcaggcagaagcuggcagggaagacagggacagugggccaggauggggagguggaggcaggaaaagggauaaagagaugacacagagugagaaagccaugucauaauauaauggugucaaagagacauagagccucccaguggcucccuagacccaaauguuaccucaguucacggugcuguuacugggcagugccuaccgccuaucagccugaguuagggacaaggccucaccuuugucuggcaguuacauucuggcagaagcagggcccaccaagaaacaugcacacguauaaauauaugaguguguaaaaugaugggcaaugagcugggaucuucacugagacaugaugggauguagcagagggauguaugggugggcuggcuagauuuaugucauugugacacaaacuguggucaucuaggaggagggaaccaaaccuuaauugagaagaugccucuauaaggucagacugugggucagccuguagagcauuuucuuaguuagugauugaugggacagggcccagcccauuguguaugauaccaucccugugugggggguucuggguucuauaagagagcaagcugagcaagccauguagaacaagccaguaagcagcaccucuccauggucucugcaucagcuucugccucuagguuccugcccugcuugaguuccuguccugacgucuuuggugaugaacaguaauguagaaguguaagccaaacaaacccuuuucucccuaauguacuuuuuggcugugguguuuugucacagcaacagaaacccuaagacaguaggauccuuguaaggccucucagaggaggcuggaaaggacucugcuaagagcugugguugcugacccagguggcaugcugccagcaccccgucucugccuguacccuacaccugucuaaucccccuguuucuucuucgcagguuugacaucuacaggaaggugcccaaggaccucacacagccgacauauacuggugccauuagugaguaacugcccuucucaccauuaacccaacccucugccuagaccucaaauauccaugcucccacucucugcagaucucuggagaaaggaggaaagaaggaaaggcagaugggagaggagacaugccuagcaucccacaagcccuacaucucucuccaugaagcaucucuauccuugcuauauaacccugcaagguagaguggccagcuguaacuauacagccagggcagccagccauaacuagaaggaugcagaaaaauaccagugcagggucaggaucccugaccuuagagucuaaaacuaagucuccuagauccagaacucucugagaggaucuagcaugcacuguaaguggaaaguccaccccuggcccugugugaugagcggcuuugaagaugugauaguaccuccaggcuguaaggauaagugcgccagaaacaggagccacccaaaaucuaaauaaagaccagugagaugacucaacauuugcugugcaugacugauggccugaguuagagccucagaacccaugguggaaaggcgugcgcgcacacacgcgcgcacacaaacacacacacacacacacacacacacacacacacacacacacacacacucaucaucaucaauaauagcaguauauuaaauacaaaaauuuuaaaaguagccagguagugguggccuaugacuuaaaucucuuuaauccagcauuugggaggcagaggcagguggauuucugaguucgaggccagccuggucuacagagugaguuccagggcauccagggcuacacagagaaacccuguccaaaacaaacaaacaaacaaacagacagacagacaacaacaagcgaacaaaaaaaaguccaagcaagcagauccgagguaugggagggaggcuugcuuuaccuuccugcuuuugaaaugauuugaauuguuaauaauuuuagccacuaaaagaaaucacaaacucacucuaacuuaguucaauuagaggaacuaggacaucucagaaaaguggccauuugcaaccccaggcaaggaagagaguuucgcgucaugucagcaggacaaaaggacccaaggacucaaacuggagcaugacucugguggacuagaacccaaagaauuaggggaaaggccuuugagccugucauaaaugaacuggggaggagacgaacucacucaagaacucuggugacccugugaauaccccucccucccucucccucaagugugaggcggcuguagcaacucacuuccacagaaaagagauuagaaguguaagaugguagcuuuccuguagggaaaccugcagauggcagcucggcugugggagggaaguuggcaccaccucgauuggucgaguggaugaaugaacgccugauguaagaugugccuugccacugagggaucuuucccacuaaguuaccacccuggcgaaugugacagagcagcagggucccagccugggaggucuucugccagauaccuggccuguaugcugcuagaggagcaaagcugaggggagcggagggaagagggaaggguaaauuacagaagggcucaggaggaggaaacucaggguaggagccagaauuuguuccugccuagaaacagccuuucuggaagcuggugaaaccuguggccgaguuaggagcaugcaacaguguggaucccuccacacugacaaagggugaccgaguaccaugguuacgucagaugugaacagggcauccaggagaagcugugcaggcacuguccuggcuuugcacugauugcuguuccacaacagaaaacaccccucaccccuuccccaaauauuuagaacaaaccaaagucaccagcaaggaaguggguaggcuuuggcuucacaccucagaugcuuggggaagggaagugacucaucuaaaaugucacugcuuacaggaggggcaguugggauuaggucuuggaugcccccugcaugcuugguauggggcagagagccucacaacugguccagccuugcugugugaauggaggccaggcugucagccuggagucuacauucucagguagauuggugaccuuuggggaucccugcaacuccagcugucucuaacgcucuuuccagcuggguuucuuaaagcagcaggcaccuucucccguugugaggaaaagauggcucuuccuggguauuugcaggcuuuccugugaggaagaaauggcuucauccucuugguuagcgccuauguguccuggggcaagucccuccacccccagccccaggaaaaaagacuuucuuagucuaugagaaacguggcccccuccgugccaccacauagcaguccccacucccugcagaucucucuccagucguuaccuaaccuguugaacaaucagguauuccaggagguacugcacauuguccugcucagggaccagcugugccaugcccggcucccuugucucuguugcuggacacaccucucccaccuccaccaacagcucugccuucuauccagcuaucuccuguggcaucauggguggccagccugauucuagccuauugucacacaaauguccuugucauguuuuugaaucuucuguagugucacuaugagguagcucuccagggcuuagggacacugagucaaaggggacgugcauuugucacuguuuagaaaauucugccuggaaugcagcccucaggaaugugguuugaugagcuuuuccuuacaugaggggaagaucugaggcaugagaagccagcccuuagcuaccauuuaguacacaaauauuuauuaagcuggaccuagggccagacccugugccaagccgggaccgugcugaugaaugggcuucggucuuuguccuugaggcucaggcagccaagccaggcaggccaauucaggccugcgccauugcauuaugcugugggaugguugcuauuaauagcugaaggagacagcgaaauucuggggcuugaacgucagccuauggauuuuguuuccugcccuacaaggcucuuucgaccucagagggacuccuugacuuucuccugggauauaagggucucaagcuugacuccuucaacuuggcaacaccuggcuucuacuagcaagccucugcuggggucacauuccaacuucccagggccugagucuggagucagagagccuccaagccuugcccaaacauggacugaaagccuucauccagccuuugagagcugaaggucuugcuuggaauacuuccucccugcuuucaugguuucucacucuuucaguuauucaauaaauauuuuuuuucugugccuucucugagccagcaauguuaggcccugaggccacagugguaccaagaccucaccucugguuccucugucugagacaggagucaggugcacccaccauaaguacggguggggacagggccauuggaccccacugaguuauccuguuuaccugcuggguuacccgggcuuugugccaagccuugcggagggaagcacacagaucucagagaaaggccuccccaaucucauuccccuacugcagaguggguaguuaggacuuugggguguaucugcaggugugaagcaguaacagcagccagaagacugucauuuauucuaaagucagcagcaaugagccucagaaaaccuccugugccguacacucacugccgcguccgcuggggcugguguggacagaauggcacugaaauguggguccuggguggcacuggacagaaaggcacaagguccgacugcaggaggcuucgccugcugcagguucuuccccaagaggcaguaacuaccaguguaggcaggagagcaggagccaggggcuggcuugguaucugagcuucccccagcuucaucccccagcuggaaaggauauuugagcuuaaucuccaugccguggacaguacagaccaaggccacugucugggaccaaacuguuaacuguugcugaguauuugaagcauggcugaaaggggguaucugucaugcuguuauuaauuuagaacaaaaagggccuuaaaguauguauaucugcauauauauauauauauauauacauauauauauauguauauguauauacacuuuuucuucuguuuugacuuugagugagagucuuggcuagccuggaacuugcuguguagucuaggcuaggcuuaaaauucggccaguccuucccaccucugcucuugaauucuaggcuuauagauguggccacuaggcuggccaauaaauacuuguguguguguguguguguguguguguguguguguguguguguguguauaauauaguacuuauacuauauuauguaauuauuaauacaugauguuuaauaguuacaugugcuuauaugcccagcugaaacuuuuucuuguuuauaauaugcacacauucucuauuucuccccaaaguaaagccucuaaaugccaucucuauacagcuucaucaacguggggcagagguuaugaguauuccaguccccaucucuguagcuacagacucaucaggcaguuuggggguaucccaucuuacccuugcagcccagguucucaggagucuuucuaggggcuuaaccauagaggauagggggggucccaguuccuugucgcucagccugcguuucuaccccagagccaccaucaggcuggcaccauggugucauggugggguaguuuguuaauguaccacccugggcauauaaauaguaggugcucaaaaaugauuguccuuccuucccugaagacagauaggaaauuagacaggcggcagacagacagauggacauggauggagaugcuuuuccacuguuaucuacagcccugugucacagcaaugcugcuguuaguucaaaagagcagaaauagaaauggaaguccauuccaguguguggcacaccucagcucggccuggugcugugcuggcugucccuauggagaccgcaugcugaccaggagcaauggcccucugccacuggccagcagcaggacaggaccgugccugucaguaaccugggaagagaggccaaacugccguaugguuucuggugagggagcccacucucacccuguuguaaagcugacaacucccaagauggacgcuggcuacagacagagagggccagaccuguggcaagcugugccaaguucagucuuugguucacuaaugugagagagaagucagguggucacaugggaucucccagauguucagugagagaagucaggcggucacaugggaucucccagauguucagugagagaagucaggcggucacauaggaucucccagauguucaguguggaucugggauucuagcgugcacggcauucaagcaggcaaagcaccuugcccaccagcaugcaguccucuuccagggcaaccucugcaucaaagagaucuugaggaguugagcagggcccauugccugugugaggaggccagucugaccacggggccgggccaguggccacuuucuggggaaaucacacugaggccauaaaguaagaagggaucccagugaggcagugaauaagagggcgccuugaugaucucugcagaggcacccucacccuguauguaugcuggugccucuaagcagcuuuccuccaggguagcaggagggcaguggggacuggccucccguguggagcauccugcaccccuaacacugucuguguuucccacagucuccaucugcugcugccucuucauccucuuccucuuccugucggagcucacuggauucaucacaacagaaguguaaguuauuuucucuggggcagcugucuugcugggguccagaugagaagagggggcgauuugggaagggauggaagccuugcaaccggcuugcuucuauuuccaagcaugugacaucauaaaagggcuuugagcucaaagccaaacugagccucacucugugaauaccauucacauuccuucgggccugggaugcccagguucacaggcagaguagaaucacccacucaucaccacuggccccgaguuuggccaguggguuuccaugaguccuuugauguuguagcuggaaggugcucagacaacccagguagcuuccucacagagggcaaggugguccuccuggaagccccucucguuucucaggcccacguucaggagucagcauggguuuccuggcaucuaauaccacagucauccaucccugauuccagaauuaguugucauccccagccugguaacccuccugcgucggguccugaccucaugcuucaaagccucuuuguagcuguguuuacaguuuguggaacugucauggggcugggcccuggcacccccuucucuucugcccagccuuggaauuuucucuuucuacucuuggaaugucuugguuuccuuugcuuccuucucagccaugagacaauaggaagcuaaaaaccggcgucauggcugcagcuggaucuuauuaccuuugucaccaaacagccccuuuuuuauggggaaacugaaguuauaugaaguagcaguacuugcccacagugaucaagugagguggcuccugaguucugagaagcuggguucaccuggucuuagcucacaucuggauguagcugcccaccugucacugaugugggagcaucugcccugcugucacucugacacugguuugguuuuuuuuuuuuuuuuuuuuuuuuuuuuugguuuuugguuuuuugagacaggguuucucuguguagcccuggcuguccuggaacucacuuuguaaaccaggcuagccucgaacucagaaauccgaaugccucugccucccaagugcugggauuaaaggcgugcaccaccacacccggcucugacacuuuuaacccagggaguuucaugggccuguggagagaacaauaagacauuagaagacccagaaucaggauacuacuuggcuguguuacccugacaaguuccugaaccucucugagucaaagaagugagaguagaucagacuucaacuccacuuccagcucuggugcuuuccaugauaacagaccauguagggaucaucagaaguccccccacaguccccaacaagugacugugaccauggggagcauccucucuguguccuauggcuuugggcuuuggcugugugcuccuaaagcugcucucucacuacagugccucugugucugcuggcuguggacacaagcaaaauauacugcaguuauucuaacuaacuauaguuaccuuugggaauucguuucugggacccucacuucagaggucccaauauuucaguacaauaggagauuugcauaaauauacauaucaucuacauaaagcuacauauaauccucuuauguacauuuuauuuuuuucuguaagagauuuguuuuuauuucaugcauaugaaugcuuauccgcauguauuucugugcacuaugugcauacacgguaugugcauacacuaugugcauacacgguaugugcauacacuaugugcauacacgguaugugcauacacuaugugcauacacgguaugugcauacacuaugugcauacauggugccuucagcgucuagaaaagaggguaucgaaucccucagcacuggaguuacagaggguugggaggcuccaagggauacugggaagugaaccuggguucucugcucgagcagccagugcucuuaaccgcugaaccaucucuucucuccagccuuuugguuuuguaguuuugcuuucugugacagagucuuaccaggucuuacuacguagcccaggcuguccuccugaggacuggaaucacacacaguuggaugucaccacucacagucuuccucuaucuacuucaaacugucuucaucuuacuugaacaucuaauaugucauugcaauaccacaggggaguagugggacaguauuaugagguggaucgagauagugaggcugggagagggaggacacaggacgggccuggugcuuucucaagauuaaacgggauggucuggguaaagaguacuuaacccaaagccuguggacauugucaccugacagacugugucucuuggugccucuguguuucccccguaacacuugaggaagccuuagucagcucagcccagugaaggcaugccuucagcacugaggcauggccacaucccaagugaccuuuguugucagagcuugggccugcaaaggcuguguagcagacugggccacucaagcaagcccagacaguagacuuugcccacuguuuaccuagggcagggcugucagaguacaguguguuccccaucauaccccucccugugcagggacuuccucuuccuaccuccuggaugcuguggucccaggaggaaggaagagggcugaagagucucaagccuggcccgcuggcuacuuguugcuguuggugggagccuaaugucccucccuucuugugcuuccuuaccaugguacugacuugucagggguccaggcaggcccaagacuuaacacuacagccuggaaauguuugcuuugcccccauugggccccuuucucuauggaggcagcccugccuggaaagcauauagguuuucucuauggaggcagcccugccugggaagcauauagguuuucucuauggaggcagcccugccugggaagcauauagguuagggggaaacugaagagggguucauucucuuucgggaggccacugguccugucugaugacuuugcucccacagagggccaggggauccccucuugccaugaagauguucauaacucaaggaaacgaggucauggcgcagcccuggccuguggcugccagugacgugaggugcuccuucuggccccauagaguuagagggagguggguuuguuugugugcuugacuuccaacccaagcuuuggccaggcuggugacaauggggaaagaaggugucccaugggauucaguuuuaacauaauaucucuuuuggugcuuucuagguauuguaaugcuagucucauaugcccagguuagcaucuuccaaugauugccucaacauuuuauaaaaccccuugaaguuuguggaggaaacuggggcaccaagaagcuaaaaaccuguaagguucauaaaaggggcaagggagagcagagucuaagcccaggaccugugcacaccuacagcgugggcacccuaccccgucaucccucccgugucucugcggggcauguuuuaaagccucaagucaugaaagccacagcuuuuggguaaaaguuauugaugguuagggacagaagcuucagcaggcagagcuuguucuuauacaagcuugauggccugaguugggucccugggaccuacuccacuccacaaacuuguccccugaccuccaugugcguacucacacacgucacacauacgcucauuagugauaguacauuaaaauuaaacuucaaaccuauggacugggagacucaagauuccccuguagaauuagguggcaaacuagaagaggccacuucaggaagcaggagcuuggagguuaccuugaguugguuccuaaaacaucccuguacugagccaaaauuggggaaacuaggaguuuauccaagagaagaguggggggcgccaucccgcccagcaccccugaacugagucucaguuguagcugguugggauuagacugucaccaagaacauccucacccuuagcgaugggagguuuaaaggcuccugggcacagagcgacagaucaucccugaaaggugggucuggggaggggugagugugagccacagacccugguaaggaguccgaugauugccaggaggaagagggguggcugggcagcugguuguggagggcauccacccaguaggcagcagcuguguuuucccuguguuuuagaagucaggguuuaaaagccaagguuccugaggcuuacuggucaacccacccgccgccucauacaccuccccucccacucccacccaccagucacugcggccuccaugcugaauggaaguuuccauuugaccagauuguuaagcauggaggccagcaaccuugggcaggaaucugaacuauuuaagugcucuucaaaaaacaaauaaaauuguuuuccauagaugucaucaggcucacgccucagccuagaaucucaaggccuucggcuacauuccaccuacauccccccuaccaguaccucccauccucucucccuacaaggccaguucucaccuaccuccuccccaugcucuggcuggugccccccaccuggaauguagccccauuccuccaccagcacacacucuuccacuuccuggaacuucugagaaccuagcacccacacucuccugugcaccccacaaguuuguguccauuucacagaaggugcucaggaguuuucauucugguuggggguugugacacuguggcuuccucuggugugacagaggagggguuagagggagguuugcagaacagaaagucauuggaccuagggaaccucuauaucccauaggcccuguacuggcuaguuuugugucaacuugacacagcuggaguuaucacagagaaaggagcuucaguugaggaaaugccuccaugagauccaacuguaaggcauuuucucaauuaaugaucaagggggaaaggccccuuguggguggugccaucccugggcugguagucuugguucuauaagaaagcaagcugagcaagccaggggaagcaagccacuaaagaacaucccuccauggccucugcaucagcuccugcuuccugaccugcuugaguuccaauccugacuuccauggugaucaacagcagcauggaaguguaagcugaauaaacccuuuccuccacaucuugcuucuuggucaugauguuugugcaggaauagaaacccugacuaagacaggcccugaggcccuggggugguacaucugaagaugauaagaaaagacagugacacuugcaucacaagucucccuaggggaugcccugcuuuccagggaucucuguccucuccagacaguguuagcacaguaggaaaggcaaaacacgagugcccgguagguagcauccuccucuuacucuccuaggcugugugaucucagccaguuauuuguucugcucgcugaagacacagugauccugcccagcacugcuuggccacguuacaggagcugccacaugcaaaagcccggcaucuuccagcuuuuaguggggcagaauacacgugcaggcagagcugcacuaggccucuuacaugcauaaugcccuugaccuucacacugguuugccauggauuaggggcccuaauauuuuaucucauuaaauguugguguugauaauaaagaucauggcuagaggcugagcauucaaccuguaaugagacugugcucaagacucugguucucauuggccaccucagcagccucauucuugauguauacagagucauuggggguugcugggacauagagagcaugacauucucaugccaccagcgcaccuccuuuaccuguuucagaucccccagauaacuuaugcuacccuguguacguaccgugugcauaguuauggcaccauauuguguaaggagcaaggaaagaagucuguguaugcccaguacagacucagugucugcuucugagggguuuuguugguuuuguuuuguuuuuugagcuucagcugguugaacccaaggguagaaacucuauagcaguggcauaucaacuguucugggagagagccccuuuuuauuucuggggaaaccgaggccauugagaacaaaacccauuguccaagcucagucuaccaggaggcgcugcagccaggaggcgcugcaaaccuuggcaucuugggcuccccuuagcauuguguucucucugccaagcagagccuguggucagcccuggagagaaaaagagacacgugcuuacaccacacacacacacacacacacacacacacacacacacacacacacaugcccucacaccacacacacauacauacaaacaccacauauaccauacacacacacaccacguacacauacacaugccacgcacacacaugcguguacacaugcacacacagccuggccugcugcuuuggccuuucaguagccccgagagguguuaauucuugcucgucuccuuuuucccuacuguuccuucacugguucccucggugagguguguaugacuuacagcaggugcacaagcccagaacucagugaucagugagucuccccuucacaguaucaucucagcugagccaggaugcacgagccaugacuucugcuuucuagaagguucuuuugcagcuccuccuccugccauucuuuagacuucuauuguccuggguuaauuugcuucuuauaaacuccacccaggacuucuccauuuacccugaugaggaagcuggggcucagaggugaagcaccugucccagguaccucaucuucuaaguggcaaaaggcccacacgccuucuuaccguauccugagcuggcuauggggugucaggccaguaagagucccuaagcuguaguauacccacaaaaauguuccuuuucuucaaagcgagcugaauguuggcagacugucagccuuuuaaaaucggcucagccccagccaguggacccggucagccuuggcagcccugcacggacggcugaggcugcaccugggguggcaggaaacuagcuggccuggaacauuucccuuggacacagaaggcagccgugcugaccucaucuguaggcggugcagacaacugaaccauauacaucuuacaggcaggggaacagccaguucugcccuuacauaaccacuggcccagguugccacaggccaugcauuuauccuccccucgggcaccucagccucuucgugcuguguggcccuucagcccuggcagcugaccacuccgguucuucuggcuaggagacagggagccaugccugggagaagccuccccaggggcggugagcucaccugagccacaccugggauuugccucacugcugaggucaucucccgggauugccaagaaugaccucaucccauaauccccaagcagugcgcagaugucuagguuuaccaggugggaaagguaagcacucauggaagagucucccugggaaggggagcccucucccuuggcugcugcucaguugaucacacagcaauuuccuuacuagacuggcaguccuuuggaauuaaggcugugguagacauaggugcugaaaaucaggagggcagaaacaggcccauggccuguuugucuuuugcccacugguacuguccaauaccuaccaguacccugagcaguauccuucacccugcauaaugaggagaagaagaggaagcuggguagcccuggaaaacuugagcgugagguucuagcucagcuguuuugugcugugcacucuugggauagaacaccccuccucugaaccuugguuuccuggguguagaauaggaacgaggacuuugcacaggagcagauagggugacacagaugcguuuauuuggcuuucuugauuggcaucccucucaccuuuugcuuaaugggccgaguauucagcagccugaagagcaaaaugugucuguggcuuucauguccccacguauauaucugugguucccacaaaguaacaaacuguuccugagccacaguucucaguaauuaagcacuauauaucacauauauaguauauaauauacacuaauaauagaucacaugggauggggccucgucgagacagaauucacuuguugggccugaucuguucuuucccaacaggagccauucccagggcucccuguguguaggacccaagggaccuaacugaucuggguuauaucauuuguuuuauagcuuuuuaaaggagaacguuuaucuuuuguuuguuuguuugugggaaaauauuuuuucuuuuuuuauuagauauuuucuuuauauacauacguuuaucauuuuaaaguguguguguguguauguguguguguguguguguguguguguguguguguguguucucauuuguagaggcagaagagggcauugguucuagagcugggguugcagacguugugagcugccuaauuuggguucucccuaaauuugagucccuaaaagagcacuaagugcucuuaaccauugagccaucucuucaaucucauguuguuucauuuuuaauuggcaaaauggggcacaagguaauauuuugauaaacugucagauuaccagcucaucuaguuaguaugucuauuaccuuaaacaaaacauuuuugcugucugagagacauuuaaaaucucuucuugcuaauuugaaguacacacuguguuguuauugcagucaccaugccugugcaguagaacagcaggacuucuguuaucuguaucuuccucucuauuggccagcaucccugguccccauccacgaguguucaacauagcccagcccccguauccaacacugcucaguugagcagccuuugaggcuaggccuagagauggguguccuccuccccguggggaauuaucuaggcagcuagccucuaaauucagccccucucccuccuuucugccucugcuuuaucuucgagggccccuggcuuagugaggaagggaagaccuggaagcauccacuuccaugccucuuguggcccaucccuguguaugccaucagcaugccaugccuguucccagcagccauggguucugaaccacuauggacaccuacaaucuggugucuuugauacacaguggcuccuccaggucucaagccugcugagacacaagcuuucuauguucagugucacguacaccaccuguaccccagcaccagaacauggcugaaauaggucacacuucuuuggcucuuauacugcaucugcugugacccuugcagaccaugagacuauacccucccuacuucaggccuuggcacaugcucuggggaccucccuccccuugcugagaccaugccuuuuuuagcaucuuagacucgaaggccucuuuauggcauuuaccuaggaggugagugaggucugguucugcuugugaccuugaucaaaacagagacuagauccggcuugaugccauuucuugaaccugacaggacugagaugccaccaaacuguugaguggauauguguugcuacugucccuggcugugaagugguguggcugucuguggccaccugcccuguaacacuagugauagaauaaugaucucguugcuugcuccugcagccuaagguugugcuacccacaugccacauggaacaugacagauguggucacaugaaggaugggaauggcuauguuagcccgacgggccacauagaaccacgggguccugugugagggugcaggagggagaggagggaagguacggggcacacacgugguaagcuuuaguuaagccuuuggcuuugugacacuugauuacagcagcccuaggaauccaguacaggcgucugguccugugggagaccuggacgucaccccugugacuuuauaaggaggagcuccauaaagcacaggcaguggaggcucugugccuguuggugcugggccaugagcuguacaggacucugcgucucaucuuacuuuucagcagugucacuccauucagcugauggguuuauagaggugaccguaggaaguacuggaaccaggauuugaacuugagucuggacagauguucuuaccagacccauccuucuuccugaguaacugcucucccuccuggugaagcuguauuggagaguggcuuuaaaucuggaacccuaacuccugggaccuggacaugugcacacuguuguacccacauggauaucuggaucacugagugcuggccaccaagcaagguggccccuggcuaucuauccccuaugggcagagucggugucuccuucucagucuagauuucuguacuugucugucccucagggugaaugagcucuacgucgaugacccagacaaggacagcggaggcaaaauugacgucagucucaacaucaguuuacccaauuugcacugugaaugugaguauuccaauagaccucuguuucagcuagccagccugugggugaucugugugcagauaugcugagccaucuggggugagcauacgcauguguguguguguguguaugugugugcguguguaaauauacauauacauacacauauacacacaugcauacacuauacacacauacauaccugcaaaccacacagagccuauggcagcccccaccuguuuucuggaaucauagaugccuccuguacucuguagagcaaccacauuugugcagguggcgcagggugguggagucucucugguucauccagccuaagacccuugagcaagcggcuuacggagaggaagaagcuuugagggagggagagaugggacuugaucaggcaagaggaugagcccagauguaugugcggcugaggucuggucugaggcuggccucccugcaggagacucaggaacguggcgacaccauaaagccgccucuucuggcaacaguggggccaggacuauuauuauccccgucgguggcugauggccaccgaugguuccuaugggaguuacaugaccucucaaacaguaauggugagaugccaguugugcaagccccagcccuuuauagcccagagcugcaaaagccagcgggacccucagugagggucuuuuuaacuauaucuuccuuuuuaacuauagaucucuucauuugcuauuuuaaucaaaaauagaauuauuucuauaaaacaaaacacagcaaaaaucugauuuggaggcagauccugccuccuuugcucaggugaaccuuggcuucaguugucuguuucuccuuuagcaugguagacuuaguaaccauuaccagaguuuccaaugggauggcaucuagcuuaccgguuauugucucccguugugaagguuugauacacccucagccccacuaggucugcagccuaauguagccuaguuagcuugcucccuucugaucacaagacauggcuuaggaacacaucccauagggacagaacauugggugggcccccaacagggacagggacacauucagcucuauuccugcuuuuggugagagugacaucacagcuuuuagcccacacugaguacagggccagggagccuguugaaauaggucacuuuuauuuguuuuuauauuuucauuuuuuucucuuuucuuaggaaaauaacucaucuggcagccucuccuucagggcugauuguaucucugaagcaaggaaauucuuagucaggccagaagacuagaccagcagagcaagggcugaggggauguggcucuaggcuccaucccagauccagacagugugacuucagacaggacagguguccuuggcugcugacuaugccaguccuugugcugugguccccuuggguccugcuggcucuauaggguuaugccaugaauccgcaggagcucagcacaguggcuuucuuucaccgaccuucagggcgguguguggcucagugguuugcccagugugcuaaggauccaugguuccagcaccacugacacaaagacuuucaaaaauguuauacguaaaaaugccuguugaucuuuguaccucuggaaaacccaaagaaacaaagagaagaaaacaccaauaauuccacuacccagugacaaggucuguggacauucugacaccauuuugucccauuggcuucucuccaguucauuucgaaccauggcugaggucagacuacaggugcccuaucauagccugcuuuuaguccgggguggagggcgagagcccucgccuggcccaggcuuccauucccagcacuguaaaugugucaugacagugguacucuucuuuaugcaccaaaugcaaggguuguuuuccgagauacacuuugaaaacacagaacugcagcucaguggcagaguguuuguuuauuaugagcuagaucuucguacagagggaaauagagaugcaggagaggacucuuuugugaucauuuuuuggugcccuaagcagccuaugcugacaacggaggccucuuuucccucuuuuuuuuuuuuuuuuuuuuuccgagacaggguuucucuguguagcccuggcuauccuggaacucacucuguagaccagacuggccuggaacucagaaaucugccugccucugccuccugagugcugggaucaaaggagugcgccaccaugcccugcuccucucuuuucccucuuagugugugcaucugcacacacaggcacugucuauaccugcaguuucacacucacagauccaacagccacagggcaaaaacauucagagaaaaaaaaauacauugcaucugaccuggcaauguacagaccucuucucucguacuuauuuccuaaacaguagggcucuggaagucacugcauuaccauuuuguuaguguaaaaugccagagaucgccagcaugcggagagaaagguguguagggucccggcguuguaagcuucagccuguacucagccagcccguugcuauauauuauggugggaacaaggaguggccagauguugcacuuaagucaaagaagcaaaggaaagagggcaaagagcagugaugucacuguccccuccaagggucuagccuaauaacaacaaggaccuccuacuagaccccacucccaaggguccaucauagccccgaaccaccacaggcugagguccaagcuucugccacgugggaugcagucuggccucaagcggaacuguugagucagccaggauuacuugcguuucuuuagcuuucucauuacagaccaguggcaucauuugugauggccgugucaugugcccuuccacgauggcuggcacauaacuucccuacacccacugaggaacguggcuguucccauuuucccuuuaugccugguugucuuuuaaaauagcuuauuuuaaaagagcuauucuuucucugaagcaagcuuccucugaugugcccuucaggaagcuugcuacaucccaugguagacaagagccucucuucccugagugagguaacccagucacaaaagaacacacacgguaugagcucacugauaaguggauauuagcccagaaguuuggaauacccaagauagaauucacagaccacaugaagcucaagaaggaggaagaccacagucuuuuucuuggcuacuuugauccuucuuagaagggggaacaaaauacauuggaggaaauacagagacaaaguuuggggcagaaacugaaggaaaggccauucaguaacugucgcaccuggggauccaucccauauacaguuaccaaacccagacacuauuguggaugcuugcuaacgggagucugauauagcugucuucugagaggcucugccaaugccugacaaauacagagguggaaacucauagccauccauuggacugagcacaggguccccaacggaggagcuagagaaaguacccaagggacugaaggguuuugcagccccauaggaggaacaacaauaugaaccaaccaguaucuccagggcucccagggacuaaaccuccaaccaaagaguacagaaagagggacucaaggcuucaguugcaucuguguuccaugaguggagaggcccuuggacuugugaagacucgaugccccaguguaggggaaugcuaggacagggaagcaggagugggugggucagugagcaaggguaggggggaugggauaggaggguuuucagagggaaaaugaggaaaggggauaaaacuugcaauguaaacaaagaaagaaaacaucuaauaagaaaaaugagccuuucuuccugcauauacugggaccaucucauggaacacaguagugcagccugcucauuguuacagugcagaagcugagccacaguagggcuacagagccaugcuggagucagccauggggucagggugggacacagucuucucgugugagcuaaagaaccucauuaagaggccugugcuccugcagguuacagcuuggcucuucccaugaugcccccuggugcuuaggcaggagcauggggccugguaguuauagacacugaguaauggaagguguggaugaaagacagauuauaaagaagaaaugaaugccuggauccagagugugaggcaccacuugccacaugcugcgcucagacgcugcgcugagcgcuugccacaccuaccaccucugcgauccacacacucuuccacugaaaguucaaugauugucaccucauaugucagaaacaaauguauggaggcauugaggguaaugaguaccuaagccacggucacacuggggaaaggcacagucaggauccaggugaccagcguagccaacccaucccucuuaccccacagccuucauuuggccuugcauguagcugagucaugcuggauucugcauccuuggcuggucuagccccugcugcuucuuagcucuuccuucauccucuccagccuuaggcagugguggagggugcugucacucugggggugggugggacuguuuugggugcugugacugugaaggaguggaacgauuuugagcacugugacucugaggugggugcacuguuugggggugcuguguuucuagggggaaugugaaguaguuuugagcacugagacucugaggggaugggacuguuuggggcacugugggucuggugagggugggacuguuuugguugcugugacuguguuggggaacuguuugggguacugugacucauagccaagcaacccccuucuccccuacugguugacuucccauguagccuggguuuccugggcaucguguucauggagggcaaauggggccucuguagaagcgggcugcuccccacucuacauggguguggguaacugcucucuuugucccucacaguggucgggcuugacauccaagaugagaugggcagacacgaagugggccacaucgacaauuccaugaagaucccgcugaauaauggagccggcugccgcuucgagggccaguucagcaucaacaagguacggagggaggcacugccugggcccuuuuccugcccccugcccacucgacccuaacagagucagcacaugacugccgagaauuuuccugagacuggguaggcucugcauucccugagauucuagagccucugaugguggguucagaaagagcugccccucgcuggaguggaaauuaccaagggaggugagaccuggcuucaaguccucuuccuccucagcaagcaguggccacaggacauugggguuuacagcugcgaugacagcaaugccacaguggcauccaccacggcacaaagcccacgggugcaaaugagagagcacacuguucauuccaggccuguauacgcaccuugcaucagagucagaucuaggcuccguccggcaacacuguggacaggugagcgagugaggucccaaggcagguggcgauagacagccagaacaugccaucacugccuuacaucugccgaucagcucaguguagguuguccccuuggugggcuacauggggauggaccagaggaggccaagagcugaaguggaaagggauauagagucagcaggucuuccuauaggagugagcacuggacagcagugugggaagucauagguuuaggcugcagccacccccaguggggaccaccaacaaggacccccaacagcaucgccuuggaagugccagggaggcagaaccuugggcucuaccuccagcauccugaaaugcucccaagacugcagucaccaaacucuaaggaugucaagacuccuaaggagaguguggagccauauuauaaacgugggauccauuaaaccccugagagauugaucugcagacaccccaaagaauguacguaagccccaucuuuguuuuuaacuaggcucuaacucuuuuuuuuuuuuuuaaauuauaugaggugucuucagacacaccagaagagggcaucagauuccauuacagaugguugugagccaccaugugguugcugggaauugaacucaggaccuuuggaagaacagucaucacucuuaaccgcugagccaucucuccagcccuaggcacuaacucuuaauuuagcaauuucuacuuuaguuaauaaaaaaacaaccaaaucauuagcaauacuuguggcuuugcuacuagaaacugcuggcauucacacuacauuauaguuguaaagaauuuccagguaccgugcacacauccccacuuugagaaugacagccaccaacacauggcuaaacacuugggggaaacgcaccacuuugauaauagagucagacagugaagcggaugcuucgguggggcugcaggggaaggcgucgucuacugaugguguuugaagauugcgggcacgugucuauacguacucacuucccagucaugagaugugguuacucgccuuugaacaugcauacuccugacaacucaggcgucacacuaccuaccucuuagcaaacauguccuccauucccuugggugggcuguguuguggcucgcagauagcucugggugagccagaauuugccuuuucaagucggaucagcuuguguucaaaaagccugacucaggccagggcaucuguggaaggguuguccaguccuugugcuauggccacuguucaauggacucuuaccuggcucuuaaccccaaagcaugggagucaaguaacauuggagaguuuagggcuaggucugaacccaggcacuugggccacugggcucugcacucugcauauggcuacugcuuuuuaacauguguauuacacaagcuaugacuagagugaccauauucuccaggcacagccuggaccacuguccacccaacccuuugcagaauguggagucccuucugacaucacccucucuccuuuguuggggucuugugucucugaagaguugucauuaagauagcaguguaacagccuaguaugaggacaaagaggacagcugucccucccgucucccaucauuagacacagacuugucccauggucccuuuauccaaccaucaggacaucgaccaauagccagauacagaguucgcugcagguacccuggcagcccccagcagcccagacugagccugcccaguagccucacuaaucauggcugccccuggagggaaggcaaagggaagggagagugggggcugacuccagcuauauauuuuuaaaauccaucagagacacugacguaggugccuaagucacagguucuaaaagcgucgccuucuguuucuccagcucagcgugugcuagugugacucagaccccugugguggauuugguguggaguggaguggauuacugagucacagccuugaagggcuggcagcaggcggcagguacccaggagccagccuucuccauucucuuaacccuggggacacagaccccaaacccaaggcauucuguaccuuuggccuggcccacugcccagaaaaccugacaggacaccuucagucucaggaauuaugacuguaucguguaagggguuucuuuuuuucacugcccagugccuccuccgauguuggaauggaucccaggccuuguguaugugagaggcaagauguucuuccugacguaaaugucuagcuucauccccacugagcuacacccuagcccugugcagauuuuguaauggaaaucaguccagguacuacuuacacugugaaaggaagcgugaaauuguuuuuaaaagcaguggcuuuuccucacacccuguugcuggcccgcccaaggcccuuucuccucaaguacugaagcaugcucaucccguguaccuguguaccucuugccauugcaaaacccucuauggucaucauccccauucucugaugggaaaacugaggcacagaaugauaacugggcuugagcccaggugccagauguggagaaucacuucuacugggucccugaguuagaccacacugaugcugugcucacuugagagaccuuccuggguggccccagacucccugggaugugugcuacggcugaagccagccugauacugguggcacugauucccugagggauggucacacaccaggcuguagcagugaccaccccccaccccccgccccagcugguuuucagugugucaguugggauuuuagcuccccagccucaccugccugcguuuucuucccaugccuucccuccaccuugaccagcuucuguuuagggcuuuccuaccucucgggcuugcuucugcugccugugcucugaggccuuuccuuguaccugaaauagagcugaggguccuccccagccugaguguagcccucagcaagguggggaaagcuuugugggcaggcauuuuaggaagaaguggcaggcacaaaggccucaaggcggagcugugcaggguacuauucccagugcgggaggcugcagggugcuguucccagcgcgggaggcugcagggugcuguucccagugugggaggcugcagggugcuguucccagugcgggaggcugcagggugcuguucccagugcgggaggcugcaggguacuauucccagugcgggaggcugcagggugcuguucccagugcgggaggcugcaggguacuguucccagugcgggaggcugcagggugcuguucccagcgcgggaggcugggggugaguggagcugagggugcuguugaugaggccaagggagguggacugagugugaccaguggccagaauacaucacaggagcacuacugggucacucgguuuuuccguuacucugaaaugcugaggcaaugaugaagacggaaagaacuuagaccuagaggcugaaaguccaggaugaguccuugucacuuggccucuggugaggaucucucaguggacaauaucacaguaguggacacgggacagagaggguccuaaaggaagggugguguggugggacaggaagcagagagaggccaggccuggcuuccucuuuuaaaaaucaaccuagggcccaugagaaucacaucggccccuccugaggucagugucccucggugaccuaaggauuaccacccccaccuaggcaccaccuugcucauggccacaaccccagcacguugugcaauaaacucccuucaaagaagagacuggugcccagaagccuugaagggcuuagggcugagguguggcccaaucaaagauaggguuuaguacacuuucucucauggcccuggggaaggggcugcagggagaggcaagggugagcagacacugacugggagccagggcagaagccacuuugagauccuccacagaaaucuugcguagggauaacaauggccuacaaggccacugucaucaguuucugacgguggugaugaggcugacuggguagcuguaagcuuaguuuagaguucuuggaagucacuuuggucuccugacucagagugcaccccucacccacugcugagccagcaacccggagucugcagauaugggcagagacugcugucauuuuaaguccaggcucagugucaggugcccacaugcgcacuucacaugcgcucuugcccuagguugucccggauacuucuuucaguagcuccugugaguguacuguucuucuucaaacucauacaguuagaaaugcuacgagccagggucccggugccgguguauguaugacucuggugccccagaccaugcagaccacacagcccuugcagucagccccccuuggacagccacccagauauaugaaaccugccuuucucccuccagguucccggcaacuuccauguguccacacacagugccacagcgcagccacagaacccggacaugacacauaccauccauaaacucuccuuuggggauacgcuacaggugagcaggggacaaggugacauggccgugagcuggucccuaagagucauccacaugagauccucuuuguccugucuucugaggaugugccugugguggcuauggugucaguggugccaccagccacacaacggacugagaugcucagccugggagggagguggacuccaggguuuggcucagucccuucagagcugcuucugcccguuuccuguugcuguuacugagcagcacagaguagguggguguuuagugaacugaaaucuaucuaagcuagagcucuggaggcucugaaguaggagcauagaaccagcacgggacuguggagagggccucucucuucuugcauccaaacguggucaggcccaugaugggcacugacacaaggcccaggcaaggacgcgucagacacauuacccucucucaggaggcccuucuacacuacacacaacccuucauuuuuauauucacagacucuuaagcugacauucaggaaaauuaauaagcauguaucugugacccccagaaugacacauguagacaugaaauaucaaaggucugagacaccuaugagggcugcucucaguuggcugaacacccaaagugaugacugaggagguggggagcagggaauuggguuuguauggggaaaaccuuugcuugguugaugaagaggaugcugacaaguguggccccuguacaccaaguguacaccugccacgaggaagaaggacccacacagcaaggcuauuggcauggacaugagggaggggcuguaaccuggguaaggagggagaggaccuaggcuaaggcaguggagagggccgaccagagcucagaagcaaaggacaacagcucugcuccaccugaguacacagauauuccagcucagagccaacccaugcccaucugaucgcuugaaaaacauuuaucaaacaucugcugugugccaagucuugcacauauuggucaggcugaggguggguccugcuggucugacucuuccagccuacagggcgggcauaccaucacaucuccauccuuggagucagaaaccaaaucuucacacuuucgguccaaggcagcaaauggacagccuucccucccccgcgaguggguucagccugagggacaggucacucaccugcuaaaguguuuucucugcaggaaccuaccccgucuacugcucugaucucccucccucccgcuucccugaggucccaugggccucuaucaggcccagucucugggcucaguucuuugcaaggucugcuuauuuggcccacuuugggccucccuccacauccaugucaauuaucccuccucccggaagcccuugcuaacucgguccaauggcuggguugcccuuuaugaccaaauggccccuggucaguccccacaagcaaggccaggcuugaaggugggaacccccaaggaacugucucucacugugcuucucugcagguccagaauguucacggggcuuucaaugcucuugggggagcagacagacucaccuccaaccgugaguaucuuagcauggagcaacccccuccccugcagaaguccccguccagccgguggcaugggacuagggaagccagcggggcagaagucaggugcuugcugcaagccaaggucauagucucacaccauuccuucccccacagcugcccuguauaguacacagacucauuccugucuuuuagaaagggaagaggguagccugucccuagggaagguugauuguacccccgagcuauugccaagcuccaacagcaucugcugucccugcuacugaccacuguuuugccguuguccugaguggaggcagucaccuggaucccacagagcaguuacagaaccagaacccacucugugagaaccagcucuguagguggccagugggggaaaccagcuggucccuccccuccugcccaaacccuuccuaucaaccauuggcuccuuccaaagucuuagugccgaaucucuacuugccaaagacugcacacacacacaccuccauucuuacacacacacacacaccuccauuacacacacacacacacacacacacacacaccccuccauucuuacacacacacacacacacacacacaccuccauuauacacacacacacauaccuccauucuuacacacacacacacauaccuccauuacacacacacacauaccuccauucuuacacacacacacauaccuccauuacacacacacacacacacacacacacacacacacacacacacacaccuccauucuuacacaugcccauaugugcauguugugcgugcaugcacacaauaugcuaagaaaaauaauguccacugggucacuuugaagcaucauuuauuugugucagcccuugugcgugguagggaccugcaucuuggaaugugggcagcuguuggccaugauggccucagggcuguuaggcagucagacacugaaugcauauugaucaggcacaguaccaaguucuagagacaggaaggugaguaaaugaagcaagcagccucugcaggccuccauucugugcugucaacuuggaaguguucaugauaccugggccugaggcagaaccccugugacuccuuaaggacauccgucuggcguguuccuacuggggaggaaaugugaacugauucucugugcacaguagacauaaggguggcucuuuuuuuuuccuuuugugacuaccuaauguuuuguacaaauagcaacaacaacaacaaaauaguagaguuaugauuuucacuaaggccuuccuuucuucagguuuuauccuuggagagugggaauuugagacuuguacuucaaggugaucuuuggccuccugguuuagguauagaugugagcccaucucaugggaguuuccagggaugaagacuagaaucggccuuuaaccccaugugacccuaguacucuggacccugagagccauugugggcaugagcaagagguguuggguccccugugcuuagcuuaaaggcuccagggcuuuccccaguuuuccugaggguguguguugggggggggggucaccuccaucccaggagugcugcccuuuucugaggagacagcagggccagaacuagucaaggcuggaaugcuugcuccaugcucaccacucuuacagaucugaaucugaucugcagagaccaggauuagaacccagaagacuaaacucccauguucuuuuagcuccaugguuccuagcccaagguucuagaaggaauaagagggauggacauugggccucauuuuuugcucgggaaggcugaggcagcucugguuagcucauguuuaucaguagcugauugaucccuucauccuuuguccagccauccuguccacuccuucauucagcaggccuugccacugucugcccugucccaggcuccgugcaggguuuaggggcaggaauguaagacuuuguccuugcacucagcaacuuugccauccaggcugggaggagacaggggcgcugggugaaaaggucguguuaaacuauuacagggcugaagggucagcaguuuauugagaaagagggaagacagugaccagauucuguuguuuguuuuggcaguguugggauugaggccaagggcagguuuaugccaggcaggcgcuugaccccagcccucuggguuugaucagucuuacuuaguucuuucuggagcccagagcccagauuauuuuaaaacuuaaaagcagacagacaauaccuacaaugaaauggggucuuucuugagucccaccuuucucccuggaaaauuucucugugugugagggaugguggggaauguaauuuugccagucucucucuagucuaguuaaggaugaaacugaagcugcucuguuuccuggggcuucucucuagacaauucuuggugaccacgcauuaaagaggauguguucccuggccccuacuucacaggagcgugcugcuccugggccugaaucucagagaaaaugcccccucagcaccccucguuaauggcuaucccauuuguaaguguguggcucagaguauuauauauuauguagugcagaucuaacaaucccagcaagccacauucugaagagaaaggggagaggacccuacaguaccaggaggacuugaacuugggguuacaggcagagccaccugccaggcagugcccaccccaucucaucuuaugcuguauuccugcagcccuggccucccaugacuacaucuugaagauuguacccacaguguaugaggacaagagcggcaagcagcgcuacuccuaccaguacacaguggccaacaaggugagugggccgugaacgggcugagcauugcaauugcucccucugcuggccaagggcauaggcgaugccccgcacauucugcugaagggaauuucagugggguggacagggaguguccaggcucauucucuagucugaguaaagaugaaauaccaguucuugccgugguaguggccucaagguccaggugagacacucuuaacaaggagauaagauguauucuguuugaaguaggcagaagaccaucccagcucugacauugucugguccugguuucuucaggcuccuguugaucagcacauggccgaugcuuugcauuaggcagggaauccuaucaagguggcuguggacgucucaggaccccaacaguccaagagacacacaggucuucugggaagccaagggacauccaagccaaagaaaugagauggcacagcgguuaguggcuugagccucuccagaaagcauggcuugugccaauggaacauaggcacuuggaguagguuccccuguuuaccacgaggcuccuguuucugcuguugcagggccacccagacccuuaguauaaaugauggaguguucagcucaauuaacuaucauuaugguugaggaacucgccaagcuguguaguuacaguguaggaauuagacccagguuccucuugggcuccagagcccccugguugcucacccacucaguccaaauagggaucguccaggcuugcccacuuggacagccucuuggucaugggucccuaugcucugauucccuuugauccauaacucucuccgagagacuuauugcuuacauucacuauuucaggccgugucuguccuacucucugguggcauaacaaaauucuaagagccuaaguaguaaguaaagaauagaagucagccaggcagugguggcgcacgccuuuaauccuagcacuugggaggcagaggcagguggauuucugaauucaaggccagccuggucuacagagugaguuccaggccagccagggcuacacagagaaacccugucuugaaccuucccccuaccccccccccaaaaagaaaaaagaaaaaaaaagaaagaaaauagaaguuaauuuaucucauggauugggaaagaggaagucaaagagaucaaccccagccuguggugagccuucuugcuguguuguccaguggagggcagggcauggagagacacaagcauacaagcuuagaagugcuuuccucuucuuauaggagagcuaaugcuaccauugacacuuaccucguggccucaucuaaccuaaucaccucccagauuaccaccuccagccaccaccaauguaggcuuacuuccggguucagccccuugauguacacaaaggaccuguaacuuuagauggcgaauagccguggucccccugccccacaugcacagggcucugggcucagcccagcacugcagcaugcguaugacuucuggggagcauauuucaaccauuguacucauuauaaccuccccccagugcugccacacaucagcaggaagcagggcccuggaccacacugccccauccuagcucagucauguguccuuguuuguaauauguccauggcaguuacuucacaagauugcugucaaaugaagcaauguuuucagaaagcucccagcucacugggaaggcuggguaauugguacacuacugcugcuagauuucauucugucucuuacccccucagcgcugggcuguggcccagacaaucacccugggaaagcugaguuuccucugcugcaggcuuccuccaucaaagcuuuggcaagggccugguggcuggaccagcucacucagcguucucuguggcuuugcccccagccuguucugugaauggagguggcuguccaguggguuaacacucagugguguccaugggaucacuccagcugcucaagaccagugcuggggacauggggguugggccuggggaccccggcauccaucuccauuuguuguaaacaagagacgcgagcccaagccuuucaggacccugaagugcucaaaccagguccugugggucaucagcucagaucccuguuccuugguggccauuuggccaaugcuaugugcauccuuacgagccauggcagguugggcacuguaccuucccuguucucugugcuggcccuacuugguggacaaguucacacccacuugguucaccugucaggcaggcuaucuucuuauucaugguuuagaaugccccuuccuuagugagccuuccccaucccccugagcagaacuggcucaccuauggccugcugagcacccuccuccacccucccuacacggauacuguuagaagcuagugaugcgaugaugucuucauccaccagccugugacuccucuaggggaggggcuucaucaccccaagaaccuuaggacagcggaggcagccagcagaauaaaugagcagauuccgugugacuggcaagucaaggaggaaaugcucagaccgaguucaaagcccacuuuccucuuccacgucacccucagaucugugcuccguucuggcuccacuucuaagcuauguggucuguuucccauaguugaagggacccagcgugcuuucacuaugcugccuguccagggcuuccagagcagcugagaggaggcugccuggacacccucugcaucccacacccucacccaccugaggcugguucugcuuguaacacuccuuccuccucucuccugcaggaguacguugccuacagccacacgggacgcauuaucccugccaucugguuccgcuaugaccucagccccaucacagucaaguacacagagagaagacaaccccuguacagguucaucaccacaguaaguacccagggcccagagccagccgugcagcugcugucagcccccuugccgaggcaacccucccucgccuaugcuugcuggaagcagauggagccugcugggccccaggugagcgcagguggcuuugauucucugaccccugagaaguguuaccagaagcaggcuggaaccucuggcgucccccuagcugguguguugugggaggugccacuuagugcaacugaugccugagggaaaucuccacuggcuucaggccgcuggugauuuuucuucuuuguggaaaacguuuuuucagcacuugguuuuuugagacagggucucacuauuucaguccuggcuguccgagaacucauucuguagaucaggcuagccucagauucaacagagauccugaguagcaggauuaaagguuugcacugcgauggcaugcccuuucagcuucuucucugugucuucuccggcccugccguccuggguccagugugguccuucuuccugcugcguucucuuccuuugcuuuuccuucucucugccuugucuucuacucugagcaacaguaggaugucgguuuucuuuuacacggacucucugucacaugaacaguuuccuggcuuccaacucaucacccuuggguccagagcuggugggucacggugccugcuccacccaggaggcuccagggauccagagucagcagaggugacagccaggauggcucucuaccugucagauuuggacacugggccuaaagauguauguacuucugggaggccuugagcaggggaagcagggucuuacuguguagcccaggcauagcagccuccuacauggcuaggagugccgcuuugcccaacuuuauacuuuuaauauugguuugagaucgggggucucaauccuggcugguacguuuccugcuauggcagagucugcgguagucagacucuucuagaacagaugggaucuaugaagcugguuugauuguugggucgucagcagacauggcuauaucuagucauguaucugucccagacuuucagucuguuugucuuucucuauccuggcuuccuucucagacagaacuuagcaauagacguuuccuauuucucuguaaucccaggccaaaccccagaaaggacaauguuguccuuguuccagcugagguccuucuguccuucuggcuuagaaaauggaauucucugcuuggucugggcuaggucucguauccucucuggaaccagagauugugaaggggguagcauuacuggagaggaaacuccaggccaguuucugggaggaggaugagcaggcgcugcgagguguauggucagggaggugucuguggccaggccauugcuuuuaaccagcgacauaagaauaaugaucuuuguucuugauaccucccaggccugugaggcucagucaguguccuggaaggggcaaaugccacuaaaaagagcagguggauacacugagugucauuauccuggggcuuagauacgccuccagucuucgaccguccugugacugcacgggaguccaaacaguaccgcacuggggcuggaaggggcaugucugccacacaacugcaugaggggcagucagcagcaucuacauaggaagaccucacagcagcaccuagccccuaaguggccaaaaggagccaggcuggagcuaaggaacauuguucccccggcagacccagugaacgccuacaguugaacuugaaaaacauuguuaagacucccucaagcaauauucaaagucugccccucaacacaaaggaggagaggagauaaaacuagggaccuacauguaggaagaaaguuauaaaaguuuuuaccuccaaaucaagagauuuaugaacaaaugcuucuacccaagaucccccgggggagcacaugcuaagcacaugugggcgccggcuuuuccuauucuggucccaccgcauacccagaauaagccagccucugagauccaagcagauguccccugcgcuuccaggcagguguggccuguccucagaggcccggggggcugcacugucaacuguagcauggacacaccgcacugcuaggcugagacggucccuccuugggcuccagagcaccaguucccauuuguucaugggaagcagcugagccccugagcauuaaaaccucuuggcaaguggcuggcaaaugagacagcuuugguugcuccuuuaccguuugcuagaauuugccgugugaggucucagugaaccugaccuuccaggaguuucccuguaguguggaacauauaggaacacagugcuggggcuggagauucagcucagugguuaagaucauugacugcuuuugcagaggaccuggguucaauucccagcacccacauagaagcuuacaacugccuauaauuccaguucugggaucuaacaccuuccucuggucucuuguggacacacaugcacauggcgcuguguauacauauggccaaguacuccugcaucuaaaguaaaaacaacagagagagagagagcacugugccaggagaucccugcucccagguuccacagcggcagagaggaggcccucacaccucuucagcaaagcccugacauaaagggagaagaaggcugucuuggaaagggccuuguguuuucagagacaccaauccagcaugccuuuccaaggccaaccagcucucuccuugggagagacccuguuaggucaaggugagccauugaccuuucaagaacuggagguuccacaagccacagggaagaucuccccccccaacgccccccaaccugucaaccgucaccauuggguccacuucugcuggaaugaggccccauaaauccucaggcuugcuaaccacaccacuccauggaaccuccugacauuaacuugguuuguuucuggaaggccucaggcugccaucuugguugccaugacaacuguaggggucagcuccugaaccagcuggcuccuggcagauugcgucauuguggagcuucaaagccucuugucaagagacagcagaugugaggaugcugcuggcucucagacacacugcacaaagaccccuggagccuguggaggguggguggugcuguggcauaguggagacaccugccgcggacuucucuuccucggcucuuaauaccaaacacuugcgugcgaagcucuaaacuccaagugagugcccucugcaaauagcccugggugugggggggugcuuaggccaagaugucaugugacgacuucagaggaagggcagcagcuguggauggcauaaggggcagagcuuuuucacauaccugauaccuggcugauucuggacucuucagagucagucugcagaggacaugcccuaccacacccaguaccaggcugcccaaggcuucucucucuggaccucacaacaccucagucaaaccuacaccuguuaccagagcauucuuccccaaaaagaauaagccuugcauuuggcagugugcacgugccuacaucucccccacccccacuccuccauaucugucccagcccccccuccugcugucagcugagauugccuguaaguggguguggugacagauugggugacuugaggugucagaucucugucuuugcaugacuuauuuuaucugagagagggaauacccagaagccuuaaggugacaaauugaguuggugacuguaagagcucucgcccaccagaaaguacagcggcugauggcaugcgcccuuugaacgcuaucaugcggcuguuucaacugaagagacacuuaggggccgccagaugagggaauuuugcuggaguaagccccacccacuuauauucuucccacugucacgcuccccccccacaccuugcuuuucuucccaggagaagaaugccccaugccccaugcuggagauuguaccucacagcugccagggccaguuauagccucugggugucaugauucacuuaucaguguccccagauugcagcacagggccuggcccagacucaguguucacagauguguaagggacagcugcuuacggaggugauagugacuaccuuuauuaagugccugccacguaucaggcaauuuuguaauuagcccuuaaccuucccaggaaccucugaguagauucuaguuuguguuuuagauaugaguucaacuaaggcucagagaaguaaagaaacucuuccaagaccacacagcucguaaaugaugagcugggacuugagccccgugcccaccaacaucuucuccucaccacauccaucuucacaagcaagggcucucaagaguggcacagccacagaggcccuggaagucaugacccucuugguacagaagacaccagugagguuugccgggaccugcgucuguugggugucugccugccuuucauagcaagagcugaggaggccggaagaguugguuggaaccagcaggacuggggcauagcucaguggaagagcgcacacuuagcaggcaggaagcugguguuuggccccuagcacuguuuggcuuaguuucauuugguugguggguaggucugaggcauuagcuugcuugaaaagaguugggguauggugguguguguuugcaaccucacagcugggaggcagaaacagcuggcuccuggggccucacuggccagccggcuugcucagcauguucccaaccagagagagacccuguccuaagauagauggcuccuaggggucuggcacacgcgugugugcauguuucuguacacacacacacacacacacacacacgguuggggggacagaguuuuacacucaucuaagguuauauaaguuaagaaagggccacuuugcuaccuggacagggaacagucucacacccuccuccgaauggcuggauucucuccucugccugcuucucuucccugaaccaagagcuacaagugugcacaccuugguccccucccguaccaucacugugaugugcaggacagaacaaaacccaaagcagaagcuccaugauucagggcugggaugugcaggggccuugggaucugucccaucuggggcagcugagugcaaaggggucuuuuggagagcugugugcagggcagguggacggaauggggcagaaugagggggaaggucucacacucaggucucuaaagucgguucuacagggugagagggauaggaaagcaggcagugggcaccaugggagguggggugggguuuucaaugaugcgaagcuucuaaccuaccaacgucuguaagcagggguuucagauauccugauugcaggauauuugcuguggaaggcccucauagaaaaaccaagaaaacaaauacaauaggcuuagaaguucaccauauacaaggagaugcacugaagggcgggacaagguggucuaauaggaaaaacaggccugcaaccucucgaacccaggcucggugaugccugcuuucuuaauggcugcaugaccuuggacgagccgucuucuccccuuuggcacagucacagcacugagugagaaagaaagcagaaggaaacagugucccagggcaggcugucggugcucaaccaaggugcagcuuugugguaggguaggaauggguauuucaguuaagcgcccuuucccucagacugcccuccaguuagggaccgaggauaagaggucuagaggacaugacaugcugagugguaaccaccgccccuccccuccucccauccccaaacucucccgagcccaaucaucagcuucccuucccgacggcccccacucugacucugcgacuuggguguucucaucuucggcuccagccugucugccuccggcagcauaugcugagacucgguucauuauuuauuuccucugacggugccuuuuccacaagcucugaaaccucacugccugccugaggaaagaugcacaguuccuggcauuugcagucaccucaccgccaccccucucguaggugagagaaacugaggcccagagauguaaacuagccuuccuggccaaaaucacagagcuggcuuccacccaggaguguuugcccuggcgccugcuuucagucccuuaccagaguggaggugauacaggcuuuuucacagcaagccacugaggaguaaacacaggcucagaggaggauguuaguccugguagaacacgaacuccacucucuagcccagaccuucuguggcauaagcaaucgagggccacgguuacaauguaaagaaauacaucuuuuaaaguuaggcuaggguauaaacuccaggacagaacacuugccuggcaugcuugaggcccaggugcuaaaaaagaaaaaaaaucaaagccaaugaacuaggcuaggugaaaugcuaacucagcauguaaagacacccaccucaaggcuggugaccugaguuugaucccucucccccacgugguggauggagagaccuggcucgugcauauugucuucugaccuccgcguggucgccacaguccaugcaucugcaugcacauaaguaaauguaacuuaaacaugaauuacaaagugcaauauucaggucagaggacuucauucuggucagcacagaagguugggaagcuguaagucucagaaagaaggugcuagaccagaagagagguguguuggugguuagugcucauuaaaauugcugcuucuggacacacuggggccuggguagggaggcagguaagaggcagaguguccuucucuggcucagcagcucuccucccugagccaccacagcgagguccccuuacccuggucaucccucuguccugaggcccgguggaggcaaggccacggucguaagcacugaaguguguaugcgugcucauagcccuuauuucacagcacacuggggguaagaaacaucccuccaagccagcugcugauggcaaugacucagagggcagaggugggaggaccucugaguuugaggcuagccuggucuacagagugaguuccaggauagccagggcuacacagagaaacccuguguuucuuggagagagacagacagccacacugaugguggaccuaagccugguucuacagacugacugucuuaagcagcaaaguaccucaaggccccaggcagcauugcccaggcuuggagacuuaaggagccaauuagcaaaugcccgcucuguaccaacgaccuucuaucuccucucccuuggccuugaauauaagagagcaagcaauaggguugacccuguccagacaccaggggcuccccgacuagggaaguaagaagggucucugaccuaaggaaccaggcccagagggaggcucuucguugugaauacgccuugacacgccccugagacacguauccuggacaggaguuaccuguuacagcccaggcugacuacagagacccauggccaacaugggucuugggccacuucgaagucuucagagaaucuuaguaugcuauuccuacaugauagcuugucuuccucuuaaagugccaggaggaagggaauggggacagaaggcucuaagaaguaaucgguaggauuccacacauuuuuuuuucuuuucugauuaaaguggaucucgguacauagaaagcaccacacucggcaccaagguuggagccugagaucauuuacugagcaccuacugaguuccagguacacuggaggucugcucugcagaaugacugucagugaagucagggugcuuuuccuguuuauagaugggacagcugaggcccugagagacgugugcauggcagccacggcucaagccccaggggaugauuucugucuccugugccagccaggaaggcccagacuccccagcccucaccuccggccugcccugguuaguuguauugaggaacuuccacuccaucucuauaguuauucguuuauucauguggaccuugggcccucccugcaggucagggcgaugcugaguguccaguggccuguccccucuccuggccauucuuagcaucccuccugcaccaucucuagcuuuaucucacaacugcuguauucauuuuuucccauguugcccaagacaucaucaguggugaaggaggaccaugacgcccucguguggcccacagcuucauuucccauguaggagcccugaccuucucagaauaaaagaugaccaagaguggcaguuuccccagugagucccagugugguaucuccuggugcugguagcugccaugucccuuugugugucaauuccaggauacuccaugcuucaagccccuugcuugugccugugacugucacccaccucacucuaguuaggauuaaggauggggaugagaucaacaauguccuuagggcuuguuuccauagcuacagugugaacauacugaaagggaauugucugacauaaaugguucguagaucuuaaauaauauuacuauaaucauacuauuucuauuuuauuauccuuugucuuuuauugugccuaguuugaaaacuaaggaauuaguacuacuauuuuaaaaguguacauuuaaauauuaaguuugaagcuaacuaguucuguacaccaggcugagggagcacuguagugaaagcaagggugggccccuagaaucuccucagcacuucagaugcccccgagcucuaucaagauuccugucuuccuugcagcccacagaaucuaguccuucagacacgccacaggaguggguuagcugacaucaggagguaaaccuggaggguuacugcagcaucccuggagccuccaggcugacagugacuuacacugggauggggcucuggcauagcuuacaugcucccucaguuuccccaaaggccgcaucuucuugugggccucagucaugggucaucucccucuaaccugggccagcccagugaaagcagaccuuaagacggugccaggcuugugugagucauaggaacccaggcuccgaguuguguguggaugaaggcagauggcaggguuauuuuuuauuuuuugcuccauugcacugaagucacauuuuccuacccaagcucuaaaagcauucugugguauaaaaucugccaucaucugacccacgcuaccgaaauaaagcagcucacugccgucauucucccugaaaagugccucugugucaugcgccaggacugguggggagaggccuggccuguuuaaaaacacuucaucauaauccccacagcgucccccauccucuuagcucccuggggggcugcucggguuucucaggcuguuauuacuggaaugucagcugcucugcuuccaggccauccacacagaccugcucugucuuaggccuucgccgccuccgcuuagcucauuuuacgaaaacaccauuucaaagauaaaugccaauguggccugcuuuccugucacugucucuguguccucuggcuucccaccccuuggcaucaauugauccauuagggcaccacugccacccagaguccuguggugguuaugugucauugauaucugucuacagaugcauacccagaaagugugugugucuuuaaucccugcauaugagaggcagagacagguggaucucugagucugaagccggcuugagcuacauacuagauaaucugggcuacccagagaaaccaugucuuaaaaacaaaaaauaaaauaaauauaauauauaugaauguguauguaaggcauacauaaguuaaguugcaaauggacuuucacaauuuagcuaguacagcugcuccuccaugugugucggaguuacauuccauguucucaucuuaaauugaaaauagcaaaauaaaaaguauacuuagggcgcugggcauguaacacaugccuuucaucccaacacuuugaaagcagaggcaggggaucucugaguucaaggccagccugguucacguagugaguuccaggacagccagagcuaugcagaggauaccccauuuaaaugugugugcguauguguguguguguauauauacaaacaauauauaauuuauauauuauuuuauacauuaauacauugcaaauuagguauaagcauuuauauaauauuuuaauguuauauguaaauaaauacauagcaauauaauauuauguauuuaguaauauaauauuguuaguauaauauuuuauauaauuauaugguauaaauauuuaauauacauaaauuauaauuuuuagaacauaugauauauuuauaugggcugcagagauaucuggguagguaaaguaauugcccuguaaaugagggauccagaguucaaaucccuagagcccauguaaagcuaggcucaguaacacacgcaucuguaaucagugguagaaugggaagcagagacaggagaaccccuggaagcucugucucagacaagaggacuaacauccaagguuguccucuggccuccagaugagcuggguggcauacgugcauccacaaucuuauacacgauguacacauacacauuauacagacacaaaaaugucuuguaaaaguauagauuuaauacagguggccuacccaacacuguggcuuugcccacuuacauacauuagccuaaucauucauguauuuauauauauauauauaugugugugugugugugugugaauacguguguacacgcgcacacacacauacgaaugaaugaauauccuacaggcugugcugugguccagcuaggccaacaauggcugucuaccuucagaaaauccaagaauccaguaguuauucaauccacaagacuggaugucccagcuggucuucacuauaugcuggaauucuaaagaauguguuaaugcccaugaaggaauggacuucccagcaagaacaagaacaagcaggcaaaaagagggcuuccuucuuccauguucuguauauaggcuaccagcggaagguguggcccagauuaaaggugggucuucccacuucaaaugauuuaauuaagaaaaaaaaucccucacagauguagucaaguugacaaccaacaauagccaucacaccuguaguuggucagaggcacugaauaggaggucuguuuugcagugaaauguaagaacguggccuucaguuuacugaacauuguccugcaguggagaaauggugguuacagacaugccuuugcaccaccguaaagcuggacaauaguaagucaaaucugagggggcccaggcagggaagcaaacccuugaagaauaagaaugaaaacucuuauugguuugguuugguuuggcuucauccaccugcaucagacuccaaggagucuaauggcagugcuuuguugcuggcauguuuaaaacacaguacaguuugggaaaagguuucaggcaacaaccaguccaauuccaggggcccauaaagcuuuagguguggcugcauagaagcuccuuugugaaguacaugugaccacgaggguggcuucuauagcuaaaaaggccuagaaucuaguguggucucugauagauugcauagagguaagcaggcuauuaggcacauguggcaucuccccuaagguuagguuuaacugggagcuagggauaaagggcuagggagggaaagucugggauaaucguucugggagauuuggaugaggcugcugccacagauagcacaaaggucauuaaugauaccugugcccaucccucugggcaggaaaacagguauuuuauuggagagaggccccuguguguuuaacauucccgguucucuagugcucugugggcacaaggaccuccaugaucccaacacaaaucaaaggcuuuaugcuauucauuuagauggggcauuucuuacggaagaggcagucaaguuaagagcaaagacucagcuggguauaguagugcaugccugugauccgggaacuugggagauagagaugagagacucagaaguuuguggucauccuggucuauaugaguuugaaauuagccugucucagggaauuaagucgcaaauuuacaaaaugaguaaguaaaaaacacgggcucuacuauuuugagucccaguucagccauuuguugaacaugauuucagcccucuaaacuacuacuguuccuuagccucgugauagacauuuaaggggguuugggggucacuagccuggagagauggcacagugguuaagagccacuggcugcucuuccagagguccugaguucaauucccagcacccacauugguagcucacaaccaucuguaaugggaucugaugcccucuccuggugugcaugaaaacagagcacucauauccaugaaauaaauaaaggaaaaggacuggagagaugguucagcaguuaauagcacuauucuuccagagguccuaaguucaauuccccgcauggugauucacgaccaucuguaaugggaucuaaugcccuccucuggagugucugaagacaguuacaguguacauaauuuauacuuaaauaauucuuuuuuuaaaauaaaccuuuaaaaacacacacauacaccaacauccuauggcucaccuggagauucuuugaggucauagguccaugcuguggcuguggaguugggcagcugcuguugccgccaccaccucuuccccccucuuuccccuccuccagccaucccuagcaaugguaauauucacuuccaggcuacauugaacaauauuuggugucaacaagagggcaaaucuguacaauucuggcaucugccaaugcaugggguaacuugcuaugaugaagaacuggcuggauccuaaugucaggaacaccacuggaagccgccuugguacccuccgaggcaaugaccuugcuguuuggaguuugcuugcuuacuaccuaucagcagaggaaaugccagcuccaaaggcugaguguuuccaguccuacccacccaggccauuugccuauucagucacagcagacgcuggagcugucagauccaggcuccagucccagaugaccuguguacauaugaccuugggggccagaggcaccacauuucagauuccccaucauuuaucugaaaauaggaucauaaguagcugggaaacauguaguagaaguuaauacuauaggcaccaaggucaacacagacgugaguucaaaucucagcuacuuacuuagugagcuuugggaagugaccucacuucccucaccugugaaaugggucugauaauccccuuccuccugcagaaaguucaucugggaacuaaaggagcugacacaggugauaaucgcuuuuauuguuauccaguucauccaacaagugguucgcuuugauucccugaguaccaucagcgacaagguggcaaacaaaaugguaucgugggcagcgugucugcaugagugcgcuucuuguaaugcaggagggugcccgccugaugccccucagcacugaugucugacacacucuguucucucacccucuugcagaucugugccaucaucggcggaaccuucacugucgccggcauucuggacuccuguaucuucacagccucagaagcguggaagaagauccagcugggcaaaauucacugacguccuguccagcccagugacugaggaccaggaacccugcuagcccugccucuggcguccuaucuccuucugccuucucuggcccagugugugugggaggagggugaugguuauggguggcaccagguuccccagcuaccucucuccccauguuuuagauaaauuaacacugccuggagucacgugucucuuucccugcagagccccaagaccagggucaggcauggggagguacuccagggaugccggugaccucucugggaaggcuguagucuauucucuguuagggaauaacuuagaguacaaacagauaagcuuucagacaggcuuugacaaucuuuaagcccccaucauuuggacaugcuaauagcuugauuugucccccgggcagccaaccugugcucucagccucgggaccagacugcccaaagguacugcugcuuggcgcucucaguauggaaugguacuuggcagggacacccauaggcccggcacugcagcuggaacuugcuucugccucauugcuucaugcccgaccuagagcccggggcuugucuccuaccccagcccugccuccuccuccgggcagaugccagauugcuugacagaacgguggagacucggauuugcccaccaguccugaggcagcucacgggugccccuuccucucuugucuuugcuuuucugaaucccccaccaaugugccucagcugcugugcuaugcggcaauagcauuucuuggugaaggggcugguucccauugcaaagccccccuccccccaacaguuacauucugcagugccaagggauagggccaugugacuggaaggucauccuuggaagaccauauaaggcacaguuuguacacuucuguccaaaccagaagcauccuucccaaugaaccacaaaugaucaugucugacauccaccuuuggucccaaggccuuagcuggggaaaugaagcaggcuucucuuuccaucccuaccuugcagggucccaaaagaugcccagcaucuggaacccacuugcuauugagacccccuguuagcugagcacaugccaacucauucuuagacccagggggcucccgugucucccccacuuccuccugaguuagaucucuuucuuguucccccucauccuuccuaaggggaggggcaguggucuagguaugaauuccaugcagagaauuuuagcuauguucucaaguccagagagagccgcgggccugggcuucauuuauauugagaugguuugcauacuuuuguaaugaagggguaccugcaguaggaaguuuugggguuuuuuguuuuuguuugguuuugguuuuguuuuucuuaaauagucucuuauggguagcuggauucucugccauuuguaauuuuuccucugauuccaauuagcaaaacuucccuuuuuauaugaguugauucuuauuguguauguaaacugccccuggccacuuggcuagauuucuuaucuucuuuuaaacauucuguuccacaguuuaagaaaccagucccuuuggugugugaaucugucaccuguggaggguugggcagggugggaugggacgggaacuauguggcaugcguaugaguugaaaucccacuuuugugaggacacgguaugccaguuucccauggaagagacgccucuggccuguuguucuuguaaagguauucuuaaggggacauauguuuugauucuuucccacucacuggguucaauuagauauuaaaaggcugcuuuucagaaauauug

SEQ ID NO: 8478 - RNA, 2049 nt, Mus musculus
ccccccccccgccccgugcuuccucagaacccgguagucaggccgaucuggguuggaauuucaacuuuaccaccugcuagcuguguggccagggugugauuacgccucuguuucuuccuggcaugccgagaaugccaaguccucccagugauggguuggaaugaaaugcaugaccucaccagcaaagaacuggcagggagcagcugcggggaggaaaaggggucuucggagaaugcccucccucaugaguucccauucacauucgcacgauaccaugucuaucuucagauaacgaaccuucgagaagcaugcaccagguugcuuugugcuggggguggggggaggccuguaacaccgagcuacaccucgagcccgaaaacaaguuuuaaaauaauuuuuuaaagauaaauuuuauuuauuauuauaugggagggugaucaagcgucauggcacacauacggaagcacacacauacucucuccuuccaacuuuacauggguucugggauugaacucaggucaucguauacaccagcuaucucacuggcccuuaaauauuuuucauuucuguauuuacuuguguguauauacauucauacauuauauaccauggcaacgagggggcuaauucuuccaucaugugggucaucaggacugguagcuguagugacaauuuugguuucuuuaagaacacaaaaauaaaagaacgugcuuucacuuuaaucucagcugggggaugugggaugcgaggcugcuucugacuguccgaagcagcuaugauuugccucgugcucuagcagaggcacgguuuugcuggcugcaaaugguuucggcgauugugugauauuuagaauucugggaacuuuucagaagguguauaaaugccagggccccaagaggcagugcaggugguuggugguuguacaggaguggggugugggggguuggcugcacuuuguuaguaguccugcuuaaaggaggaacaagaaaaaaauagauugagaucucucuuugucucccccugcuauccuuuccuauguagugauagcaggggaaacuggggggauaaaggguggggaaaagaacccacaaaguagcaaagacggcuacaguagcaaguuccuuucccugaugagccauccccuccacccccaaauuuuucucuuaaaaaaggcuuuagaccucuaauggccugucauuguuucuaguaaauaaaagcaacuuaccgugacugaccuccccucuuccuccuuccucugaguccuguuacacuucccuucuucccagguuuccuccaugaugacacccaucucgccuagcacuugaaccucucccugggaugccccuucaccacugccucuuagaagcacugcagcccagggccccuggcuaggauucagucuuccauguucuaugucaacuucaaauacauuugucaguucauggauccaguuccaaggagcauccacggagaaagucccuugguggucuguguuccagacagguggcaucccaggguagaucucucaaaauuucuggaaacgcuacugcuugaggacaaacgggaaaugguucuuuuguuuuuagcaaacacuuuaguaaaacuaguguucuaugggugaacggacugccagccugggugccucacccguggcucagucacaucaggcuccccuccucccagggugaucucccccuaagguacccauaguuaaacuugauuagaagaaauccucucucuagaagcuuccacaacucucuacauauauaaucugacugggauaaagccaacuaggcucuucaaggucaaugguuuguaaccauauccugcaagauuuucuugguucucggcagaccuucucuccucccccuccuccugcuccuccugcucguccucccuuuacagggcuucucucuguagaccagguugucuuugaacucacauagauccucuugccucugccuccugaguacugggauuaaaggcaugugccaccacaccuggcuuuauuauucuuguuuuucuugacagguuuucucugcuuugucc

SEQ ID NO: 8479 - RNA, 2948 nt, Mus musculus
gugcguuagcgcacucacuuuaaugggaagaggguucucauuucuuacaacagguaaaaacauaaauacgggugggugggcgacggcaagacaaccagggcccgggcgcccggcccaggcucccgguccuaguguggaauccgucgaaagugcccgugacccuggaagggcucugccagguccgagacaccaggcuacgucaauaaagugggauggaucggagaaaggucccaggccugcgcgagggugggugugaaaucugagggacagggcauagugggagcuuucccauccccggagucaucgcccuucuccuaaaggugggagucguuccggggcgccccaaacgggcucuuucccuaccaggcucggaugccgugcagcguggagacgcccgaauugcccugcggcaucccgggacucugcacgguguucaaguccccgacgccaaaguucacgaaguugcuguuggcggaggcggcggggggcugcgcggcggggggcgcagcgggguaggcggcgcagcuguagccgggacugcaggccgcgccgccguagcugggguagggguaggcguuguagccauaggcauugagacccacgccguaggcgggagcguaggccgcggggucccccaggcagggcuucccgucgcgcaccagcacgggcaccgcgauccugcgcgcgggcggcggcggcggccccagaagcuccagagucugguccugccgcugucgcuugcacuuguagcgacgguucuggaaccagaucuugaccugcguggacgugagcuucagcacgcuggccagcuggucgcgcucuggcgccgacagguaccgcuguugcuugaagcgccgcuccagcucguagaccugcgccugcgagaagagcacgcguggcuuccgucgccgccgugcgcguggucucucggcgccauccgucucggcuuuguccagcuccacugccuucugcagcgcgcacagcucugaaggggaagagaggcagagagguggcggguuagagcggcgggccggggaccucagggcccuuguagggguggcagggaguaucacucugguccuaugccggacacccagcuccgcuuaagcuaaucgccgagugcacgggcucgcucgguucgauguuggcgcaauugcgcaucugggaaaugccuaaguggcuuggacaaaacaaaacaagagaaaucucgggcgcccuaucccagaccucuuccccggauaguuagcguucucuuaacagucugggauuuagcuuuagcuuuucuggcugcaaagaaaauaaagucaugaggaugcucggagugaauuacauuaggaauacuccgguuugucccucggguggucagcugauguuggcauggcuucuggacuucccaguacccggaggaggacagaggccucuacaccagcccugcgggauuccgguugguagcaauaaguucuaauccuccuccaguccuucuccaauguuccuggaccuucucucugcucccagggaaaaccuaggaacguccucuaacucgcagaaaccauugggccucucuggcuuuacucagcacaggaucugggccugggacuucccugcuccuucugugagcuggccaggagccccucucccuacucugagauauuugguauucggccaccuucggaagccugcucuucacuucucagugucuuuauucguuccguauuucccaacaguucccagaaaggaauuucugccugauccugccuggagauuguacuagaaaaacaaagccaaccccagcuccugggauccgcagcaucgcaucucaaaaucacaacccgguccccagacuccucucuuuuggcacaaaggaggcaaggcccagaaaggcagggugggcuacacaaggcccaggauacacggggcuaagcuuucgguuuagcaguucucagugucucaaaguacccccaaaucuggaagagauuuuaacucuccaguacgaagauuuguucuaacgcggauuguuagauagcuuaacuuuguaacagauccaagaacaaggcccuaaccuacugggguuuuguaggccgaaaacaacauuuuaaucuucucucucucucucucucucucucucacucucacucucucacucucucccucucucucucucccuucuuuuuuccugacccucuaaauucggcguucccucuaaacuucggacugacugcgggacagccuggaaucuuauacuccaaacuccccgcgcccagccuucaccccggacugagcuacugucaggccuggguuucuuggcucaggguuuuggacaugaaagcgauuccagaagggaagagcuugagguucuccuuaccuuuuuuauccgcccgagggucuuuggcugggucagggucaccguaggcucccggguaaaaugugggggcggcugggaaagcaggagagcacuuggggggcgaaggcgcggggcccaucuccgcgcgcagcucugccaggccggacgcugccgccucggggccagaguaggccucgggcuugaaggcggccagcaugcaggaggcaggggccaggguggccucgaggcgcgcagacagguccccagacgccaggcuacgcugcugcugcuccagguucaggaugucuuugacugagaaaggcgugggugugagcgcagggcuggggaacaugguggcgacgcagguuucacagcgccagguggguagcagagaguggugcugcccaccccuggggacagccuccccgcauggugcccgccgcccgcccgcgcacccgccucucugcccuggauguggcgcgcggcagcagguagcgcggagcaccaggggcagaagaggcgggagcaggcuggaguaggggggauucagccugccauugggccaggggccuggaugacaggagcgacgggcaguucugcgucaccu

SEQ ID NO: 8480 - RNA, 5727 nt, Mus musculus
uggggaggcagcuguuucuacucgggaaacgucuucagaaaagcucccaaaacaucucugggcaacagauugccccauuuaggaucccuguaaacagcugggcaaggugaagcuaagcgguaaccuugauuccgcaaagaucauuucaccugagucccuaggagcugggaaacuacaaaacgaggcaggggagauggaaaagaguagagucgagaagcugaccagagccacccaccuuuauagggcucaggauuagaagacuggggcguuggagcugcuccaccaggaacaggguuucuuuauccauaagagaaaacaacgagcucagggaaacuuucucagcacccauaacucuaaccauccuaucuuggaauaggcccccccaggaugcaauggcgcagcucccccggcugagccguuugggugcccccucucucugggauccagcuuccccugcucccaccucaggccccagaccucggcuuugggaaggccaagaugugcuggccagauggacugaugggcugcuguacuuggguaccaucaaaaagguaagacccaccucugaucucacugccuucccagucuccagucaguucucauucccauuuuagcaucacugggcacccauuccagguggacagugcucgagaggugugucugguccaguuugaggacgauucccaguuucugguucuauggaaggauaucagcccaggugagaccuucagacugaagccugugacagcagaagcuggaguggguggggacacugguuguugguaggccuccugacacuuuguucccucacagcugcccucccuggggaggagcugcucuguugugugugucgcucugagaccgugguaccugggaaccggcuggucagcugugagaagugucgccauggugagaggccaggauacuuagguggugcagucugcccugggucuucuggguugccacuagcccugccuuauagcaugaguuaugucuccuguccuggccagucuucacccugucaccacaucucucagaacagggcgagggagccauagaucaggugacccaggccaugcaaagcugaggggcuuacauuaccuuucuuaaccgugcuuccuugggcuaggcccucagcugugagaagcuuguugacucaccugcagugucaggauaacacacacagcaggacuuagaugcacacaguggucuacccucaacauuguccuuauucagcuuaucaccaggacugucacguucccagggccccggccccuggagaaggagagggcgcauccuggguaugccgccagugugucuuugcaaucgccacuaagguaaaggugccucucugccccugugugggaagcuccuguggucucuccuccguuccugccucucugaggucuccaucugucugucccucugcagaggggaggcgcacugaagaaaggucccuaugcccgggccaugcugggcaugaagcucucccugccauacggauuaaaagggcuggacugggaugcuggacauuugagcaacagacagcagagcuacugcuacuguggaggcccuggagagugaguggagaggguguugucaagcuaugggauggggguuguugugguggcagagcccgggaaaaugggugaacagggggcgagggggcccugugguuucaagaaggcugucugagggccacaagcgcugucuccccuccagguggaaccugaaaaugcugcagugccggagcugccuccagugguuccaugaggccugcacccagugucugagcaagccccuccucuacggagacaggugagacaggacaugcacgcaugcucgggaguccaccugugcucucccgcaguccucugcagccggggucagagggcugaaugaggugcauccucuguccuggcccaugugcagauucuaugaauuugagugcugugugugccggggcggcccugagaagguccggagguuacagcuucgcuggugagauggguugugauucauuucuguuguccaccauguuacccuaaugaccccugauuuugauagcgccgaugcugcugacaauuccaugcuccuccaggguggauguggcccaucuuguccucuaccaccucagcguuugcuguaagaagaaauauuuugauuuugaccgagagauccuccccuucaccucugagaauugggacagucugcuccugggggagguaaggguucuaaagugugggaacuggggugggagggacaaggaaugucugcuuccuugacccauuuacccucuucuucagcucucagauacucccaagggagagcgcucuucccagcuccuuucugcucuuaacagccacaaggaccggugagucaaaagagggaggcucaggggugaggugcuagucuggaugaggagaacuuugcuacagcacggaccugccgacauuccccuugucccaguuucauuucagggagggagauuaaaaagcgaaaaugucuuuuuggucuccaugcucggaccccuccuccuguggagcuucucacuggagauggagcccccaccaggucacugguccaggggggauggggagaauucucaaggaucuguuuggagggugcauauaaagaaaaugggggucugggguggcugggagggggcuggggggauaaagagaccucuuacagcuucccuucagggcagggcccugggggaggggucucacguccccuggggaaacgauggaggucggagccagaacccuuaaggaggaggcagaaggggaaaguggaggaacuggggccacccacggcagcacacagucggcaugggucccgggagcagagggcccugcagguacacgggcagggaauuucaaugaggcaaaccggagggggugugaagaaacccagggucaccucacagccccacugccuucuccuacaggccucggugucuccaccaccccccagcccuaaccagagcuaugagggcagcagcggcuacaacuuccggcccacagacgcccgcugucugcccaggugagugccugguccagaugugccccagucauuccagacucugucaccugcaacucuuuucccuuuccaccuucacuuguggauuguugucccaaagagcugugcagaggcagccucuacccagcuuugaguaugugagcgcuacccuucccugcuugaggugcugacuugccuguccccaaccucagcagcccuauccggauguucgccuccuuccacccuucugccagcacugcagggaccucuggggacagugaacccccagauaggugagucuaucccgucgacaccaguucccuccuuucaggcuuuagucucugaagcccagacuagcaucaguccugcccgcccuccugccacccacccacaucucucaggccugucuggucucacuguuuguccucugucuuccaggucaccucugggacuucacauuggcuuccccacagacaccccuaaaaguucaccccacucagugacggccucaucuuccucggucccagcccugaccccaggcuuuuccagacauucacccccuucucccuugugccguagucugucuccggggacugggggaggaguccgaggugggguuagcuaccugucccgaggggacccugugaggguccuugcucgaagagugcggccugacggcucugugcaguaccuaguugaguggggaggggggggcaucuucugacagccugcuucugcuccccuccccauucacacacuggcacuuucaugcccugaccucugaccucaccuacagcugggauguaccuggagagauggggagugguucucccuccugcccaggcuggaauccaggggagugaagagguccucuucucugccccuucaugacuccuaaugcccccccucauuuccuuugauguuauuuuguuacagcuuuugagauaauuuuuuaagacuauuuaaccccugggauuagagauuggggggggggguuugggugguccaggauuccagacuguaugacuguaauaaagauaaauaaaccuaguaggcaugagucauuuugaaagauugacaagaggcgcucucgaucuucccgaccacauccaugucacagagaaaaggcaucaggagcaggagaggauuuauuggggguucggucaucacauggaagccagggggcauuaaaacaggaacagggcuccucaugguagggcugugccagaauuugaaaccgauucugugaccuggugcacccagugcagguacgggggauuucccugcuccacaggcagugcaaucacuucggccacuucauaagggugcacagaucugcgaagugauagggcgagguuauuuggacacccaaagauacacccccuaagacaccagcccuggacuccccaguaaguuccaccacacaguguccaccucagcgcuugggggaggggaggcggggagcgggguuucuucucacucaguggcagaguguuugccugaaauacucaaggcccugccugguucaucccccagccccaccaccaccaccaaaagaaaaucucaaaguucuuaccgaacaaacucugucagagcagggaccagggagcuuuggguuuuaaucaucuaaagggcaaagacagacauaguucaaccaacgggguagagaacuggugucaggagagggccagaguugucaaaggagccaggcagggggggaauuuucucaccaucagcaccucacuaucuuccucgaucuuuccuuuccauucauagcugaagaggucagagaaagaagggaacaaagucuugggaaaggaagauuucucccagaaaaagcucucagccccuccggguagauuuccguuucuaacugacaacucacauggaugugaucugcgggaugagguugacgcaggcugccagacgcuucucuaccacugcccugagggugaagcgagaucagagugugcacgacccggaaacagcacccuuccccuaaccccaacgcucucucuaggucaucuggccgagguccccaccuggcgaucuccuuggcgacuuuuucguugggacaagugacaaaggcugcagagacugauccuggaacguagccggagcccgaggccggagggggcugggacggagggcuuccagaagccauugacagcagagcucgggguagcaacagaaggcgggaagccaccggcaguagcgcuggcauccaaagaaacgacaggagcagaguggccuggagcaggggggagggcggauucaguguccccacaacugccccaggaaauugcaccugggcugccuucuggggcagacaccaagccucugcgcugccuuuucugcaccaggaagaaaaaaaaaaaugucccugaaacuuaaaagaaacuugggacagcuccucuguuccgcugcagaagcugggugagacuucgagaccggaaaaggcggggccagacucaccccuccgccgagcaagacgccgggcgcccgcccccaguucaugcagcccgcgcugguagagaaaagaagaaaucaauggccgcucauugcacggacgaaggaccccgagccccggcggagcggccgccucuuaccugcaguagccacgugacgcgaaaacagugugcaccacgugacaggagcagcccugccuucccggagucuccagaccuggccaaucccggcccu

SEQ ID NO: 8481 - RNA, 9202 nt, Mus musculus
cugagcugccccuccuccuccucuucuuccuccccuucccccuccuccuccucucuuuuaggguguuaguagcacaggcuggccucuauuucaugauccuccugcuucagccucuugaacgcugggacugcaggucagcucauccugguuuuuguuguugucugugguuugcuuuucacuagagggagaagauggaagaggaggcccgggaaucagagacaggaaaggcagaaaacagaacgcuuuuccccuuggcugggacagggcaggcaggggaggcuguagcugcuuccaagcccggccgaggaccuuccccuaagcagcagccucccugagcgccugcauccggcggccaccgagaacuuccucuagagggagcuggucauugccgggagcugggaccuccucuauggucacaaagucgcgagguuuccugggccaagaggcaacccgaggcggcauccagcaccaugaauccacugauaccaguuccugccagucaggccugaaaccuuggccccuggaagcagccagcaagcccuucggggucuucgucuuugcacggcugagccaucccacaucuggagcagagucauucagguacacgggcagccagugccaaaucccaccguccuaauccugggcaauucuggcccaggguggggcagaaaccuccaucggcaacccggugaggagggaggccuugauguggcuucccugggagguucugaaagggaagcugcaggcaugguucacacagggccucuggcuauacaucagaagcgccccuuccugcccgguucugguggcccuggacuuuuauguggaaggaggggagggucaaggucaugaacagagacagaaauuauacgguugauacucccugcuguaccaggacacggacaguccucccccagaaugauucuagguacagccuaguggucgguugugaggaacaugcauccugggcccagccaguggacauaaugggaagucaaggcgacuuggaugggggccaggugggccagggcagcacuggcuguggagggcuuuucugagacucuuccugcucucuaacaguaagccuccagggugguguuauuauuacuauuauuauuuugagagagagagauguggaugaagucagcguccccuggcccugcuggccugggauuacaagguaccaggaagagcacccuaucccggaaggagccguuggguagacuaugcccagcagaggguugucuugaugaggccuggcucucagggauggcaagaggagggucugucugcucacccugucuccaucaaugaagagggaggugaaggggagccggcccucccccaccccuuuucaaagagugcuuccugcagugauggagguggcccacauaggggugggaacucuugaaagggugcaaacugaaagugaaaggucuugccucaggaacuaaccgaacucugagacaggucaaagaggaaaacgggcuuggguguggcuauaacaccagccagccaauggcugagucaggaggaucagggauacaagacuuuccucaggcugccuagagggaaccugucugaaaugaacaaauagacagguagguagguagauaaauaaaccaauaaccaaagaagacagcaccaaagaguauggugugauuuggcacacugugugcuguagcagugagguacacuggggagacugugagagaccccagcucacuuccaagcagugguuggaaggagaggugcccuggggacaaacugugaaauaagcccugagacuuugucucaaaaauaaaaaauucugggccagugagauagcucagcaaaugaaggggcuugcagccaaguguaacaacccagguucuaucucuggaacccacaugguggaaggagagaacccauucccgagaacugaccaacuaccccuaaccuucacacacguucacacacacacacaaaaccaaccauaugagguccucuggccagcagagccaggggacgcugacuccacccagaucucucucucucuuaauaauaauaauaggaauaucaauaauaauaccacccuggaggcuuacuguuggagagcagguagaguaguacauauguaguguguguguguuuaauauauauguuaaaaacaaaacaaucauucugccagacaaaugucuuucucuggccacguggcccagguaaccauuucuuucugcuccuauuuuuccaaucuguaaagcaggcacaggcacuggccauaccuguguuaugaguauuuucuuuuguuccuucuuuccuuuuuuucuuuuuuugagacuauaucucacuaccuagccuuggcuggccugggacuccauauguagaccaaacugccaggauucucccaaacacuagaaucaaaccaugucccaucacacccagcacgaacgggaauuuucaacacacaacacacagcaaaguucuccuaaguggccagaguccaugguagaguuugcugcccagaggcccuguuggaaaacauucaugucccaccugggaggugccaggcugaggaagggaccggcagccucagaaaccccaggaagaaggacaacacacacacacgcacacgcacacgcacacgcacacgcacacgcacacacacacacacacacacauaccagucucugaaagcagcuucaugcuguccgggagugacuggaaagagcugugucuaugucgcagccuucucaagaccuugaccucgccuggucucugccuagcugccucaaugguccuuguguuuccccugaaggggugcaaccaggugcugaauucaaauugcucccaggagauaccaccaggcccucaagguggcagaacuuuagucccagaggauugcaaggucuuccugucaguugaggaaguggggugcccugcucugugguaaccagggcaacacucugggguuagucuccauuuuuccuccuugagacagggucucacuguauagccuuggcuauccucucuggaagaccagguuggcuugccugccucugccucuuaaguacugggauuaaggucacacaucacuacccgcgccucaccucugcuuucucucaccugucucugcaggugacaagugacgguggucuccaccaagaccugaaaaauggcaucuggacaaggaccaggucccccgaaggugggcugcgaugaguccccguccccuucugguaagagccuccugccccucagaaccucauuaaguacaagacuuagaaguacacuggacuggugugcgcacaugcgcauggugugugugcgcaugcaugcgcauggugugugugcgcaugcaugcgcguguguguguguguguguguguguguguguguaugugucacaggggcaggcagagggagggagggagggagggagggaggguuagaagaaccccgccuggcugccgcaguggaagaaaggaggaagugaccuggcuucuuacagucaggucuguggacagggaauggcauuaucaugaacucuggagaggaagugaaauggcugaccuuucucuucucugaagugguugggcguggagaucaggcuggucccuggacuugggguucacaucccaggucugugugagccgggugugguagcucaugucugcaaucccaggucggucaguccuacagaacgaauuccaggucagccugggcuugagugaggcagacuaagacccugccucagaacaaaaccaccaaucccuacagugcuugugggcgcacaccuuuauucccaacgccagggaggugugggaggaggaucucuaugaauuugaggccagccuggucaaggcuagcccaucaaguuccaggcuggccagggcuacguagaagaaccuugucucaaaacagugaaaaacaagcuauucuccuuugacuuuugaggcaaagacuccccaauuucaacuugguuccucccauuuccuauacuccaaggccucggguccacaucccacccagacagcucaggagcccugcagugagaauucugguuucuuacaaaauccaguuauagcugggcagugguggcgcacgucuuuaaucccagcacugggaggcagaggcaggcggauuucugaguucaaguccagccuggucuacagagugaguuccaggacagccagggcuacauagagaaacccugucucaaaaaaccaaaaacaaacaaacaaacaaaaaacccaaaaagacaaaaaacaaaaacccaguuacgugggucggagagauggcucaguguuuaagggcacuggcugcucucagagguccugaguucaguuccuagcaaccacaugguggcucacaacucucuguaaugggauccaaugcccucuucuaucgugaaggcauaugcgcaaacagaguacucauauauaugaacauaaaucuugaaauucauuuuuuuaaaguuauguuaugugaauauguuuucauuugaaucccagguguaggauaaggggcugcuucacuccgucccuagcugcuaacuaggauugucuugugcucuggggagaugugauuuuugccagcugcagauaguuuaguucuggggacucuggagagguuauaaauucgagaguucugcaagagagucuguggcggcggcggcagcugccccccuuguuacugcauuugcuacuguuggacugcuggauauucaaacaaggaagauuggaccugccccaagaaacccacugacccuaaucaguuugaaguaaccuauagaaggcuacaucccuuuccacccuaauuccuuucaacccuccaacauuagguaggagagaaagaaaguuagacaagaaagggggcauagaccucuuucagucaacaaaauacacuacuuccugcuggucagggugguuggguuccuuggggaaaggccaaucuuugucgucaggauauccagcaguccagggguagcaaacgcaaugaaccagcagcagcugccacaggcccucuuggggcucuccagaguccccaaaauucaucuaucuucagcuggcacaagucaugccccacuagagcaggaaacuucauggucagcugcuguggacagucugaagaagccgcccaucccacgccuggauuaaaacacaagcauccauagagcccaacucggggguuaaagaaaccagaacucccaccacagagcccaguucugggcugucauucugcaacaggcucuuccgaagagcagaaccgagagcgggcagagaugacaaggggacuuguuugauuaggauccuggccgggcccgagcuguccagcgaaggccaucuacaugcugggguggccaagaaccuggcagcugcuuggucacaaggcacaaaccccagaagucccagucuggugucaaagcccugaaggguuccuggacagcccugggucucugcacagcagaaggcuggggcagcugggugcugauaacaaggaaagcagcaacagcgagaugcaguacuuacccacaggcagugggguggaugggcaugggggagggcaggcagugggggagggcaggaagugaguguagacagguauguuuggggagggcaggcagugacuguggacaggcaguagggcagugacuguggacaggcaguaggggagggcaagcauugggggagggcaguaagugugggcaagugggugggggagggcaggcagugagggaggggaggcagugggggagggcaggcagcgggggagggcaggcagugggggagggcaggcagcggcacugcaacuggaaggugcgcucacugugaggaaggcccucccuucuucagucuuucuggcaaacacaguaggaccugcccagaggugacucuuaccaagcugacaaccaagacaacaaacaauuccucccaguuguccaggccgcaugaccccuguauacauggcuuagccccccacccccacccccgugccucaguuuccccaucuguaggcuggagcucccucaugugccaggacuaacucucaugcgggcugaaugcucacaugggggugagaguggggguggggaugcguccaaggagggugcuugggacagcuugccuuugcugacccccaguucugaucugcagaacagcagguugcccaggacacagaggaggucuuucgaagcuacguuuuuuaccuccaccagcaggaacaggagacccagggggcggccgccccugccaaccccgagauggacaacuugccccuggaacccaacagguaagcuccagccuugggguacaaguccugggagcccuaucagaccuucagacagggcuagguggaaagucugcccccaccccauggaggcgccccucugcccugagcccgguucccagugcagaauuccagcucucugacugaugcucaucccuacagcaucuugggucaggugggucggcagcuugcucucaucggagaugauauuaaccggcgcuacgacacagaguuccagaauuuacuagaacagcuucagcccacagccgggaaugccuacgaacucuucaccaagaucgccuccagguaccagcccauccuccaccccgcagacgcaugacgcagacucagacgcuccauaggaugggcuccccagcugaggaauggugucagggugaacauaccaacuuccgccagcccaauugcaacuggauggcuucuaagaggccaccugauaccgcaucccagccugccauaggcuaccacugugaaaccuagggaacagggaaaggaccggaagucagugucccugcuuugacgccacauccaaguuggcuugaguucuguugucugaucuuuaucuucugugucuggguguuuagcgugcauguauaugugcgcaccaaccugcgugccuagugcccaauggggccagaaggcuggagcuagaguuuacagaccgucaugagccaccaugugggugcugagaauugaaaccaggucuucugaaagagcagccaguauugcuaaccgcugagccagcucuccagccccauuaagucucauguagcccuggcuggccuugaacucuuaucauccagcuucggccuugcaagugcuaggaucaaucaugugccaccgagcaauguccuuuccuuacaccagggagucagcgucaggguagaucucaaggugguaguugauguagaagcaggcggcaaguuuaaguacagagguggcacauccugucccuguccucaggccccacuccguccccugugauuuggggaucugucguaaucucuucuguccuuuucucucugcugucccucgggcugccaggccagcagcaacaugcacagguaaucucccugucaccucaucuggucgcucuucccucucagcuccccccacccuuccuucucccccccccccucgccaugcagccagcucaucacaucaccccucccucacuaggcugucuccuuuccuagaaagccaggcucuuccugacgggcagccaggccaaggcagacuuucugaccuguccuggcagcuuagccguguagcuucccaucuggugguggagggguggaggucggguagaggaagaaggaaaggaccgggucucccaaggcaggcucuccgugacuuaugaaaaaacucuuugcccacagccuauuuaagaguggcaucagcuggggccgcgugguggcucuccugggcuuuggcuaccgucuggcccuguacgucuaccagcgugguuugaccggcuuccugggccaggugaccugcuuuuuggcugauaucauacugcaucauuacaucgccagauggaucgcacagagaggcgguugggugagugccugggcuugggaugucccaccccccaccccccaucacacccccuacccccaccccccaccccccugcugcaggggcugcccggccaggccacuauaacccacccuguuuuuuuuuccugacagguggcagcccugaauuuucguagagaccccauccugaccguaauggugauuuuuggugugguucuguugggccaauucgugguacacagauucuucagaucaugacucccggggagccccacuggggccccagccacgugccuggcuggacuaaaccucucucccuaccccacccccuaccccccaccccaacaguccucuccuuccuccccagggcaaagacgcuuuagcaaacaggcaccccugauuuggagagccaccgcccaggggucaucaauaccccaacauugcauggugcuacugaaccccauccugucucagaggcacugacugacgcacuggggggggugggugggggauggagaggcugggccacuaauucccagaaaacuagguuuguuuuuauacuacccuuuagauacaauccacccuuuuucuccacugugcccaaagucagaacauggagggcuuggggacuggugguucgaaccuguguucccaacacuccugcuacuuuggaaggucagcccuugagaagagaccugagcacaauccuugcccucccuacauuggcucccaagaccaacuguaggagacugcaugaccuacuucacccccaccucaucguccauuuccccaacccuaccccccacacccccuccccuccuaucuccuaccccaauccauccauuuuugccuuggcggcuggacucucagggauucugagcccagagugagggcagaggugagaguucagaccacagcugucugaacacauccaucaggcucuccaauccuguguccuuccugacccgugcucccaaccuaguggguaggggaagacgccacuuucuccccagggcucucaggugagccugccugcuggggcggaggccuuccugacagacggacggacagagccucagacucagccacuaugacaggggagggggugggcacucuuuggagguguccacacuagagaacuacuccagcagaagcaacuguggaccugggugcaguuccuccccggaaccuaugauuacuugaaccccaccuucacuccuugucugccuagguccuccucggguugggugggguggguguuuuucucugucuugcacaacauaggggugagaaguuuugauuaagccaaauguaucggggaagagggggaggcagagggugcucugugucuggaaauaaacugugcaaugcccccaacac

SEQ ID NO: 8482 - RNA, 11256 nt, Mus musculus
ggagggugggagaaaccaggcaguuuuauugaugaguaucagaccccacggucagguccgugggcgggacaggacccgaguccaggccuugugcuucuccucaggccuggugggcgcaaacuucuccugcaguuucuuccacaugcucuuauucaucucuuggaacucuuccaaagugucugcacagggagagagaacaggcagaugucgucuuacacuugcucauggggacgccgcauggggcuguccccaaaaagagcaugcucugcuuucugugacccaggcaguggguccucucugguuauaggugacagggcugguggugagggcacaagcccgagaguuacugcccgccccccucaaccccacagauauauacguuccugccccacuccauaugcaccugcaaggccauggccuucuccuucccaaccugacugcgcucuccucagcacugccaaggcacucuuucugccccacauaugcacacaccaagaaauggccuccuaaugucuacaucaguaggaaccagguagagggaggcaagguccuggcugugggagcacaucgagauaaggagcugucagcaguguggacccuguaggcuggaggggaaggacguggacacccccacccuaccccaccaaaucccugaacccuugcaaccuucuguucaucugugaaaccaggauuagacuacaaacuucccaggcuggguguguggcagucaggguaauguagcuagcacuagauggaaagaaaggucacaccuucacaugguggcagggugucuguguucaugcaugugugcagagagccauguuuaagaaccacacaagccaggugggggugguggcacacaccuuuaaucacagcacucaaggcagaggcagguggaucucuaagucugagaccagccuggucuacagaguuaaguuccaagauggccaaggcuaagcagagaaucaauaccuuguaacgucccagcuccccuugcacgcaugcaaugacauggucagcccuucccuacacugacgcuguggcugggugcuuuccccuggaguggcccucugucagccuucucaccucuuuucaccaaggccaacacggcccuacccugcaugugggcucaaggcauugcuuagcagaccucuuguuuuauacccuagauauuaaacucagacacugucacaauaccguuuagcuuuuaggcccauuuuagcacaagcgcuagcugcaauuacuguuugugggcaguggcucacaccagccuggagcacucaccguguggccaccacagcagugccucccacccugggacuuucccaaguccacauucccauacaaggugccaagggucacacacagggauggcugcucugcucuucucuccucuacacuaagguccacaggccaggggccacacugcaggccugccugcuccuggggguguggagagccuuauuugggugguacugguuucacacaauugcaacaaaaacacaaggccugcugugcacacauugucaggguuuccggggcugacgggaagccagaccaacagucuccauguccccugcugcccgcccagaggcuuucugagcagaaggggcaaggacaagauggcgggaagcugaguccaugcugagcccacucuccuaucccucauagacacugcuggucaugcaugcucaggggugugggaguaaauuauaugucagcgagacaaacaccucaaagaccugcuccacugacacaccaggugacauucccagauucccaucugcccagaaggacaagaauucuggaaggucgaaucuucacggccaaaaggaaggagaaauuucuagaguaccagacagccaacauuuagggcccuacccucccagaaaagguuagccuauuuuuauauacaauauccuugggcaauaaaaauagcaguuuuccaguaccuacccgcucugacccuuucagugacaauagaaauggggaagugaggagggguggcuggcaggggcuuccuuccuaugagcuggguucuagccauggcucccaaacagaccucguuagacgcauaucaaaccugcagaccacaucuccggggacagauaacucacagacggauauccccauacucauucacugaauggcuuuuuguuuuaauuaaaagccucauuguuuacaaagcccccuuaggaccauaaaaauaaaauuauuuuccuuccaaacugaauccaaugacuuccaauuuggcuaaucuguucccagccagcagccuugaacuaaaagcacuaaagauggucuugucuucuaaguaaugccuuugaccucccauacucuguggcucaaguaucugagcccuguaacucaggguuuccucggggccacucaaggcuuuccaucaugcaaaacugucuuaguaggcaagccucuauccuggcuggugaaagcaaaccaaccagagagggcagccaugccuacauaccuguggacaggaucagcuuguacucuuccacggacaggccacugaagcuggugucucuggggcgaggguacuggcacaggggaggagagaagggacauguuaguuucccacacacuagccuuccucuggauggaggcaguuuaccaggugcccaggcccgagacccgacaaugaagggaacagcgccaccuggaggccaggccccgaaggagccacagcuguggcgaucucagcaggcccaggccuccgugcucuaagcagcagcgaccagguggagcacacacucgugucugggagcugguguuuggaaggaauccuucggcacacagccucuuccauuuggccaugucuauuuguggagcuccugacauacuuuucaagucugggaagaacuacccuccguggaauuggacaguaagcucgcuaaggcugaggaggagugagccuuggugugacaggaucguccuaguacuccaucuugaucagcgugccacaccagguccaacugagugagaaauacuagcaggagugugcgcuagcacacacacaagcaugguuuuuauucagagaaccuuuaaaggccucugcugggcaccauuguuggcuuagcugaaaguacuggguuacaucucaaaguggcaaccacaauucuuugcagacacuguauaaccaggucucccccauuaugccuggcccuccccucggaggcugggauacaaaggccugcacccacucaccuugugcuuguaguaguuugaaugcagucgugcuaagcucucguacaucugaucacaggccucggguucugcaaucugaaagacagcgugucccugggaagugagcggaggaggugggcccccacgaugcacccauacuuugauggggggcuaugcacacaauguauucagaggagggcacugguguccuggugugcgggaagcaaacccccuguagcucuugagaaaaaagucaccuccagggaugaaaagccccaucucacccgccccugaccuguaggaucccugagcccucaacaaaccaacaaaagcguucagcagcucuuugcaccuugggaacagcacaucaugcguggguagaaauucugggggcagugugggcuccagggacccacaaagcagcucaagugaugucagggacgaaggcccucccagggaaggacacaaggugcugccauggaggcccaggggcacaagaaagccugcucggaaagcaagcaagcuuugugacccgagaucagugugaagugcauuaaauauucuuuaugaaagacccaacaacaaaugagccgagggaaccugcagcacguccaucucuaagcaaggagcucugagacugcaggggagagagccaaccagaaaaacaaacacacaccugcaaccccagcacuuggacaggauggaguguggugucagccugggcuacacagagagcuccagcagacccuggccuauaguggauacacagcucaagaguaaaggagacgguguugcaaagccaagaccaggaagaaagcccagagcaagcgcacgaaccugugggaagccagguuuuucuguccuucagaccuuuacucuucagcccuuccuuuucuccacccuugccguuugccuaugaaccucauuacauuucucugccaggauuucuuaaggcucucagaacaaaaaucuuuuauaguuuucccagaauucaaacgacggcuuuuugcuucccucacuuaagcccuuucuugaagagugagcauauaaauaaaucagggguuaagcauugcagcgaggcagccugugugucuucugccugcaugucaaacaaggucccaguucucagccggcacagccccagcccuguuugccuuucuacagauggucccccugcucggggucggcaggggcuguccaggaggccagcgggggcggggggucuguggguugauacaggugagcuacauaacuaagacauuaaaacaggaagaugcauggggcuggcaucucccugacaagggcuggcaggacaaaggguggcagccauguccuccaaggaggguauguguggcacacugcugaugcugcuuccuuuagguguguguucgugcgugcgugcguguguggucagggucucugcaguccuccggccccugcccucugaaugcuggauuaaaggugagcuaccaagcacacugcuucuugagcaaguguggguaacaagccacacagcacagaggcagagcacacaaaccccaagcucucagccacggacacagaaugcaucauguccacucaaaugucaggacacaggggcucccacuccuagcugcagugcugggcacauggggacaguugcuccuuggcucacuggcuggccugcccagccuacuuagagccuacagggcagagagagaaccuaucuuuuaaaaaagggagggagggugggaggaacaaaaggguagacaguauuugaggacugacagcagaagcuguccucugcauguguucuugcagacgugcaugcacacacagcugcacauacgcagcugcacucacaaacagcagucacacggugucuaacaccaaaaggaaggucacuucuuuugcuugugcucuccacacugggccaaccguccacuuacaaacuccacaaccugcacaaggcaccugccuguaccgccuugguacgagaggacucuuaugaauaucugacuauguguuugcugagauuccuaauguucucucaugggaccauucaggacagcuaacgcuaacagaaugccauugucuaauaaucuguguccacguuccaauccugggcacugucuggggaaacccucacagggcagagcaccauccacugugguacaccguacuaugucauggucaccuuuuauccuaugccucguucuguuuccaucuuucaugcacugccacuuuauaggguuaccggugaaccugacuuuaaaggaagcgauagugugaaguugaaggagauggcauggccgcuccuggccaggaccaugagguaccagagcccgcaugugcugcgaugaagcacagugcuggggccugcguuucaauacaaacagguaagagagcacugcucagaccaacacagcacacuggguguguggugugcuguagccugugcaggggagccagggaagacuggagaaacaucccagcagacaccagcuggaacacagccaggaagguccaagcagugugcaugaguggcuagugccacucagcuaggacugcuacuggggucggaggcaaugcagugagaacuggaccugaccuagacaucucugggcagccacuaagcaucccauggucaggcagggggcucugccaaaggcuauucucauaccugcaccccgccucccaccaucaggcugccacccuagugcgaagcaggggcagccugcacagcaaucagaccugagccccugcagaggccaccccacaggaugagcacggaggacagguguucucuguccccggugcucauggagcuuuguaggcagugaugguggcacaggucuaucaucucagaacucaggaagcaggaggguggcgaguucaaggucagccucggagucuagauaacacaaugcaaaauuaccugucaucuaauuuucuacuaggucaagugucuacaaaaggcuggaaagcagcccagcaaagguaaagggagcuugcaacaugccaauuucuaguaaauucuuacugccuagggagagacagcaagcaacaagccccauuucaggaucccuguuguaucuaacuccagucuuguuugcuacuugacugcucccagugagacuccagccuuguccuguaccuaccuacaccuuaccuccauucacagacuagcacaaauacucuggaagcugggacaccagcauuucucaugaaaucuauggguuuuagcaaagauuccuacaugcaaagcuucacauuaccuggacuugcauuugcaccuaaugagauuaaagacauuuugggacaaagagcugcacaugggcguuaugaaaaauucaacgcgguuccccacacgugaaugaaauggaggcucggagacgagcgcccuucacagcuccaucucauucccuccguguuucucugcucagccgucaguaaauuucucuuuaccauauuaaacuuuuauacauacaaaucuacaucggugccacaggcgcugauuucgauucucaaaauugaauuuuugguggugacagcaauuuguacuggggacccuauuccggcggcacgagggaagccugagcacacuggggaggcgcugcagacugcucugcuaaugaaggcggggcuggauccgguccaggaggcucaggguuccaggacuccguaacgaacuuccgacaggaaccaugcugaccuggagugcuuuccugucaaugaaacuaggugucuauuucuucagccccuacuauggaaggugcacugcuagagaaccagacugugagggacauaaaggagcagccagcagucaaggaugggacaagaaacgagcacacugaaaaccaaccuggcuucgagcuguguggagcugaguggcagucagggcauggcaacauugcagagcucaacaggacaggugugggugugaggguggagaaucacaccgacagggcagagcaggguacugaggcaggcugggaggccuggacaccaagguuggcaggcacugaaggccuggaguugacgaaguggggacuacuacuggaugcagccauuugccugagaggagcaagcugcacuacacuuuuauacacacacacuccaaagcgaggguaagaacgacaauggcacucagcccauccuagacaccguucuccucacccccaguuuuguagugccugcagcauacagagaguacaugcuguccuuagaccauguccccaaagucugagucacaaugagaugccuucucuguggcugccacuugccaggcagccccacugaggugcugagcccaggccucaccuggacgacuacacucacaccucggaucccuuaugagaugccggcacuguuccuugcuagaaaccuccuuggaccaucaccuaacccucuguaagacacaccggccaccgccugcacggcuggacaggcagccuucacccaaggcaguaguauuuccaaaccgggccauggugggagcugacugggcuggcagagcagagcuuucagccagccagcccgcaccugacaacucauuagugggaucugcucuuugccugcaguuaagucaauaagcacagcuguuugcccugcccccacacugaagcuggaggugcagcagggagugagaacccuuaagaaagcuguauucagaauagagcagacccacggccaugaacuucaaaaggcaacaagaagcacgaggugguagggguguucccuguguuccggcuccccacugcuacccccuccugcugggguuagggugggccgagaguugccccagaggccaaccucuggcucacauggaggcagaggguucugugcucuggucuguagucugaauuauuaacuggccucccagcaagccuggccuuucugcacuggugucccacugagggccaccuagcuucuggucgcacuggggaggugguggcuggcacagaaaaggaagugggccucaaguauuuaauuccuugccccaacugcugugauccuaaaggucugaaucaagggagggaggacuugaugcuuacagaagaaacuuaacaggaggucucucaagagaaccggaugacagggcaccugcugagaccucagcacagaggcugggcugucuacugucucuuacugucaaggaacccgagccaaagguuuuacuuuucugauuuaauuucaauaucuguaaaaaucaggacagugauagcuucuucaccugggggcccaaaggcuaaaaucagaugagaugggccaaguguucuacacucuuguacauggauacuguacgguggauguugggccacaggaagccaagaggccaggaggaugcaggucucagcaaggccgcucagcacagcagccuccacccccuccaguuccacuuucuggacaaguggcagaaaggugggggucacagccaucagccacccccuggucucaucccgagacuguggguuuaaugaagcgucucucagagcuaccuucccuucucaaggucuuuccuaagugaugcgggggugguggagggagugacucacucuguucuccaucccagccaaggacuacuccuuccaaaaauuaucaccaagauuuacuaagcccaagcaggcucaauuucaggugacaucaggaugagcuacgacagagguccugaguaaugugcccgcugccaccaugacgcccuggcucacuccaccccgaacacauccaucagccgcugcagaaccucuggugcagcuaugacucaagucugugugggccucgacugaucagaaacugcgucccuagguggugacaaaggaugacaacucucaaagaaaaagcucuccccuccccgcuggcugucuuacccuaacaaucaaauuggugagcaccagucucuccgccucuggcaucuagccccuggcugcccaacucuaagcuacuccagcccgaggacugccugccucugucagcagggccugggacugcacauacacagacgcuucggaccaaggacugugagugaggagcggguguccacacagggcacagucugcccucucaccucaccacugccccagaaacuuccucuacaucuggagacgcucuuguguaccaagaaccacauuagacagggugugagagucagagugggggcuucaucucuguucgcaggaagcucauacuggaaauuagggagcacagcccuagaaagcccacaggguuugccuugugauccguaagguaugggucagugaagaccuccagcgcaacguggggacccugggccugaccugccauccaugugacaaucagcagugcaggcaugagguggccacugauggagcgucucacuccugaggcaggcugguuuagcugguuccugcuuuggcaggucgugguccaucucacgggucauccaucuggccaccuaccugugcugggcaucacacuccucaccucugaccucuuaccuaagcccugugcucaaauaaccuccugccuacuugacauuccacuugggaguuuaaagccuccaacgucaaaugugcgaugcacuucccacaccccaccugcuccaucuaagucuuucccguuucagcaaccagcugcucaagccaaaaaaagaaaaggggaaaucugggagcuguccuugguuccucuccuucaccccacauccaggacacccgcgcugcugaugugacccgcacauuauggucugcuuucuguuacuucugucuccugugccacuaccauuauccaaaccaccaccggcaucucucucuuccggugcuaccacggcaggcucucugcagcuccuuguuccccaaugccagagcaccagaggaaccuuugaaaaucagggcacgucaguccccugacuaaauguccccgguggcuucucccuugcuuccugguaagaucugaccccuagugcagguggcugggcaguuaaaaagaaccuagguuugauuccuaguacccacaugguggcucacaaccacuucuaacuucaguuccaggggauccaaugcccuccucuggccccagugggcacugcauuaacaggguacagagacauaucuguugguaaaaaaaaaaaaaaaaaaaucuguauugugccuggcuccugccuuccuucagcuucaaaucuuagcuguagacaugccacucacuacccguaggcuugcuuucuuuucuguaauaugucaguuugguuuccucugaagugccuggccacccuucccgaagugcagucaguguucacugucucccugccucgagaccgaccuauguguaacuuccucaggcaagccucaggaacccgacuaauguuacauuuaccacgaucagaguacucauuggaacugucuuaugagucuauuuguuccucguguccugaauaagaauccaaaggcaaaaggagaaagaccucaucuaauucacugcgauuucccuggaaacuaaccuaguucuaugcaugcacauggccgugcuugguaagguaaccuaaaccugaguggggcgagaaggucuacuacucacacaagggaccugugugggagacucaguuucacagugacggaaggcagugaggcuuagcuggaggugucuggggauaggcugggcucgcagacacauuaacgaugguaaggaagaaacaaccccgccuuacaauuugacucuuuaguggcaucuggaccucagggccgcuucacugacuacuacacugugcagacaaggaaggaaacugcgcagaaggcgucgcacuccgcagcuaacugcaagauggguaccucgcgcacgugcagccuggcagcggccgacgcaugcgcagaucccccacccuugccgcccaucgcuucgacgugcccacccuccuccccuccggucaccuggguguucucucccucccggaaggccugcgcuacccgcugccgcagguaagcgcccaagucccggccccguuuggucucguccacuggccauuccucacagagcuuaaggaaacgccgguagcggagagcggccaucuugggccccgcuugccccgccccugggggggaguaguca

SEQ ID NO: 8483 - RNA, 11256 nt, Mus musculus
ugacuacucccccccaggggcggggcaagcggggcccaagauggccgcucuccgcuaccggcguuuccuuaagcucugugaggaauggccaguggacgagaccaaacggggccgggacuugggcgcuuaccugcggcagcggguagcgcaggccuuccgggagggagagaacacccaggugaccggaggggaggagggugggcacgucgaagcgaugggcggcaagggugggggaucugcgcaugcgucggccgcugccaggcugcacgugcgcgagguacccaucuugcaguuagcugcggagugcgacgccuucugcgcaguuuccuuccuugucugcacaguguaguagucagugaagcggcccugagguccagaugccacuaaagagucaaauuguaaggcgggguuguuucuuccuuaccaucguuaaugugucugcgagcccagccuauccccagacaccuccagcuaagccucacugccuuccgucacugugaaacugagucucccacacaggucccuugugugaguaguagaccuucucgccccacucagguuuagguuaccuuaccaagcacggccaugugcaugcauagaacuagguuaguuuccagggaaaucgcagugaauuagaugaggucuuucuccuuuugccuuuggauucuuauucaggacacgaggaacaaauagacucauaagacaguuccaaugaguacucugaucgugguaaauguaacauuagucggguuccugaggcuugccugaggaaguuacacauaggucggucucgaggcagggagacagugaacacugacugcacuucgggaaggguggccaggcacuucagaggaaaccaaacugacauauuacagaaaagaaagcaagccuacggguagugaguggcaugucuacagcuaagauuugaagcugaaggaaggcaggagccaggcacaauacagauuuuuuuuuuuuuuuuuuuaccaacagauaugucucuguacccuguuaaugcagugcccacuggggccagaggagggcauuggauccccuggaacugaaguuagaagugguugugagccaccauguggguacuaggaaucaaaccuagguucuuuuuaacugcccagccaccugcacuaggggucagaucuuaccaggaagcaagggagaagccaccggggacauuuagucaggggacugacgugcccugauuuucaaagguuccucuggugcucuggcauuggggaacaaggagcugcagagagccugccgugguagcaccggaagagagagaugccgguggugguuuggauaaugguaguggcacaggagacagaaguaacagaaagcagaccauaaugugcgggucacaucagcagcgcggguguccuggauguggggugaaggagaggaaccaaggacagcucccagauuuccccuuuucuuuuuuuggcuugagcagcugguugcugaaacgggaaagacuuagauggagcagguggggugugggaagugcaucgcacauuugacguuggaggcuuuaaacucccaaguggaaugucaaguaggcaggagguuauuugagcacagggcuuagguaagaggucagaggugaggagugugaugcccagcacagguagguggccagauggaugacccgugagauggaccacgaccugccaaagcaggaaccagcuaaaccagccugccucaggagugagacgcuccaucaguggccaccucaugccugcacugcugauugucacauggauggcaggucaggcccaggguccccacguugcgcuggaggucuucacugacccauaccuuacggaucacaaggcaaacccugugggcuuucuagggcugugcucccuaauuuccaguaugagcuuccugcgaacagagaugaagcccccacucugacucucacacccugucuaaugugguucuugguacacaagagcgucuccagauguagaggaaguuucuggggcaguggugaggugagagggcagacugugcccuguguggacacccgcuccucacucacaguccuugguccgaagcgucuguguaugugcagucccaggcccugcugacagaggcaggcaguccucgggcuggaguagcuuagaguugggcagccaggggcuagaugccagaggcggagagacuggugcucaccaauuugauuguuaggguaagacagccagcggggaggggagagcuuuuucuuugagaguugucauccuuugucaccaccuagggacgcaguuucugaucagucgaggcccacacagacuugagucauagcugcaccagagguucugcagcggcugauggauguguucgggguggagugagccagggcgucaugguggcagcgggcacauuacucaggaccucugucguagcucauccugaugucaccugaaauugagccugcuugggcuuaguaaaucuuggugauaauuuuuggaaggaguaguccuuggcugggauggagaacagagugagucacucccuccaccacccccgcaucacuuaggaaagaccuugagaagggaagguagcucugagagacgcuucauuaaacccacagucucgggaugagaccaggggguggcugauggcugugacccccaccuuucugccacuuguccagaaaguggaacuggaggggguggaggcugcugugcugagcggccuugcugagaccugcauccuccuggccucuuggcuuccuguggcccaacauccaccguacaguauccauguacaagaguguagaacacuuggcccaucucaucugauuuuagccuuugggcccccaggugaagaagcuaucacuguccugauuuuuacagauauugaaauuaaaucagaaaaguaaaaccuuuggcucggguuccuugacaguaagagacaguagacagcccagccucugugcugaggucucagcaggugcccugucauccgguucucuugagagaccuccuguuaaguuucuucuguaagcaucaaguccucccucccuugauucagaccuuuaggaucacagcaguuggggcaaggaauuaaauacuugaggcccacuuccuuuucugugccagccaccaccuccccagugcgaccagaagcuagguggcccucagugggacaccagugcagaaaggccaggcuugcugggaggccaguuaauaauucagacuacagaccagagcacagaacccucugccuccaugugagccagagguuggccucuggggcaacucucggcccacccuaaccccagcaggaggggguagcaguggggagccggaacacagggaacaccccuaccaccucgugcuucuuguugccuuuugaaguucauggccgugggucugcucuauucugaauacagcuuucuuaaggguucucacucccugcugcaccuccagcuucagugugggggcagggcaaacagcugugcuuauugacuuaacugcaggcaaagagcagaucccacuaaugaguugucaggugcgggcuggcuggcugaaagcucugcucugccagcccagucagcucccaccauggcccgguuuggaaauacuacugccuugggugaaggcugccuguccagccgugcaggcgguggccggugugucuuacagaggguuaggugaugguccaaggagguuucuagcaaggaacagugccggcaucucauaagggauccgaggugugaguguagucguccaggugaggccugggcucagcaccucaguggggcugccuggcaaguggcagccacagagaaggcaucucauugugacucagacuuuggggacauggucuaaggacagcauguacucucuguaugcugcaggcacuacaaaacugggggugaggagaacggugucuaggaugggcugagugccauugucguucuuacccucgcuuuggaguguguguguauaaaaguguagugcagcuugcuccucucaggcaaauggcugcauccaguaguaguccccacuucgucaacuccaggccuucagugccugccaaccuugguguccaggccucccagccugccucaguacccugcucugcccugucggugugauucuccacccucacacccacaccuguccuguugagcucugcaauguugccaugcccugacugccacucagcuccacacagcucgaagccagguugguuuucagugugcucguuucuugucccauccuugacugcuggcugcuccuuuaugucccucacagucugguucucuagcagugcaccuuccauaguaggggcugaagaaauagacaccuaguuucauugacaggaaagcacuccaggucagcaugguuccugucggaaguucguuacggaguccuggaacccugagccuccuggaccggauccagccccgccuucauuagcagagcagucugcagcgccuccccagugugcucaggcuucccucgugccgccggaauaggguccccaguacaaauugcugucaccaccaaaaauucaauuuugagaaucgaaaucagcgccuguggcaccgauguagauuuguauguauaaaaguuuaauaugguaaagagaaauuuacugacggcugagcagagaaacacggagggaaugagauggagcugugaagggcgcucgucuccgagccuccauuucauucacguguggggaaccgcguugaauuuuucauaacgcccaugugcagcucuuugucccaaaaugucuuuaaucucauuaggugcaaaugcaaguccagguaaugugaagcuuugcauguaggaaucuuugcuaaaacccauagauuucaugagaaaugcuggugucccagcuuccagaguauuugugcuagucugugaauggagguaagguguagguagguacaggacaaggcuggagucucacugggagcagucaaguagcaaacaagacuggaguuagauacaacagggauccugaaauggggcuuguugcuugcugucucucccuaggcaguaagaauuuacuagaaauuggcauguugcaagcucccuuuaccuuugcugggcugcuuuccagccuuuuguagacacuugaccuaguagaaaauuagaugacagguaauuuugcauuguguuaucuagacuccgaggcugaccuugaacucgccacccuccugcuuccugaguucugagaugauagaccugugccaccaucacugccuacaaagcuccaugagcaccggggacagagaacaccuguccuccgugcucauccugugggguggccucugcaggggcucaggucugauugcugugcaggcugccccugcuucgcacuaggguggcagccugauggugggaggcggggugcagguaugagaauagccuuuggcagagcccccugccugaccaugggaugcuuaguggcugcccagagaugucuaggucagguccaguucucacugcauugccuccgaccccaguagcaguccuagcugaguggcacuagccacucaugcacacugcuuggaccuuccuggcuguguuccagcuggugucugcugggauguuucuccagucuucccuggcuccccugcacaggcuacagcacaccacacacccagugugcuguguuggucugagcagugcucucuuaccuguuuguauugaaacgcaggccccagcacugugcuucaucgcagcacaugcgggcucugguaccucaugguccuggccaggagcggccaugccaucuccuucaacuucacacuaucgcuuccuuuaaagucagguucaccgguaacccuauaaaguggcagugcaugaaagauggaaacagaacgaggcauaggauaaaaggugaccaugacauaguacgguguaccacaguggauggugcucugcccugugaggguuuccccagacagugcccaggauuggaacguggacacagauuauuagacaauggcauucuguuagcguuagcuguccugaauggucccaugagagaacauuaggaaucucagcaaacacauagucagauauucauaagaguccucucguaccaaggcgguacaggcaggugccuugugcagguuguggaguuuguaaguggacgguuggcccaguguggagagcacaagcaaaagaagugaccuuccuuuugguguuagacaccgugugacugcuguuugugagugcagcugcguaugugcagcugugugugcaugcacgucugcaagaacacaugcagaggacagcuucugcugucaguccucaaauacugucuacccuuuuguuccucccacccucccucccuuuuuuaaaagauagguucucucucugcccuguaggcucuaaguaggcugggcaggccagccagugagccaaggagcaacuguccccaugugcccagcacugcagcuaggagugggagccccuguguccugacauuugaguggacaugaugcauucuguguccguggcugagagcuugggguuugugugcucugccucugugcuguguggcuuguuacccacacuugcucaagaagcagugugcuugguagcucaccuuuaauccagcauucagagggcaggggccggaggacugcagagacccugaccacacacgcacgcacgcacgaacacacaccuaaaggaagcagcaucagcagugugccacacauacccuccuuggaggacauggcugccacccuuuguccugccagcccuugucagggagaugccagccccaugcaucuuccuguuuuaaugucuuaguuauguagcucaccuguaucaacccacagaccccccgcccccgcuggccuccuggacagccccugccgaccccgagcagggggaccaucuguagaaaggcaaacagggcuggggcugugccggcugagaacugggaccuuguuugacaugcaggcagaagacacacaggcugccucgcugcaaugcuuaaccccugauuuauuuauaugcucacucuucaagaaagggcuuaagugagggaagcaaaaagccgucguuugaauucugggaaaacuauaaaagauuuuuguucugagagccuuaagaaauccuggcagagaaauguaaugagguucauaggcaaacggcaaggguggagaaaaggaagggcugaagaguaaaggucugaaggacagaaaaaccuggcuucccacagguucgugcgcuugcucugggcuuucuuccuggucuuggcuuugcaacaccgucuccuuuacucuugagcuguguauccacuauaggccagggucugcuggagcucucuguguagcccaggcugacaccacacuccauccuguccaagugcugggguugcagguguguguuuguuuuucugguuggcucucuccccugcagucucagagcuccuugcuuagagauggacgugcugcagguucccucggcucauuuguuguugggucuuucauaaagaauauuuaaugcacuucacacugaucucgggucacaaagcuugcuugcuuuccgagcaggcuuucuugugccccugggccuccauggcagcaccuuguguccuucccugggagggccuucgucccugacaucacuugagcugcuuugugggucccuggagcccacacugcccccagaauuucuacccacgcaugaugugcuguucccaaggugcaaagagcugcugaacgcuuuuguugguuuguugagggcucagggauccuacaggucaggggcgggugagauggggcuuuucaucccuggaggugacuuuuuucucaagagcuacaggggguuugcuucccgcacaccaggacaccagugcccuccucugaauacauugugugcauagccccccaucaaaguaugggugcaucgugggggcccaccuccuccgcucacuucccagggacacgcugucuuucagauugcagaacccgaggccugugaucagauguacgagagcuuagcacgacugcauucaaacuacuacaagcacaaggugagugggugcaggccuuuguaucccagccuccgaggggagggccaggcauaaugggggagaccugguuauacagugucugcaaagaauugugguugccacuuugagauguaacccaguacuuucagcuaagccaacaauggugcccagcagaggccuuuaaagguucucugaauaaaaaccaugcuugugugugugcuagcgcacacuccugcuaguauuucucacucaguuggaccugguguggcacgcugaucaagauggaguacuaggacgauccugucacaccaaggcucacuccuccucagccuuagcgagcuuacuguccaauuccacggaggguaguucuucccagacuugaaaaguaugucaggagcuccacaaauagacauggccaaauggaagaggcugugugccgaaggauuccuuccaaacaccagcucccagacacgagugugugcuccaccuggucgcugcugcuuagagcacggaggccugggccugcugagaucgccacagcuguggcuccuucggggccuggccuccagguggcgcuguucccuucauugucgggucucgggccugggcaccugguaaacugccuccauccagaggaaggcuagugugugggaaacuaacaugucccuucucuccuccccugugccaguacccucgccccagagacaccagcuucaguggccuguccguggaagaguacaagcugauccuguccacagguauguaggcauggcugcccucucugguugguuugcuuucaccagccaggauagaggcuugccuacuaagacaguuuugcaugauggaaagccuugaguggccccgaggaaacccugaguuacagggcucagauacuugagccacagaguaugggaggucaaaggcauuacuuagaagacaagaccaucuuuagugcuuuuaguucaaggcugcuggcugggaacagauuagccaaauuggaagucauuggauucaguuuggaaggaaaauaauuuuauuuuuaugguccuaagggggcuuuguaaacaaugaggcuuuuaauuaaaacaaaaagccauucagugaaugaguauggggauauccgucugugaguuaucuguccccggagauguggucugcagguuugauaugcgucuaacgaggucuguuugggagccauggcuagaacccagcucauaggaaggaagccccugccagccaccccuccucacuuccccauuucuauugucacugaaagggucagagcggguagguacuggaaaacugcuauuuuuauugcccaaggauauuguauauaaaaauaggcuaaccuuuucugggaggguagggcccuaaauguuggcugucugguacucuagaaauuucuccuuccuuuuggccgugaagauucgaccuuccagaauucuuguccuucugggcagaugggaaucugggaaugucaccuggugugucaguggagcaggucuuugagguguuugucucgcugacauauaauuuacucccacaccccugagcaugcaugaccagcagugucuaugagggauaggagagugggcucagcauggacucagcuucccgccaucuuguccuugccccuucugcucagaaagccucugggcgggcagcaggggacauggagacuguuggucuggcuucccgucagccccggaaacccugacaaugugugcacagcaggccuuguguuuuuguugcaauugugugaaaccaguaccacccaaauaaggcucuccacacccccaggagcaggcaggccugcaguguggccccuggccuguggaccuuaguguagaggagagaagagcagagcagccaucccugugugugacccuuggcaccuuguaugggaauguggacuugggaaagucccagggugggaggcacugcugugguggccacacggugagugcuccaggcuggugugagccacugcccacaaacaguaauugcagcuagcgcuugugcuaaaaugggccuaaaagcuaaacgguauugugacagugucugaguuuaauaucuaggguauaaaacaagaggucugcuaagcaaugccuugagcccacaugcaggguagggccguguuggccuuggugaaaagaggugagaaggcugacagagggccacuccaggggaaagcacccagccacagcgucaguguagggaagggcugaccaugucauugcaugcgugcaaggggagcugggacguuacaagguauugauucucugcuuagccuuggccaucuuggaacuuaacucuguagaccaggcuggucucagacuuagagauccaccugccucugccuugagugcugugauuaaaggugugugccaccacccccaccuggcuugugugguucuuaaacauggcucucugcacacaugcaugaacacagacacccugccaccaugugaaggugugaccuuucuuuccaucuagugcuagcuacauuacccugacugccacacacccagccugggaaguuuguagucuaauccugguuucacagaugaacagaagguugcaaggguucagggauuuggugggguaggguggggguguccacguccuuccccuccagccuacaggguccacacugcugacagcuccuuaucucgaugugcucccacagccaggaccuugccucccucuaccugguuccuacugauguagacauuaggaggccauuucuuggugugugcauauguggggcagaaagagugccuuggcagugcugaggagagcgcagucagguugggaaggagaaggccauggccuugcaggugcauauggaguggggcaggaacguauauaucugugggguugaggggggcgggcaguaacucucgggcuugugcccucaccaccagcccugucaccuauaaccagagaggacccacugccugggucacagaaagcagagcaugcucuuuuuggggacagccccaugcggcguccccaugagcaaguguaagacgacaucugccuguucucucucccugugcagacacuuuggaagaguuccaagagaugaauaagagcauguggaagaaacugcaggagaaguuugcgcccaccaggccugaggagaagcacaaggccuggacucggguccugucccgcccacggaccugaccguggggucugauacucaucaauaaaacugccugguuucucccacccucc

SEQ ID NO: 8484 - RNA, 1675 nt, Mus musculus
cacccacaacugguuuuucuuggcguucuucgcaguuggucuaagccaggugguugaagacuggggagcuuucacaucucugugcaguggagaucugucuccgcgcucuccccugcgucccuucacacggccguuuaagguuuccgucccugauaguggaaacuggcgcuagucccccuguagagacuguugggggggcgcagaagaaaguggggaucggagggcacuugucugucggccgcuucccgcuuagaccagagacagagauugaaaaugccuuuuccucaaaccugccgcuaucccgcuaucaucccgcuaucccgcuaucaucccgcuaucccgcuaucccgagccucugaucauagugggggccagcggcaaaguaagauccaggaaaagauaaaaacuugcagacaucgaaacuaagugcaagacagacaaugcagggccaucacgauagauggagcagauagauggagcaugucaggguggaggccgcucacccaaggauguauggucugggucuccgacaagcauucgcucucuuugcccaaagguguacauacuuugagauacucugggaauggugcgccucugggcuuauucgggcacaccuuugacaccugugagucucuugaagaaaugcuggcaugagguguuggaacaaggugccuaagggagaagagagaauacuuagaauagacugaggucaaucugucucuuagccagcagaaguuagugacuuccucagccacacaggucuggcuagagacagggagacagggggaaaaaaaaucaagggacucaggucgaccaacaacacacaugccacagagaugauggcguacaugccaaccagggcucucaaguaggacuggagaaucuuuggauaauuagaauggagaauucucagugaggugguuacccacuauauuuagggaauacgugauggguuugccagugaaguagggggaagauuuggggcuuuuuuucugacuguuaagauacucagaaauguauuucacagaugagaggaaaaucuuugggacucuuugaguuccaaaaguuuggguauaaagcauuccaccguuuuucaucuagaaggggagaccuuucauuccaggauucucuuugccuagaacacagaggguaacaagauucggugccaaucuccccaauguccccuuccagggaagaaagagccaaggggagagggucuuggaucacuuagcaggcucuuuccucucuuggguguucugagaaggguuuaccaggcaggccuuaggcugaggaugaaauuaaggugcacucaggugauagaugugacucugugcaagcuuccccuaauagucaccuauuuauuauccuugaggggccgacuucucuagggcaguucacuucccccucccccacucggauacugaacuaacaaaaugaucguuguaauugugacuuacauacuggaucugaaaccagagguacagguguaagauccacaacagcagucggccaccaggggcggcugcagagccaagggugagguggugugcagccaagaaccuggggccauuuugaauuuugaccucuggggaacgcagccugggcaggucccauccucuuugcauuccauuuuagaagaauaaauacuuucuagaggaaaaaaaaaaaaaaagag

SEQ ID NO: 8485 - RNA, 2375 nt, Mus musculus
cacacucauucagcaacagcagcaccaccaccaccaccagcagcagcggacagcccugaggagguauuagacccuccaugcugucuuaaaccuugcaugcuuuuugucuguuuuccugccacuucuaagccugacuguugucagggucgguggcuuacauccauuguuagcccagggucccuccucuuaacugacugcuggcuggcccuagucagaccuacaguuugaugcugaguggccucucuuccgguauuaguggggagaauauccugccucacuggagucccccacccccagcgacugagaauucaugcagcuugcccaguggcuccagaggccaagucucucucaugucuuuggugggugcuggggauugggaugcacaggacaguguaagaguagaaaugccugugcugagaaaggcguuugcuggcaucaaggggagggggaaacugaaagcaaccagggaggaggaggggagaaggggggugcaggcugugagaagauggucaaugcccgccggcagggcuuugccaugugugaauggaucuggagguuggaacagcuagaauggagcugagagcugaagagaauguacagagugaagcauccgagcaucucugaagggagagggaggcaugauggggcugugcaacuccacagggugccacggaggagaaagaggaagaggaggaggaagagcaggaggaggaggaauguauugggucuugguagcagggagaugcggccgggagaugaaagccauccauuuggaccauuguagcucauacuaggcaaccugauggagaccuccaucuaccuccacuuuuucuucugugcagcauggggccugcugggacucgucuccugcuaugcuucagcuccugcccaaucacuuaccugugccaggagaagccucuggacaugccugggcagccucuggacaugcacugcucccauuccucgcugagagggcaucuccccgagugccucuccaucccaguagacucuccagaugugcccaguccucaacugguguggccucaccagagagacucagaccaaacaggccuccacagccucucucuagacacuuucugggaaaccacaguggaauacaaaagguccucauuugcccugaacccugggaagcccuguggcauugguucaugagugcugugguugguuauuuggaacuuaauucucuugguauuugccacuucccaguuguccccuuuacuguucacaguccccaccuauaauccucggcuuccuggcacuuccggagcccauauuaacguaccaauuuuuuguaccccauuuagggcaccaacuguucugaucucuugaagagcuccucaggcaaccuucuguuucuagcaagaugauacacccaagccuugaugacaaggcuuggcucucaaccuccuugcuccccaccuccugugaaauacacaaagaaauucagugaucaucggggaugcucugguccaaacacuaccugccagccagacgcaggagauggauggcucagcaguaaucgugcugcuugagcuuggugucuaauggggacaguagugacaggaaguucacagggacuggaagacaugaguucucugagggaaaggaaggugaagccuggugcuuaggacccucaggagaccauaggaugugagaaggcucaagacacccagagguggggucagaaacagggcaaaggagaccaagcaugggagagcugcaguggacguguacagacaggagaagcaggcccuaaagaaucccugaggcggcagagaggcugggcuguggaacuuuuuaauuacuuugcauuaggggacuguagagacccagaagcccacccuuccccuccccucaucagcuuagccccaacauaugguggcuaccaaaguaguuaaaucggcucuugguagaaaaggaaagagauuccucccaggcucuucccaggguccacggccacacuccaggagggcucaacuccagggcaaggcagcugggacagcaggcagcugaaggaggacuauuacugcaccuuagggaagagugcaguggcgaguggggaggacucugcugggacccgggggucaugugcauucccauuuaguugagcucugcuuaauccgggccuaggcucacaguaauggggaacgaggagaggcucccaucagagaccaagaagaugacagacucucuguaaaggcugucagaggggucugcaugaccaaccacaccugcuccuguuccuuuggggcucuugugaccucccugucuucuugugagaucuuauguuccuccaacccugagagcuacaaaccaaucuccggaauaaaaaaaucugucccucgugcugucag

SEQ ID NO: 8486 - RNA, 499 nt, Mus musculus
ugccuuccuuucucgcuccccggccaucuuggcggcugguguugguuggggguugucccgcaccuaaagcaggaagaugguggccgcaaagaagacaaaaaagucucuggagucgaucaacucuaggcuccaacuuguuaugaaaagugggaaguacaugcugggcuacaaacagacucugaagaugaucggacaaggcaaagcgaaguugguuauccuugccaacaacuguccagcuuugaggaaaucugaaauagaguacuaugccauguuggcuaaaacugggguccaucacuacaguggcaauaauauugaacugggcaccgcguguggaaaauacuagaguaugcacacuggcuaucauugacccagaugauucugauauuauuagaagcaugccagaacagacuggugagaaguaaacaagaaaguuuuccuuuaauaaaacuuugccagagcuccuuuugaaaaaaaaaaaaaaaaaaaaauugucccagga

SEQ ID NO: 8487 - RNA, 1631 nt, Mus musculus
caguccagaagacggccugagccagggauaggagcugguaagagccucccggauccccaguggagacccaccacagccccagcugaaguaaaccaugagcuugguguggugcugcaguccugugaucucggcacucuggagaaccaagaguucaaggcuguccuaggcucgacaucggguucaaggccagccugggcuucauucgagcuaaauacaaaacuguaauaaaguccauggcugggugugaaugcacaggccugaaauuccagaucucgggagacagggguaagagggacccugcaaguucaaggccagccugcuguaccagccagggaacauaaaugagcaaaugaaaaagaaagaacacagagacugaacuccaggaggcacaaaguuaucaggagggggaaaccccagagggacuaaccaagcaaccuguuacucuagacggaggaaagucaaaaugcaagaccaggaggagagagcagggccagcauugggggaaggacucggugagcaucccugggagaccaggauacaggaggugcuggcccacacuggccgcuuccuggcuuccugcccccugcugcccccccgggaccucuccagggagacugacaagaacuccagcugaggaccuugcuuucucucaucugcuuuuccaacucuguccuugggucucagucuuguggacugcagaauggaugggcccuggagaggcgagacagccacagaaccguaucugcagcuuugguccuuagcccggcugcucccugagggccacuggggaacccagcaucuuuguuuuuucuauuggaggagcaucguggaacagaggcaguuugcugagcuggugcaggucagggaggaggcagucggggcagcuucccucccaagcgccaagucucagagcgacagucggacagucggauccguguagcuggcuuacagcugaguggggcagcgaggggguguaaauuucucaagaccacgcaggaaagugggacccccuaccuaucugguucuaaaucgaucucucuaaaccuuuccuggaaauggguguguguggcucggugcugagggggcuuugcaugaagccagcugccaaccccaguaguucaauaccaaugcaagucuccaagcuucgggggaggggcaucacuuccgggagagcgauggaggugugagcagagcuuggggagccaaagcccggagcgcaccaggcccuuucucgggcaggauuaggaaagagucagggacuuguaucccagagucggauguuugacccacuaccagcacaguaaagucaagaaggagaaagguccacagagagagcggggaaggugaccuaugaugcgauguuucauaaggacccgugcgggagcccagagucaugggucgucccaggccugggaugauggcaugccaggguguuagcagccagcgcguauagaggcaaagccugcuuaggacaggguuucacuuauugguuuucuggccguucucuggccucagccucccgaggggugggauuuuguuggugagcuaauguacuuggcuucucuuguuauuuauuucuuugcuuauuuauuuauuuauuuauuuauuaaaauuaaaaauuuuuaaaagau

SEQ ID NO: 8488 - RNA, 2179 nt, Mus musculus
gugggggagggguggccaguauuugucccagccuggggcuuccucccugguuucuuauuugcaguuacuugaauaaaaaacaaauagccuuuucuggacagucucugguguaaggagcauucacaguaaaaggggcggggccgacuaugacccuucccugccccacccugcaauggaguccacccaaggagggcaacuugaagccacaaaaguuuuuauuuacaaaacauauacaccuauacaucuggaccugucaccgugggaauaggcuaguguggaagagcggcugccuggaaggcuuggcucggggccagcuguaggugguuagaauagacagaugcuccuguaccuaucugggugagugguggaguguggacggucaugucuugauguccagcaggggcauccgcuugugcugguagcugcucugccagccaugaaccaccugucaggaagagcaagccacugcagccucacugcuggcaaguauuuguaaggaugacccaugaccugguugcuuagagugaggaacuggccuccuguugcaacgugguucuuagccagaaauguagcucaccuuggggucucccacaucagagagcagcuccugcucagcuuccuggaguucuucugcagggucauagcuauacaugggaagcagaugauggcgaagccgguccacccugggagcgggagcacaggaaccucagccccgcacuauccggugucuccuccccucaaaccacugggccagaaaggaacccauuucugcuaggguaaaggguauuaguaccagggaguuagggcacucaccgcuuuuucuucugcacauacauuaccuguaacagagacacguacuauggggcuggggaggcgagcacugcccagucucaagacccacuuccacacccuuaauaacagccgagaugcuguggccaccaaaccaggcccacccagcagccaccccaggcaagucugaggauuccuuaccacggccaccaccaccccgaccagggugaugaggaagaaaggccccagcacauagcccaccauagagucgcuguuggccuggggggcauugggcacugucguguuacucaugacaucaguagccagauggcugaauggauggacugcaugggcagugguggccucgggagggcgccuccucugggcucccuggggaggaggaagggaggauaucagcuguaccuguggugacaagcaggucuggaaaucccggaaaacuuaaagccaaacacuaaugaccccgagguaaccagacaggcccagaucccauccaggcuugguuccggcccagcgucuuacaaacaagaggguguggcuuagcuuggaugccugguagacauuugcagguaucaacugcuuggggaagguuaggugcaggugcacggcuaaauggagagaaagaaauagcugggccuucacugcgguggaggggugaguuaggaucaugugaagggguucugguuccguucccccacgguaugaaggagccacaggccugcauccuugucccugguguaauccuauccacgguccucagcaucgcucucagguacgaguguggacauuguguacagauggacaguaucuaaucuagaugaggucaccugccucuaguacacccggggcuccgccuaugucccuacccucucggccagggcugacaggcagagguggagagggucgcccccaucgacagaaacgcgaucauccucgggcggcagcacugagauggcucaaguuccugucccagacucucagagagaggaagagguacuggcugacugccucauguccaugggucaguuuugccaguucccaguugcgagcuccccgucucaggccgaggggggcgaaccagaaccgaaaagguaugaggccacucuuaggaugcugcuggcccgccugggugggcagaugguucccagcugcggggaggaucggggguauuggggaggggauaucgaggggccgaugcccgccuagauaccuugggaccccggcaccccaagcugcuccgugcgggcgcgcugcugcccauccaacccggccaugccuuaccucccgccgugcagcccugacagcaacaccuuggguuggccccggccccggaagaguccuccagcgcgugaucaaaggagcgggagagaag

SEQ ID NO: 8489 - RNA, 9118 nt, Mus musculus
cgggauucaagugucuaaaagaucucagaaaguugaacgcaccucagcucccugagcaagccuugguuucuuuccgauuaagucucaggggggaaaugagcagaugccacuuggacgaacccagccaaagugacaacgacaaacugagcuucaggcgcaagaggggcucaaagucugaacaccucgugcgugaucaaugcagaagcaauuuuaaaaacaaacaaaagccggguuccgcacagcccgguggaacguucuaagcucguuggggaaggaagccgagaaugugcucuaggggagucgcgaggcucugcacggcgugggagucccugcaggaugugagagggauuccgcgaauucggucugcucugaagcggcuuuugugagaagcgacagcuggcaccucacggcgggcgagggugacgccgagcugugccaugcggcgcgggcugccaccugggcacuccccccauucuccgcagcggcgacgccagacacgagagcccggccugcgccgcgcgcgccccaggaaccgugaccucucgggggagcccucgcaguccaggcugcgagccccggcgcgcgcacucaccucagcagacuggagagcggguggcuagaagaaccgaggccgccgcccccggagccgccgccgcugccugagccgccgccgccgccgccgaagccggaggagagccgcuucccggacagcagcuucuccacggccgggaggugcccggugcgggccgccuccagcagcuccugcuccuuccccauccccaggaccgccaccccucggaccucaacccggagccuugcagagccugcuccggcuccgaaacuuuccgucuccgggcaacgcaccccucaaaccggccggggacgccacccccucuccccccgccuccucggccucccccacucccuggcggcgcgucacuuccgggauccggcgucacgcgucaccgcgcccccgcgccccgcccccuugcccaccuagugggcggggcucggcgccgccgugcaggugagcccgcuuggcggaggggagccucggugugcggagccgagccuggcgcaggcgcggucuacgccuagcggacccgcccauucgccagguggcggagaucggaggcggcacgccugcaggagcuucccgaacugcucgccuucccaaagguuugggaccucauggcacuggaaaugcggucauuguuccuggcaccguagaaacaaaagaaaaggggguaacgcguaccucuguuuucaacuccauucaaaacgcauagauucaauacgggauaggcgcggagaucuagaaccagacuugaaaaaucccucccucuggugccuccuggagggaagaccugagaguuuuacuucugcaguuagacuggcauuguggcaacugccauuugucccagcagucgagaagcagaagccgcuggcugcaucgcugugaguuuaaggucagccugaucuacaaagcaaguuacgggcuagccaaggcuacauagugagacccucucuccagaaaaaaaaaggugggggggggggagggaguacggggguggcuggagaggugguucccuguuaagagcacugguugcucugccagagaaucuagguuugauucccaucacuuguggcgccucacagcagucuguaacuccagcuccagcggauguaacaccuuuugcuggccucccaggguaccacgaacgcauguggagcucagacuuacaugcaaaacacccauacacaugaaaaaaaaauguaagaacucuuaacagacacuauccucgcacuccauccuacuaacucuucagaaaaagucagaagagaccuucuuucucuuaguugucaugagagacauuuuaaaagucagauuuggggaaccauuuccaauuuuuaauauugguggacuaaggagggaaauguaauugggaaaggaugacuuuuuuuuuuuuuucuguuuuucccucacaacacuagccuguucugacgcgaggcagguggccaauauuugaaguguuaaaugaaaccauuggauacuuucuguuggcguuagagaugcuugcgaaacagaagggaaacuucccugguggacacaagccgguggucuuaguucuuugggaaauccgagguuaggucgcugccggaagcugcucaguccacggcaacaacaagcagcgggaccgaguucucucccuguuccccgacuuugggcugaaggaguaaaguuaaagaaggguuaauuggcauuacauucccaggaaggagaagaaaaagaaggaaaaagaagucucucgggaaacgaauuacgcucuuucaaaaacgcuucugcccugaagcggaggaucuagacuucuacauuucuuucacauuaaaacaaauuccguuuauaugaauccccugggcaaccaacgcgcuucuggaagugaccccucccaggauccgugggcgugacgucaucgcggcgcgacgacgagcccucagcuccagcuccgcuccacagcuccuucucccggcggugcugccaucgccucugacccccugcucucgcgauggacaaccucggggagucgcccacagacaaaggcggggagccaggggagucagaggagacgagggcuacuccuggggcuuugguggcagccgacacugagggaaucccggaggaaaccgacagggauggagacgcggacuugaaagaagccgcggcggaggaaagcgagguagguggaaguugguggauaacgcugcaggacuacccgggugcgcuccugacugcuuucuuccaaagccagggaacuagaauucccccacgacuguuugugagucugcaaccuugaggggcaggagagggaacgggaagguguaggugcuguuagagcccuauucaggccugcuuguacuccagcuccuuuugggggaaggcugaggaggaagguggaggagacaagaagauaaaagacgaggagaaaaugguuaaggacaaauaaauuugaaaaucugaagcacaaagguuagaaacacgcguagaucaauaguggaaaguaaguuagaaaggcugucagauagauaaugccuucucucccccucuccauauuucuguaugaguuuaaauaugaauuccuuccuuccuuucucucuuucucucucucccucucuuucuuucuucuccuccuccuccuucuucuuucuccuccuccuucuccuucucuucuuccccuucuuccucuucuuccuccuccuccuucgagacaggguagcccuggcuaaccuggaacucagguucuauagaccacacuggcuucgaauucagagauccccuugccucugacuuccaaguguuaguaucaaaggcaugugccaccacuucccgacauaccuuucauuuuaaaggaaccauuaaaucucauuaaugaguuuugauguauuacgauuuuauaguaaguuggcuaggacagaguuuggaucacucuugugaauaaaacgguuaaguguuuaugugaggagaaauguaaauaguaaacaucuugaagacguuuuuagcuuagggcaggcgaaauuguucagcaggucagggugcuugauccccagaacccacguuaagguagaagcggacuaucugcacaaaguuguccacuuacaaacccacacacaugaauguccguaguaacugaaaaauuguggguuuuuaagaauauuuuuuauaugaauguuuugccuguguauuuuuguuugccguguaaugugccuggcacauucccuguaaaagucagaagaaggcauuagauccccugaaacuagaguugcuaaugacugcgagcugaaauguggguguugguaaauggaaccuagauacucugcaagaacagccaaugcucuuaaccucugagcuuucugcaguuuuuaguuuaaacucaauauaaugguacaagucuauaauuuccacaagcugaaaauccaaaaugagacuuugucuuaaauuacaaaaggaaaaaaaaaaaagcuuccgaacugggcaugguggugcacagcuuuaagccuagcauucuggaggcagaggcagguggaccucuugaguacaaggcagccuggacuacuacagagagaguucaaggauagccagggcuauguauagaaacucugucucaaauuauuuaaaaaaauaaaauaaauaaaauuuguauucuaguauugggaaagaucucgugauccaguagagaaaggaucagaagaacagagcucuguucaguguggagcucccaagacacacauggaagggacuguacugacaucuauggagugaggucagaagggugggcccgagggagaguggcuguuuggauccuuggcauuuuccucguaauguguaaacagaugcaggaccucuguaugaucauggcuaggcugggaaauggauuauucauuuucuuuuuuguuuuuuguuuguuuguuugguugguugguuuuucaagauaggguuucucuguguaguccuggcuguccugaaacucacuuuguagaccaggcuggccucgaacucagaaauccaccugccucuaccucccaagugcugggauuaaaggcaugcgccaccaccacccagcggauuauuuauuuucuuucccagcuggaguauaaucuuccuuggagagauggauugccucuuaugcagaugguauaggcagugccuagaacuagauagcuacugcguagacagaguugcugggcuggaaagaggaggguguuugcuggccuuucccaaaccugagaagugugccgaguacauaauaagaguuucuguccaucucuccagcucaagagucaggaugucucagauguaacagcagccgagagggaaaacucguccuuacuuacuccugcagccaaaaagcugaaacuagacauuaaggacaagaaggagaagaagcagaagguggacgaagaugagauucagaagaugcagugagucacagagguccccaguccaggcucuaacuccacucuguacauucaugcuuacuggcuuuuuugugugcuuuugagguaagggcucaugagacuuaagcccuuagcucaaagguuucaacuccugaucuuccugccucagccuacuuaguacugagaucauaggcaugagcugcuaugccuggauauaguuucaggccagcaagaugccaaggaaaggugcucaccacugcucgccaccgaaccuaaugaccaggguuuaauccugggaaaccgcgugguagaagaaggaaugagggccuggaaacuggccucugaccaccaaacaggcaugguccugacagacacaaaauacaugcauacauguaaaggacaguaaauaguugguuuuucuaaauguuugggcuuuauacuacauuuggucauuguuuuuccuuuucaguaaauauaggcucauugcaaauaacucagaauacaaacaaaacaaaacaaaccucaaaauccagcuaguagcgcuuaucccaagagugucuaucugggaauauuugugcaauguccucauggacaucagugucucccgcugcacugaucucaccuaugugugagucacaccaucagucccugcacuuacucuggcuaggauuuuuuuuuuuuuuuuuuuuuuuuuauuuuuuuugguuuuucaagacaggguuucucuguauagcccuggcucuucuggaacucacuuuguagaccaagcuggccucgaacucagaaauccgccugccucugccucccaagugcugggauuaaaggcgugcgccaccacgcccggcuuggcuaggauuuuuuaaauuuuguuucuuuuaacaacaucguguuccaucucugggaacaucucuacaucuuacccauuucuuucuaugauaaaauaccuguauaaacacacugguauaaauguuuucaaagaugucucaacauauuucuagacuuagaaaacugugauuuuguuuaauugaucauuucaaguucauugguaauaauuaagguuuugaguuguuuuguuuguuucguuuguuuuuucuccaucuugauuagccauugauauuuuugugaauuuccuauuaagugaugguucaucuucuaaaacuggcucagccaucuuuuuauuuauuuaaaagaguuaacuauaaagaauaaaggggguuagagaaacugcucugaggcuaagagcuaucagcgcuaacaggaccaguaagacccagcacucaugucaagcugcuuacaaaugccuauaacucuagguccaagggaucuggcucggccucugguuuccauggacaccugcacaaacaugcacagacacaaacagacagacuuacauugagacguuuguuuguuuguuuaaagaaacacagggcuagugauuggcccaugagguaagggcaugugccaucaagcuugacaccugaguucaauccccaggaccgcgugauggagagagcuggcuuccucaaguagucuuucaccacggaugccccuacauguacacccagcacacaagcauaguaagcagacucaauaauuuaaaaugcaagcauuagggcugacgcuggagcucagucuguagacugcaaagcauucaggaaccagaugugcuggcacaucuggggucccacacucuggaagguagagccaggaaaaucagaaguauaagguuauccuugauuucccuguaaacuuaaugcugaagaacccugauuugaacauaaauuucucuaguagauguuuacugucagugugaaauccagccgacauagagucggauguuaucuccucacauugcugucucuuagaacaagcaaagggcauacaccaccauagccagcugcuucugucuaaugaaauuauguuuccuuuuucucuuuccaaaguuccuuaggggugggaaccuugcccuuccucaagagcacaaagccuuaagcuagagacccuuugaaacaguguuugucugccgcuuguguuuguugacuuaaugaaguagucauccucauuaaccaucuuaauuacucaaauuuuuuugucuagaauccuggucucuucuuuuucugaggagcagcugaaccguuaugaaauguaucgcaggucagcuuuccccaaggcggccauuaaaaggguaagauugugcgugcgugcgugcgugcgugugugugugugugugugugugucagucacuacagugcaacagcuguguccaucagcucugaagugaggcgugugugagauugcuuaggagggagaaagaaccaccucucaccaucuggccaacuccagcaagucagugccuaugaaccuuuggcggguuuggaauuguuuugcuguuuuuuauugcugugucugcgaguaaaugaauacauguaugugugugcccgugagagucagaagagggcaucagauccccaaccagauuagaggucguugugagcuacccacuguaggugcugggaacugaacucuaggccucucgaagggcacucuuaacacugcgacaucacuguagcccaggucauuuggcucuuggccgucauuuacugccacugcauuccaggccagcccugaccauacuaacaccagcuucuucuuuuuuccaagcugauccaguccaucacuggcaccucugugucucagaauguugugauugccaugucuggcauuucuaagguuuuugucggggaggugguagaagaaggugaguagugucggucacagccuguacugcucucacagggaucgcauucccaagaguaccuccaccgaggcauguaagggaugugggaguuuccagcugcucgcuuuucagguggagccuauagggagccucaucuuaaggagagcauggcuguuuuuauuacugggugcguggagcuggggggaggggaugaggccaucuaggaaaucccucuccauagcccagggcgaagaagacagcucgguacuuuucaucagcagaccucacuucaaaagcaaugccuugauagcagcgcccugcugagagcucucccugucagggagaaagcuugcugcuucucauggcuaauuucuagcuugugguauaguacagucccugugggauaaagccaaagccaguuagaaauacuuuauaacuuccuuuuuuaugucuuucuguauuggugagguagggagaggguuggugcuuuuugggacaggauuucucuguguagcccuggcuggcaguuuuagaacuuguacuguauacaggcuguucucaaacucacaagagauccaccucucucuccucccaagugcuaggauuaaaggcgugcaccaccacacccggcuuauaguguucucuuaaggaaaaacacuuggcuuguuucuuuagcaaaucucacaaaagacagaauuacauccugagucgugacuagugaaucucaugugaugauacuguuuccuuuccccaccccagcccuggacgugugugagaaauggggagaaacgccaccccugcagcccaagcacaugagggaggccguccggagguugaaguccaaggggcaaauccccaacucaaagcacaagaagaucaccuucuucuaaaucuaagggagacuguuccagacuucucagagucgggcuucuguccuggggcuuuggugguggugagcucgggacgcaggaugccgauuuuaauguuucggucacaccuacaaggcaugcagugugacucagacuugccuucacucagucauggacuguccucaggcauguugaagacuuuuacugacucuuggcuaguuugaagaaaaaauauacaggggccuuuaguaucuucuggagaaggagaugguuucagagaaaaacagaacaacucuaguggcuucauauugaaaccuaaaguugcuaagauucagguuguuucuugcucugguuuucaaaacauaaacuugcgauuaucugcggugaagucaccgugacacgcuucucaccauuaacauuucagguucuccuauggauuuugugagggaucauuaaacuuuuccaaccugugugggaaaguuuauuuuauuuuguugcagacaaaacucauuguucuuccuauguugaaauaaaacuuggcuuuuguuuuucaagacag

SEQ ID NO: 8490 - RNA, 2951 nt, Mus musculus
gagcacaacgagcgggaccgcaggguguacgccaacauguucaagaaguucgcagagcgggacgcaaagguagugugcccacagccccaggcuuguaaggacgcuagccuagggacaagguugggcagccuggcuggaagaaauaagacuuaggaagggacuccaugugggcagagacacaggugggaggcccuggcgugucccugagagcugagggcugacuccugagguggagcagugcucuucuuguucucuguuuuguucuuaaaaugguuucucuuuguggacccagcuagcucaucucagagauccuccugccucuggcgaugagcguuaggauuauaggcaucugccaccaaaccaaguucucuuguuauuuuuaaaaaauaaauaaggaguuacagagacaaaguguggagcagagacugaaagaaugaccauccagagacugccccaccuggggauccaucccauaaaccaccaccaaacccacuauggcagauuccaacaagagcuugcugacaggagccugauauagcugucuccugagaggcucugccaguaccugacuaauacagaaguggaugcucacagccauccauuagacggagcacagggcccccaaugaaggagcuagagaaaguacccaaggagcugaagggguuuacagcccccugggaggaacaacaauaugaacuaaccaguacccccagagcucccugggacuaaaccaccaaucaaagaaaacacacggagggacucauggcucuagcugcauauguagcagaggauggccuagucagucaucaaugggaggagagacccuugguccugugaaggcucuaugccccaguaucggggacugccagggccaggaauaggaguuagguggguuggggagcagggggaggggagagggauaagggaauuuucagaggggaaacuaggaaaggagauaaaauuugaaauguaaauaaagaaaauaucuaauaaugaauuaguuaaaaauaaauaaaugcagccaggcagugguggcgcacagcuuugaucccagugccugagaaacagaggccaagguaggcaguugucugaacaggaggccacauacacagagaaacccugucuggaaaaaaugacaacagcccuaagcccuucaguguuguuucucuggggagacuuccuaguaaaguccagguuggauuggaaacgggugugccugugguggccuuuacuguauucucugcugucaucgggagccucgcuggcagugggugugucugaacacaggucaacuuccugccccauggccacccuguggucccaggucuguccuccaucuucagcuaugaguagcauaaggacuugagcuacucagcagcugccugagguaggcagcuccucauugcuugccaccccuacuuacccagugugcaccccagauccaagcguacacacuugcugcagaccugauggaccaucucgggaaggcagugguugagugagcuccucuucuccuuucaccucaggaggaagccagcaaagcugggagcaagaaggcuguagaaggagccgcuggcaaacaacacgagagucaggccauggaagaaggaaaggccaaaggccauguaugacgcugcgccacggagggaagagaguccuaaugaacucggcccuccucgcugggcucgccuccaacucaggacugaacaguguuuaguguaagguuuguuacagucucugugauucuggaagcaaauggcauaccaguagcuucccaaaugaccaccugcugcugcgggggggugggggugggggacaugccaggaaacagcagagaaggccgcuggugugaagagaccaggccagcagcucaguccagcccauuucaguuugucaccuuucaguguccagcacagcaucccugugaaccuagggcccagcugcuguggguucuacaucggcacuagggucacacugcagaaaccguugauaaaacaaacucagugaucucugcuuuccuauuggugggcauggcaggggcgggugaugagauuugcuuagcacugacugacuggccugcuaagaacacaagcccacagccaggggcucccugguccacagcugggucucaggccccuuaccugccuuccaaguccuuucgcagacucuugaguguggcuuucuguccuagccagcaugucccacagacucuguuguuccuccaacgcccgucauuagugacagcuuucucucugaguuucugugguguggagaguggguagaaguagguuuaucuuucccgcugucugccccacucaaggacgauguuagcgcucagccaucccugcccagcacagcugcucagccucaugcucccacccgcacccuugcugugcagaaccuaaggcuugcucccgucccagacucgaguggacggacauccauguccacccaggauugacgaaggaaggaacuucacacuccucuaucaugcaaaaauaguuuucaauuuuuacuuuuuagcuuggguuuugaaaggcaaacucuaggaggcuuaaaacgggcaguuacucuuaaggcgagguagauaccucauccugcaccgcagccucuguauucuggugggagcuguaaggguugcgggcuuccgguguccaugcaucaagccaaagucuccaaaacuugggcauugaauuagggcaaaucuuaaauaguuuugggguuggauuuuaguccuacaggugaugauugaacguggcuggcuucuccacagccuaaggaacccccauggggacacacccaccacccaaugacccaugcaccucugccuggacagcucacuuccagcccuaaggaccacugugcucaagauguguggcuguaguaagacagucucaugucaggcauuaagucaaggccuuccuucacaccugcgggacagcgcuucugag

SEQ ID NO: 8491 - RNA, 8252 nt, Mus musculus
uagccacaaggcagcacggaagacaugggcaagaccauuccccgguuccuggagcaacuggaccucaucaaaagcuucgugggccuggcuacaggcgccggggccuuauaccugcuguacaaggccgucaggacuggcuuaaaaugucauccgccacucugcuccaacucgccgaucugcauugcccguaaguguccagguccuggggagagggcucugccccaggaagccucccuaaggccuccccuggggggugggggcaaaggugacucuuucaagcuccucuuuccuccuuccuucuuucucuccuccggucugucucaguuccccuccuccuucccagcaccugaggcaaggcucugcuauagaagcuaguuugggagucucuggguagcagguuucauagagccaagucuccagccaggaaccaucagcuuggcuuucucuguucuauguauuggaaauggaaaucaagagcuuuuuaucuguccugcucuugccuaggaucugaagauacugaagggaagaaaaguugagacaccuuuugcccagaguuuccaacuaggucgugggggacuuuauuugauguguuuggguguuuugccugugugugugugugugugugugugugugugugugugugugugugcagugcccacagaggcuagaagagagcauuggauccccagacugaagaaacagauguuugucagucaccaucuggcugcuagaaaucgaacucagguccucuggaagaacagucaguguccuuaaccacugagucaucucucuacucucccuaggguacuuuugugccaucaggaaaagggucaguaauuugagauuguuggugaaagcagaacccuacuuguuggcgcuacacaccaggaaaguugucauuguggacaaacgagugccugacagggcagauggcacauuauuagauuagguucuuggugcggugcacaguugguguugcagcagucugugaagcgugaagcgcuaggcacagccuuugcccucagcucccuccuucccucucccccacuucccagccccuugcuuuuccuaauucuaaguccguaucccuaacuguggacuggggugcuuucuaggccuggccaucgagagagagcgccacgggcgggacuccggugagauucgaagacuucucaacucucuagacugcaaacaggaugaguauaccaggagcaugauccuucauaacaucacccgcugcguguacuugcuggaggcugaggugggcggggccgggcagggcggggcggggcggagcuuagccgggcccucccagucagucugguccuuggcuuguagcucacccguaaccucaggcagcguccucagaccugucccucugauugcuagcaucaaagaaaagaaggccucagagacuugggggacagugcaggccaagacacccgcuucucccgucucccccaccucuccucacacacuguaggccucuucuuguacuauggaugacaucgacuugguggcugacaugcuagaugagaaggacaacaguguaaaaauccaagcucugaaugcacuuaaagcuuucucuggcaucaggaaauucaggcucaaaauccaggugagccuggguaagauccggucuggguccuuuaaucugacagcugaauggugaaguuuguuugaagccgaguuuguaacccggaggaggagacaguggucagcuuccuccagggccacucaagucuccacaugucugcacgacacuggacccccaaagagcagauucuuagacacuggugcguaacuuacaauuggaguuaaccguguaacucacaagacuugucauuucaaggcuagaugucguuugacuucugacaggcagguugugaaacugggguuaccacacuuuccugcuuugggggguggggguaucuguguaguccuaucuggccugaaacucacuauguaggcuaaggcuagccuuaaauucagaggcccucaugccucuuccuucugagugcugggaucaaaggugugcgccaccacugcccggcuuaaaacauuucuaucuuauaugugugaggcagaaagaaaaacaauucugccgggcggugguggcgcacgccuuuaaucccagcacuugggaggcagaggcaggaggauuucugaguucgaggacagccuggucuacaaagugaguuccaggacagccagggcuacacagagaaacccugucuugaaaaaccaaauaaagaaagaaaagaagaaagaaaagaaaguaauucuucuaacgaaacccaggggcgagauggcucagugggcaagugggcguuugcuucuaagccucacaaccugauuucaauuuccagggccccacaugguggaaggagagaaccaauucccacagguugcccucugaccgccccccaccccggccccacuccgcacccaugagcacgugcaugcagcaccuucucccacauggcaggaaaacaacaacaacaacaacaaaagccuucccuaaauguggccagccccaaacugagaaacagcaugggcauaaugggguucucucaaucccauccuccccuccggaaggguuaugaccucacauaagaugcuguaggugcaggcacccuugcgcuugcgcagcccugcgcaugcgcacuuguacggcaaggcagacagauagguaaagcgcagugugcuguguuugaagucccgugugcucagggauauuguguguuaguuauugcugcuucagggacgacaccgauggcauagggagggaagguauacuuacgcauagacauccauuugcagcuuguacuucucuguggucugccuuugcuccggaagcauugacgacuaagcucaucccuucuucucacagugcaugacguaccguggucuguuuugugacuaccucacuguuuguccauugugggauauuuuuuuaaaagauuguauuuauuuauuuuauauauaugaguacuguagcugucuucagacacaccagaagagggcaucagaucucauuaaagaugguugugagccaggugugguggcgcacgccuuuaaucccagcacucgggaggcagaggcaggcggauuucugaguucgaggccagccuggucuacaaagugagcuccaggacagccagggcuauacagagaaacccugucucgaaaaaaacaaaaaacaaaaaacaaacaaacaaaaaaagaugguugugagccaccaugugguugcugggaauugaacucaggaccucuggaagagcaauaagugcccuuacccgcugagccauuucuccagccccccauuaugggauauuuauaucuucccugguuucuugcaucuccacaugcgacaagcagauggcucaaccuccuuguauuacauuaguauuaguauuauugaauuacuguagauguuugacuauuuuacauuuuaauauuuccgucuugguuaguuuuuaccaccaacuugacauaaccucaacugaagaguucccucuaccagacuggccugugggcaacucugugagagaguguccugucugaugauugggguuggggcccagcccgcugugggcaacaccaucccuagaugugggccuaggcucuguaagaaacuuagcugagcaugaaccagugagugaacuagaaagcagcauuucuccacggcucuucaaaaaggaguaaacauuuauuuuauguguaugaauacuuuugccuacaugcauggaugguauuauagucacgccuguugauuguggagaccagaagaggggccagauccuggaacuggaguuauggaugguucuaagccaccauggaguaacuagaaaccaaaccugaacccuuugcaagaacagccgaugcuguugaguacgaagccauuucuccagccccuccuccauagcucucaucucaggcuuguaccuuaaauucaguugugaccuggagauuuaagccaaauaaauccauuccucuccaacauugcuuucagucaugguguuaaucucucucucucucucucucucucucucucucucucucccucgcacacacaugcacacacacacacugcaaacuagaauaauuguuucuuacaugggaaaaauugguuugggacaaaaguuuggacugagguauuguguuggguuuuuuuuguuuguuuguuuuguuuguuuuuguuuuuuugagacaggguuucucuguauagcccugucuguccuggaacucacuuuguagaccaggcuggccucaaacucagaaauuugccugccucugccuccccagugcugggauuaaaggugugugccaccacugcccagcaagauaaaauauuuuaaaaauuaaaauuaauugacaggggcccgagaaauggcucagugguuaaagcacuggcuauucucucagaugucugaguucgauacccagcaccuacaugguggcucacaaccauuuauaacuguagccccaugggaucugaugcccucuucuacuguaucuauaugaaggcagcucacccauauccauaaauacauaaaucuuacaacuuuagucaagaacaccaaaggcuacaaauauguagcaaaacuagguuccuuccccauugccagugcuuauauaaaauggaagccuuucuggugaaauuagcuuaauaacuucuuaacacauuauggccuggcaguggugacacaugucuuuaauccuagcacccaggaggcagaggcaggcagaucucuaugaguuccaggccagccuggucuacagagcaaguucuaggacagccaaggcuauacagagaaacucugucucaacaaacaaaacaaacauucaauauacauuuaucaacugguaguuauacuucugggcuuuuuuuuuuuuuuuuuuuuuuuuuugguuuuuuaagacaggguuucucuguauaguccuggcuguccuggaaaaucacuuuguagaccaggcuggccuugaacucaaagaucugccugccucugccucccaagugcugggauuaaaggcaugcaccaccaccgccuggcuacuucugggcuuuuaucccagaggaauauaaacuuacagcuaccuagaaacugugcacaauuacucauagcagccuuauuccaaaucagcucagaacaaaagcuaccgaaaagucuuucaauuaggugagugguuagacuguucccauucaaaggaauacuacaccgcaaccaagaggagugacauuguugcuccaugugacuuggguagaucucuggcauuguauuagacaacaaguagccaaucucaaaaggcuacaugaaguuuaaucucaucuuuaagacauucucaaaagacaucuggaaaacagaucgggacugggggaggggcagguagcaaugaguguaaggaaucccgcaagagagaucacugggacaguucugaugugaugaaguaacaugggaggcaguagucauuacaaaaaaauaaaauaaaauaagaugcagaucugggcacucauaauaccaucucucuaauugugguguugaacuaugauuggauaagauguauauguggaagagcaagcuuccuuugaauuuauaaguauacaaauaaaacaucgauaacuuuauuauaaaaauauugcaaauaugugugugcgcgcacauagguuuuuuuuuuuuuaauuuauguauaugaguacacugucgcugucuucaggcacaccagaagagggcauuacagcugguugugagccaccaugugggugcugggaauugaacucaggaccucuggaagagcagucagugcucuuaaccacugagccaucucgccagcccagcacgcaggcauuuuaugggcauuuccauggcauggcacaguccugaagguuaggacaaccugcagaggucaguucucuccuaccaucugggccuuagggaucgaacucagcuucucaggcuuuagugagcucucaccagcccuuuuacuagauuacuagaugucuaaaaauguguguguguguguguauguguguguguguguguguguguguguuguauacaugugucccacagugcguuguggagaaguuccagaagacagcuucaaggaacugguucucuuuucccaccuccuuugugagccuaccagggcucaaacuccagucuacaggcuugugccacaagcccuuugccuacuaagccauuuccuuagccccuuuaugguggguuugaagauuaaaccuaaaagauucucugaaggaugggaaagggugagagggagggagaaggagagagagaaggaggaaaggagacagacagacagaauuggggaauacugcagcuuggggcuuggaggaagugcugcaccaguggccaggaucaaggaaacaaaguaggaagaaaguggaauuaacagguggaccggaugaccuuacggacaggaugaaucagagaagaggagguuggguagaagguuuaggaagacagagauagcccagcgacgaaaaauaaaaaucugugagguggaaguagcuagccgaggcaugagguguggguagcuaaccagugcuuugguacuuccauucagggcaggaaggguuaucucccggguccuggguggggucagggaaggacgauaugagcauaaucaggggggucaccguaugagaacagacccaucucuccacuccaggagcauugcaucaagguacuggaacugauuuccaccaucugggacuuggaauugcacguagcuggucuccgauugcucaacaaccucccgcuaccugacuaugugcacccacagcugcggcgggugaugccugcccugauggagaucauacagucagacugcauccuggcacaggugccugaccgucagggccgcggccccgcccccggccccgccccgccccgcccccagcuaguccuggagcagcaccuagagggaagagcagagguucaagucaccccugcugaggaccagauccacguucccucuccugcuguuccuucuucagguacaagcuguccgccuccugaguuaccuggcacagaagaacgaccuucuuuaugacauucucaacugucaggugaggaaagauggagagggacugaugagaugcugacgcaggugucaggaucgcuagaucgauuuuuuuggagaugauuuuuuaaugugcacuggugucugugcgucgccugugugcaaggccuguggaggccagcggagggcgccagauccccuguagcuggagcuaacagaggguagugcaaaaacagagcuugucaccuccgcuugagccaucaucucuccggccucacacacugucuuuuuuguuuguugguugguuugguuugguuuuuuguuuuuuuuuuuuuuuuuuucgagacaugguuucucuguguagcucuggcuguccuggaacucacuuuguagaccaggcucgccucgaacucagaaauccgcuugccucugccucccgagugcugggauuaaaggcaugcgccaccacgcccggcacacacugucuuaaaguuaaucucacucguguucucuugaccgugaugcagucucucuggaaaacgaucaugaaagggaauggcaaaccuggguccgucaugaaagggaauggcaaaccuggguccgcgagagagcagaaagccaaagaugagacuuugagaacgggcagagucucacugauucucucccaucuccaucauaggugcgucccaacuuccugaaccucuuccagucuucacagccgggcagucugcuguucgaggugcugguguuugcggaacacuugagugaaggucggaacgccacccacuaccgagcggucaaauggcauuacaacgagcaaucccugcacgaagcccucuuuggggaugaguccagacuggcagaccgacugcucucccuggucauccacccugaggaggaaguucagauccaggccugcaaagucauagugagcuugcaguguccccaggaccugggaucccgacccucuuccugccgaccuagccauuccugcuuuaaaaccgggaagugaaguuaaggagauccaauaaaugcguacgggagggaagcucgaggccuccggaagcaagcgucuguccguugccucccaggaccuggguggaggugcuguucaucagggccucccccuaggccguggaacagcacccaaacacaucccacuucuguguuugggagacugccccuucuguugcugcucuucaaau

SEQ ID NO: 8492 - RNA, 626 nt, Mus musculus
agagauucaugcaugauguugaaagguuccugaauaaacugcuuugagaagaacgcaguguugucgcucuuuccugcuggucagaauaggaagcuacaaaugguggcccguacggggacccuucucgacguucagaacucaucucagucagggcagcuagcuuguaagguucccagguaagugggacaauuuaaguucucggauugagacgauaagguucccaguuuugggacaaguuaagguucccgguuuugggacauguugcaccaagcaccauggggacuugagguuugcagaggaacagaggguuuuacuaaaagggguuuugccggucuggaaguuagugagaaauugcauagaagauaaagaugugacguagaacuccagagagguaaugaggcgcugagucacgugagagaggaacacucuauugguuugggcgagagggucuguuuguuuccucaggaucaccgacaacagcugugggucccagaaccgcugaccagagcaauucaaaacaagcagagcuaugaggacguggauguuccuguggcugggaaugcucccgcuagugagaacugaagagcuauguuggggaauuaugucuguguuccugaaacccaugc

SEQ ID NO: 8493 - RNA, 57078 nt, Mus musculus
cauauuggguaagaucuggauucagagcggggccuccuuggagcuguucucgcgagaguuccgcgagaggcucccggccgcugccugugggaucgccgccacuggagcccaagcggggcgcugaagcgcgagcgggugucuugcggcgucggcgugcgcucccuccccggggagcggcugcaggaggaccgcggcgggagcagccucgagccgugcagccggcuccggcaccuugccgacgcucguaggagccgccgcggcugacaggggcggcgggucgcagccuccacaccugcgcggguggcgggcgcgggguccggucugccgcgggcgggcgcagaggagagcgugcggcugcaggcaggagcccccgcucggccaccuccucgccccgcugcugccgcuggaagaugucgcaggagaggcccacguucuaccggcaggagcugaacaagaccaucugggaggugcccgaacgauaccagaaccuguccccggugggcucgggcgccuauggcucgguguggugagugucgccgggccucggguuaggggugggguggggggacgcgguggagcaagcaggguggcccugcaugccugagggccaggccuguccccacagcucagcgaugcgcccagcggcaggaauucuccuccgggcgugucugggggugcagggggcagcuggagcgggacguguccugcaccccucgcccugcauacgcaggucgggggcgagccgugugcgggagcgggucagcugcggacgcggugggaugcuucucuacccugcgcucucccugcucccaagacuggcccucccggggguccucugcugcagcgcggccucaggacccugccuccggguaccgccacucgggacgcgggagcccugccccggggagcagacgagcugggcggagcuccagcgaggagcuguagggcaaagccugacccggggacugcggucaccugaacgaaacuugcaagagaaagcgcuccuuucccggaauuuuuuuuuuuuuccuuuuuucucccccuuuucccauuuuugcaagccuccaucgaaaaauccugucucaggaaacguuccuuugggauucgcacuugaauuagcagcaccccgaagagcuuaaaauaccgacuuuaucucggggaccacggugccagcuugcgugguguguuuccgauucgguugaaagcguauuuccuuuucggggagggaggguggcagcgccuugcaaggacgcuccagcucgccgcuuagucacauaccacugcucauuucaguauuguuugacaaaacaguuuuccauaccgagcagaggggcgccccucaagaucaagaagguaggacuagagcuggagguguagauagcuuuuaauugaaguaauucaugggggugcuuuucuuuuuuuuaagucccuuagaagauuugcggaguuuuaucagcuuguaaguaccgagguacguggugguuuucgggagauccuggaacauaggaaacgaugcuuuuuagcuuuccuuaacaccgggugggggagggggguaggagugggggggggccuauuuuaguuccacuauggcucucccugucuugccuggaacucaacaaauuuugucugccagcucugagaauaaaggcuuuugcuaccaugcauggcccugggagcagguuucagauuaaauuucuaccauaaaacuuccacuccagaaauguucuaaggaacuuugaaggauucacgcaguaucuuuuacuauaucuuuuagagcucccuaucugauaguaaucugauagauucaguagaugagcccuuccuguguuuuagugacuuacaugcauucaugguuuccgaaggagucugggaaaugguuuuuguuuuggaacaaauuccaggcuucuggaugugcuaaccuuuaaguaugaguccuguguuacuuaaagucauaucgugaauuuccuguuugguagaaucuucuggguaauugagauugugcaauuguguccagcaacagaucacauugcauuugcuggcucaagcugcuuaagcuauguugcagaugauaccaacuuggacaucuuucucacgagucuacagaauggcaguuuacacuuuaaaggaaaugucaauaauaucucucauguauuugugauugaucuguugcaucauuguuucucuaauaguuaccagcuccuuaaguaucuccauucuucguuccuaauugguacaguaccaggcguuuguuuccauuugaaugcucagggagugaagcucaggggcuucugggauggugaauuugcaagguuuccuguggacaccacuguccuggcagaagagccagcuucacagugaagugccacagugaaaccaacuccacuuccucuagugcugcuguuuucuguguaauauaauugagcacaaccucacaauuaaauagacuucuaccaaacagcuucuuaaacauagguagugcuggcccagugauggaacgcagugggacagcccuggccuugccugugggaggcccugcauuccagccccagcagcagugcaccacacaaagcagguugcuugaaauaagggcccaaaagguaugcagcaaaaauccuguuucugcucucagcccugcaugcuggucuuccagagacaaccacuguuuaguuccuugccugacauuccagagagguguaguuucuagcguagagauuuacuauguagccuauugaugaggaaaagauagcugaaauugugugugacccagcaaaugucaccuucaguuagauuugcaaguguuaacuucucucaaguuauuugaaauuguguuuucaauuagcuuuuuaggugugacugaaaaauacuuuuuuguuuguuuuuugagaugagcuguccuagaauucacauuguagaccagacuggccuccaacuccgaucagcuggacuuugccucucagagugccuggauuaaagacuugcaacacuacaccugacuucuugaauuucuuuuuuaauccacuuugaggccuguguucccuuucuucaccuucguucucugagauaguuugauguuggggaauaaugaaguccauuugaauggauauaauugagggggauuuaaacugagcucuugagaagagaggaggcuguucuacuggugacaguggaauaagucaggagggaccugaagucucuucaaaaaaggaaucucugaauuggacaugauacacuuugauuuguaacuuaauuuuuuucuuuuaaguuuaagauuaauuuuaauuuguauuaugcagugagcgacaguaacaaaaaacaagcagcaaacuguaguauuaccaacugugacucaaaguugaaugagagucuagaaauugagaauuggcuuguuuuuacaaauaucuuucuuuuuaaaaguguaaagggaacuaaacuaaguucucuaaguuuuaaggaacuguauuuacugccugaaaagggaaacaagcaaaaucauuaagaccacauuguugcaaagcauugauugugugguuugggacauaggggaaaaucuuuguggugaauuuaaggaaauacaaacgggaacgucagugucuuuccucuggggaaaggggcucuccagccccuugcuggacacacuuggguaccaugccuugggagugagaauuaagaauuacuucuagaucauucacagcuauuuauucauuagucuggauuacauaacaccaaacucuggcuagaaucaaggcuagauucuugagcuaaaaguacagaacgagacagcucauuuugucauugggcuuguagaagaauggauggauuuaauggcugcauuuuauggguugcuugcuguguuguaggcauggagaugcuuaguuuaugaucggcauguagacauguaacaaacuuguagcuaaacaugguaauuucuucuaacuaaaucugauuuagcaugcuauauaggacaagauuauuccaguaaauauaacaaaaauaaaugaagcuuuuuuuuuuuaaguauuaauagccauucaccauuaguuuuaauuagccagggaaaaaaaauaaaacuccacaauuagguaugacuuuucacucuugacgaccgagaaggcugggccuuuacuauuaguuguaauaauagccggucucucuuccuucccuuccugccuuucuuccuacuuuccuucaggacacagccuucuggucuugaacucuugauccacuugucugaggcucucuaaugcuagggucauaggagugggccaccaagcugcuuuagcugaccuaucucccauuuacuguuuugugacuaaaaguagacuaguuaacuggauguuaccagucuuaauaagcauuuagguuugaggccaaccuagccucacucagcagagugaacucagugcccuuucucaagaaaaacaauaaauaaacaaaaagugcccaccaaauaugauuggcaagaggguguguguguguguguguguguguguguguguguguauguauguguguguguguguguauguguuuagauuuauuuauuguuauuuguaugaauguuuuguuugaauguguauuucuacaccacaaagugcuuggugccucuggagcccagaaggggguauuggauccucuggacuuggaguuacagaagguugugagccaccagaagcccuugccagugcucauaaccacuaagcaucucuuccccagcucccggcaaugguuuguauggauggaggagaguucagcugagcuagcuguagaguuuauuuuguugaguuccguuucccacucaugaugagcacuacaccccaggccucugaguucugccacuuuucaguuuugaauauugaggaguauucuuuugauuucucuuuaauucagccucagagaugauauguguuggcuuugccuucuguggacaauguugggaauugugcuaaacccuuaaagcuuaggacucaaaugucgaggaguucccuggaugcugucacuuucguauuaacuggcaucuuaaugugauucuuugguuuaucaugaucuucauuuaaggcauuaucagucccucucuuucuagaguagguggguugcuuuuccuucucucucucuucugcaucuuuaguaacggaacccugggggcuggugcacacuaaccaugggauccagugagcugcacuccagccuccaggcuggcguuuuagccuaguucuguggaugagcugggguuaacagaagacccugugcuguaugaccaucagcuagagcugaauggaucugggagcaaucagaagggggaggguuugcagcugcuaggaauccuaccuggucauauuugccuuuguaaagaccaacuucugugcugaaaaaguaagccaagguggguugcagacagagcagagcuggggucuagcucccuagcuuuucauuucuguuccuuaacugaucgaggcacuaacuaaacuguuugugguuuauguaagcacaagagagauaaaucauggcagggacuugaccuaugcccuguacucuucauccacaaguccaaaagugccagagccagaauuuuuguugagcucggaaauucaggguacuccacuucagcucucuaaauaacaugcuuacuucaaaauuuuuuuuuguuuuuuuuuuuuguuuguuuguuuguuguugaaggguuuugcugccaaaaggaagggaucaaagagauuagcugcugaguucagcugaaaaagaaagaggagcugcuggcaggcugaguguuuucuaacaucuuugacuuccaggcuuuuucuuaauacuugcucauauuuuaagucacuuguaucuuccucagaguauccgagcauuuaaaaucacauuuaucuuaaucuuugguucugugucuguuuuccauuccugccuuucccucauuguguuacuuggcacugauguuuuugucuguaagacuccaaggaauguuaacuugaauagaugugaccaauaccugucuacagauaccuuguaacagcucugcucuguccugucuuggcugucuucaugugcugcacacucucuggcucucuugcucucgcucgcucgcucucucucucucucucucgcucgcucuauacacgcacacacacauacacacacacacacacaucccgccuacacacacugcuuuaucaucugguugcagaaaguaaguuccugaaaacagguucccauggcaacauaacagaaagguaauagaacaaauguuuauucugucuagaccuguugucugacuaacuguagacccugaacauguuugcuccugucacacugaacaaugugauuacagauuuccuuguuucccucaaaaccuccuccuuguagaucuuagugggguugccacugugcuugugacgugaaggaagcugugugugugcccuacugcagguguauacugguuguguccccaagcuugcaggccacagcuuaccuaaaacagcagcaguugcuccuuuguugucauaaguucuuuagcuuaguauugguaguguuaagcguuguuuauaaaguccaaagaaagcaagggaccuggggaggugccauagugcuugccgugaaagcauggggccgugacuuggaucuagacagcaugugaaagccggacacagcacaugugugagcucagugcuggggugcagagacaggaggauggguggagccuuuggacuagcuggccagcuagccuagccaaguuagugagguccagauucagugagaaacccuuucucaaaacacgguggaaggcaccuaaggucaaccucugaccuacacacaugcacacacaaaagcaggaagagaccuagguugcuuuggaagucuuuguagcuuuucuuucuuucauauuguucagugucaucaucucaaaacuaccuuuauauuucuaaagacagcccuuccccuuucaagugacauucuaguagcuugucaaaucuagggcagcuugaugccaggguauguauuggaaaucugugucagagaaccauuuccaucuggugauucagaucuggaaaggaugacaucagcgugugcccacaagaggucagaaaacaaaacaaaaccucuuuugaugugugaaggcucugggaggcuguuuuaguuaaauggggugugagaguaauuggucuugaucuugagcccuuugcucggauccacuuggaccauugucaugcucauaaucaggccuuugcucuuuccuguaacacgcagcuuggggugucuggcuugugcgaguacugaguucaucuuguauuacugcauuccuguagcagaucuaauuuaauucccagaaauaauuuuuuuauucuuaguaucuucaguaggugacuccucuuuacccuucccccuuaaacuucacuuagggcuuuugcuagcucuaacuuccuugaaccuagguuuagaaauacaucguuuaaucuaccaguugccagugaagacuuuaguucuuucucaucuguaaaaaaagaaagaaaaauccaacucccuaguaaucauugugcaauucugauguugacaucuuguguugacauaguugugauuaccugauuguguguguguguauguguguguguguguguguguguaaauguucuugcauguguguuugcauauaugcaaagaccagagguuaacuucaguuauugucgacuaucacuuucuacuuuauuuuuugauaguaucucucacuggaucuggagugcauggauugcuuagacuagcuggccagagguccucaggaaucuuccuguuuccaggcacaucgucuccuaccuguuuuuuguugcugauguuguuugguuuauguugauacugggaucaaacucagccuucauacuugcugcuggagcacuuuucugacugaacugucuccccaguucugcccuugugugaugcugcagucuggcuugcuuagguuucugauuccuuaugucguguucugagugcccuaugguugggugaucucuuuugaaaugagcgacucaauguuaaaugauacugauaccaggcaaaagguuuaaaaaguaacaguguuaucugagauguuggaaaaauaguugccugguuaagaacacuggcuguucuuccagaggaucuggguucaauucccaggacccacauggcagcucacaacugucucuaauuguagucccaggggauccaacaccccacacagacuuacaugcaauacacaugagaguuuuaaaaauugugaucuguuuuuuuuuuuuuuuuuuuuuuuuuuuuuuuuuuuuugguaucucugaacuucuuuacauccccaaacaugguguaacauaggguucuugguuugugccuguucugagcagagggugauacuuuguugugggucugacuggguauuauauauuuaacagcaguguuguccccuaaucuuaagauuuaugacaauuucccauugugacagccagauuugucuuauaaguggugccuuauguugggggaggguuggaaauuagucaccuuuaauugaaaacguuuuacacaacaguacauaucuagaauaauuggucuugacuaaaaccuauaggcuaacuugaacacuguaccugucagcagagaggaaugcuacacauggggcuuccuucagcaugaccgucauuaucuucaggagaacaugagaaagcauuaucgaggucccaagcuuacugugguuagaaccgcuugcacagaucguguguuggccacguggguagcuguauagugcugugaagaaacaaugaaugugaauaacuuuguuuuccuuuugucgugauuccucuuaggacuuguaaauguuucuggaaaggaaagcuuauugaguauguuagcauuaaguccaaaucugaagguagugcuuuucccagcaucucugguuuucuuuucuugacuuuuuuuuuuuuuuuuuuuuuuuuuuuugguuuuucgagacaggguuucucuguguagcccuggcuguccuggaaacuuacucuguagaacaggcugggcucgaacucagaaauucgccugccucagccucccgagugcugggauugaaggcgugugccaucaugcccggcuaucucugguuuucucgcccuuuuucuccuacuguaaucuuucaguagguagcucuuuucagaguucaaauauacaguguucaggccagccaggacuauauagugagacccuaucucaaauaaaauaaaaauguuagaaaagcaagagaauuucaugugaacacagaacaagaaguagcaguguuacccauugacgugaccagcuuaugcuugacacaguccagauauauaagccaucccuggcuuggagcauaccaugcacacuagccuggcugcagaucaugguagucuccuucuuucuaccucugucucugcugggauuacaggugugcaccacugcucuuauuuugaagguucuuguuagcauuuuagucuuuaaaguauuagacaguuacagagggugaguuuuuaguaaucuguggauuccagcaguaacaaaaaaauuagcuuuauucuugacucagagccuuccauuuacacucauauuuugguguuuccugaauuaaccaugguaaugcgugaaagguucuggcaugguaauaaauaauucuguauuagaauuuguaacuuuuaauauuuaaugcugugcuuuauaucuuuauuucuauguauaugugugccuguucacaaguuuguguggaagcuagaggugcagucuaucuucccucagacagagugucaucagccuggaucucuaguuaggcuaacuggccaacaagucccaggaauccuccucuucugucucuacacaguccuggaguuacagguacacaccaccacacccagcacuuaagugugguucuggggauagaacuuggguucugacagccccacuuugugucguccucauacuucaaagugcucuguuguucugauauccuguguuuaucuuugggcaguuuuacucaucaucgccaucaucauuuugcaucaugacucauuuuuaaguuuucuuuuucuauauauauccauuuugggcacauugccguacaaaaguacucuuggugguuggcacuccucuguugugcuaggaguggugguacagaccaguaauuccaguagucaagagguugaggcaggaugauuuugaguuugaggucagcguggggcaccuugugauaaucuuauaucaaaagaacuagggacaucuaaucuuguaaauuccgaguccacugagauguacaagauuuuguagcacccuaccuucccugauuaguuuuuauuuuuuuaaugauuuguuugcuuucugugcaaugguguucuguuugcaucaugugugucuuucuuucuuuuccuuugcuuugaugaaguacccugacaaaaguaacgugcaggaaaaagguuucucuuggcucaccucugaagaauacaguccuuuauggugguggugguggugguggugguggugguggugguggugggguuaaggcaacaggagccuaaagcagcuggucccagccaguccacagucaggaagcagagagugaugaggucaugcugcuguucagcucccuguucaggaucccagccagggaaugacuggguguucccagcccagucaguguaauaaagauaaucccucacgcccagaggccugucucccaggugagucuagauccugcucaguuaacagcacuaaccauuauaguguguguguuuauacacacuuagguuuaaguuuucgauuuacuguagugaagaaaauuuguugauaccuaucagacaguguuccagacucaccagcauguggaacagacugcuuagaaauaaagaaacugauuagggaacuauauucacauaguguggacauaaacccagaaguggugguugucugugcacuauaguauuuaggaugguuucauggaggaaaaaaguauugagaguuauuuugagagcugaguagacuaaucaguacagcaggagagaauaucauguaagugaacagaugccaagaggaccagccugaccccgcugcggcucucagcuguguuucacagucacucgggagucaagauguaggucuacaauuggacucagguaacugcuuucccuaauaguugacuuguguuccugacuagcagaacuucuguacaaagcagagagcuguuaucuucacuuauacaguggaagaaacaguaugccuuuaaucccagcacucgggaggcagaggcaggcggauuucugaguuguuccaggacagccagggcuacacagagaaacccugucucaaaaaaccaaaaaaaaaaaaacaaaaacaaaaacaaaccaaaaaaccaaaaaacuuccuguuugaaguguuggcuuggacugauuggaggaagaaagggcugcucuuguacagucggcugcaguuugucugcaggcaccccugucuuuuugacuccccagccuucucuauucuugaggucagcagugaucugguuuugguauguguuuguuauuuuuguuuuaugaucaggucauggcuaggugccaaggauaaaagauaaaccacagcuucugcucucucacagacuggaguaggaaacaaguaugcagaggaaaggugguucugaguuccgucuuuaaaggauuaguuacaauguacugccaacuguaguaguucucagguuccaucuaaggguuguagaauccauguacacuucuaacuuguagaaacuacagguauccauagauugacaaaucauggaggauuucaaggacucucaguuacauuuuaauaaucuucucuuuuuacuauuacuucagagauaugcucaacuugcagugugagagaaagaucuaaaaauacugagaguuuacuacaugggaagccccaugcuagagacugcaggcacagacuuauuuuauaguuggauauucauuucaacuuggaguauuuaaaacuaccuucuggggcuggagagguggcuuaguuguucagaguuugaacuguucuugcagaggauccaaguuuuauuccaguagcuuauaacugccugugaccucagauucagacauggccucuacagacaugguacucacaugcacaagcccccacacagacacaaacaacaguuuugggguuuuuuguuuuuuuguuuuuuguuuggagaggaaaggauuuauucagcuuacacuuccacauugcuguucaucaccaaaagaagucaggacaggaacucacacaggguaggaaccuggaggcagaagcugaugcagaggccauggacugaugcugcuuacuggcuugcuuccccuggcuugcucagcuugcuuucuuuuccuucuuuuuuuuuauuuuuuuauuuuuuuaauuagguauuuucuucauuuacauuucaaaugcuaucccaaaggucccccauacccuccuccccacuuuaguuuuuaauauaaagcacauucaacauacuuacuugagccucuucacagcguuuuaggcuaggcggggcuggugauuccuuguuuuauuccuuuggaaacagaugcguuaaagcuuuguuugggaucaucuccuaguaagugccaaacuagaacucauauuuugacuacugguuuguuuuuuguuuguuuguuuguguguuuguuuuuuguauugcaugggguacauuuaaauuugcuaauuggaaauuucuagaucaauaaaagauuuuuuuuuuuuuaagaaaaagauuucuuuuaugugcauugauguuuugccugcauguaugucugugugaagaugucaguuccccuggaacugaaguuauagacaauugugagcuaccauguggcugcugagaauagaacccagauccucuggaauagcagccagugcucuuaacugcugagccaucucuccagcccaauaaaaagguuuuuauuauuauuauuauuauuauuuauuuuuuguauaugaguacacuguagcuaucuucagacacaccagaagagggcauuggauggcugugagccaccacuugguugcugggaauugaacucaggaccucaggaagagcagucaguacucuuaaccgcugagccaucucuccagcccaaaagauuuuuuuaauguagagaaauacauuagaaauaccagcuuugggcuggcaagauggcuuagaggguaagagcacugacugcucuuccaaaggucuugaguucaauucccagcaaccacaugauggcucaacuacccauaaugagauuugaugcccucuucuggugcaucugaagacagcuacaguguacaguguauaauaauaaauaaaccuuaaaaaagaaaaaaaaaagaaaaagaaauacuaacuuugacuuaacauugguuauggagguuuguuuguuuguuuguuuggguuuuuguuuuguuguuuuguuuuuuuuuuuuugcccaaaagaaauccaaaccaaaaaacccgguaaguuggaauauuaagucauagugcuucuaacacaucuauccaccccaguguccugccuuagcaacagauuacacuguagugugugaacacccggcuuccugggacagaugcuguugcugagcauugggagagcaucugccugcuuaucaucagccuggagacgcucacgucagaauuccaaguaauuugguacugagugcuugccaucuucucagucuuaaagguguauagaacaaaguuggagagcaaauuagagaacaucuguagucugaauaaagaauuaagauguccuguugaggcagagcuuaguuccuuccccucuacugaggacuguacuugguggcucaguuuucuacuguguagaauguggcaggaaugaguggcugcagaaggaaugcuguaaaugagauuguaccuccuguggugcuuuuucccugggaacacugcugaaggaguaggauauccaacaucuugcuuacaggcugcuuugcaggccaugugcaucaggauagcuaugaauuccacccaacacaugcauagaugacaucauucuaucacaguucaggagguuggacaccccuauucuagagcauaguuucucagcucugauacacuuuggcauuuggggucaaauaguuguucauaauucuuggcuguuguaucuccuguaggaugcuuagcaagcagcaucucuggacaccaccuacuuggugccaggaacauucuucucuaagacuugguugugacaguccagaaugacuuuuggauguccucuagggaacaaaaucacccuuucuuuucuuuuuuaaaauaguauuuauuucauguauaugaguacacugaagcucucuucagacacacuagaagaggguaucagaucucauuauagauggcugugagccaccaugugguugcugggaauugaacucaggaccucuggaagagcagucagugcucuuaaccacugagccaucucuccagcccuaaaucacccuuucuaaagaacuucuaggggaagccugcaaagcagcccuguggagagcccaagauggcaagcacuacagcuaagagaacccuuggaaaaggauccuccagccucagcagguauaaaagugacuguugggcuggagagauguucagcaguuaagagcacugguugcuuuuccagaggaccuaaguuugguucuccgggcccacaugguagcucacacccauuuguaacuccaauuccaaggcaugugacuuccucuuuugacuacugcaugaacaugguacacagauauacauguagguaaaacacgccuucccaugaugaaaauguaaaaacaauuagaagagacuugcuaugguccaucucuucacugcagcuuucggggaaauagccagagccaccuugcuaaauagcuuccuaguucuugauccacaacaauaggagauaauaaaucagguuuaaagcuccacauuuugggaauauuuguuacccagcacuagauaauacccuaagugcuaucauaaaauguccagauauuguauaagguagaaaguucuguacuucgggaaguuagcuuguggagacaucaguccuuguguuuacccauaguuagguuuguagcucagauuuauacagagauggagccuaggaacuauugcuaugaaagcuuuuuccaugcugguagcuagaccauaguaacuugaguguaauaugguuagucugauauuuuagauuuauuugaagugaguuaauuaugauuacuuaaagaaauauuugcuauugagauuuugaaacagcaaaauggagaaauguuucuagugguacacuguaaugaggcuuuggaaaauagccccuuuuauaaaagaaggcacagugggagggacauaacacucaaaaaugcgguuuauaccuguguggaaaugaccuuauaaaaccccugauugugcuggagugguaaaauaagggccuuuacauuugucugaggcuagaggauccucuaaaggcaccuuacccguguggcuauugacagaaggccugguuacuaucuagaucucugcacagggcugcuacagucuucucuagaucagugguuuucaacagaggggacauuuuguucccuuggaaaccacauuuugaaagggagggggaaucugggugucauggcaugcacuuguaaucugagcacuggggcagcacagaagggcagaucuugggcuugcccaguccagccuacuugguaaguucuaggccagugagagaagagacccuuucucaagguaccuuuucaauuuaaaugaacuagacagugccagaauaguaguauguggcauagucacuuguugaguggauuguagauuccuuuccucugggcuuucaguuuguuuuuuagaugguuuaaggcuuuucuaggagugucugcuuuuggaaauuuauaauuuagagcagaaugcaugauuucuguucuuuccaaauacugcucugauagggagaggaagcagcauguuagugcauagagcucuagggcauuagcagccuuugcuggaggguuuccaacccacaagaacuaugucugaguaacuccugccugucuuguacauguaagguguauuuucaugggaguguguguccucuaugguaagaauuaguauguuguaaugagagcaugugauuagggaggaagcauuagacggucacugagcuggugcugcguuauaugugcggacaucuggugugacugcaucagugagaauaucacaaaaggcagauuugaaaauuacuugguaaaaugaaaaaugauugugauuuaggaauguagguuucagauuuacauauggugauuauguccguguaaguaucauuagaaggaaauguaauugcuacuaacuaguaguuugcacuaaguugaaaacaccacuaagugacagagcagcagugugagucacguaucucacucuacuaauggccuccaugagaaaugaaagcuuguuuuaagaaaaaaagagagagagaaaauggaaacauacacuguucaaaagaguguaacaaguuuaggauauauuagauauuuaugcuguaugaauacaguauuucccuaugauagaaucauuuucugcuucugaaacuuguucuuuugcccucaguacaugaaagagucuugcucuuugcuccaugugugugaacggagaauguacuagaauuuuaaaguccuguuguuggaauuucaaguaguuucuaguuuuccugugaccaggcugcaacagauauguacuuugaacccuauuuuguuuguaucugugccgauguuuugagauaugauuuuacucuguaguagacuggcuucuaccaugucccaucugccucugucuuccaagcagaaggauuauaggcaugaaccacucacuacuacucccagcuucagugugugugugugugugugugugagagagagagagagagagagagagagagagagagaggaaggagauccuuuuuuaaagauuuauuuauaugaguacacugucacuaucuucagacacaccagaagagagcaucagaucccauuagagaugguugugagccaugcaguugcugggaauugaacucaggaccucuggaagaacaagaagucaggaaaagaaugagagaaugagaaugaauaaaugaaugaguaugcaucauuacagacuuagacuuguggaugucggaggacaacuugcaggagucaguucucucuccuuccacuguguagguuuccggggcuguauucucaggccuggcaguaagugccuuuacccucucaucuuuucuuuaccugcugaaccauuucacaggccucgguauauaugguuuuuuaauccaggauuuggagaaauguuuaacugucuguuggcuguuuaauuggucauuccugguaucuugugcauuuuguuaucccagguagauaguaaguuuugugacaucagcuaccauauuuacuguuuucuuuuguauucauaaaauaaaauaacaucgcuuggugguaggggcacucaccuuuaauccaaggacuggagaggcagaggcaggcggaucuguguguccaagguuagccuggucugcagagugaguuccaggauagccagggcuacacagagaaacccugucccccaaaaacaaaaccacaaaaaaagaaaaaagaaagaagcccuauaaaccaggagugguggcaugugucucuaaucccaacacacaguaacugacaagaaggucauacauucaagccaguguagaaaauuuagccagacacugucucaaaauaaaacaaacauuaguaaaggguaugcggcucagcuuacugaccaguauuugucugguguguguccaacccugagggaacugggaagugcuaauugaggaaacugggguuuugagcccuuuguaucacgauggugagggaaacagauggacuucuuguccucaacuugcccagggcagguggcaguaggagucauuauuaaugucugauaauugaguuuuacaaaauuugcuaaaccugccauaaaaacuaguaccuuagguuagauacagacauuauauuuguuuuauauaugagguugguagaauuuaauuaacuuccucaagaguuauuaaguggcaaagcuaguauuaaaacccugauaguccucuuccagagcccagcccuuguuuaacuaccuggugggugguaaauaaacauauacuaaucauugugauuauuggggacuguagggucccugugcggcaucuguccuccacugaguggcuagugaagucagaggguggaaccugccccucuugcucuggagcuggcugcaaaagagccuggguagugaucauaaugggcagcuguucugcuauccagcugagcugaacuuguagguguggccacauccugcuggcccucccugcuccccacagguucauccccaaggagaggacagaguuacaaaggcugcaugaggcaugacacucagaguggaaguugaagaagccacauugugugggggccauggccauuuccucaguuucuaaccacacacugguaaagggaagguugucuuauggucuuauggagauaaagggugaaagacggagagugcuugccucagguggguaggaaccccuguggaggggugacucugccuauauauacuugaagaauaaagauuuaguuguggggugggugcggguaggcgagaaggaacuagcagcagcagauccaaauaguuuacagaacugaaagaagccagcacaccagagcaggccuguggugggggacuacugauugggugagcccugggauugggucaacucaucugaaacuuagacagcgguaggaaaugugcauuuuuauucuguauuacaagaaaauuccuugaguuuaaaauagucauuuauuauuuugaaauugcacgucggagggcagcuuguaggacggaucuuuucaccuugucaaguucuuaagaauuagguaucuucuggaccgcccacaguccugcugcccagaaaagagauuucaagaaaggauaggcuuuggggguuuuguguuuauagauggaauuuaacccgaaaugaccaguuguguaguuuucucaucccugcaaccaaacaccugagaggagaaaggagccagggcuuacggucuccauuucacagggcucccccgugcuugccuccauccauacccucgagcagagcacgugggagggcauaccgugggcuguucuguacaccugagcuggcaggaaugggacagaagagagggugcccaaccaaacuaucuccuuccagcuaagcucuaccaccauagugaaaacacugaagcuuuucucuuuuguuuaguaugaggugauguacuguguguucuugugucguggugugcguguauaggacagaggacauuuucaaguugguuuucgccuuuuaccauuugaguuccuggaaucaaacuuagguugucaggcuuguacccucauccacugagcuaucugcuugggcccucccaccuccaaagauuuuagaauucucucaaucuggaaauggcacaucuguuguuccaguguucagaagguggaggcagaaggaucaggaauuuaggauuaucuucagcuugagagugaguguaaggccaaccuggauuuaccuaacagcaaaguggugcuaccagcugggaaccaaguguuuaacccaugcgccuguggaggauaguucacgcugaacuguaacacagcuguaaaggagguuauaaagaugagaagaugaaagccgcccaggacccuccccugaagaacuccaucaucaggagcuuauguaguacaaguaugugaugcagagaaagucccagaaagccccauguccauuguaggauugacaggaggaagggggagucugaccaugccaaaugcuaggccagaacacuggccgucugacgugcuuaccgagcccgagcccgguagugggcuugagaagagcagcuccagcaggcuggauugaaggaugaauggagcugagaagagcauugucugucuagcugugcuucucaaacuuaggaacugugugaaucacauugucacaaugcagacucugcucugugggucaagauccugccuucucagggagcucccaggcagagccaggaccacuggucuacagagugcacuuugaacagcauagguguagguuaacagcucuuguuuuaguuagugcaugaaggcuuugagaauugcgcucucuucaguuucugauuuguagcucuaggaugguguguccaggaguuuccuuacuaauuaauccuugggugaagcugacgugaaugguucccauaccuugagaauuuggagauuauuaaguuuuggagaauuuuuuaaacugugaggaagaucaucaaaacuaguuaaugaauauggaaacuuucuagagcacauucugagacaagugagacaucaguguguaaauaacucagugguagagcacucgccuacccaggguucaguuccgugugugugugugugugugugugugugugugugugugugugcgugcgcgcacgcgcgcucgauguguguccauguguaugucccacgucccccuacgucccccuccuccccuuugugagucagcaacacgcaggaggaauguuguugagaagaugugggacggcuccaaagcacagucuuggguuugaucagagggcauguguuccuuagaguaagagagacuauggagaguguuggcugagggcaucuggggugcacagauccacagaagagauggagcuauauggaucucccuuugcuagcuucuguucucucaaggaaagggagggagagaagggauuggaaguuugagagguggaaaagucaugagaucuuuuuucagaguagagaaugaccuugugaguggagucacuguuucaguguuugcaauuauguucagaaguaaaaacuuagaagcagucugauuguacuuuuuuuuuuuuuuucaaccguagcuagccuuggguaauuaggugguuguggucaccuaagguuagacuugauccaaggagaggguacaagggagcaguuaggagguugaagacaggagagcuggagacacaauugaugaggucagcagccucgaugcacucaagguagaguagugaaagcaagccgaacgguuggaggggcagucggugcuggagagagauggcugaaauauggcccugcaugagguggaguuuccggagaggucaggaaacgggauguuggauaugcccuccagcuggaugauauaguugccaagaauguuaucaaaaguugggaguggagggguacuuuucugauaggacagacuuuuggagggugauggaaaauucuaguccauagauaauagcaacccugaagaaggguugcuagcaagggcuuuuagaaaacaaauagaaagugaugucuugaagugccguuaccgcgaagugccuguucugugagagaaaugucugugguauagccucagaaaggaggcugggaaauuccaagaguguuaccacaaaucaaauugauggcgaggauauguguagguuuggggguaaaaggaggacuccugagcaggacagacuggugugcaauuguucugcacuagccacugcgaugcugcacuggcgucauguugcugcucaucccaccuguguucauucaguggucacugugugcaucacuguugugagugcuuauucuccucugucacucuucccacacuugaggacuuccuacuguuugugcuucagucucugggaauuguccagcacuuggaaggcuauucuccuggaagcaccguaauuucuggggccuuuacuuugaccagcacauagucuuuaagauuaucaguguguuggcuccuuggacaggcugcugccugguuucaugaaauuuacuagaaaacagccauacccauuuuauagguuccuauuauuuggcugcuuucaggcaacaacuacaagcugaggaguugugucagggaccuuaccugggcuuuggagaguaaaaugcuacugucugcgccucucuggaaaaugcuuaccaacugcugauauagacaaaagaggcagaaagaagcaucucaaauaaauaggugccuucucuggguggugggugaugagucauuauagucuuucuuuuugugucuugccacaaauuuaauuuggaaaugaaauagccugaaaaguacuaaaaauaguauuuggaacacucuuuuuuuuuguuuuuguuuuuguuuuuuuuguuuguuuuuccagacaggguuucucuguauagcccuagcuguccuggaacucacuuuguagaccaggcuggccuugaacucagaaauuugccugccucugccucccaggaggcagaggauuaaaggcaugugccaccaugcccggcuuaaaauaguauuuggaacacucuuaaugguggguucuguuguuuuccuuacaucagugcugcuuuugauacaaagacggggcaucguguggcaguuaagaagcugucgagaccguuucaguccaucauucacgccaaaaggaccuaccgagaguugcgucugcugaagcacaugaaacacgaaaaugugaguaauuccuuuuccugcacacacugaaggcuuuguaugcaauccugccgguggaugcaugucacacugucagaguuggguucaugccgcaugagggcugcagcuuuggugccauggggcugucagaucaucgcgaggaugaccgagugccucuucccagaguuguacuuuuacuacaggaucucaagaagcauuuaauuuucuauuuuuauuuaguuaguuucuguguauguuugccugcugggguuuaugugaaucaugagaugcaguacccuuggagaccagaagaugucagaucuuuggaacuggacucacagaugcuugugagccccacugugggugcugagaaccaaaccuggaggcucugcaagaguaacccccacucuuugcuuagauauuaguguuugguguguuuuguuuguuuuguuuuuuucuagacacaggguuuuucucuguauagcccuggcuguccugcaacucacuuuguagaccaggcuggcaucgaacucauagagacccaccugccucugaacuucaaguguuugaauuaaaggugugagccaccacaacuggcugugauuuguauuuuuaacauguauguuuguuuguuuguuuguuuguuuguuuguuuaagacagggucccaguauguagcccugauuggguuggaauuacggagccacucuccagcccuguauugcuuuguauuuuugaacaaagcaggcacggggggaaugagaaaagaucagaauacuuacacuuaauguagaaauuaucucaccuuucagucuaucaauauuaugcagugaagaacaaagacuugggacugaagagaugucucagugccuaugcgcauuugcugcucuuguagaggacccaagauugguucccagcaccuacauugggugauucacaccugccuguaacucuggcuucauggguucagugccuucuuccucuucauccagggauacacacacacacacacacacacacacacacgcacucacgcacacacaugcaggcacauaggggcaggggagagaaagacagacacacacagagaaagagacacaaaauaaauauuacauaaggcaggaaucccaauucuuuuuucugucugauacacuacuggcuauguuaacaaauucuaaaaagauagacgguuuuuucaugguauuaugugacgugauaagcagguguuguggcacacaucuguaugaacuugggagguggcagcaggaagaucaggaguccaaguuagccugggccauaugaaaugcuaucugcaaacacccaaaccccagaaagaaaugauguuagcaaauauaagacagaaacacagucuggguagaaaaucaggacacugagcacauggguguggcugcacuuggaguuaguucuaacuaaaacacuggagugguacuguaagaagaccacuacuuucccacuguuugauuuuuauguguucuugcaggugauuggucuguuggauguguucacacccgcaaggucacuggaggaauucaaugacgugugagugaaucuucuguguuugcaggcucagcaagaggauggggaugagcagcccauggaacugcucagcaguauccaaccucagaagauuauucuccaccuauucugguuucuugggggagggauacauaaagugaauauuauguauggugcauuaggacacaguguggcccauucagagccaaugaugaguccuuacaaaaguuacacagagagggaguauagggaauuuugguuauaauuguuuuuccauaaaugcaaguccacauagguguuuccuucuuugaucccuccugaugccaggugauacugaggcuacauacugauacuuaaugacaucuuccagucugaugccuucuagaaagcagagccuggaagucccaggaaccacaaguagaggccaggagaaauaaaacagggacaaaggggaugguaaugcauggauguguuagugagagcaccuggcugggaacugccaggguguaggagcccuacagaaugcaccucggauggggcuguucuucugauugcaacuaagguuugcuccauuguucaugaaugcuuugcaugcugacacacaugugaugcaagacagcaggugucuugugcaaauccagccuucucaccaccauagcuuuccuaguaugauuaacacccguauuaauuaucaucuugacagaagccagaaucaccugaugggccucugggcaugcggggggggggggggggggcgguugucuugacuauuaauugacaagggaagagccaucuaaacugugguugugacuguucccuaggcagggcaucugcaguuguguaagacagaaaaggcagcagagcaguagcaucuaguucaucuugcuugcuggugcagugugaugacuguguacagcuguuucccuuaaaaugcuuaugucagcuuguuuaucaaaagaagaggaaaagacacagccccaccccaccuaaguaagagacacacugcgcugcagaaggggaaacaucuuaagcacagcuguacguuuggucuuguuaggauucucgaauuccuaagugcaaaggauguuuauuguaaaagcuaaacuguaggucaucacugcucuucccuaacuucuuguauuacuaagccaccuuucucuacgacaugaccaaagaaacuagcuuauguaaagagaaaaauggguuccuuaccuccugguuuuaaauguuucacaucauagucagaugagcccauggcuucuaggcuucugguagaggugccagguagugguagagaguguugguauaacagaaaccacucaucucauggcuaagaagcaaaagaaaggacggaccaggauuucacagucugcagucacaccccugaugacuuaagccuugccauguugugggaauuuggaauuuugguuuccucaagaaaugcugugcuucacagaaguaguguaugacuguuuuuguuuuagucccggguauggggauauggugcugccgugcagcagcugacugugauuugccuuguccucuagcacaguuuuuuuccagcuauagauaguuucugcaauuguguaauguuuggaauucuggaaacuuuuuacaaaguauguaagugcuagggccucaaugcuagguugauggugagugguuguuuaggagggcugguugcaguugcuaguggcagugcucaagaaaaaccagaagaaagaaauuagauucagggaucucucucucucccucccaccuucccucucucuaucuagugaugggggugagcccaggggauaaagggugggaaaaagaacccacaaaguagcaaagaccggcuacauuacaaagaccggcuacauuauugcccagagguuuggcugcuuuuguagcacccuuggaaaggaagccauugacaugggguugugugggguuauugcucaccauccacacuauaccaaccucacuccugaugcucccagugcaaaaccugcuucucuccauucuuucuuuggaauguaugcccacaccauuugucuuuuccaacagaacaagcagacagauacauuugcucucuugugucaugucuauagaaaagggaaaaacaagugaaugccaaagauggagcaggagaggagagguggcagcgggagggaaggcagcuuggccccuguacaggagcucaaccacauuagcucaccugcaaaugcaaguuuaggaagcaagugaaaggaagacuggcagugaguaagaacaguguccgccuguccugcaguccugucucagcagcagaacagaggcuccacccacacaggcugagcagacuacagagcccugcugcagccggugcuuggaaaagagaaugugguggagucuaaaugagaaacaaaugcugcugcagucuuuugugaauuacuuugaaaaacauuggaguuaggucugaguguuaaccuaaguuuuagugaggguagacucuaacagaaaaaaaaaaagauuuguggacuccaaguauuggguuuugcuuugauugagcauucuggaaucaaaaguggaccuauuuuugcuacauuaaaagggcacuaaugaaggcugaugucuauuugaaugguuaaauuuuauugucuagguuuaacccacccacuaccagcauuuaccccaguaaauaaaguuguauucauuuauuacaacuuuaaaguuagucuuuucaacaagagcagaggcuucuguuuuuaccucuagcugguuuuuaacaacuuuuuaaaagauuuauuuuuuuauuguguauaucugucuguacacauauguauguauguauguauguaucuggcauguacauaccugaugucuguguaggucaggaaaguaugucauaucuucugcuagaguuauaggugguugugagccacaguguggaguccugugcaagaguagccagugcuccuaaccccugagcccuccccaguccuagcucuuguuugagcaaagcagcucucaagugcugucugguagguacugugcccuaagugcugaguaccugcaagucaguuaacaugcuuuccaugagaacaguggagagccuguuucaguagggaguguuucauugcugacuguuugugauguugauaccagugaaaagguuagcacccuuccagaacagagcuuaucucuguguucuccacauacuauacgucuucacacagguaacaagaauagugaguguaguguugccgauugagccucgaaaccauuuguguucacuaagaaaaaauugucgugcaaacagcauacuaaggauuagagacuaaggcugccagaugcauagcaggcuccaggucugcaucugcacuucccaugcuagugagcaaggugugccacuggcuuuccugugcuuucccgagccugugcguuuauguuucaguuacugcuuuuccuuucaucagauggcucacauuuuugcuucaucugaaagaccacgcgugucuuuaagaaaggagcaauggacuggcaguggacuguuuuugcuugcaagucauggagguggcuugggaagugagcacauggaauucugacugcuguauaacagcaguugcaggacagguugcacauuacagagacacaaaugggagaucauuugagcacuucuccuguuguucuuaguucuugccuguacuggucaguguacagguaucauuguguauccugaauauuuacaaaugcagaaaguuucaaaagacuauauuacuuuuuuuuuuuuuuuuuuuuuuuugguuuuuucugagacaggguuucucuguguagcccuggcuguccuggaacucacucuguagaccaggcuggccucaaacucagaaaucuaccugccucugccucccaagugcuggcauuaaaggcgugcaccaccacugccucacagucucccaaacauucuuaaccaagcugucuuagcugaguaggcaggggguacuuuuaggacuuuuuggaaauacuuucuucaacuuucaggaaagccagcuuauaucagaguaaguggaaaugggacuuccuucccaacuuacaacuuuuccuccuugauuuuuuuuucccuuccuuuuuuccuuuucuuucuuuguuuccuucacucauuuauuugagacaggaucucucuguaucccuggcugaccugggauucccagagaucugccagccucugcaucucugcuucauucacucuuuauauuuguuaguuuaucuuugugauggaaucuccugcaucccaggauggcuucaaaaugacuguguaaccaaaaauagccuugaacuccagauccucaugcauuuuccuaccuaguuuaugcagugccgggaauagagcccugggcugcaugccgcugagcaagcacucuaccuccaccagcuuagccaugcucauuccucugcucaguccugaagagacaggaggagucucgaagucugcugugaucuagcggaugcacugcggggcacuuagcagcucucauuuuaauaaagcuggagagcaguuggucaccaagcuggccuugcuccugugcagaguaagcuugggcacugugguucaguuaacuagaacugagggcaucgagucagcgaauacauucugccaaacacgguccucauccuugaggaagacagcaaacauguucucuaaucauugaguuuaaauggccacauagugugcagugugguagguuugggagacccagcauggucuggcucugugcacucugaccuuguguaacccacuuuccacuugugucucucugucuuuguauucuuucuaauacagacaaccagccacaucccagcaaggccucugccugcucuccucacagccuggccucuccacacuugcugauugguuccccucagucccauacaagguucucuggaucagaaccuuuauuccucucuugugcccuagcugggcugugaucuccaggcacuaucugugccuugcucugccugguacuuugcaaauauugucaccauauauuucugucuguuuucucccuugccuuguaaccucuguuagaguagggugcuuuccuuuauuccuaauuguuaguguuuggagcaguagcaggccuaccugcagauauuauuuguagaagaaaugagugcaagaacuaacaaguucuaggacagccaggguuacacagagagagagaccuugucuuuaaaacacagaacagucaaucaaaaagcaugucccacucaaguggcuagaacuguaaaacaugcagauggucugugcuaucagcuggguuguuagcagcaucucaaacuuacagaggacuugagugucagucuugucaacugacacaacacugugauguagacuuagcaucucagguugucagaugagggaacagaucgaaaccuuuauugaauaagaaugugaacaaaacugcuuccuucuugguacucuggcuccauuuccuguuacauauccaaggccauaccugcaccacuguguucuauuguauuuaaagcccagugugcaacugagagccaauaaggaaguagccaguaggucagaggucacuggggaaaguaaggggcuggaaggauucucucucacugugaaugagggagaagugugaucauugguuaauugucagcuccugccgcuguuuuaagcccuguuuaaaucuggaagacaugcucugccuuuucuuaauuacuuuuggauagagcccauagugguggagaugccaagcuauaacaagagguuuuuguuuuguuuugaaccuucuuuguauucugauuuuaaaaagccugggauggugggaaucuuaacaguugguugucacccaaguguggcucuggagcagggcaguuuggagcucugaaaaucgucaauccugaguccuacuuagugcugguuaagagacagguuauuugucucacuuaaguuuagaggaugccacaucccaagugagaagcaaacuggaauccagucgggaacgucgucguuuuggccuugagcuuacaauauaaucucacuuaaucuuuuaaagaugagguauuggauagcuuucccacugcagugcacuccagccuuccuuaaauuauuuuaagaauuuacuauuuaguccagugauaauagcaagcaugucuucucaaaugccauuaaguacacucaccaggaucagauacugaagagacagacaaguggcucucuaguggugcccuuuucagauuauccauucugcuuuuaugguacugggguagaacaugugaggucaucugcguugugcuucuguauccugcugauuugagaaguggcuugccucccauagacaguaacuguggugcuugcuccuguccuaugauguaugacuugcuuuugaacuccuccuauauaugagcugaaauuugauacuuugguaauagacugaucuuggaucuugugggaccagcauggaauuauuagcugaaagaacuccaccauaaauacugcuuucggucaacuaguagcccaggaggggaguggugucuauuucugugcaagugacuaauuguacguacacgaugguuugaccgucucauccugcucuuacaaaugucugugauaaaauggaucaggagugcaggauccaccacuuaugucuccuagcucaucagagacaguugugugugauaggaagggggcugggagugaguuacauaggggcuguggagucuaaccauuugcugggccuguguguuugugugaugguugcagaugcgugugcacugugguauggaggucagaggacaacuuuaggaauugagcucaggcuuucauggugaguguuaccacccacagaguucaucuuaguagcccugcucugcauuccuacauuuaucagauuauaugccacuuugaagcuaaaaaugcacaguccugaagcagguguuggguuggcugccucuaagcccagcacucaggagggaggcaaaagaaugucaagggcagcucagguaaauagugagacccugucucacuagcuccaggcaugcgggaccucaguuguaagaguugcugccucacaugcacaagacacugguuccucagcaccaccaaaaaacaaaugacugggauaaggaaagacagucuuacuucauucaauuuugaggaacuguuagggaaauuguccaacuauggugacaucuguaaaauguuaaacuuguaugaguuuauguaugcaugccacagcaugcacguggaggccagagaacacccuacaggagccauuucucuccuuccauaguguggguccuagcaugggccucaggccauuaggcuuggcagcugccuuugauuauguucuuugggggcuuggaacaccacucaaaucaaaacuacuuugauaaaaacacuucaaagagucuaguuuacucuuuguuuuguuuuuuguuuuggggguuucucuuuguaucccuggcuguccuggaaccgcucuguagaccaggcuggccucaaacucacaagagaucugccugccucugccuccugagagcuggguuuaaaggagugcaccaccacugcauggcuacucuuuauuuuucuaaagaagguuuuguguguaugauagaguaugugucuguaugcacaugaguguagugcccacagaggccagaaaagagcauuaggucuucuggagcaggcagcucugagcugcccaacaugguuucugggaacugaacucaaguccccucaacagcaggaagcacuuucacugauaagccauuucuccagccucuuaauuuacucuuaaauuaugugugaaguucaccuuuuccuuaagacaaaauuuaggaaaauggcuaaaaucucauuuuuaaagucaaaacuaggccaagucccucuaaucuucauauagcagucaguccuccugagccucgugaggagaggaccccugccugcccucacuuacacaugcagcccuggugcucugcuaugcucugucccaugcugcugcugcaguaguagugagaguuuguguggcuugaguuugagagccuguuguccugaguguacucauacccucaucucacuccauaaagcaggacggacacucagcaucacaccugcgggagcucuggacugccuugcuccuccuuccuuuaagggagagcaggauaguacucauaagccuuuugcuagucauuuuugaaaggauuccacuuugaaaaucuuaaaacagccugggguuuaaugagguaaacauaggaugaugggauugcagauacgugauccuuuauuaugugaguacaguuaaucauacugcaaaaaugagacaauugaagggcaggggguguggcuuagaggccugaagcaucagguuugaucucaagcacuguugucuugcugugaaaaaacaacuuagagaggagagcauuuaauuuggggcuugguuacagcuuuagagguaggaugcuuucauggggugcaggggcugggccugguugggguuuugaaaccucacaguuuaucccaacgacccccuccaaucuuaguuaugguuaccauugcugugaugacaugccaugacccaaaaguaaguugggaaggaaaggauuucacuuauaauuucauauauaaagcacugagggcagcgacuuggaagccauggaggaaugcugcugcuuacuggcuugcucuucaugguuuguuuagccugcuuucuuacagaacccagaacuaccacuccaggggagcaugaccccugugggcugggcucuccccgaucaaucacuaauuaagaaaaugccuuacaucuagaucauguggaggcauuuucucaacugaggcucccuccucucugaugacucuugcuugugucaaauugacacaaaaguagcuaauacaccuacuacuccuucucaaacaguuccauaacugaggaccaaacaaaucuaugaaccaugggggccauucucauucagaccaccacaguggugcauaguccaucauacuagcacucaggaaguagaggcuggaaucagaaagccaaggucaucuuugacuaaguuugaggugaccugggccacauaagacuugccuuagaaaagagaagacagagagaaagaaggcacuuacagugcacgugcuuucugauagcguccauccaggugucucuucaccuccgugcuuucuuuacagaucaggaaaaggacauagcaaguaggagugguauaaauguggagaggauagugcauguaggaaggcaaggcuggugugguacuucuuaggcagucuuuccugcaucgguauauaacauacauacacacacacacacacacaccccuuguguuuccagguaccuggugacccaucucaugggggcggaccugaacaacaucgugaagugccagaagcugaccgacgaccacguucaguuucucaucuaccagauccuccgagggcugaagguacaggcaguagcuuugucauuuggggaagugaguuaucucucccguguaguaagaacuuagaaaagacaguuuuucuuaugaaaaacuuuuaaaagaguuacagaaucaaccaacccugcugcucuuguauuucccaggccaguuuacuagaaagcaaauauuguccuucccuuugauccuuuagucugaauauccaagagacuuuuagccacauugaaaaguuaguagcauccugauacaaccugguauccagucagugugauacugaggcuuuaaaauauucuucggggcuaugagcugcuuuuauauuccuucucaggacuugagagguagaaaaaagaaggaccacugugugcagccugagugccagccaccaaggcugucuggggcggggggaccucuucagaaccaccuuugauguuuagcacauuggagcccuuacugaagucauccucuagaaagaaaauaggcugacaacuccaguagguggagugggaauuagaguuuguguaauggcccgcugugagcgcgcacagugcuugacugaggggagagcacugcaagcacucuagaggauaugacaccaaaaagcugaagauggcuuucauucaaccuacuuucuucucuuuugcaguauauacauucggcugacauaauucacaggguauguauuauaccugacgugguaauuauuuugguaguguggguggggcuagaagagugacaucuaguucagaucucagccuuguaacugaaauagugauuuucugcaaccuuguucucaguguagaccugguaaaggaacacuugccauuugccugcucaaggcuuggagucugccuuucucucugagagcucuuccacaugugugcaucuuuaggaccuguagggagcagacucugugcauuguugauaagcucucucugcuugcuuuccaggaccuaaagcccagcaaccuagcugugaacgaagacugugagcucaagguaagaaagaagagauggacuguuugcuucucuuaaguguuccccagaaucgugaccaaccacacuuaagccacgacuugcuaucuaaaaagucauuuguccuuaggaauaucagacugugagacuugaacuaggcugaacaagcuguuuaaguaacuuuggaaguagaugucgguaucuuguuuucauuuuuaaaagauaauuaaauuagaaaugcaacacauuaauuguaauaaagggauauuauagucuaaaugucaguuaagccuuccuggaacacugauaauuagauagguuccuaaaaggaaaaauugcagaucucagaaugaucuaaauaaaaccuaaguaaauuaaaauuaagucuuuaaaaaguaaguagaggcugcccccugcccagacugacgagucagcccugcugucccgagcgccauguuggguucuucuagcguugccgccaugaagaaggugguucagcagcuccggcuggaggccgggcugaaccgcgugaagguuucccuggcagcugcaggcuugaagcaguucugucugcagaaugcucaacaugacccucugcugacuggagggucuucaaguacaaaucccuucagaccccagaaagucugcuccuuuuuguagucaucuaucuugagguuucucaaaccacuuuucaugaaccagugacuauucaagagagcuaaguuugaagucuguacaaaagcuucucuuuaacacgugccauaauacacuaucuucugcucgucaguccuuaacaucuaccucucugaauuccauggguuucugucucacaagguuuaacuauuuuauauacacuggcuguagcauacaauaaagcagcauacaaaaaaaaaaaaaaaaaguaaguagcugcccaaggagcuaaagaggucagcaacccuauaagaggaacaacaauauguacuaaccaguaccccccagagcuugugucgcuagcugcauauguagcagaggauggccuagucagccaucagugggaggagaggccccuggucuuucgaagauucuaugccccaguacaggggaaugccagggccaggaagcgggaguggguggguuguggagcagggcagggggaggauauagggaacuuucgggauagcauuugaaauguaaaugaagaaaauaucuaauaaaaaagaaaaagaaaaaaaggaaguagcacuaugcuuuuuuaugauuuuauuuauuuauuuauuuauuuauuuauuuauuuauuuauuuauuuauuuauuuauuuuggauuuggguuuuucaaggcagcaguucucuguguaucccugacuguccuagaacucacucuguagaccaggcuggccucagaaauccaccugccucugccucccaagugcugggauuaaaggcgugcgccaccacugcccagcaaugaauuuuuugaaaugucugcagggggcuagagagauggcucauuucccagcagcuacauggcugcucacagccaucugcaucuagagcaucugaugcccacucuucgucucuguggacacugcacagacuuggugcacagauauccaugcaggcaaaacacccauguacaugaaauggaaaaggaaaagaaauguacuucuuuguagaguguugcggccgccagcagcucgcaacaugaacgguucgacugagaaggcuacucgagcuguaagagaggaaucuagacggggcgaaagaagaaacggagccaagauaaauucauucugaucaaagcucaaauuuuauuguugggacacuaguuauaaaagaagggggaggggacccgauuuccgccaaauaaucucugguccaguaaaaaggugcacguguguggcuccgcagguucuagcagugggcgugacagaacagaugagcgggaagcuccaccccugagcaagcagguuucaggcugggggaggagagacuacaguagaguuguaauguccauguaaccacagugaugacauaguaaccuccauaguuucaaaagguuugaguguccccuccuagugacccaugacucucacccuucauucaaugcaggcagccacugacccaauucugacucuggauuaaucuuguuucguauaaauggaacugucgagggucaugcacauuacugaauugugugcucaucuguauugugugcuccagcauucccaguuguucagcaguuuccuuuucauaagcacaccaaaguuuguacgcugcuguccuauuagugagcacuugugguucggaauauaaaccuauugugaacauuccugugcacacccgugugggcauauguuuuuauccuugaguaaauggggggggggguugcuuugcuugaagcuuuauuuuuaaaguuucuuggaguguuuuaucaugucaugcauucuaagugaaaacuggggugcccucuuucugaaagugacuuuucugcuuuccugguugugagguagcagaacuugcugcucccaugccugacuucugcucuugcccuuagauucuggauuuugggcuggcucggcacacugaugaugagaugacaggcuacguggcuaccaggugguaccgagccccagagaucaugcugaauuggaugcacuauaaccagacagguacugacugcuucagucgccuccccagauggggaaggggugcucccuaacauggcuuucaggugacuuagcagcuggggccuuacuucuuacgucuuccgugucauucuuucugugacacuaccugaggggaguggucucuuaauccuaacaccuauguuuccugggaggauucaccauuuaccaguaacaaaguuuugccccuuugugaguugcuuauuucuuuuaucuuaauuauauucugaguugcacgaccuguggagucuuuucuugagugacaauuuuaauaaguuuguuucuauauaaaaaagauugucaaaccuugggugucuuaaauccugacuugaaucucucacucauaguuagagucauuuguguccaugaauaugaauagaaaccaugucggugcuuguauccucuuuacuguuccaguggauauuugguccgugggcugcaucauggcugagcuguugaccggaagaacguuguuuccugguacagaccguauccuuuaacacguuuuggcccuguuucucaugugugugcugugguagaugugugcuucccuaacucauugguggggaagacucaguucuuugcaguuccagcguggcuuuugaggucuguccucuuguugaguugcucaccuugccaagaaaaggcuuugggguugagaaaacaagcuuagaacucaccugucauauuuuugcagcaagucccuuuauuaaugaguuuagucuauuccugaaaauccuuggugaguguacacggccaccuguauucagagguaucugguucucacauuugcuuauguacuaaacagacugugggucccucugcugacacgcccgcugaguccuguccuauuugcugcuuaacaaccaacaaaagaagcaggaagagagaggcccugcugugugcucuuguucucuacaccuuguugucccuguuuagagccagccccacuuuagucccauacuuagcaccaucuggguuuugggcacuaagcacucguuccuaucuguugggcacuugucccauggcuuaggaauaauaucauuuaaugugauugugagaacgcccaccagcucugcuuaaggaggguguuaggugaaaauguuaaaacggaugcuuaaaauccaucuucaggaggaguuuuguaaaacucuaguagccugcaacugguuuugguugggcuuuuagaaauaccauagcgacacaugcuucaccuucuaacugcagggugagcucuugccuaacacauugagacuguaagcucaguugcuguccacuuaggcugcccuucuccagggacugccaugccacugugucugucgugacaguuuucugcuagacaaucuuuuauggaguggaauccucugcuccccggauaaugcugucugcuccugugcgugcugcuuggugcagcucacucuguuauucuccacuccaggaugucaucaccugaccaucucuauucccuugagauuuuggcuugcuuacaguccgagcucagaggguuaggcaggguuuaugaugcaccuugugcuguacucugggaccauccugaagcugaucucucuucucuuccuuuuccccugcugucucuucagcuguccuuuggcuagucccagagacacaugccuucauaggcagacagacuaacagaacuauccuuagggaagugucucaguucauugcuuuuguaguccauguaugcacaguuagaugcuaaggccuuggaauuucgauuuuagauuuuagcuuuuuuuacuuuugaacuauguggcuuugaucaaguuuucuaauauccacaucucucuauuuccuuaacuguauacagcucagugauugugacuuuacugaguccagagccaucaggaagugcuagcuucaccaguggcuguaucaguagcuugucauggccacagacagauagauaccugagagaaauacuuauuuugggcucauggguucagaagucucgguccaugaugagauagagcaucaggguagcaggagcguguggcagaggaggcugcucacuucaugguggccaggaagcagagagggaacgagagaagguuggggagaggaaagcauccaagaacaaaguaccuucuaggacacauucccaguggccugcuuccucucccagaccccaccuccuaauguucccagcauaaaaaaauagcagcgccagcuggggucagacgcgcaguaggagacauuugagguccauacuguuaauacuccaucccuaccuucugaaggccauauacuuagcuuguaguauaaaacacacucaguccauguccaagaauccagauccucauuagucucccgauacucaaggcaaacucucagcuguagccccuguuacagucaacagauuauaugcuucuccuuuucaguggcauaaacauucucauccaaagguaaggaagggccagaccaaagcaaggugagauggagcauuaaagucccauaguuugacauccauccuccaaggcuuggguggcaugagcugaguuccaaagagcuugggcagcccagcuccugucacccugcuggauggauccauaugccuucucucuuggcucacugccuguaacuguccacagcccacauucuggggacucacugggacaucccccucacagcuucauggaucacacugucaggccacucacagugauuccaacccugguguacacugcccugcuuaugccaccccauaauccuuggguucugcgugccucgaaaaacuagcaucgugcugccaggcugagcaguagcugggucuuuuuggaccguggcuucagagaccucagaguagcuaagcacuaugaccagguccuaaccagcccucagugggcagggggcucugagguaccuguucucuaggguguuuuggacgaguuuauacuuugcaucugggccuacaguaguuaggggucucuccaauauccagcauauuugguaucuuuccuauuuuuucaguacaaauuuuucuguuuguuguuauuggugguagacauuuguuuuguuuuguuuuguuugagacaggcuuucuucguagcccacgcucaccuggaacuauuguguauuucaugauagccauagccucccagugcuccucuugccuuggucuccugagcuaccgugccuuuuuuuuaugcuguguugggucuggaucccagggccuuaugcaugcuagaaaaccacuuuaccagcugagucacaucgcuaagcaguucugacagguguuuugaguaaaaguaggaguuuaccugugugcguuuaguuuuaacugggugaacuggaaaucauuagucuagugggccuauccauuuuucuuaaggucccaaggaguucuaaaguucucuucacuacucuguccugugguuucuagaacucuuuucaacgccucuaaagaacauacggaccccacuccagccagccuagaaggccugaggcuguagccugugugguuuguaaauggaacacugaugagacauuuugcagacugcucuuucguggaguucaauuuucuccauggguuucuguuuaccucacuuuuagucauugugccuuugaacuagugaucuuagcuucuaagagcugccuaauaagacuuuuugaggcaucauagaucuguuaggugugugcuguccuguguauggcucauaguugaggagcccgugugguuaauguaacuugaugauugauugacuuaaccucuacaauuuuaaaguuuauaaccuaucaguaucaauuagguucaugguguuggacagucguugccacugaugacugugcugugacuuagaaaacccuuccauccagcuuaauaagagugguugguguucuagugguuguguaaagaacaaagcucuucucuagaagccuggucggcuauaaguaucaagugaauucagcugauagagauuaauagcaaaagagggagcagggagccccagacugucucuccggguggaacccuuacuuacuuugauuuugaaaugugugguuagcuagguauggagucacugaugccagcacgucagcuucagcucaaggaccguaagcuguguggccuuuucuuugcuguauccaauauagacaauacauuuucauaccagagaucgcagacuugacuuguuauuuuccuguguaaucaaguauaaauuuccuucacgcauaaaagaccuuucccccauuguaguggaugugguacuccuaagacgugaccuauggucaggagaggcaacucagcaguuaaagagcauagcugcucuuccagucuccaggcugguguucagauucuagcaccugcaagauaguucaucuguaacuccagucucggggacccagugucuucuuuuggucucugugggcaccaggcacgcacauaguacagauaagcacacaggcaaaacgcucguacacauaaaaauaaaugauuuuuuacagaugugaacagaggguggagggcuucuggauuacacugcugcugcugcacugaucugcguacuguccuggguauauuagaacagucucagagcaguucguccuucuucaaacaugcuacggaacaucacagauagacaguaccgugcucuagugaacccugugucugcucugcccagagggugaaguaaaaugugggugguugagcaaacgcacuggagugcacagcauaucuagcuacccauugcucuccauuguuaaguuuccggucuuuuccucauuuuuaguuuuuucuuuccuuaaacucagggagggcuuauguaugccaggcagauacuguaccauugagcugcaucucuagaaguuggucucaguuuugaaaagaaguuggaccgggcgugguggcgcacgccuuuaaucccagcacucgggaggcagaggcaggcggauuucugaguuccaggacagccugggcuacacagagaaacccugucucgaaaaccagaaagaaagaaagggaaaaaaaaagaagagaaaagaaguugcacugcugauacuaaagccagugccuuaggguuggaaagauggcucagauaauuucugaauuaaaauuugguauuaucggggcuggugagauggcucaguggguaagagcacccgacugcucuuccaaagguccggaguucaaaucccagcaaccacaugguggcucacaaccauccguaacaagaucugaugcccucuucuggugugucugaagacagcuacaguguacuuacauauaauaauaaauaaauaaaucuuuaaaaaaaaaaaaaaaaaaaaaaaaaaaaaaaaaaaaauuugguauuaucaucuuacuugaaauacauuuuuuuuaagauuuauuuauuaauauauacacuguagcugucuucagacacucuagaagagggagucagaucuuguugcagauggcugugagccaccaugucguugcugggauuugaacucuggaccuucggaagagcagucaggugcucuuacccacugagccaucucaccagcccccuugaaauacauuuuaaacugaugauaaacuuacuucuuuguggggaaggaaaagcuaucccaguugugaaggauagcucacuguggaaauagcaggcuguacuaagucuugcugugcacugucacauagcuggguggcagcuuugccuuagcuccuaaggaggguuuucuuccauaauguguuuauuaccuuccaauucccagguuugcuguagcagcuccagccacagcccuccucgcugugcacgauguucauucauccuuuuuacuacuuuuuuuuuuuuuuaaauaaacugcauagaauguuuuucuggguuuugaggauaggucagaacagugagucaaguguuuggaucagucgguguuugccaggcuggcugcacugggcaaggcuggagagaugcugcugccacccucaaaaccaggguagucagucugaaccaaccagagugguggggugacugggacagaagucuuccuccgguggaaaagcagaauggaaugaggagugagaggugcagguaaguuacuucagagagaaguccaacauggaguaaaaccccaggucauuauggagaggagacggagacucaggaguccaggucaccucagccacauaguaaguuugaggccaucucaaaaaagcuuguccagaaagacuucuuguuagaacagcccuuggaagggacagugggaaaggaaaaggcuuaauacaggaagaguggaggcuucccuuacaacugcauaaagaggcauagaagugccugagaccuuugccuugaguugaagcuuugagccuauucaagaauaguaguuugaggcaagcagauaaaaguugagugacaggugucagaaaggcguggaugugagggugaggagcugguugugauuuagucugagaaugcucaccccugcagacaagggagaaagguauggaugagcccugccugcugauagaugcauguucuucaggcagcuuggaggugaagcuaagucaguuaggaaacaacccagacuucacuuuucccaaagggaauaugaaacuugccucuuuagaaaguccagcugggccgggcgugguggcgcacaccuuuaaucccagcacuccggaggcagaggcagguggauuucugaguucaaggccagccuggucuacagagugagugccaggacagccagggcuacacagagaaacccugucucgaaaacaaacaaacaaaaaaaaaaaagaaagaaagaaagaaaguccagcugguuaauaaacuacuuuggagucguacaugguaaaaucaccucuuggagggcuggaagagucuaauuuuuuucuauuaacauacauccucuugaaguggcuaaucagauauuccuggggaguagaaaugugaauggagcuagauuuauauaaacugaguagcuucuuccugucugcaaggaagaugcucaacugucaccauuagcaugucggcaguguuacggccugagugagucagugccagucucaguccacccacuguccgcaccuggagcaucuccucuuuuccauuuucaguagcagggguuuuguuuuguuuuguuuuuucuuuuaccauucuaacuucagaaauaucuugugugaguggacuuccuucuggguuaacucgguuuucuguaggaugccauuuuugggcacuggcucaucuuaucuuaaaaauuauugacuguugcaggccugugaaaacugguguguaaauacacgaaugcacggccuuguugcauuccaggaaaacuccauguauaagacaggcaccaggcuguaucuuccugucaccuuucuagaauuuucuucuguuuuagcaaaaaaaaaaaauguucagaggcaaaauggccaucuuguugcauaagcaguuccugugacuaggcaacuguggcuugcagacacuguucucuugacugacucaugcuuauuuugccucucuauaugcaagcuaaaucuucucuaucuguucuuuaaauauuguaugugccuuuuauguaucagauaaucuaaaauaagggaugggguucagccauacauuguagucccagcacuuggauagaugaggcacaaggacucugaguuaagaggcugcugggggauuuuaggugacacaggaaggacggcuaaugauccugcagaaccugacgggcucacacagucucccuaucucaccaucagcugagguauggagcagcuguucagaugcucaaaaggggcugacugaaggcagugagaguaaauggccucugauccuccggugaacacaugcucauuuguucugagguuuuggauggcagaaugacuauuccgggcccuuugccuuucugcuuuucaagucuuuagugaguagacuuugguuacuuuacauccguuaugguugcagccuggugucucccauagugggguagcacccucugccagcuggcugucccucacauguucugucuccuagaggggagaggggaaggucuccagagggcacacucaagugaacgaauggugucugggaggagagcaggccucccaacugucagauuacaaguuccuuaggucaggccuuagggggauagucacaaauagaugcauagagugugcuccgccucugcuugccagcacacucugcuuagcuaccuccuagugccuugguggaaggggagguggagguggaggcugggcucauggacugaguggcguggccucuugucuaagacccaaccacagugacuuuacuuccugcugcaugguggugacaaauguguguguguguggcgguuuuuugaaccuuucuacaggaggagcaagucaugcugaaaguggccacccuacagaagccuuccacccagaaucuuccaccauguuggccuuguuugggggagggggggacucauuuccauuauugagauuuuuuuuguuuguuguguuuuauuuugcucauuauuguuuuguuuugcuuuucacuuuuauuuugucccgacauuuuccuuuauaguccaccguuagauauugaucaguugaagcucauuuuaagacucguuggaaccccaggggcugagcuucugaagaaaaucuccucagagucugugaguugacgcuuugauugaauuacuacccucgggggccucugccacuugccuuccgucacucugcacucugacuuuggaaugcaugugugacgugugcugugugugaugugugcacacaugugagccugcaugagcccgcuugcaugcaugaguguguuuuauucuaaacuauccuuaucuggguguggacuuaagaucaugggaaccccuuuggggcaauuguaugcuaauaaaacugagaguugagauuccaguucauuccaagagauuaaugggaaauuuguguguguguccuccugagcccugacuucucucugaaguugcccacgugcuuaagagcccucucacuuucugcugagcauccuaaucucugacacugugugcuagucugaccuucccucucaguggugggugaugugugccuugucccuagaggggcuccuccugggcggggucuuuccaugggcuccucucccacccucagaccacacagaacagcuuccuccccucaugacagucugcagauggcucugaacuccuccaggaaccuuggucaauacagugaauagcaugaggggccacuuggaacuugugcuuucuccauggaggccauaagaaggugacucuguuuuacuuuagccaugguugguugguuuuuuguuguuguuguugguuuuuuguuuuuuguuguuguuguuuuuguuuuuugguuuuuuuuuguuuuuuuuguuuuuuuuuuuuguuuuuuugagacaggguuucucuauguagcccugguuguccuggaacucacuuuguagaccaggcuggccucgaacucagaaaucccccugccucugccucccaagugcugggauugaaggcuugugccaccauugcccagccuuguuguuguuguuuuuguuguuguuggaggauuuuuuuuuuguuuuuguuuuuguuuuuuaagcuguugucacuuucuggggccagaaacuuugaggaagcuaggaaagccccuccuuccucucauuuccgcuuagggaaauaaauggaggagcuaagccccagcugugcacgccuagguuccccuccuaccacuuccaauagaagagccuucugcucagcuaagaaggaaguuaaguagcuguaggcaaccagcaacacacgagucaccuccccugacaaaaucaggaccccgaaucugcaguguagcuauacauaaaggacccuggagcuuuugaaugggccuauuuuauuuuauuuccuuuacuccuuuaagauaagaaagcaagccaggcaugguggcguacgccuuuaaucccagcacuugggaggcagaggcaggcggauuucugaguucgaggacagccugggcuauacaaagaaagccugucucgucaaaaaggaaaaagagagagagagagagagagagagagagagagagagagagagcaagcaagcaagcuggauacauggccuaauaaugagaugucuuuuaucuuaacaugaagugggcacaucagauauuugaacaguucuagugcagcaauggacagaaucagguaccaagacaaacauccucucagugauaacucaguuguguacaguagugagaaaagagcuucccugcauaaucgucagaaauggguaauggcagucuaaauguuggaaaaguaugggcaagguuaaguuaguguugaugacaccacccaguacuuuugaaaucuccaaagcaccagcugugauggugcaggucucuaaccccagcacuuaaaaggcagaggcagaaagccugggcuuaauuuguaagacaccuuuuuaaauaaacaaacaacuauuguagauguagcucagugacgucaacauggccaugggucuaaccccagacccccuggggguggggagcauacaguaccuacauccgggugagauaaagcugacugaguaaaaguagucagaaaaauuuacuaaagaauuguagucaacagaacacugaauaacucauuccuucuggaaagaacagaacagggaagccaguguagacaaggacacggggucugaauacagagaaugcaggacagggagaacaggacagaaagcuggcagaggcccgaggacagcucacugcuuagugugcuggcaccuggguuaaccagccaaggaaacaaaggcauggcuccugcccucuucuucagagauacaucuucuugacucccagaugacaaauggcugauccuguacgugcugcccgcaaggagagcaugacaguugagcgugugagcucaccugaauccugcgugucuaguucacccuguuuguccccucucucaguaugcagagcauuguugaguguggaguuuucagagggaaguccaaagucuguacagagugagucagcccaucucugcacucagguagaagaagggcaaaugcauagcaguagucaccuuccagcaggguucgugcugaugugcaaggaaaggacgccauuggcuugucuauuaaagaugagauuccagcugaaggaugacuugauacuuaggugaggagaaaggaagcucacuaaaucauguuaagguuuaguuuaaaauacuaucaucaccuugagagggagcgugggauaaacuggcaguggguuuccauuucagaagcuguggccuguaccuggugaauugguggccuggcugagggaaguuaguaguccugucguuugaguaaggacacugagauggcuuagcagcagagaccugaguucucuccuagggcccacacagugggcagagaauucuacaacuuggagaucaauccucugaucuccauucauuagugguacgugugaccugccccucccuaccacacaaaugaacgugaaaauggaauaacggaaacuucauguaacuuugccccgucagauaaacacaguguuuuaaacuuuuuguucauugaaguuagugucuucccucacuacaggugugauuguggcauguucugaagcugucaaccagacuguagcuucgguuuugccuucgccaucacuccuaaaguacccuucuucaccaaccuauauauuuguggcaugcauuuuaaguauaucacugccaacgucuuugagacuugguguagcucagcacccacacuccaaguuucucagccuguaggggugugucucguagagccugugccaucaacacugaaccuccuccccagauagaucuguuagauguguuagguuuccagaguuucaucaccauuaucuccaucuucuacuuuugccacugcagcaaacagguuuuagccauugggacuugaaaaugguucucuggcuggcauccuggaucaaggcacagucugcuuccagagaaccuaaacuauuuaacauuaaaguugauacuuaagcaaaaguuuguuuucauguguguguggccacucacuggcuacaugccuaauagcuccugccauucuccacagaauguuacaacacgcagccuuaggcgcuggccuggugugguugggaguugcuuugcuugggauggcuuuugacuuaaacaacuggaguugauuuuuacaccgugucuuaacaaugcccuugacuaggcaucuuaagauauuaaccagcuucagcagauaaugcgucugacggggacacccccugcuuaucucauuaacaggaugccaagccaugaggugagaacaaacagcaugcacagggaagucuaccucggaggccaccuucucgugguagugucuguguauagccagcaguuucuaaugucaccgaaugcuugcaugugccccaagaaccguuaaagcaguacuggcugugugcuagcggaguguuggcauuuaggaugcagucuccugagccugcgaggcagcgaugcaguguagggcaguguucccuaguguuuggcuuucugaucuugugcuugagguaacaagugucguugcaguuguauguaguuagggugugcuacagccgugucaugggugcauggaacagaguucauuagugugcuuugcucuccacccauuuuacaaccaagagaagacugcaugcaagcacgcacuauaaaauuccuugugcuaauaggugugcuggguuuuuuuuaaacaagacaaguaauucauaguaaguaugaacaccuggggaaucgagcucuugaccaggucauaacuaaccuaacuccaguuuaugaucagacgugacagacaaacccuuguagagcauugugugcauuucagcucuugucuguauugaaaaauggcuuuucuuaccucuauuccuuuuuccauucuacgugguuaaguaggaagggauugcagccaugucugugucugguuccuacaacuucaaauugcagugaguucgucugcuucaguaccaacucuucuucaugacuuaccugauuaggaaaaugguccuggaaaagacugcuuggucucaauucugguuuuaagcuucugacccuuugaccagaaagcuaguaaagaguagcugauugauuaucacucucauccacaggaaacagaacucuggggagaccgcaagaauaaagucaguggucacaaauagagggggucaguggcuagaagaagaguaagccugaauugagcaucccagacagugguccauacgggccucagccuagcucauucccugagaucacuaacacuacugaacauagucauucugaaagucuguguuuuuacaggcaagaaacuacauucagucucuggcccagaugccgaagaugaacuucgcaaauguauuuauuggugccaauccccugggugaguugaucguacuuugauuuugugguauaaauuagaaauuugaaguuuugguuuugacuaaaaagaguaccuuuuuuuuuuaagauuuauuuauuauuauacauaaguucacuguagcugacuucaaacacaccaaaagagggcgucagaucucacuacagaugguugugagccaccaugugguugcugggauuugaacuccggaccuuuggaagagcagcccuuacccgcugagccaucucaccagcccaaaagaguacuaucuuuaaguaacuuuugggucuuaauaaauauagcuguuacugucugucuguauugucacauaaggaaauaucauacagugauaggcuuguaugcuuauaugcuugcagaauaugguggagaggcuaagggaagugaggaauggggaacagggaauuauggggacuugggggagaaggaaggaggugugaaccuuacagcugcuagugguagguggagcccagcugaggacagaaaacaggcacagacacaugguuaaugcccagcaguggguccugauguccucuacacucacagacucgucccccuuuccuccccucucugcccuucaggguguaagcagcugccuuugcagcauugauuugguggcuggcuccuugccuuccugccuccauuaccuccaggaucaccuggcagaggaagugacagugguagcucagauugugucagcacaggacagugugcuaagguucuaauuccucucucugguguaguaggcaguaguagauacagagccaucagaccaccaccgucuccugccaugagaagggaacaagcaggugguggcugcuguccccugccucucccauuccugcagauguuacuguaaagucacugcacuuaagucuucgugggucaugucccuuucugaggguucuagaagccaugugccagaguuacuuauccuuugaagggcugaugucuguggcagugauuucaaaagcugggagcggaagcuuucacgaacucuguccauagccacaauacugaggaguggcuguggcuguggcaaugauuccuguagcaggagaggugugugcauucuuggaggaggggguccagccuaugcuacaccauucaggccugagguguacaugguacugacagguuggguuagguuuguggcuucccugucaggcucacugggcucucuguaacuuaccuugagcuauugcaucagauaagggucuggggucucugugaucucuaaucuuuccauguugauuccaccccugaauccucaccagcagaugugcgguacacagugucugagucuucucugauggagcugguagagauccccauuuagacacugagaagagcugccuuacaggagugaauccaggcugcuggagacuaaaaggaggcucuggcccaucuggugcucuucacagccugcucacauccaaacgugccuggcagcccauugccaagugcuggucagaaggaacaugcuguuaccgauugcuagccuagccguccccaacaggcugcacaccagcgauauaaauauuaacagcccuguugucggucacaggcuucgcaucacugcuagccucaagacacagcugagaacuucacauugcccuuugaucuuagagugucuauuuaugucugccuccauacuugaaaagucuuguucuuacuucugaccuuguuccucaucuaagugcuuugauccugaggacguggaccucuuuuuaccccaggguagcaggcacccacucauucauguucaguauaaagucagcggauuuguagaacgugaggauuuguauccaggaaguccaccagugcuucaguguugaagacagagucauguggccuguugugccaccaugcucacugucugcagugcuagguuuagauccaaggccuuaugcacacuuugcaaacuuuacuggcuauaucccagcccuccuccagcacucuaaaacuggagagccagcguaugcauguuugcuguuuccucuguacccucaaagccugcguuucuguggauaacugguguucaggcuacaggguacauaaucacucagaggagcagagguauagcaucucuucaggaaguucuccucgacacccauggagccuuccacgcugaagaaaucaucuggagcuguagagauggccaacggggcccuuggucugagucccugcaccaacaggaugccucacaacugucuuuaauuacacuuacagaggauccagcgcccucugcuggcuuuuagauuuucagccagcaggcaugcacuguaguggagacauacuuaaaacuuaaaucuagcugggcgugguggcgcacgccuuuagucccagcacucaggaggcagaggcaggcggauuucugaguucgaggccagccuggucuacagagugaguuccaagacagccagggcuacacagggaaacacugucucgaaaaacaaacagaaaaaaaaaccuuaaaucuaaaaacuuguggaguuuauuucuguuuuacuuuugggagagaaaaaaccuggaagccauuauugaaaguaacugauaaucaccaggagacaaaccaucuccccauauuauucacuuggggagaaacggggaagagcucaagaugccaaccaccuuagcucagcauaaauggagcuccuggcuguggugccccaggucacagcaucaccuguggcauggucucacccaguaugccuaauuucacucuuaccaacaauugaggugguaaauguaaagacuagagagaaaugggagagagugcacacagcauaaggagaggggaaggaagccuccaugguggugugccacaccugcaguguccacaaaugaaaaccaagguggauggagaaggagagcugggggguaggaggggguguuuguuuauuauucuggguuucaaacccagaaccucaguaauguuuuuaaaaugugccauaggcauucaaugcguacauggagggaagggguuacaugcagaagcagacaccuuaaaggaugcuuuguguggaugugaaaggugcuuggaacuugcacagugguggcacugaugucauguguuuuccucuuuucuggugugacagcugucgaccuacuggagaagaugcucguuuuggacucagauaagaggaucacagcagcccaagcucuugcgcaugccuacuuugcucaguaccacgacccugaugaugagccuguugcugacccuuaugaccaguccuuugaaagcagggaccuucucauagaugaguggaagagugaguccagggcaggcuagcgugggcuuugagcuugcuuucauuuuauucauguuuuguuuguuuucugagccaggguuuuucucuguguagccacucagaggaacucacuuuguagaucaggcuagccuuaaacucagagauccaucugucugugccuuccgagugcugagauuaaaagcaugugcuaccaagucccguuuauguaauauuuuuuaacagugcuggagauuggaccuaggacucacacauauuuccaacauaccuaugaucccagcacuugggaaucagauuaaaaguuuaagguuaaaaaaaaaaacagacugaagccgggcauuggugacgcacgccuuuaauuccagcacuggggaggcagaggcagguagauuuaugaguucgagaccagccuggucuacagagugaguuccaggauagccagggcuacauagagaaacccugucucaaaacaaacaaacaaacaaaaaaaaaccaggcuguaaaguuauucacagcuguguagguaguuugaggcuauccugggcuacaugagaaccugucugaauaaaacccucguggaugguugccagcagcuuucugagcucacugccagggucucugaugcguauguucccugaugggcugcagacacagagugcagagccuucaaacugacagagcuuugaggugcuuggcgguuuuacguuuacagcaucuuuucaggauaaagagggucuggcguauuucagcacagaacuaggacaggaguuuuuuauagcuuacuuuuggccuaguuagggacugccaggaauggagccacaucuccacccccagucauacuccuucauaaagcacaaggucaguucugcaguuaggacugccucguugugugcagagugcagugcugcuccagggagcacucagaaggagcaccgugcaugauggaguggggagacaguucugucuguguccuugaacuggagcugcucugcugcagggcagggcaggagcaaggcaggugauguaguucaucagaccacugccaggagggaagggcugagugucugccugccggaguuguacgccucacccuuccuuccuucuuuccuugcccuaggccugaccuaugaugaagucaucagcuuugugccaccaccccuugaccaagaagaaauggaguccugagcaccugguuucuguucugucuaucucacuucacugugaggggaagaccuucucaugggaacucuccaaauaccauucaagugccucuuguugaaagauuccuucaugguggaagggggugcauguauguguuaguguuugugugugugugugugucugucuguucgucuguccaccuaucuuuguggaagucacugugaugguagugacuuuaugaguugugaaugguccuuggcagucugccugcuuucucagagucugggcaggccgaugggaacugucaucuccuuagggauguguguguucagugcaaaguaagaaauaugaaaauaucccuguucuuaguuaccuugccacuuuggcuucuccuguggcccugccuuuaccauaucagugacagagagaggcugcuucaggucugaggcuaucccucagccaugcauaaaguccaagagaaccaacuggcuccuggucucuagccugugaccggcuugcuuaauguccucagaaccugacagguauguucaaaacugucagucuguuugugccuuaaaagggugagaagggcgcguagauaguuacagagucucagcugcugacguucugagccaggcaagugcacggggcuguuggauggccaguggggagcuggaaaaaacaaggcagccuuuaggaaggccauggugcaugugugugcaugcguguaugugcagccgcccucccucacuucaggagcaagcuguuugcugugcuuacccuucaccucagugcagaggucuccagugccgagcacaggcaccugccaucaguaguuccugugucaucuucacaucuagcagagcacggauguguuugcaugcugugcucuuggagcuuguccugucuucuggaagcccuggacaaggcgugugaaggcuucccagaaguuccuguccacauugccuccgcccaccgacgccaugggcacacugcucccuccuccuccuccagcuacuuuguguugaacacaauugauucuccaggugcucauggugcaggaaaacaggacagacagagagcaccugaacccuugccaucugaugucaccaauucaggaaaacgaguccucuccuaggacuauccccgguucuggaaaucauguucuccucacucauggugacaagcuaagaaagcugaacaaagggagagacgagagcgccugaagccaggagcuccuuuacuaucuuucucaaaaggguuguuagacacaaaccaagucaucaaggccccgcuccucuccucggaagggucccccaccccccggcagcuugacacugaauccagugucaauuuggggagaaagcaguuuugucuuggaauuuuguauguuguaggaauccuuagagagugugguuccuucugauggggagaaagggcaaauuauuuuaauauuuuguauuuucaccuuuauaaacaugaauccucaggggugaagaacuguuugcauaauuuucugaauuuugagcacuuugugcuauauaaggacccauauuuaagcuuugugugcaguaagaaaguguaaagccaauuccaguguuggacgugacaggucuuguguuuaggucaaggugucuccucucagugcagggacaugccugcucuguggggcaggcgaggacccugaaucauuuggagcccagaaggaggcagacuggccaggucucaccaccucagugugcaguucaacuccaugccaucccaucaagauggguuaguagcagugucuguuuuugaaugccaagugugauuuccaacaauucugcucugguuauuucauugaagacaucuuugcacaugugaccaugcuguguuaggggcuguguuccagggacuggacucgaagcuagaacuggcagaagaguucuggcauccacagcgcaaugcugccaccacccaguuucuucaucagaagacaagggaacgagaaaacugcuguucguuuguauuugugaacuuggcuguaaucugguaugccauaggaugucagauaauaccacugguuaaaauaaagccuaguuuucaaauucagu

SEQ ID NO: 8494 - RNA, 4370 nt, Mus musculus
uguuucuuauuuauuuugagacaagaccagguuauauagcauugccuggccucaaacuccuagagaucguccuguuucugccucccaagugcugauauuaaaggcauuacacaccaugccaagcuuuaaaaaaguacaaauauaguauuuucacuucauucuuauuuuaugagcauggcuguugugccugcguguguaccauauguauguagugccccuaguggccagaagagggcaccagauccucuaaaacuagaguucugaaugguuuuaaguacccucacuggugcuggaauuugaaccuagguccuuugcaauagaagcaacugcugagcugucuuucuaccuccuaaaucuuaagauggacggauggacaaacagacagauagauaaaaucuucauccaguuuccucaccagugucccaguuucugggucugccacaggcacccugucucucccuagccacaggcagaaaaccaggcauuauccgugaaucaccuugcucacccagccagucccacauccaaggcucuguggcaauagcuuugcugacucacccuccagccauucaucuuccuggaucaccgacccuaaucuguccucccuuccacgacucuccagcuggaguguccuccaaaggucccccgccccgcgcaguggaggucacaugugucccuucugaccuacuuacucuucucuuccacagacucuaggauccaucuuuuacagaaaccuuggccucuauugccuucugauagugacaggccugucaccugccaggcauagccuuuaucugucaccucuguaacuccugucaagcuugagaacuacugcugccuguuuugcaaaugaggaaaauccagguguacugugcgggucccacugcguguaaacagcaguacagagccagggagucaaccugucugucugaccccaagagccccucccaugccccugaguucaucaugccucccuccaaaggaagcccagagcuguccccugcccugcacacugcucccccaucucuagucuccaguccccagcuucugaugucauagcucaaccugcccucucucccucccucuuuguuccuccugaggcaaucuagccuugcacaauguagcaguuaauuacagggcgccuuggcugcaucucugguuacuucacaguugcuugucagagucccaggaaaccugucaguaucuggucuguggucugggggaguugaggcggcauuucuccuuguucucauugccaaaagccauuggcuucuuccuguuacauguccccgacacacacacacacacacacacacacacacacacacacacacacacacacacaaccugccuuccaaaucugacaauuacaugucugaagcucuguguaagauggaacccuggaaggcucccuccuuagugggugcuggacucuguauugccaguuuggaucaaugaaaucaucaguugacaggaacuccaggaaagacaucauuguccccaccuauagaguggcuggggccaacugggacuaggagagagacaacuugucucaguucuaauucugguccugcuaccauggggugauggugacagugacagugauggcugugaggguggaggaggaaagagaggagggaagagaaaaaggaggagggagaauauggaagaggagggagaggacagggagagacggaggauaaaggaaagguggaguggggagaaggcaggggaggagggggaggggaacgaggaggagaaggaggaggagaaggaggagggagaaaagucagaggaagagugggaggagggagaggaggggaaagaggaggagugggaagaggggaggaugcagaggaggaggagggagagcagagaagaggaagaaguaggggagagggaggaggacgggaaggaggggacuaggaaagcuuuuugcugccuuagugauccgcagugaccuuuuugggugagaaaaucccuccucucagaaaucaugcugaguagcccuagagcuaacccugguccccaagccccugucccuuaccaaaacaucucucugcccugacccugaugaggagacccagacaccccacaugagaccucaugacccccgaccccugacccccauccacaagcuaucuauucauguggccaucuuggaaugaccaagcucgcuguccucuucccuccugcacacccaagagacagcacuccagcugaagacaugaugcucucucccugaggaccgguguucaguucccagcaccuauaucaggcagcucacaacugccugugauuccggcugcagggcaucggauacccucuucaggccucuggagcuggcacaggacugagaggcaagagagaagaccugcacggaccaggccagggacagggagaugacagaauaagaagagguaggaaggaggcuggcgacuucuggcugguuacugauggacgcugcgaagagggacucucauuggaggaguugccgccaucagaucggccgccaucagaucggcaagucuauaggguauuuucuugauuaaugauugauggaagaaggcucagcccacugugggcggugccauuccuaggcagguggucugagucuguguaagaaagcagguugggggcuggagagaaggcucagcgguuaagaguagugacugcucuuccaaagguccugaguucaaaucccagcaaccgcaugguggcucacaaccauccucguaacaaaucugacgcccucuucuggagugucugaagaugcaguguacuaaauaaaucuuuacaagaaagaaagaaagaaagaaaggaaggaaggaaggaaggaaggaaggaaggagacagcguguagcgaugggggagcaaaccugcauugguuccucucgcccugccuugacuuucaugaugaaccuuaaacugugagcugaaauaacccuuuucuccccaaguugcuuuuggucacgguguuuuaucacagcaauggaaagcaaaccagggcaaacacccagagccauacuucucuguuacaguuuuugcccagagccaauccuaagguaagaauaaauagagagguguuuuguguaagaacuuuccagagucugaauggggugggggaggggcauggggugguaugaguugcuccuccccauugaaagccaaagccauccugcagcccacaauggaagugaggggaacacaggcuggggagggggcguggcggauagggggcguggcguguaacucugcguccugucagugaagagcagccugucagugagggaggcacagggcgaggcagagauuuugcaacuggaugcugagaggcaccgccucuguggacaccguccagagcagggugcagggaaugccccgcuccuaggugcgcuccggauggguggagagcgcugaagagccuguaccugacagaagucuagcaagggcaugaagugagcaaggggucugcaggaccacgccccugcccaugacucuaaggacugucuacauuucauccaguaccuggggaucccuaucagcccuuccgggguaccucucagcagagcuaaacaggcccaggcaguggcuggaugaaccacccguggaugccugacugggcugguagaguugccacauucccugcucuuggcugggggagaaggagauacugagccaaggcagacagguguggguucuuccuccgcugggaggccauagaccccgaacauggacgaacagguguucaaaggagacccagauaccccucauuccaucuccuucuccgggagcggguuccuuuccuacuaccaggcuggggccguggaugcucugcgagaucuggccccgaggaugcuggacacagcccaucgcuuugcagggacgucagcgggagcggugauugcggccuuggucgucugcgggauugagauggguaagacuuuuauucuggugucuuugaagggggcugcuggagggggcuucucagaacagacccuggacaagcuuggaagugcacggggagagaggcgggaaagccuggcagccaggguagucccccuucacacacacacacacacacacacacacacacacacacacacacacguccuccguccuccuccuccuccaugggcgaggcuucuuuuaaauuguaaacacugccucaacuucccagugaggaggagggguucccaacaugcaaacccugaguugaggagaagcuggugacagaugugggacacagugugggagcuucagcugugccccggugggccagaggccacagugcugacccagggcuaugagcaacagccuucuuggcccggccaacccccaccugcucgaugccaggcuguaauguagag

SEQ ID NO: 8495 - RNA, 4370 nt, Mus musculus
cucuacauuacagccuggcaucgagcagguggggguuggccgggccaagaaggcuguugcucauagcccugggucagcacuguggccucuggcccaccggggcacagcugaagcucccacacugugucccacaucugucaccagcuucuccucaacucaggguuugcauguugggaaccccuccuccucacugggaaguugaggcaguguuuacaauuuaaaagaagccucgcccauggaggaggaggaggacggaggacgugugugugugugugugugugugugugugugugugugugugugugaagggggacuacccuggcugccaggcuuucccgccucucuccccgugcacuuccaagcuuguccagggucuguucugagaagcccccuccagcagcccccuucaaagacaccagaauaaaagucuuacccaucucaaucccgcagacgaccaaggccgcaaucaccgcucccgcugacgucccugcaaagcgaugggcuguguccagcauccucggggccagaucucgcagagcauccacggccccagccugguaguaggaaaggaacccgcucccggagaaggagauggaaugagggguaucugggucuccuuugaacaccuguucguccauguucggggucuauggccucccagcggaggaagaacccacaccugucugccuuggcucaguaucuccuucucccccagccaagagcagggaauguggcaacucuaccagcccagucaggcauccacgggugguucauccagccacugccugggccuguuuagcucugcugagagguaccccggaagggcugauagggauccccagguacuggaugaaauguagacaguccuuagagucaugggcaggggcgugguccugcagaccccuugcucacuucaugcccuugcuagacuucugucagguacaggcucuucagcgcucuccacccauccggagcgcaccuaggagcggggcauucccugcacccugcucuggacgguguccacagaggcggugccucucagcauccaguugcaaaaucucugccucgcccugugccucccucacugacaggcugcucuucacugacaggacgcagaguuacacgccacgcccccuauccgccacgcccccuccccagccuguguuccccucacuuccauugugggcugcaggauggcuuuggcuuucaauggggaggagcaacucauaccaccccaugccccucccccaccccauucagacucuggaaaguucuuacacaaaacaccucucuauuuauucuuaccuuaggauuggcucugggcaaaaacuguaacagagaaguauggcucuggguguuugcccugguuugcuuuccauugcugugauaaaacaccgugaccaaaagcaacuuggggagaaaaggguuauuucagcucacaguuuaagguucaucaugaaagucaaggcagggcgagaggaaccaaugcagguuugcucccccaucgcuacacgcugucuccuuccuuccuuccuuccuuccuuccuuccuuucuuucuuucuuucuuucuuguaaagauuuauuuaguacacugcaucuucagacacuccagaagagggcgucagauuuguuacgaggaugguugugagccaccaugcgguugcugggauuugaacucaggaccuuuggaagagcagucacuacucuuaaccgcugagccuucucuccagcccccaaccugcuuucuuacacagacucagaccaccugccuaggaauggcaccgcccacagugggcugagccuucuuccaucaaucauuaaucaagaaaauacccuauagacuugccgaucugauggcggccgaucugauggcggcaacuccuccaaugagagucccucuucgcagcguccaucaguaaccagccagaagucgccagccuccuuccuaccucuucuuauucugucaucucccugucccuggccugguccgugcaggucuucucucuugccucucaguccugugccagcuccagaggccugaagaggguauccgaugcccugcagccggaaucacaggcaguugugagcugccugauauaggugcugggaacugaacaccgguccucagggagagagcaucaugucuucagcuggagugcugucucuugggugugcaggagggaagaggacagcgagcuuggucauuccaagauggccacaugaauagauagcuuguggaugggggucaggggucgggggucaugaggucucauguggggugucugggucuccucaucagggucagggcagagagauguuuugguaagggacaggggcuuggggaccaggguuagcucuagggcuacucagcaugauuucugagaggagggauuuucucacccaaaaaggucacugcggaucacuaaggcagcaaaaagcuuuccuaguccccuccuucccguccuccucccucuccccuacuucuuccucuucucugcucucccuccuccuccucugcauccuccccucuucccacuccuccucuuuccccuccucucccuccucccacucuuccucugacuuuucucccuccuccuucuccuccuccuucuccuccucguuccccucccccuccuccccugccuucuccccacuccaccuuuccuuuauccuccgucucucccuguccucucccuccucuuccauauucucccuccuccuuuuucucuucccuccucucuuuccuccuccacccucacagccaucacugucacugucaccaucaccccaugguagcaggaccagaauuagaacugagacaaguugucucucuccuagucccaguuggccccagccacucuauagguggggacaaugaugucuuuccuggaguuccugucaacugaugauuucauugauccaaacuggcaauacagaguccagcacccacuaaggagggagccuuccaggguuccaucuuacacagagcuucagacauguaauugucagauuuggaaggcagguugugugugugugugugugugugugugugugugugugugugugugugugugugucggggacauguaacaggaagaagccaauggcuuuuggcaaugagaacaaggagaaaugccgccucaacucccccagaccacagaccagauacugacagguuuccugggacucugacaagcaacugugaaguaaccagagaugcagccaaggcgcccuguaauuaacugcuacauugugcaaggcuagauugccucaggaggaacaaagagggagggagagagggcagguugagcuaugacaucagaagcuggggacuggagacuagagaugggggagcagugugcagggcaggggacagcucugggcuuccuuuggagggaggcaugaugaacucaggggcaugggaggggcucuuggggucagacagacagguugacucccuggcucuguacugcuguuuacacgcagugggacccgcacaguacaccuggauuuuccucauuugcaaaacaggcagcaguaguucucaagcuugacaggaguuacagaggugacagauaaaggcuaugccuggcaggugacaggccugucacuaucagaaggcaauagaggccaagguuucuguaaaagauggauccuagagucuguggaagagaagaguaaguaggucagaagggacacaugugaccuccacugcgcggggcgggggaccuuuggaggacacuccagcuggagagucguggaagggaggacagauuagggucggugauccaggaagaugaauggcuggagggugagucagcaaagcuauugccacagagccuuggaugugggacuggcugggugagcaaggugauucacggauaaugccugguuuucugccuguggcuagggagagacagggugccuguggcagacccagaaacugggacacuggugaggaaacuggaugaagauuuuaucuaucugucuguuuguccauccguccaucuuaagauuuaggagguagaaagacagcucagcaguugcuucuauugcaaaggaccuagguucaaauuccagcaccagugaggguacuuaaaaccauucagaacucuaguuuuagaggaucuggugcccucuucuggccacuaggggcacuacauacauaugguacacacgcaggcacaacagccaugcucauaaaauaagaaugaagugaaaauacuauauuuguacuuuuuuaaagcuuggcaugguguguaaugccuuuaauaucagcacuugggaggcagaaacaggacgaucucuaggaguuugaggccaggcaaugcuauauaaccuggucuugucucaaaauaaauaagaaaca

SEQ ID NO: 8496 - RNA, 37118 nt, Mus musculus
cagucccgcugcccggcgagcgccgcuggcggggggcgcaugcgcagucucagccgcggcggccccucuccacagucugaggggguaccgggggagccuuggccccuccgcgccgccgucuuuuccggcaguugggguucuuccuuuuguccuguccugucgcggaucggcagcugcgcucauucggaguccccggcgugucgcggucgcucuggagccgcccgcacgucgcgucugcgccgucucuguagccgucggccccgcgccucccuccccccugggucuggugagugucucccggccgucgccucaggcuugccgccucguccggccgucccacagcuccugugcacuccagggcuccugucagcguucucucugugguccccagagcccccuuguccgucccucucuuucuacgccucuguccucaaccgggacaggcagccgcucccuccuuuccuagucgccagcuuugugugucugcugccaccggcucguccccucugaccucggucaguaccacucugcaccuuaggaugagagaaccagagggugucugcacuucgagagcuccccccaccccgggguaggugugggaccuuggaggcugucccccuaguccgcgaucaggggguaccgggcuuccccucaccuuaagauccccgcccguggacugcagacuguuaaaauucgagaaaagggaccgagcuggaggacagggaaaaguggcagaagagucggaggaaaagugugucagaaagcgcauaacggcugcugccagcggcgcccugcaaaggacccagagacauaggggaaucuugcucuuuuucaagaugaauaggaaggucagcggcgugaaguagcuucacugcuuccucuuccuucagcucaccuuggcugugaaguagccaguacauacgguuucccuaaacaaaaaaaacaaaacaaaacaaaacaaaaaaaaacaaaccacaucgcugcaagaauagcucccugccccaccccacccaaacaucagauagcagcuuccuccuaacccgauggcucuguccucagacucuggacagcacaccaguguacacacacacccacuucaacaucaggcauguucuccacucccgggaguggacuucacaaauggagcauuuugucugagauggggucugaauguguaccuaugccuggccuggaauuugcuuuguagacuaagguggccuagaacucacggagauccuccugucucugccuccuaaaggaauaugccuccacagaccagcccacuugugacuugugacuuuacuuuucuuucuuccuuccuuucuuccuuccuuccuuccuuccuuccuuucuuccuuuuuuuuuuuuuaaagauuucuuuauuuauuuuauguauaugaguacacuguagcaguacagaugguugugagccuucaugugguugcugggaauugaauuuaggaccucugcucgcucugguuggcccuuuuuuuuuccuuaauguauuuuuuuuuuuuuucuuuuuuuccggagcugagaaccgaacccagggccuugggcuugcuaggcaagcacuuuaccacugagcuaaauccccaaccccuccuuaauguauuuuugugacaggguuucuuuguguagugcuggcuguccuggaacuugcuguguagaccagucugaucacuaacuaggagauccacuugccucugccuuccucuugugacccuuuuuuuggguguguguguguguguguguguguguauguguguccgagacaggauuucccuguguagcccuggcuguccuggaacucacuuuguagaccaggcuggccucgaacucagaaauccaccugcuucugccuccugagugcugagauuaaaggugugcgcccccacgcccagcucaugugacucuuuaaggaguagccauggcuucaucuugaauugcccaaugaaagagaauagaccuuuggugacaaggaaauaaaauguuggugcaaugguuuuuguagagauggagguaccauuguaaagucauccagccaggcauaacucuauagugaauaaaacaguuggcucuugugugagcucauucugaggucccagucccuagugcugaguuuuaugaagcguauaugcuuuguuaaacugaacuaagacuuuuuuguccaccauccucuaacucugcagagccaaaggagccugaaguaaguaggauuccaguggcuuauaagacagggcaggaagcuugaauuaugaaaagcaggagggaaagcccugccucauaagaagcacucgguugacccaguaaacccguaaauugcuauugagcaauauuaauuggaucuuuugauuagagguuauuagaauuaggcuaaaccuuuuaugaguggagguagagagaagggcuugaacaaaggucaaaagggcuggguguggugggccacuggggcacuggguagcaaaggcggguugaucugagguggaggccaccuugccuacauagugagccugggaaggagagcccagugcuuagcauugcauuagguacuggcugaagaauaaaaggauucugcuggccuguuauauuugacaucugcgagcgcacauaauaucccauugaccuuuuaguucuuucaagauagauucucacuauauagcucuggcuauccuggaauucacuauguagaccaggcugcccucaaauucacagaucugcaugccucugccucuggagugcugugauuaaagaugugugccauuaugcccgguuuccuguggaucuuuuuauugauugauugauugguugguugguugguugguugauuuuuuucaaaacuggguuucucuguguagccauggcuguccuggaacuccacucccuuuuaagcucuuguggagcuuuuuuaagugaauaagaugcagcccccagccucuuuuuuguucuggaauagaacccagggccuugugcauucuggacaagcaccauacaaaugaacuacuucccuguguguugcucaguucuuuauauaccagucuauaaaugaucucuuccuuccuacagcuguguugagaacuaaaaaucauuagcuugcucaacuugaaccaacuaauuacucuuuauauggaaggcauuaucugccugcaugccugucuucuuucucuucuaacaccaagcuauauuuucaacccuuaaauaauuuuaguuguuaaaauguuacugucaagccggguguggugccacacgccuuuaaucccagcacucgggaggcagaggcaggcggauuucugaguucgaggccagccuggucuacaaagugagugccaggacagccagggcuacacagagaaacccugucucaaaaaaaaaaaaaaaaaaaaaaaaaccaaaaguuacugucuagcugggcuaugguggcgaacagcuuuaaucccagcccuugggaggcagagguaggcggauuucugaguuugaggccagccuggucuacaaagugaguucuaggacagcgggggcuacaaagagaaacccugucucaaaaaaccaaaaaaagaaaaaaaaaguuauugucuguagagccuggugugguggcucaugcuuggaaucccagcucuugagaagcugaggcaggaggagugccaugaguucaguaucagccugguuuaccaaagugaagcauuuuccacuuccaugugaacauacaugcacauacacauaaaauaacuauguauauguauguaggaugucuagacauuucaacaaacaacucucacucgccucguuuuaagguuuuauuuauuuuguggugcauggugggguggugguuagagucuuuugguggcuucucauggcaaguuuguagaggucagagggcaacuugugggaguugguuuucuuugacaaccugugggucccaagcacugaacucaugucuucaggcuugguggcaagcacuuuuaccugauaccauuuuacugcccugcauuuuauuuacuuuuuaugucugguuuuuaacucuugaaacacacuuagagugcaugugguuuucauuguggguggaggguguacaggcugacaaauaagaaaccacacccaaacuucagaaaccagacgguuuuuuuuuuuuuuucaaaaauuuuuuuaacuccucuaucuuucuaaaagcaguauguuuugguauuaguaggaacuucccuguuuaaaaaacaugugauauuuuaugagauuacuuuuaaguaauucaguguuuuggauuugugaauacuuuacuuuugaugucauagagcaaaauguuuggcacuaaaauauaucuuugauuuugaaucucuguucuggaugcauuauuguuuauauaguuuuugucugaauaucuuuaaaaaccucccacugauaaucccaguaccaggaaguuaggcaguuggucauuuugaggccagccaggcauucuuaguguauuccaggccauccagggcuuuacagcaagacuguuuugucuuuccauuuuuuuuuuaagauuuauuuauuuauuauauguaaguacacuguagcugucuucagacacuccagaagagggcgucagaucuuguuacagaugguugugagccaccaugugguugcugggauuugaacucuggaccuuuggaagagcaguugggugcucuuacccacugagccaucucaccagcccgugucuuuccauucuuuacaagccuuaauuuaaugcacaaaacaguuuagaaagcugggagugucaagggaugaccuuuaaauguuuuuucauaaagugaaccugcuuugaaaauggcuuucuagcccugugugguggcgcacaccuuuaaucccagcauuugggaggcagaggcaggugaauuucugaguuugaggucagccuggucuacagagugaguuccaggacagccaggccuacacagagaaacccuaucucgaaaaaaaaagaaaauggcuuucugcuccuccugaauuuugcucuacuuccuguugggguaaaaggacagaacccauuaggcauggagguacacaccuguaaccacagcauuuggguggugaaggauagugaguucuaggccagugugggcuacgcagucacaccauaucaaaaaaaauuccacuagggagggagguggaggaaguaaauucauugauuuuacacaaaagaaagcuggcuaaggacaaacuuuugaauucggucacuuaugcuggagcaguuuaguuugucuaacaauaagccaaguauagguuaaugugguaggaaaugagauuuuaaauuuaagaagaaaaacauuuuacaaaccuuuagaccugcaggguuuugcuuuuuaaguacaaaaugaggaaguuggaucuuugauuuuuaagguaucuuugagcauuagaauugugggucaauuuucuuuuuuguaauaguguuuuuuuuuuuuuuuuuuuuugguuuuucgagacaggguuucucuguauagcccuggcuguccuggaacucacuuuguagaccaggcuggccucgaacucagaaauccgccugccucugccucccaagugcugggauuaaaggcgugcaccaccaccgccugcugauuuuguaaguuuuaaugacaauuaaaaaaaaaaaacaggccgggcgugguggcgcacgccuuuaaucccagcacuugggaggcagaggcagguggauuucugaguucgaggccagccuggucuacaaagugaguuccaggacagccaggguuauacagagaaaccuugucucgaaaaagccaaaaaaaaaaaaaaaaaaaaaaaaaaaccuuacaaagucacaggaaaauacaaucuagaauaaaauuguauucacuuuuucugccuuuucaauacaccaggcuggccucuaagucuuuuauguaaguugaagaugacuuugaacuucugagccuccaacacccaccuuuuagaacggcaggcuuguacaccccugauuuaccuuacuguaaauaauugaauauauuuagcuggaauuuucuauacuugcagucaguucuauuauauauuuauuuauauuauuucuaguauuccuuuguuauuaaaauguuucauugagcugacuggugguggcacaugccuuuaauuccagcaauaugagacagaggcagaggcagaggcagguagaucucagaguucaaguccaaccaaguuccaggacacuacacagagcuacacagagaaacccugucucaggaaaaaaaguuugauugaaccaaauuauguagggaucuuuucuuuuguaaauguaugaauguuuaugaauuauuuuuucuuuuuuucuuuuuuuuuucuuuucugagacaggguuucucugugcagcccuggcuguccuggaacucacuuuguagaccaggcuggccucgaacucagaaaucugccugccucugccucccgagugcugggauuaaaggcgugugccaccacgcccggcuuuuuuugguuuuucaagacaggguuucucuguguagcccuggcuguccuggaacucacucuguaaaccaggcuggacucaaacucaaaaauccaccugccucugcuucccaagugcugggauuaaagucgugugccaccacugcccagcaugaauuauuauuucaagguaguuuccuaguuaacaaaaaaauggaauuauguauaauuguggguauauuuuuugcuugcuuugagauagggccuguguuagguuuguuuguuuguguguuuugucaacuugaugcaagcuagaauccucuaagagaaagggcacuugaguugagaaaaugcuuccucaucaucagugugccaccacugcccagcuccacuggaacuucuugaaugacgauugauguggagaggcccaacucacuguggccagugccauccccagacaguccucuugaaguauaaaaaaucaggcuauguaagcuauagagugagccaguaagcagcacuccuccauggcuucugguucaguuguuuccaggcuccugccuugaguucucguuuugucuucuuuuagugcaccauaauuugggauauuuaagccuaauaaacccuuuacuuucuagguugcuuuuggucguggucuaucagagcuaugguuggcuaacuaagauggugucaggugccagugucuccugaacauugaaauuacagguagaugacacuuagcuuuguuuccuguugcugugauagacacccugacgaaaacaacuggagggagaaaggguuuguuugcuugcuucacagguccgguugcagucccuuguuguggaaguuaaggaaacaggaacuugaggcaggcuguucacaucauacccacagucaagagcagagagcagugaaccaaugcugucugcuagugcucacuuuccuuuuccaaacguuaaaagaggaaaguguauguggcguggacgugugcaugugcagcaggguuaguccugaggagggauccgagucccuagagccagacucacaggugguguucagcugucacaugagugagugcugggaacugaacucugguccucuuugagaacagguucucuuaacuacaagccaucucuccagcucugucugguaucgcucuggaaaauccccacagacacguucacaggccaacccugucuagacagucucucauugagauucccuuuccaggugacucuauguugugucaaguugacaguuagauuaaccagcacacauggcuuuuuugccuggcccuuguuucauguuauguuuguccuccaggaagaugguacccauuuauauuuuuaccaaggguucaggggagugcugaagaugcauaccaacaccucucuuuuccuccuagcagccauggcaaugacaggaucaacaccuugcucauccaugaguaaucauacgaaggagagggugacaaugaccaaagugacacuggagaauuuuuauagcaaccuuaucgcucaacaugaagaacgagaaaugagguaaagauuucuauuuggaaacauugcauuugggggcuggggauguugcucaguuauagaauguguaggcaccugucauauacaaggcaaaaaaccaaaacagaaacaaaaugaaaaauuugcugugguuacauguagcaucauaucuaguacauaaaaggugaccaggguuguagccaccauguuguagccugucaacugcagugggaugacagugaggcagauuuccaaauccuuccuauaaaaacugcuggucagaaucuaaagcuccauugcauuaugaggaaaucauuugcuuucauugcuuguguucaucacuaaagcagggagaucucauggaguagcuccuugguuugccuccugccucaggaguagcagcuguaugaggcuggagcugguuccuaaaggauguuucugugucagcuuccucaccaggaaaguggggauaaugcuccuugucuuggaggagugcuagagaguuggccaugauacucgaguacuugccauucaaaugacuuacuuaaugggaacagugauaaccauuccuuuuuguuuuaaaaaacuaaacagagccgggcaugguagcgcacgccuuuaaucccagcacucaggaggcagaggcaggcagauuucugaguucgaggccagccuggucuacaaagugagcuccaggacagccagggcuauacagagaaacccugucucugaaaaaaaaacaaacaaacaaaaaacaaaaaacuaaacaggccugcuaggucucacuauguagcccuagcugucuugaaauguagccuguagaucaggcuguccuuaaacucaccgagauccgucuaccuuugccuccagaaugcuggaauuaaaggugugcgucuccaugcccagcuguuguauugacuuuuuauuauugaguuucaggaguucuuugugugccccagauaccaauuuuuuguccuguguucuaugagcacuuucucccaguauguagcuuucccacugucuuuagaugagcagacuuuuaaaauuuuugauaaagucaauuuggcuuuuuuauuaaaauuuuauuuuucauguuuuuucuuuuuuuccuaugaguguaucuaccaugugcuuucaggugccuaaggaagaccggaaucacacguggucgugagcuuccuggugugugcuagggacugaacugguccucggcuaugacagugaacacuuuuaacuuucaggucaucucuucagccccauuguuuccuuaaauuuuuauauugcaguuauuuuuguuugagagugugugcacgggcgaguauaugggcaagcaugugacagcauauguguggaagucagaugucuugcaucaguuugaacccuuccaccacacauguagauucuagggauuggacucaggcuugguggccggugucucuacccauugaaccauccugaugagccagcauucucuccuuauuuggucuugauagucugugucguggagacauucucuguucuggaauuuuuguuggcuuggccuuacagguuuaguucuaugauccauaauacacuaaugugugggugggauguguauuugcucuaguacauguuggaagucaaagcacagcuuucaagacucuuuacauggcuucuggcaucaaacucaaacuauauucuccaguuuguacagcaaacaucuuuauccacugagcuauccugucccccucuaaguguacauuagguaagacuugagguauauauauauauuuguggguauauauuauuuccccguaagaccuuuuuggaccuuguaagcucuuuaauguuguuuuguuuuguucuuuaaauaaguuuagucagccuguuaacauauacaaaaaaauccagagauugugauuggaauuauauugaauguguugaucaguuugggaugauuguuguaacaauguugaaguuucugguaccucaacaucauauauuucucuacuuuacaauucuuccuuacugcugcauuaauuuccagcauuaacuaacgucagaggaggcagauauggcuaugggccuggaacguauagcuaggcacauggcuggaugagcuagguggucagguuaacuuagaugagcugaugagagucugcccagcugaggacuaagcuuugaaauacuaaaaggucuuuguguuguuauuuggggaaaggcugguuaaggaauaguugcugcugaauuaauuuccaucauuaauuaauauauacagaacauaauaaucauuuagcuugcacucccuaggggcuagugagauggcuaagggguuaaaagcaccuguugcucuugcagaggaccuguguucaguucucagcacucacaugauggcucuucugaccuuccugggcaccgcaugcacguggugagcgauguucaugcaggcaagacacccacaacaaucacuuaaaauaaaaauaaaccuuuaaaaaaaaaaaacagaaaagacaagguuucuuucuauguaguccuggcugcccuggagcuugacagauaaacccaaguucugccuggaacuuacagagauccuccuaucucugccucaaucucugaaaugcuaggauuaaaggcacacacacacuaccacacuaagccuaaaaaugcaucuaaaaagcgauuuuuaaagugucccucgaguuuucuuuuaagcaguguuuaguggguaguuccuguguagugacugcuuuucuacaucuagauuuuaugcauuuauaaguauuuagaaucuuagccaggcagugaugguguagacuguuaaucccaguacuugggagucagaggcagggagauuucugaguuugagggcagccuagucaacagagugaauuccaggacagucagggauacacagggaaacccuguuucaaaaaacaaaacaaaacaaaaacaaacccaaaacagaauaaauuacgaucuuguccaguuauuugcugcugcuguauugucaguagccgacagacaggacauccuaaguaaagguucauccaugggcuugaaguugcagaaacucagccccuuuggcgagcugugggagcagcucucauggggacagcuuggacgggaugcagccccacaggcaugcucccauaaccuacugucucuucagaguuugacuccauuaguggaguacaccauucuuuagguuagagcccucaugcuguggcaaagucucugggaacagcauauauaaugugccuucaaaaucacuaucuccucaugagucauugacgugugcuucuuuuucccuuuggauccaacaguggguuuaguuaguggguuucauuuuugcuuggaacaagagugauuggcagggguucuuuuagugaauaaccaagaugaucuuggaagugaaaaaaaaauuaucgggcuggagagauggcucaguggguaaagagcacccgacugcucuucugaaggucaggaguucaaaucccagcaaccacuccauccaucugacucccucuucugaagugucugaggacagcuacaguguacuuacauauaauaaauaaauaaaucuuuuaaaaaauuaucauuuauuuuauuuuauguacaggaguacacugaaaaccaaaagaggccauaggauaccauuacagaugguugggagccaccauguuguugcuaggaauugaauugaacucagggccucuggaagaacagucagugcuccagccccuagaaaugauuuuuuuuuaaaaaucacuaguauauuguguuuuaaaauuuuuuuuaaauuuauuuuauuagauauuuucucccuccgaaaauccccuccccuuauacccuacccucucccccugcucaccuacccauuccacuuccuggccugacauuccccuacauuggggcauagagccuucacaggaccaauggccucuccucccauugaugacccacuaggccauccucugcugcauauguagcuggagcuacauguauacauauauguagcaugaguccuaccauguauacucuuugguuggugguuuagucccugggagcucuggggguacugagggggguaguucauauuguuguuaugaaaaaauuuuaaaaagauuuauuuauuuugguuuuuuuuagacaggguuucucuguauagcccuggcuguccuagaacucacucuguagaccaggccugccuccaacucccaagugcugggauuaaaggcgugcuucaucacugcucagcuugguaauaguuuuaaugacaguugguaaugggacauuuguacuuugagaauaugucuaauauaugaugcaguuuuaaaugcuaaguuuuaggccaguaaauuuugagagcaaguaauauaauuuuacuuucauauucugugccuuaucuaguacauacauuuaauuaaacauccaauuucuaccacucaaauguagguuuuguacuauucuacuuuaguagagcacuuaaggagcuggagagaugacucagugguuaagagcacuggcugcucuuccagaggaucccgguucaguucccaacacccauauaacagcucucaacugucuguaacuccuauuccaagggaucugacacccuuauacagauauauguauguguguguauauauauguauauguguuauuuuuauacauauauauguauguauauacacacacagucaaaacaccaauguacauaaaauaaaaauaaaaauaaauuauuaaaaaaauaagacaucaagauuauuuauuugauauagucucacacauagccuuggcuggccuuuagccaggucucugucucagcuuccagauugcuaguuuuauaggcaugugcugucacaucugacuaaguuuuuacuuuaaacagaggaacuacuuacuacauggugagguuugucuaaauucuggagauggaagaaagaauaaauuuaauuuggaaauuaccucuuguauacuaguaaaacaggagaaauuugaaccacuucauggaaauacuauaguaagguucacagguugguucagaacaguucagcauggugacccacguccacuugggaggcaagaggaccaggaucaaggacagccucagcuaaauauugaguuuaaggccugucugacuaucugaaacccugucuaaaauaccagcaaaacaaaagagcuagccccacagguguaggguguuuccugugugaugugugcuccucagauguagagcguuacacuaugugaccugugcuuccuggucccugagguagcuugcaggccacacaugcucuaguucugucggcuguuugccuucuuuagcucguuagccucuaagcuucccuagaacacugacuguccuauuguuuucccugguacacagcuaagguacccagcaaauguugauaauuaucuagucaugaaaaauaauaguuuguauaauucuauagcaaucuaauuaaaaccaaggaaacaggcauuuccucugauaaaauauuguguuuauuuuuuucuuccugaagauuguccuggaggauuagcuaaagccaugaaucuaacuuaauacauaauaaugguugccccaggugugguggcacacgccuuuaaucccagcacuugggaggcagaggcaggaggauuucugaguuugaggccagucuggucuacagagugaguuccaggacagccaguauacagagaaaccagagaaacccugucucaaaaaaccaaagggggggauuuauuuauuuauuuauuuaugugcguacgcuguaguuguacagaugguuaugagccuuuaugugguugcugggaauugaauuuaggaccucugcucacugggguuggcccuguucauucugccccaaagauuuauuuaugauuauuuuuuuuaaauauuuuuuuaauugauugauugauuuauuuauuauauguaaguacacugcagcuguccucagaugcaccagaagagggcaucagaucucauuacggguggcugugagccaccaugugguugcugggauuugaacuucggaccuucggaagagcagucgggugcucuuacccacugagccaucucaccagcccauuuaugauuauuaauaaguacacuguagcugucuucagacacucuagaagagggcaucagaucuuauuauggaugguugugagccaccaugugguugcugggauuugaacucaggaccuuuggaagagcagucacugcucuuaaccauggagccaucucuccagcccccucuuucagguuuucuuuuuuuuuuuuuuuuuagauuuauuuuuuuauuauauguaaguacacuguagcuguuuucagacacuccagaagagggcgucagaucucguuacggaugguugugagccaccaugugguugcugggauuugaacuccugaccuucagaagagcagucgggugcucuuacccacugagccaucucaccagcccucucucagguuuucuuaacgacgcaguguuuugugugaucugaagcucacuguacugucaguggugaccuguggaucagggucaguuuuaucuuaacuaagguucagggcugaagauauuucuuuucuuaguguuggucauggagauacaauugcaaguuauuuuuuaugcuauuuuccuuguucuuaucugugccaugagcaaauauuaguauuuugaugcauguuuuauaugcauguaugucuagaccacuugccuggugggugucugcaaaggccagaagagggcaucaaauuccuuggcccuggaguugcagacaguugugcaguguuguaggugcugggaacugagccuggccuuccacucugcuccagcaccacucucugcuuuuuuuuuuuuuuuuugguuuuuuuuuuuuuuuuuuuuuuuuuugagacaggguuucucuguagcccuggcuguccuggaccucacuuuguagaccaggcuggccucgaacucagaaaucugccugccucugccuuuuuuuuuuuuuuaaauagaauuuuuaaauaauuaaaaauuacacugguuaaguguguguguguuuguguguguguguacauacaugcauuugugcuaugggacaaguaggaccgauuucaggaaucaguucucucuccaucuuguugguauuugggaucaaaaucaagucaugcuugguggcaaucaccuuaacccaaagucuucuugcuagcuucuguuucauuuauaaacacaaaauucucuuaccugucauuguaguucuuauuuguuuuucuuaaacacauuauaaaaauguguuucaugaccuuuuuuuguucuguuuuguuuuugguuuuuugaaacaggguuuuucuguauagcccuggcuguccuggagcucacuuuguagaccaggcuggccucgaacucagaaauccgccugccucugccucccaagugcugggauuaaaggcgugcacuaccacugcccggcuauuucaugaccuuuuaucuaagugaauacuuacaagugcuuaacaauucuguuuguauaggcuugucagaauacaaaugcuauuuuaucuuuuuuuuuuuuuuuugguuuauuuuagacaaaagaaguuagaaaaggugauggaagaagaaggccugaaagacgaagaggugauuuauauggggcuuguucccggguuccagcgugaagguuauguuuucuucaucaaguuagcuuuggugccagggaagcguuuggcuccgugacaggaauuugagaguuagcaugcuuuuggauucaguuacucauucagaggaagacguuaauuaggugcuuaggagagggcggucucucuagucacaguuauggugauuaauuagcuuuagaauucuaagaaaagaaaagaugaaauuaguuaaacuaaauuaaaauuuagaagaacagagugagaauuuuuuaccaaguuguggugcuucauacuguaaucucagcacuuggaaguugaggcaggaggauugcugcaggauugaggccaaccugcaccagagggugagaucuugucuuuaaugagugaaugaauuaacugaaagaccccguagcaguaaggaacauuucugaagucguuauuggaacaggggacugccuccugacagcccuugugcacacagcuuacagaugugaggcaaagauacaccagugaggagggaugcagguagccaaacagcucuggcaacaccuucagaaacgugggugauacagcccaggacagugguagcaaguccccagcacagggcauugaggccagguggugaaugaaugcuaguauguacuggucuuggaggacuuuagaaaaacacccuuaccuaagaaaaggcucauggaaaauguugauuugucucucaccauuagaaaggcuagauuguugaaguaguuucuucagaguucucaggagccccacacccccuucaguguggcuugcucguuaugucugaugaccugggaggggagaaggaaccacuagagcaugcuugugugaugcugucagucacagggaaaaugggaagauuauguauagacuagcguggcucugcucccagcugcacaagacagauaggaguugguuucagaauuucagcuuuccuuccuuuucuuuguauaaacauuagaaacgacucagaagauccgcgcacgcucggaaggaaacagaguuucuucgauuaaagagaacaaggcuuggacuggaagauuuugagucuuuaaaagucauaggccgaggagcauuuggugagguaaaaaaaaaaaaaucccagaaauucaaagcuuuuaacaugccaugaguuccugaugguguguaauaccagguuagcuagggagagccugucuugaaauauauggaguucacuggauagacauguucacuucucuuuuucuuuuucuccccaguucauugucccagaucacuucugacuugucagagaggacauuagcacuuuguuuuuuuuggacagagucacacuauguagcccaaguuggcaucaacugugugaucccgcugccauagcaugcagaguguuacaggcaugucccacugugcugagauccugauguuaggaugcccaguauauuuacucauuaauucuggaaucaucacaguggauguagacauuaagacucugaagaugcacacggucugucagucacacagcuguugagcauagagaccagaggcugggcuggaguccucugccuugaagcuguugcuuucccaguaccaccguucucaaggaggaaacugaucuugucuccacucuauucccuaccagaugcuuacagcucuaaagagaugugccuaagcuugguuagacauacgcaugaauguaaugguagcacucuagaagcugaggcagaaggacacgccagcccagguuagcuagggauccugucuuuuuaaaaaaaaaaaaaaaaaaaaaagacagaccuugaauuaguauagagcauuaaaggcccagcugcugucugugucugguugcaagaaucaaauguagacaggugcucugcccuucugcugcuccccaggccuuuacuuagcccagaucuuaucaaugaauccugcugcacuacaagagcagucucgggaaaacggugaaugagcucaugccaaggucauugccauugauggaaaacaugcaaaggcagcuuacugaugcaguaauuacauggucuccguguagaaggagaaacaugguauaaacaacaguacucaggggagaacugcauauuaucgugaagagacucucaaaagguaaaauugacccuucaguugagaauuccaguuagcccuugagaauaaggaaguguuguucaaaaugcucccuguucaagaaaaagcacaugguacuugauuagaaagacaaaaugcagaaagacauaggggaaaaaccacuucucagucuuuuugacugagaucagguguaguaucugcucuuagcaguuuaauaucuaguauguccuccaucuaaggacaguaaauuaaauggaguuuuggaccugggagaaggaacaggagcaugcucuuugacuuggcauugcaguaagagaacaaaaccccacaaaacuuagguaucuugggggaaaggagagaaugcccaggagcuugccaggagguuuuccuuuuuaauagaccauuaguuuucuuuucacaguacaauuuucucuuuaaaagcacugggaaaauggugcuagagagauggcuuauugguuaaaagcccuuacugcacuuuuagaauacagugcccacuuacagacacauucacuuuaauuaaaaauaauugaauucuuuuaaaaaauuggaaaauaggcuggacauaguagcuuaggucuuuaaucccagcaccuaggagucagaggcagauggcucucugugaguuuggggccuuuucuccauagugagcuucaggacuacauagauccugucagaaaaaaaugaaaaaaaaauagagaaagaaaacuuuuuuccuaauaaaacauuuucgaaagaauuuaacagcccgagccuugggucagugguuagggcacucacugcucuugcagaggaccugacugagcucuguuuccaggacccaccaggggacucacaacugcacacagcucuaguuccgcgggaucggagacccucuuuuggacuccuugaguaucugcacucacacauauaccuacacacagacagacucaugcacauacaauaaacagaucacuuggguauuguggcccaugguuuuaagucagcaugcaggagucagaggcacacagaucucugaauugggcaccagcuagggcuguacagugagccucugccuaagugguucggagcaucugcuucucuuucacaauucccaguguccacaagucggcuggcaacugccuuuccuccagucccugaggaauccauugccuuuuggcuuccucaggcacugcuuacauggggugcacggacauacuuguaggcaaaacacccauucacauaaaaccuaaguaaguaaaguaaagaaauaauuaaaacacuuaagaaguggggcuggagagauggcucagcgguuaagagcacugacugcucuuccagacguccugaguucaaaucccagcaaccacaugguagcucacaaccaucuguaaugagaucugaugcccuuuucuggagugucugaagacaguuacaguguacuuacauauaauaauaaauaaaucuuuuuuaaaaaauuuaaaagugcuguuuaauuucuauuuuacuuuauuucuuccaagaagaagguuuauuuuugugggguuuuuuguuuuguuuuucuguuuuuuugacaaagggucucacacagcauaggcagacuggcuucaagcuggugagagcucugcuucagucccucagugcuaggauuacaaguggaucugauguauaauuuucauauuaaauguugugauuuuuacuuaggcuuucugagucaacugucggguauuugccauagguuuaacucuggauauuugccaugccuuaaaaugaaacuaaaggcuuuuacauguguucaacucggagucaaagcuguugagcucuggagacagguggaagucuucucaucgcugucacagcuguauaguagauuuguuuguaacauugaaagugucuguuuuugcauguuuaagcaauacuagcuuacauucagauggucaugccuuucuugugugaguaguauuugugaagcuucaguaugcuggaaacgaaaauccuuagcuuggcagugugaacuugacuuaccacaucuuugggacccuuccaggugcggcuuguucagaagaaagacacagggcauguguacgcaaugaaaauccugcgcaaagcagacaugcucgagaaggagcagguaacugagcgggagcugccggcagucagcuuugggggcuuguugccuaauuacacucugauggcuuaguugucuuuauuuuacuacaguucucucuaguuaguucccuuaugcauauuguccuauuuuuuauccucaaaagaugcacuuguauauuuaaaaauauaaguaagggacuggagagauggcucagcgguuaagagcucugccugcucaauucccagccaccacaugguggcucacaaccaucuguaaggggaaucugaugcccccuucuggcauguggauguauaugcagcagagcacucauuaaaauagauaaaauuuuuaaaaaacuacaaguaagacccgugaauacagauaguguguuucacaguccaggcugugaggaagcagcuuuggguccucgauaaccacagcuacacuugcaagagacccuccuuugagcucacgccugguaugaugggaguuuuuuguacuccuuggauggggauguagaacuggcgagucugaauacacuauaaccugaacaccuaaccaaagacggguccucugugaagcuuacugaugcgccaguuucugaauuaauguggacaguguaaauggcagagcagcagaaggucuccuuuaugguuaggaacggucuugggccguggagcuuccagcagagugcuuguguaugaugugcaaagcccugggcccucccuaguuaacagcccacauuauccaguaaggaugaagcucacgaugaaacuagaucugacauacauacuuaaugcaaauuccguaggauagcuuuauuuuuauuuuuuuaaaguaagaguucagcccuucugugggucuguugagcugguugccucagaagagguagcagugggugacgcugcaguuugaggccagagauguugugccaggcagaacucuucauuuggagcccagcagcgaggauagaggcuguccccacauuuaguguucucugcccacugaggauuguaaucagggagcauuuccuguccacauucaagugccucuucagaccugugcuuugggggcuggagagacagcugaaugguuaaaagaacuagcugcuguuccagaggaucuggguugaauuucuagcacccauaugguggcucuggaauggucacauuccagucccagggaaugugacacccucuacuggccucuuugugcagugcaugcacaugguacucagacuauacauguaagcaaaccaaccauucacauagcaguuauuaagucuuuuuuguuuuuuuuucuguuuuacuaggaagccuugaauuccucuuuuucuuuucuuuuuuguuuguuuguuuguuuuugagaccggguuccucauugugaccagcccuggcugucauacacuugcuuuguagaccaggcuggccuugaccuuagagcucuaccugucucugucuccuaaguguugggauuaaaaguaugcaauaccaugcccggcuaagccuugaauuauuuuuauuucaaauauuuauuuguuuauuauguauguaauguccuggcugcauguaugcuuacacaccagaagaggguaccacaucucauucuagauggcucugagucacuacaugguugcugggaacugaacucaggaccucuggaagagcagccagugcucuuaaccucugagccauguauucagcccaagccuuggauucuuaauuccaguuaaaaguagaucuuuaacaaaucuucagcuauuauuguaguuuaugcaaacaccaacugauaugcgagugccuuacagcccuauguaugugcugcccagaggucaguguaugguguggauacaugcucaggcuccaggaaagaggaccaguuaaucucuuugaggaaaacaaugucuguguuguuuaguuaggauauuuguggguuaugaguaaguuuuacaguauguauguccuaucauuuuagccaaaacucaaaacuccugucaguuuguuagcuguucugagaguuagaaguggggcuggugagggcucagagugggaaggugcucgaugugagguuuucugggagcugugccuugccuuccauucacacacaaacauguguacacaaaacaaaauauuuaaaguuaggaaagagagugugguggcacaccuuucuuucuuuuuuucuucuuucuuuuuuuucuuucuuucuuuuuuaauauuuauuuauuuauuuauuuucuuuugugguuuuuccgagacaggguuucucuguauaucccugguuguccuggaacucacucuguagaccaggcuggccucaaacucagaaauccuccugccucugccuccuaagugcugggauuaaagugcgccaccacugccuggcuuauuuauuuauuuuauggaugugaguccacuguacuaucuucagacacaacagaagauggcaucauauuccauuacagaugguuaugagccaccauguaguugcugagaauugaacucaggaccucuggaagaucaggcagugcucuuaaccacugagccaucucuccagcccuuggauugaguauuaaugaacuuagauuugauucacuucaucuuuggaucuugugacucuuuuuuuuuuuuaagauuuauuauauuuauaugaauacacuauugcucucuucagacacaccagaagagggcaucgaaucccauuacagaugguugugagccaccaugugguugcugggauucgaacucaggaccucuggaagagcaguuggugcucuuaaccacugagccaucucuccagcccccuugugacucuuaaaaaagaaaggaggaguauaauuugagaauauguaauaauguuuugguuauugcuccauauuguaaauaauaucaguuugauauaaugaucaccaguuuugagauagggugucaccuccaccucucaugugcuagugcuagaccugcaggcaugcaccccucccccacacucugcuuuccauggugcuggggaucaaacccagggcuucaugcaugcuauuuaagcucuuugcuagcagagccacaccccugcucauaaagcauuauauuuuaaaaaagugauucuaccaguucccccaagcugccuguaguuagguguugcagcaaauguagaaaaugagaaacgccaugauuuugaaucuuuaacccaguguaaauguuuuuuuucauccugcaguguagugcccagcagugagcuacagcuacagagugcugcugugucauggugaucugauugucacucagggcuuuguuauuuugauaucaguuuggagccuguagcugaguuuuaaguaacaugagcacuuguauagacuccuugaauagcaagaagguccuggguuccaucucaggcauugcaaaaugaaacaaccagacaaaacagaaaccucagacagaaaccaguucaccuagauaguguagccugaggugggacugcucagggucucaccuugggcacuguuucuucuacuggauuacuagagcagugugcuugcuuuaccccaagaaccuaugugguguuucaugccuauaaucuuugauuuuggagauagaagcagagggaucuggagguagaauucaaagccagcauggaauacaugaaucucugccuuaaaaaaauaaaaaauauaaacuuauuauauauaacaugcauauaaucauauauaauaaacauauuuauauaaaaggacaguaauucuaacuaaucagagauuuacuucauaguacugcugcaguuguguuggguugaagccauucauucauuucagcagauuucaaagccuuucuuaccagguuucugucaccaaagagggcucaaaugucaguuucaagguggucaguguguguuagcagaacuuuugcucaucacaacuaaauauucagaacaguauuuaaauuguuuaaacagauauacaguuuacagcagagcaaggcuugucauuaaucaaaugcauauaccuccagguuggccacauucgugcggagcgugacauucuaguggaggcagacaguuuguggguugugaaaauguucuauaguuuucaggauaagcuaaaccucuaccuaaucauggaguuccugccuggagguaauuacuucacaaugaaaggucgauuucccuuuguucugugguuucucucucacaucagcaaugaaccuuccuuucuaccuguaacugugcucacagaacugcuuucugugucuguucuagguccguaaaggagggcaguagccagccuugugcugccugccucucugccggucauucacucgccauuucagguggacaggucuucuauuuauuuuuccuuaaacacauuuagacuagguaggagcucugccugcccgcugcuuguuggcacccggcauggguuguccagcugaucggacugaagugauagcauuguuugcuucaguguuuuuguuuuuguuuuuuuuccugugguuuguuagagugacucccucuucaccuauauuaauaccuagaguccaccucuccucucuaggugucacgccuagacagguaaggcagagcaggugucccguauguuuuggggacagucgaugaaccagugaauucugagcuaauagaaaguagcuuuuuuuucuuuuuggcuuuuacaaagcaaauguaauuaauugggacaugcuauauuggucucgugacaccccuuaguuuagacccagggucaccaguaauuuuuaacaacugaugaagauuacaacacagaguuggcugguagaacaccuuuuuccuuaagcacuucaguaguagggaacagcuaggcuaucaugugucuacuagccauuacugcagcucuuccuuagcuucucaugucccgcagacacugcccuuuguauuuggugaugcuggccugcagagcccuaagaccagcaggccugagcugucccaucacaugggcaagcccacacaaguaaggccauccaucagcugcucuccugggagugaaggcugcagugaccuuaggguuggccuccccacugccccuggccucagguagcgagcggagcgaguggcugucagagggcagcaggaggugcuaggaucagaggccucucucuuccuugcuuucuaaucuaaguagcuuuacaugagguggaaacugaaccauccuuuuagcuauuuuacauauuuccuuugcuuuuguuugauugcugacuuuuaggauaugaaucuuacuuuccucuugcuuuaugaugcugguauuaagcuuuaaauuuucaccuugcaggacacugagaaguuugucagucgaugaaacguuauaugaggauagugggagguguuaggaaaaggcccuguggucuugggaacgggcagugaccucaccugucaggcagcugcauuccaguggagaggagggacucagcauugugacugccgccuagcuucccacaguccucuucccauggguucccccucccccauguuagugggggaaccuuguuuaaaucucccaaaauauuuacauuuuacucaaccuuucauucuaaggcagcaguucacccuguguggaagugccauuucccucuagacagaugcuucacagacacagacacgugagcaaacguaaaagccaaguggauucccccuggguccaaaauacuguccuaaacaaauauacuuuguaacuguggaaaaauucucacuucuccaaagaggaaaaugaaauuaaaagcuagugcuuaggugggagauagguuuucucugagugugacuuucuugccuuuacacauuagagauuuguugcugauugcucccauguuaacacuguacaugacuuuauggggcacagcacaguuggguguaguugguuuauauuggcagauaaugaagauguaucugaaaacugguucuuacucauauuuuacgugugugugugugucuauguguguuuguguguguguacaugcauucuguguguauggugguggcuuuguaucuuucugcuuccaggggacaugaugacuuuauugaugaaaaaagauacucugacagaagaggagacucaguuuuauauagcagagacaguauuagccauagacuccauucaccagcugggauucauccacagagauaucaagccagacaaccuucucuuggacagcaagguaugugggcacacagcacccugcccagcgugucugcucggcugggcagugcugucuuggagugaucuuuuguauguuuuuguucauuuuacagguaaguuugccaucacauccugucucugaacuaugauucuguaauuuaaucuaauguccuuuaaaaaaaagcaggcacgauuugaaucccagcuuucaguagguaaagccaagcuggucuacacagggagaucuguggcagacagggcuacauaagugagacucugucucaagaaaguuaagcagggcauaguauggcaaagcaugcuggugcuuccaccacuugggaggcagaguggggaggcuaggaauuccuaguccagcuugaguuacaaggagaccucgugugcacacaacacaaaugcaaccaagucaguuuuguaauauggcagagacagucagucaucuucccugagcugaguaucuagcagccuuccucuacugacgcaccaggaggaagacagcagcagcaaaagccugccacaaaguccaccacaaagcagggugucacaugcaccaagcucccagaggagcccccagccucugcagccuauauugcuuucccucagugauacaagaagagucugugcugcuggcugcacuuuguguccacugguuucacuagggagaaaacagguguuauuaguauuuucaauaaaucccggggcgggguuacuaccucccucaaugguuugucccucuccagcagacugauuuggggauccauuagcauaagauuacaagcagcugcaauggguguggugcugcuuccaaguuuucagcucuagaauucuagaauguuuuacuuguaaaucagaauguuuuguuuguaaugaaagcguccuauuccuggugugaugaucuuucccgcugcagccugccugccugccugccugccugucuucuuccuuuccuucucuccucuccucuccucuccucuccucucccucucccucucccucucccucucccucucccucucccucucccucucccucucccucucccucucccucucccucucccucucccucucccucucccucucccucucccucucccucucccucucccucucccucucccucucccucucccucucccucucccucucccucucccucucccucuccccucuccccucuccccucuccccucuccccucuccccucuccccucuccccucuccccucuccccucuccccucuccccucuccccucuccccucuccccucuccccucuccccucuccccucuccccucuccccucuccccucucccucucccucucccucucccucucccucucccuccccucuccucuuccuuuacuuuagagacaggguuucucuguguagccugggucuccuggaacucacucuguagaccagacuuccaaaagagaucugccugccucugccuucugagugcugggaucaaagguguacaccacuguuucuuuugguaaucuucuaggugucuuuggaaggcccaggauucuugucuuucuguggaaacuuuacuugcugugccaugagggcaggaggcuggucagauaauauuuugugucagcaguucuguucuguaaggaugcauauaaagagccaggcaugaaggaaggcgcacagaggugaugucagcacugaggaggggggcggggggaccauggggcuagugcccagccugccuagccuaaacaggcaaguuccaggccacugaacgaagagaaaaacgaagagggagacaagccaaagaauuggcuacauaugguucccuuuuguacagauaugaaaaugucaaucugaagcccaucguuuugcauaaguaauauaugcuaauaaaaaagaauagucucgggcuggccagauggcgcagugguuaagagcgccgacuacucuucugaaggucccgaguucaaaucccagcaaccacaugguggcucacaaacauccguaacaaaaaaaucugaugcccucuucuggagugucugaagacagcuacaguguacuuacauauaauaaauaaauaaaucuugaaaggaaaaaaaaaagaauagucucauauaguaaaaaauuagaacaagacacaguuauaaggaagaaauguuuguuugguuuuuuuuuguuuguuuguuuguuuguuuggcuuggguguuuuguuuuuuuuuucuuguuuuuuuuguuuuguuuuguuuugagacaggguuucaagacgugggccaccacugucugacacaaagaagaaauguaaugugcggucucauaacugaaacaugaccagugagugauuucugguugggauuuuuuuguuuuugagauaggucucacuauguagaccaggcuggccuaaaucaaccuacuucugucuccagugcuagaauuaaagguaugggcuaccaugucuggcuucaauauuuaauugguuucucuagguagcccuggcugaaauggaacucucuguagaccaggcuggccucaaacucagaucuccuugcuucugccucccaagugcugggauuaaagacaugggccacacacuucgcuggaaaucuguuuaaauuuguugcuguguguuuuuccuuguaguaagcuggguaggagaagucuguuggcggagguguaaugggugcuggaagguaacaaugucugccuguccaggaguccacacaucccuuguuuccccuucccccacagggccaugugaaacuuuccgacuuuggccuuugcacaggccugaaaaaagcacacaggacagaauuuuauaggaaccugaaccacagccugcccagugauuucaguaaguuugaacagugauguuagcugccccaguccuuaaccuggugggugagugaguucccuggugaccaaacuauuuaggaaaccugagagcgucucccagcaguguacagaagagauccagcacuuuucuguauugcccaugcugucugacuaggcgagaugagcgcuuccaacugugcuaaugcagaaguugaggacagaacucugcuaggaagaugcuggagugaccauggcauaagcagcaaggaugacaggaugaaagcgcucagaacagcuccagaauaguuugguugcaagcauugucuuucuacuugagcaguaucagaacacaggaaagcauacuaagucacaguugaggcuugaggagauggcucaguggguaaagcucuugcccugcaagcaugaagacccgggcuugauuccuaggaugcauauaaagagccaggcgugaaggaaggcccauggcaaugaucucaggacugaggagggggacggggaacccuggggcuagugcccagcccgccuagccuaaauccucaagauccaggccacugaaggaagagaaaaacgaagaaagguggcuggcgccugagaaaugcuacgugagcucuugccccacacaugguuaugcaccugugugcacacaccugcgugugcaccugcacagacaugaacacaggaaccucacuucauccuagaaaacccacagugcaccuaagucuggaguccacuucugcucuuagaucuuugagcaacuuuaggaacugugagugucaucaucucuaugcuggaucaggcccauccacacagauucagguguggauuuucuggagugccacaaacuagguuuggauaagugugaaaagggaacauagagacggggugagggagaauagaaaggaugugguuguagcucgguagcaggcugcuugccuugcaugcagaaggcccugcugccuucaccaguaccauuaccaaaacccaaaaccaaacaaggcccauaaaucaauguccaguugagaaacauuugcgauaccuucucuacaguuuuuuuuuuuuagacuuauuuauuuauuauaugcaaguacacuguagcugucuucagacacuccagaagagggagucagaucuuguuacagaugguugugagccaccaugugguugcugggauuugaacuccggaccuuuggaagagcagucgggugcucuuacccacugagccaucucaccagccccuucucuacaguuuugauaaggccugucuguccuuucuagcuguaugagccacauaaaacuauucacaauuccacugugauucucucggagcugcuggguuuagaacuuauauuugggccaauagagcaagucacccuggagcugauugucuguguguguuuguuuuacuuuguugcauugagauacgcucuguguaucccaggauggccuaaaacuaaaagagaucugcuguccucugccucccgcuaccacaccugguccuaccuggaauguuugauggguguauguauggucugacuagugccagagugccacagaauucuuuuuugaauuuugauuaggacuugaacucucuucuuuuagcuuuucagaacaugaauuccaaaaggaaagcagagaccuggaaaagaaacagacgccagcuaguaaguaauaccggaggcuucugaaguacuaaaccagucugaguuuuaaaaagaauacuaauggugugggauuguggcucaguaauagucacuuaccugggaugccuugaacuuagcagcuuuuugauauaaagucuccuguagcauaggcuggccuaaaacuauagauagccgaggcuggcuuugaaaccaccccacccccaguccuuuccagucugccaauggacuaggauuauggcuaucccaccauguccaucuuaaaacacugucucucaaacuuaaaaugcucauccucagaggcaagucaggacuccuguucaucugccugccuugccuuacuuuguggcagacaaguacuugcuagucagaacuggagcggggauuuaagaauguuugcguuugacugugcacacaucuaaaauuaggccccauaagcuugaaaguaaguaaguaaccuuauuacauuuaccuugauaguauguugaaagcuauuuaaagaggguacauucaccacugaauuacuacuaagaaaacuucaaucuuaauucucuugugugugcacaauacacgucuguguguguugucagaaggcaacugguaggaaacuucuuccaccuugugguuuguggagcucgagacuuuauggcaagugcuggaccagaacucuguguguguguguguguguguguguguguguauguauguauguacgcauaggauccccuggaaggaguuagagauguuugugagccacuauguggguucuagaaguuaaauccagguccucugcaagagcagccauugcucuuacccguuuagcccgcucuccagccacagcagcauuuauucuuuuuuuuuuuuuugguuuuucgagacaggguuucucaguauagcucuggcuguccuggaacucacuuuguagaccaggcuggccuggaacucagaaauccgccugccuuugccucccgagugcugggauuaaaggugugcaccaccaugcccagcagcauuuauucuuaauagaugauuuguugguuuguucauacaugaagacuaaacaugaguuguacuuuguaaggguggucacauguguauuauguaggaagggcagcacuuugcuugucauguacauaguaauaacauggcaggucuauguguuaugggcauauuaccuaguaaagugcugacuuagacuuucaguguuuauuaacuugccuuguuauuaacugggcuuguccccucagggcuugagugacaaguguagaguguuaccugcagcacugggcuagauguguccuuucagacagcugagcagaaugaggaaggcucauucagguguagagccugcuuccuaacgggugcuuagucacuuacgcugugggcucuggguguguguagaagggcucuuuugccuuauuaaccaagcuuuauuguucauuuuggaaagugcugucacagguaaguuuguauuaggcuuggguuguccugcuuauguaguuuggggugcccugauggagcuugaggguuuuggucucuggacuagcauucugagcuuaggcacucacugcggacugggccucccuaaugugugcacauauuucaggccuucucuacagugggcacuccugacuacauugcuccagagguguucaugcagacggguuacaacaagcucugcgauugguggucgcucgggguaaucauguaugagaugcucaucgguaagcuccaugcuuccugugcacgcaggaaagauguuugcauugcuguuacagggaauugcuuggaggugaacuaggugcguggcucucuugccuucaaagugaaguuccuugaugaacagcucccucaagugggucccaguguacucacgggcucccugacaucuugucuuucaguauuucuaaauccaucuguuccuccauucccuccauugauagcuauucucacuuaucagacaccgauuguguacaaagagcuuaaccauggcagugugucucucagcuugugaacuguggcuugcuuccucucucgaagcuuugcgagcauggaaccuuucucccuuguauuuggaugaugugucucuguauucacgcacacaucuguggcauagccguaugccacugagcacuaguagaugagucuguggacacuuggagucacuugucagaugaucugggacauggauguacuuguguggcaggcaggcuggagauagauagagaagcaaauuguuauccucuugcauggacuucccaaaagagcugggauggucucuuugccuuuagcuuacucagcuugcuugacacgguaccauaagaggaacucucucaagugggcaucuuuuucccccuuuuaaaaaauuauuauuauuauucuuuauuuuaugugugugaauacaccguagcugucuuuagacacccuagaagagggcaucagaucccauuacagauggucgugagccaccaugugguugcugggaauugaacucaggaccucuggaagagcagucuuaacugcugagccaucucuccagcccaaguugggacuuuuuuaaccguguugucccuuuguuucuucuggcguugacucccagacugcaucucugcuuauguccuuccucuucccaaucucagcugucagcugacucugcaguuggcucucuaguggcaucagagguacaacucuccacugugaauuggagaaaaaugaaaaauggguuuagauguuuuccgggcugaauggaaaucccccagcauggggagggaggaauaugcagaggucuagcugcuguuagagacaggggucuccucagucgacccaagucuguguucugggcuguaaagauccacacuuccugcuccuuacaggcuacccaccauucugcuccgagaccccacaagagacauacaagaaagugaugaacuggaaggaaacuuugaccuuuccuccagaaguuccugucuccgagaaagccaagggccugauucugagguagcagagugagcaucuuccaugcucauccuugggauuggagugaaccuuguggccucuugcuuucuucuucagggucugggggugucgggaagaacaugcaggagccuggcuauuccuuuuuccugaagaaacuggagugugcugaaaagccugguuuuuuuccagguucugcugugaaugggaacauagaaucggagccccuggaguugaagaaauaaaaaauaaucuuuuuuuugaagguguugacugggaacacaucagguauacucccacauuaguuuccagcauuuaggauaugcaugccaugggaugagugagggucagagggcagcuuuugggcuucguccuuuccuucuaacuuucuguaguucuggggaucagaucaggugccaggcuugcauagugaggaccuguacccacugagccaucuugcuggccacagacugggucucauauaguccaagcuggccuucugugagucaucuagcagaaggugaucuugaaccccugguucuccugccucuucaagugcuuggauacggaaauguggcaccaucuguggauuacgauuucggaaagaguagucuggaaagaucaucagcaggcuaaggaaagggagagagcccuuuagauguuccgggucuuccauuguggugaaaaugaggagucagacagagacuguuacugggagacugaggaccagcaaggaggaggagguguggcccuggcacuuagaccacccgcugaagcuccagcucucauuagcacucacugauugcuaagcagaaaagugucuugccguuuuauacugcaauuauguucugauuuagauccuugaauuuuguccuuuugagauagugugacuaaauagucuaagcuagccugggacucauagucugcuuuccuuggucuccacugaggccaucauccugguaauuuuuaccuuuccaguggaaucaguguagagcugaaaguggguggcuuugaagcuuuucccuuccaggaggacucuuucauuagcggguuggcugcauugacacagggcuguagcucccuugucuuucugacugaaugcuuuguucaguugguuuuugagacaggguagcucuggcugcccugaaacucacuauguucaucaggcuagccuuaauucaugagagauuugucugccucugccuccuaagugcugggauuaaagucaugcauggcugaauuaccaauuuuuaaugauaauuuugcuuggaugcagucauuugguuuauuuagcauuagagaaaaaaaauguugccaacagugaauaguccuccaugucagacaggaaggagucuuccaagagagacuggggcaguauccucugugagcauaccaucuguggucauuuggccugugucuguuuuugacagggagagaccagcugcgauaucuauugaaaucaagagcaucgaugauaccucaaacuucgaugaauuuccagagucugauauucuuaagcccacagguaaucccacuggcugccacugcagucuuuagaguugcagcauccccugugauuuuagggugauauuuacaaaacagaaugccgagggggacuucugguccuggguaaguguuuaucaguccccacagugggcagcagugagacgaucguguucagcugcuugagcaaaucauaagcugcuuuucuguuacucagaacuuaagaacacuuaagugagcaaaguagaaagcuugcacagugaaagagaaucucucugaaugggagcuguacuguguucuucagggugcuuuaucucuggggcagagcuguccuugaggggacagugacuugaaggcagcgauucaguccuacuucuguuucuuugccagugaccacaaguagucauccugagacggacuacaagaacaaagacugggucuucaucaauuacacauacaagcgcuucgagggccugacagccaggggggccauaccuucguacaugaaagcagcaaaauagggccugugcugggaacccuaaauggggcaguggucucuauacaacauugugguuuuccucuugcgcucuugaaagaacuuccaagaaguuuguagaauucauuaauacauccuagucaagucucugaaaugugauuguaaguggauauuccuccacggugcaccgggaagcugauaggacagagacaagcauuuuuccaucggccauaagcagcugcuugcuucuuuugaagccccaugagccaguuugguaugugcuguaaagagaauuugauuuccccaaguugaucagaaugaaggggaaaagcagcugcccacuguuacugaacuguuacacacugaguaccagccaacgcccugugcuguggugaugauaugccaccugccaagcccaccaaguauuuuucuccuuauagcugaaaauucuguaguuaaauaaggcaauaaugaaagucugugugaacagccaacaguguggcagaaggaacaaucucggucucgcaggugccggugguuucuccccauaccuuggcccucacaaguggcuuuccacagccuucacucauggugcacuuuacuuaugguacuaggacaaagacccugaucuacugaccugucucccauccaaaagacucaugcugcucuucuguugaugggagagguacuagugugauccuuuuugaucuuagaaagcccauaaaggcacugggcacugccaaggaguucuggacccuguggacaacccuuacuuucccuucacggcuguagaucaucuugaggcacacacugccuaccagcaagcaauaccugcaagugcugccaugcaagugcccacagccuccuugggagucaaggcaggaccagcccgcuggguccuugagcucauuccucaauccauggugcaaccguguuugucuugauauuuccuuaccccaacuuuagccauuuugccuuggaaucaugauuacaaaauuuuccuuugcagaugccuucuugggggcauucuugucccuccacccaaaaggguugccugcagcuugggcugauacgccucugcuguggcguucucucaugagaaacacugaauuuagcacaaagugccuucucugucauggcugcugccaccuuuagaagauuuuucgcugugucagaaaaauguggagguuccauauaaugacuuugguuuuaaguguugauaacuguuaaggcauuauuugcaccugugugguaacuugcagucauuggccaagcuacaacugggaucggcccuccgcuggucccgaaguuugugaagucagcucagucuuagcucagccauucagaggauagaauuuaagacuuauaagcagaacugcuuuggguuuucaugucuuagaugaagaaaaaggaauguuagggaagucuuaacucuggguuaagauguuagcuccuuaauccucuauucagagccugcuaaugcaaaggagauagaagggccugggcguggcuuuguguucuauugauaaaacaguugaggcucgauccccguguguuugcaggaguguguggugagcaugggagaauaagaauagugguagagucugugugguggggaugauucauuuggggggaaauguucacauuuuaacuauucaacuuuugaauaaacugugaaaacgauaaucgaac

SEQ ID NO: 8497 - RNA, 1112 nt, Mus musculus
gggcgugguggcgcacgccauuaaucccagcauuugggaggcagaggcagguggauuucugaguucgaggcuagccuggucuacaaagugaguuccaggacagccagggcuacacagagaaauccugucucaaacaaacaaaaguuccagaauagcagaucguccugacacagccccagggacacugagaagcuagggaaauguggguuugaagaccacaggaaaaccccaaacuaucugucacccauaggaggcaacuaguugucacaggaaaaagucagaagagggccuauguccuuuugagccucacgaggaggaggaauuucugagugaaacaaggaaacucgggagccgugggagacagaagcaugugagucauguguaauauuaacaaaaauaagaugcacccuacugccuggaugcggcuagcaacccagcggauaaccacccacaggggccccuucaacuaucuaauuagccuaauuaccaucuagcaucuuuugaccuuccuugcccucucggauucucauuuauuauuucuucuguaaauaauacaguacaguguucccaaacaaaagcccacagauaacugggaggggagaagccacagguuugagaacgauuaucaugcuugcuugugaauuuaguugcuuccugccucccuuuaaaucagaaacaggggagcagaggcagguggcucacugugaguuccaggccagccagagauaagcagugggacaccuucucuaaauaaauaaauaaauaaauaaauaaauaaauaaauaaaccaaccuccuugcugggguggaugugacgauccaggccugaagcccagcacucaggagguagaggcaggaggaucagaaguucaagguuguugucagcuaccuaguaaguuugaggcugucccagaauucuuaggacucuguuuuuucuuuguugcuuuuguuguuguuguugcugcugcugcuguuuuguuguuuuguuuuccuuuuucuuuuuuuguuuaaaaugcuaccucacuuuucaucaucucagugccugggaagacugcggggaggguguggaagaggaaggaggccaacuguaccuccggguccgcagcugcugcu

SEQ ID NO: 8498 - RNA, 1710 nt, Mus musculus
uguuuuuuuucgagacagggcuucucuguauagucccagcuguccuggaacucacuuuguagaccaggcuggccucaaacucagaaaucugcccgucucuuucccaagugcugggacuaaaggugugcgccaccaccacgccuggugaaauuuuaauuuuuauuuacuuuuuuuuuuuuuugagacagggucucucuauguagcucuggcuguccuggaacuauguagaccagacaccugcuuucugccucccaagugcugggauuaaagguagucauuacuuuuuuuuuuuuuuuaaagauuuauuuauuuauuuauuauauguaaguacacuguagcuguccucagacacuccagucugaucucguuacggaugguugugagccaccacgugguugcugggauuugaacuccugaccuucggaagagcagucgggugcucuuacccacugagccaucucaccagccugguagucauuacuuguuuguuuuacaaaccaaaaaauuuuggaacagagaauaucacaagucauuuagauacaucagauuuuuuguuguuuuucagaaaguaucucaagaaguucuuucuggccuagaacucacuaaauguaugaacauaaaguucgacuccuguucccuugggccaagagcugagauuaugaggcagggaggagaggaaaaagacaaaaggacguucaaaugagccccauuacuacuauacuaggcaugucuaacccagaaagaaaaaaaaagaucuagaaggaaaugaaguuuugcuagaaucuucugaaggucacaacaaaaacagguuuaacaacuguagccugcaccacaacucccuuaggggaacaaaagcauuagaguugugucugaaaaacugguuaauauuuugaccuuucuuggaagcagaaacaacuaagucuccccaauaaaucagaguagccugaggggggccaggccgaggauacgucugggagcuggaggcaaacgauguggcuugucaaacgaggguauucagcuauccuggggucuguguguagaggcccagggagacccacaggucuggcagccagagcaaagcccuuacaaaggccgcaggugccccuccuagcaucugcauggcggagcugcgugcucagagcguaaaggcaaccuaugcaaaaccuugcucuccuccugggaaagugagcccugugaccguuugucuuguuuuuuuuuuuguuuuuucaugcagccucaucaagucgcauuugccgcgcgcgcgguuugggcgaggcgggaaagcgaaaguugagcaaacuuugcaggcucuacccugcaucggggcgcagaccgggcaccgugggguaccaguuaagucgcccaagcucggugaccuugagagcgacuauaaggcuccuuagucugcgauggaugccccacaacgaggaagcaagcguccauguuucacucugacccgagcccgcggcugcagccgccaucgcccgggauuaauggcggcagagucuggacagcuuuauucggcugcagccuaggcggaaguggaggagagggggcgucugcgcggcucgcggggauggccgggccgagcgccgcaucugcgggacaagccggcacgcggcgacgagcucgcgccaccgcgcguaccccacccaccugacggaacggccggcgcgcgcucccaguaaccgcgguuucucgcagcguuug

SEQ ID NO: 8499 - RNA, 21655 nt, Mus musculus
uacacguguguaugauugucugugcacugugugcuugccgggugccuauagaggucagaagagggcauuggauuuccuggaaccagaguugccgucaugcgguugcugugaacugaaggcagguccucuguaaaagcagccggugcucuuaacugcugagccauuuuuccuccccagcaccagcauuuuuaggcccuccuccauccaucuaacauaugcucauugccuuugacuuguauuuuauacucugcgcucuggcuagaauauucuaaaauaucgcaaaagacaacagccagauucggagaauccugggaggaaugagggggagacuuggacuuccaugaagaaaacaccagauagcucacggcucuuuucauuugucauucagaugucccaggcugccucagaucccuuuauaaaggggaggguggucuugaacuucugauccgggugcuugcugucuuuucccaacugcuaggaucacagguaugaggugcagacagaacccugggcuucauggaaggcaagcaaacguucuaccaacugaacaacacccuacucagguacucccuucuugagcggccucugccaguguccaggaagccggcagcccggggaaggccugcaccacagcuguuuguuuuggcacuugccaaggagccaguugccaguggagcugugguuaguuccuuuguguggcuuaacuguuggcccaguuuuccaagcccgauugggugucacugugcauaucacaucaaucuccgagggauucugaccgaguggccgaagcaauagauuccuucgcuccagcaagccagggccugggaccagguucccgugccucccugugcuucugagccucagcuuuaagaggucugagggcagagcugcuggagccucagcaggugacagaaauggaaucaguuauuuuaucagagagacauuguacaggaugaacugcuuagacacaggcuggugugugugugugugugugugugugugugugcacaagagauguugagaagucacagaagccacaagcacaggaagcuuucagggauuccuaagggcuaaagaaggaaaggggaaagggcaguguugaaacccagaggugaacugccuuccagagagagacaguccgugggucgguggcugccuuccagagagagacaguccgugggucgguggcucagcaggugcuggguucugaagggaagcugggagacugguucugccaacuggaagcaacugugccccucgcccagagagcugcuggcguugcuaggguugggagagagagguagauuguuggcuccaguucuggucucaccugcaggcucacugucuuguuuguccauuuucuccucugcagguccaauucuggcauuguuggcucaaucgauacguguuuauugaacacccuugacggcagcccuggggucuccgggggugcuggagacacugaacagcaagagcacccucgguuccuggaaaucauaauugcucguucuucuuaucagaggcagggccccagugaccuuccucgcuacccccccccaaggcaaugauggagcuacguagugaaaagcagagagauguauucgcuucgcuguggccacagugagaagggugacaaguaaugagguccagggacccccccccccaauccaucuucagacugagguugagguuugagagagaugcacagccagguugucccaccgugugcugugccgugugucacugacccagaccagucugggcuccagucuguccuguguagaauuuuucccugacagacaaguacccucucuggcugucagcaggcuucagcuuuuuuucuucucugagcaugagacuccugucggaggggauuccgauuccugggggaaccuuuaucucaacagucugauagccaaagggaugggcucuguagagucccuagagaguauaggccaggaugguuuuguucuugcuccaagcacagaccacgccugugaacucguuuacuauuacagauggggaaacugaggcauggagacaccucuaagcaacuaauuaaaguacagaguugagaaggccaugaggagggucccucagagguaguaacucauucauucauucauucauucauucaagcuucagucagcuguaguggagcaugccuagagucccagcugcucuagaaagauggagcaggagaacuguuggagcccaagaguuucaaguuggcuuaggcaacagagcaagaccuggucucuaaaauaaacaaacuuaagcaaaccugcagacugguaagcaaacacacacacuucaguugacccgggcaagguucuaguaggaaguacuaugugauuuuuuuuuuuuuuucacacucagaacauaagugucaaugcucucgcuaugaagaggagucacaggauuggcugggguggugaaagcgaagcugggugaggcuccagaagcuguuacccagcucucaggagauagaggcaggagggacugguucaaggccagccucaguuuaccuagucaauuugagauuggucugggcugcaugagacugucuucauaacacaggagccggagauggcgagauggcgauagacccgcacauacaggggcaggaagagaaaucgacaguaauguccaugaugaaaucguagacacugaaaaggccuaucucaccccugcagacuuuguggucccuguuucugauugguguaggcagcuggccuccaauauguugcuggugacacacaggugcucacuucugauguuaggaacuggagacggaaugucucauuccaccaucuuuauuuuguauuccaaguguucacuacacugggcuacacaguggcauccugucucaggguggggggaaaucugagagagagagaaagagagagagaaugaaucagaaauuuaaggccauccucagcucccaaaggaaagcaaaaccaucuggagauaucugagacccugucucuaaagagaauaaaagaagcagauuagagggaaauacccaacccauucagugacugccuccgaagaagauaauaggugauucuaacauuaaaaugaccaggcauugccaggcagugguggcacacgccuuuaaucccagcacuugggaggcagaggcaggcauauuucugaguuugaggccagccuggucuacagagugaguuccaggacagccagggcuacacaaagaaacccugucucaaaacaaaacaaaacaaaacaacaaaaacaacuaaaaaaacugaccuaggauuacuuuugugacugaagggaguggccaaguacaguccucagaaauuacggcuguguuggggagcgagauuaugggucauuuuuguugcuuugcucaguuuuccaaacuucucauuaugugguuuugauguuauuuuagccagaacaaaaccagcucuaccacaggcagauaaagagccaauguucccaauggcuuaacagggcccaaggggcugcuuggaucccgguagacugcuacuguugacaugucccugugagaaaggaacauaucaggggggcugagcauucagcccgcucaguagcuagcaugcuggaacagggcacgguggugcacgccugugauccuagcacggggaagguggaagcagaaaagauuggaaguucaaggucaucuuuggcuacuuggggaguucaaggccaguuuggacuacuuguuacaaaacaaggcacacuauugcguuguacagagccccgauggcugggcugugugccggaagaacacuaguggcgagagccagacccugcccaguguuuggcucaauaucccauggcauuucaaggugaggugcuuuguaaagaauccuaggguucccuccuccuccaccucuucucccuccuccuuuucuuauuccuucucuuuccccuccuccaccucuucccccuccuccuccucuuuccccaagcacaaaguaaggaggccugagaguaucaaaucugggaggcaaugacaaacuuuguaaggaacaacacuuaucugugaggaacuggagagauaacucagcgccccccccccuccccaguuguuuuaagccagccaaggcuaccuauugaggcccucccugucucaacaauaacuacaacaacaacagcaacaaacaacaacaaauuguuuccacaauuagcaaucaaaaggauuagauguccagaauuucagagcucacucugggucagggcagagugaccggaaaggaagaaagccuaccccuaaagugugcccagccucgggaaaggcccugucagaucuuccuagggcagcagugacugaggugggaaacccauacuggcaaaccuggugugggcucacucuuucaucuaguggcucuugugaucucuugggaagauuuaauguccccaccuuccugccccgcagugcuccccagcccaaugggaaaugcuuccuaguucuugcugcagguaugacugugaagagacuuucaaaagaccaaaacucccccuccuccccauucucuuccuucccuccuccccuuccuccuccccuuucauuuucccuuccucccccucccucuucuccuccuccucuaccucuuccuucucucccccucuuccucuucccuuucuuuuccuccccucuuucucuuccuugucccccucccuccccuccucccucgccucuucccuccuccucucgugccuuuucuuccccuucuuucccauuucucauccuccuccuuccgguagugcugggucagagccauugcuucugagcuuugacuaugcuagaccagugcuguaccacagacucuaucuuuagcccuuagauaagggauuuucgaugacaacaguaauaugacauuuugaaagcuucccuggaggcucuggaaggggagcacuacugcucuucuagcccugacucaagaugggccucuucucuggggaaagaagcacccucuucagccaagcaggcagcuuccagugagggagggagggaggcgcugcacgcuuggcuaccaggccagccaaauucucuccggcugucagugggcugaacgagagagcuguuuugaugaccaugguaugaccggaauauuuggcuccuuggacacucagaugagaaaauauuguugcucucagguucuuuuccacuuguugacucagacugucucaggagacccacugugggagcugcuggagaagugggcagcucacucuacucuuguuuaaacuacacagaacagagaaagucacucaugaggccaccucucucuccucucugccccucccucgcccacgucccuggggaguaggcagcucacacacuggcuucuuugccuuucucuucuccacccuccccacagugccccgaggccccaaggcagcugugcccuuucuguccagaagcagcagcuugauugaaaauacccauccuuuucgggagggccucacagaguggguacugccagaaaaaucuguccugccucucucccaggaugcuagagagucacugagcugggacugggacugguaaaucugugguacacacagacacacacauauagagauauacagagugagagaaacagagacagaggaauacacacacacacacacacacauauaaagauauacagagugagagaaacagagauacagaggaauacacacacauacacacauacauagagauguacagagugagagaaacagagauacagaggaauacacacacacacacacacacacacacacacuauugcuccguagcccuggcugcccuugauugauuuugcagcaauucuuucugucuugacucucaaaugcugggcuuguaagagcacaucccuaacacacucagcgugggugugggugugcgugugugucggcaucucuauucuuagcucuuugggguugugauuaaggaaaaucagggucacuugagccaggguccugcagugcuguggcugucaaucugauaagccagcuggccccugagugacuaaugcuguucuuuggugguguccuguaaccugcacaaagggcuaauucacagcaggauagagcaggauggcgcaagauuuggugcuccuuagacgaggacacaauuagaacuuagaaauuguguauuucugugauuuuuccauuuaacuaauauauuuauuuggccaguugacugcuucagguuagcccagaacacugaacgaguccugcagaucauuguacccuuugcccaacacucaccucucccguuucagaggugcugggguggagcccuggguaucacacacaguaggcaagugcucuacucacagagccacacuccccagcucccaagagacucauuccuccugauguuugugugagucucacucacugggagaccuuccuaacuugacacugaggccccuugggaauugcaccaucuugauuuauagcuaggaggcacagauuuggagaaggaaggugccugucugaggacuacaggagggcuacauacaacuagcuccagggauccuccuggaccucgggccuguucuucauuaauugccaccacaaguugcuaccgaacaaagacaguagagucccagaggacccauuucugccuacaggaauuccccaguguuauguuuuugucuucaguauuuuaggcaucuucacauagcccaggcuggccuugaacucacaaaguagccaugaacuccugaucccccugccucugcucccugagugcagggguuucagucaugugcuaccaagccuggccugaguuguugaugcugcucugugcuccccuucccuccuccucucccucccuccucccccuuuucuuccuccccuucuccuuucuucuugggcugugcaugugccauggcacacaucuggaagccagagaggcaccaugugcagucaauucucuucuacucuuacgcauguguuggggauugaacgcagguggcaagugacuuuacccgcugagccaucuuggccgcccuauacugaguucuuuuuuuguuuuguuuuguuuuuuguuuuucaagacaggguuucucuguauagcccuggcuguccuggaacucacuuuguagaccaggcuggccucaaacucagaaaucugccugcuugaguucuuaauauuuguaaauugguggcagcaucacuguccuguggcauuuaaaugaacucccauuuaacuaaugucugaaagcacaccuguggcuccaggguggaagaugcucaugagcauuuagggaauguagugcugcauacuaaaccuuuguacagaauugucuuguucaaucccuucuugucccucaaggcuagauagagccugugcccccauuuuacaaugauggaaccaagacucauucacagagguuucagagcgcuccccccucucgccaccucccaccugaguagcacggauguccuggaacucccucuguaguucaggcuggccuagaacucugagaucugccugccucugccuccugagugccagaacugaaggugcgcugcacuaauuggcaaaguuucagcuuuuaaaugagcuauucugguccaaaccuggaauccaggaugcaaggagaaaaucaacucagaaagccauucugugacugcuacacagguacaccaacccgccucccccaaucuaaauaauaauuaaagaaagaaacaacuauauuguauguguggugguuugaaugagaauggcccucacaggcucguuuugguuauuagcagguggagcagucacuaacuggaucaguaaagggagugguaaagaaaggcccaggacgugggaaagaaaagaccugacaauccauuuuugggcugaaaaacaaauaaaccaaaccuacgcaagaugaaaagaauaucugugcggagacgcuauaauuacacaucuccucagcuuccgauucccaugagcccucgguguccucucaucagagcgccuacccugagcuagucugagucagcuucuuuuuugucuaguagugcgaaaugugaacguaugugguuuguguuccuaaggggccaagggccccuuagguuaggaauccacucgggguccaauccacaaguccacggagcagcuucucagcagccaggucuuuccuguuacccgcugcagugagcaaaagaaccccaccucagggucuuaaaauuacuguaguccuuucuuuccuuucucaguccuuucauuuaggccgggcugggcggggcuggguugaggcagcccgaaggcugcuggugggaacccucgcugaagcuuugcgcaugcgcacacucacagguuuggagacugaugaggaugggggaugaggccucaguuguggccaucagcuagaucccuaccuaugaucucucccugcgguacuccauuuccugaugcauaguuuguauagucuggcaaugcaaaagcguuacccguaaucaugauggaaacuuaaccuccugaguucaagugauaccuuuaaaagucaggcugggagcuggaaagcuauggcagaggucaagagucagagguugcugcucuuccaggagacccaaguauggguucuagggguccacauuuugaucacauuucagcucaaggggggggaggguaugaugucuuuguccucuaugggcuccugcacuuacgugcacacccacacagaaaugcauaaguauucauaaccaaaaaaucacacccacacccacaaaaagucuuagccaggugguugugguacaugccuuuaaucucaucacuggggcugaggcagaucucugacuuggagucagcauggucuauauagaguaauuuccaggaccgaaacaguuacacagagaaacucuguuucaaaaacaaaacuacacaaaagaaagguuuuagccggggugugguggcgcacgccgauaaucccagcacuugggaggcagaggcaggcgaauuucugaguuugaagcucuacaaagugaguuccaggauagccagggcuacagagaaacccugucucgaaaaaccaaaaaaaaaaaaaaagagagaaaggucuuuuuuaaaaaacaggcuagagggauggauggcuuagugguuaagagcagugacugcucuuccagagguccuguguucaauucccagcaaguacaugguggcucacggccauguguaacggaauccaauacaauguacuuauauauauugaauaaauagaucuuuuaaaaagugccugguuggccuugaacucacuauguaccaaaagauaaccuugaacuccugacgcuccugucuaccugaguuauugcuauuacaggaguggggcaaauuccugggagaugaagcugaaacugcauuucucuuuguaacccagccuuggaagucccacaguuuccugaacccacuaagacucagggagccagucccacuuugagucccuuacaaaugcaaacgugaguuucuagcuucagaguucugagagcuaucaucagcugccauggagccaagggaaccccaccccuguagccagguaguuguuccacagguggacuuggcccugagacuccgaauuuacuguagaaucuguucuaccuuaagguggucagacggcauagugguauucccuucagcagcaagacagugggaauggagagagguacauucagaggugcauacacaagaaagaagccaaggcucuuccucaucguagcuauacggaaccgacagagcacuuacaggaaaagccugucuacaaacacaagauacucauacauuuuuaaaacgaucuaaaaauauuuuuaaaauaacuuucaaaaaaaaaacgacuauuugcugggcagugguggugcacgccuuuaaucccagcacuuggaaggcagaggcaggcggauuucugaguucgaggccagccucgccuacaaagugaguuccaggacagccagagauacacagagaaacccugucucaaaagaaccaaaaaaccaaaaaacacaaaaaaaaccccaaaaacugacuauugcggaugccaagaagugcuugcugacaggagccugauacagcugucuucugagaggcucugccagauccugaccaauacagaugcaggugcucacagccaaccaucgaacaggguccccaacggaggaguuaggggaaggacugaaggagcugaaggggccuuaucuggcacuaauggguggggaggcucuugguucugugaaggcuuggugccccagugcagggaaaugccagggcagugaggugggagugggugggggagcacccuuauagaggcaggguaagggggaugggauaggggcuuugcagagggggaaaaccaggaaaggggauaacauuugaaauguaaauaaguaaaauaucuaauaaaagaacgcuuauuacauuugauuuuuguguguguauauuugucuguccgucugccuguccagugagugcuuauggaugucagaggauagcuguaagcaguuguuuguuuccuucuaccuugugggucuuagggcuugugcuggcuggguuugugucaacucgacacagcuggaguuaucacagagaaaagagcuucaguugaggaaacgccuccaugagcuccagcugcggggcauuuucucaauuagucaucaagggggaaggucuccuuguggguggugccaucccugggcugguagucuugggcucuaucagacugagcaagcuaguggaagcaggccaguagguaacaucccuccauggccucugcaucagcuccugcuuccugaccugcuugaauuccuguccugacuuccuuuggugaugaacagcaauguggagguauaagcugaauagaaacccugacuaagacagggcuccaacacagguugucaugcuugguugcaagcacuuuuaccgaucuugcucaacucgauuucucuugcuaaccaugaguuccuggccccguuuauuuuucuauuagacacccacccucucuaucgccuaugcguuuuuguuuuguuuugagacacagaggacagccuuaagccugacguguagccaaggaugaccuugaacuaguuggacuucucgacuucaccaaccaagugcagagaugcucagcgccauauccuuugcgugucuuucuguuccgggaagaggccaguguuaggcacaugagcucaaccagcacuacacuagguuacugaagcacuugucgugcccccugcuucuccaccccuggccucugggcuuggcaugaaagacaaggcguuaaccaugggagaauaaaaugucacucuuugauguugaaccaauuaguauaaaaagacgguugucggugcuuuguucgggccuccucagcgccugcuccugcuuucuagagaagagacgcccaccuuccagucugucuccacgaagcuuugcucgguugaccaggcugcuuuggaaagcuuugggcaggaaggaaccgugaucgccaucuauggaaauaggaaagccuggcucuccagccugaguugaggugaacucuaaggcauaauuuauacuccaguaaggcugagcucaggauuuugucacaaauuauaaccuuucuugacuuugccucuucuguucugcuccccgccacccaccccgccccaguccccauccccgcccccauccuucucaguucauccuuaauaaaucacuuguccacaaacccuugacucaggguccacuucuggggcaccuaaccuaaguacuuguaacucuucaccacucagcagauagccaugugacucugcuguaggagggggacccgcccagcccucacugagucaagggcggccaggagaccagcucccaccaauggaaugccccuggagucccugaugcgccacggccgaccccucacgugacccuaggcucacuguuuucucugggaaaagcccacgagagaggggcuucuccuugagccuggggcccagaacaagccaugucaggcaggcagucccacagcugagccaacugccaaacuuagagcugucaguaacaaugaaccuuuauuuuuguaagggguggagagaccuagggguugggacugccauccugccucaaggcuccaguguaggcugagcagcugaggaauagacagcucggggacgaagccaaaguuaauuucuuucuugucacaaaacugugccaugcuacugagguuccuggaaccuuagugucuccauuuguagaguggcgaccuuaagcucaggaugguagugugugucuguaaucucagacuauggaaaauggaggucggaggaucaggaguccaagaucauccuuggagacaugcugaguuugaggccagccugggcuacaagagacccuguccccaaacaaaaagaaugaagcuaugaauguuucucagcccaggagguuauuguggggggucaaaugaguuaacauauauauaaagucuuucagacagagccuggcauaugguaaauguuuaaugaauauuaacuaaagugaacuugaguuaugaacugccauaauucaugcccguuuuaccuguagccacugaacuuguuggccaccuccucuagaccauugauggacccucagacguguuuuguuuuuuuuuuuuaaauugugcgaguggcugucuugugcacgucaucccacacauguggaggucagaggucaacccaacuuccucuccucuuccauguguguuccaggggcagaacucgcuccucaggcuuggcagcaagcagcugcacccacugagccgucucguuggucugcccugugugcucuaaacuacaaaagagauuugaaaaccacaccagguagaaacuacgaaaucaccaguguuuggccaguuuugaucuacaccaaggaagcuucaacuguucagacaccuaagugaacaaauacccaugaugcaaugauggaaagaggguaaggggaagaagcuggagaggagggggcagcccucuacaggggaccaaagcccucuacagguggccguuuaaagacuuuugguggguauuaacuauaagguugacaauuagaauuaaucuaaauggucgacuuagggaauggaauaagcucugggaauacuggugagaaaugagauuaaauucauugaugugggaaaacccacccuaaagugggcugugccauccucgguacugaggucagggacugaauaaaugggagaaagcaagcugcgcccuggucuucccuugucucucuguaaaccacguagccagcucucucugacgcccacugcccgugggaccuacugcucaagcugagacaaaggaacuccuuucucccugcaguugccugcgucagggauuuuaccgcagccgcaagggaaguaaggacuacgcuggccacuuaacccagcauuucucaaccuguaggucaugacccccuuucauaagggucgaauaucagauauccuggacaguggauauuuauauuaugauucauaacagcagcaaaauuauaguuaugaaguagcaagaaaaauaauuguaugguuggggucaccucaacgugaggaacuguguuaaagggucgaagcauuaggaaaguggagaacuacuguuuuaauucucacagcuucugggaggugucccaucccaauagcuucauggaauuccccuucccuccagccucgguuuguuuguuuauuuguuuguuuguugcaguauaaaccuugcuuccuuuucccugaaaggaaaggccucuuaggguuaaaaaagccuacacuuuggacauguuugggacucucagacuugaaauuuccuaaaacgugccuguuuccagugugggcaugggggacccagguaggcaucucuaggugaguauccaugaguggacguuugagagucuucugggcaaugagaggggacuucucagccacucgguggagugaucaauguggcuuuaucaaaaggagaacaaggggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguauuuacauauaauaaauaaauaaaucuuuaaaaaaaaaaaguggagugccccgcccgucgaccauggggcacagucaccugugccaaauauccuuuccuaccuuccccuugcaucucgcacagaggaugugccgcaucacacggacaccaccaacacuucuuucugcacuagggacauaaaucacacgccucaugcucccacccccaaccaagcccacacgggcuacugcacagagcaugugccaaacacacaccagcuacaggucucagcaacaccccccaucagacaaagaacucaucaccacagccaguaacagcuuuauaccaaucacacaccaagagucucuucccugccccccacaccaauauaucagacucacuugaaaaacacaacucagguuuuugccagagaauucaugguucacugaacaccaugcauauugucuuauuuccacccaagagaauuggggggagggggugcgaccuccauauuuccugcaucuaacagcauuacucgugcagucuaaaguguacacacccaucucuauguaucuuacaaacacauuacgucuuccuacacggagcaacugaaacccagcagacagacaaacguaccagcagacccacugugcacaaagacaucugaucacacuuaagcugcaccucaacacacacaacauauacacaacauacucagugacuucugggucgguccagcaugaacaaccacgccugcgugcccggggcugaaacucagcuccuaaacuccagaagacccugcaaucccagguaaucugggacaauuaaucuucauuugacacauugcucacauggacacauggcugguguggcugggucccugugacagaaucugagaugcuggaggguggggaagcagggaaugggggagggguacgggauagagugaggggugccagugacucagagaacacaaaguaccaaaucauuguccccuuugaccccuuugacuagaggggagucacacguggcucacagauacagggaugugcugucaaaaagaaaacagaaaagaaggcuuaagcacacuugccugccuuuggggguuggcucugggcuaugcuuuaucucaccugauccuuuacaaaaccuguggggaggcuggcauagcaugguacucacuacgaugaucagaucugggagaagucuccugucccugaguuuccuccacccagacuucuccaucuggcagggcugucuauacaucucucacuccagaacucacccauccugacagagacacuguggcuggaaccaaaagaccaccugucuugagccaccaccuucaaaagccuuucauuccguccuaaugggcccaggcgcccaggcugccccacccuggggcgggauuagcucccuggagcuguuuaaggcacaucaaaagagugccucucacuaaaauagcucucuggggcccugccugcuagccugaaauuauaccaggggacuguucugucugguaaaaagcauccuacagcccgaaaggucccugcucuaaaugcaccuguguccuugggaggcacucccaggccacagccuccaacccccuccccucauuguaucgcggucaucuaggucaucuacgcacuugcacaaacaucacagaaagucccgcgcgcuguuggcuuccuguggaaauagagcccaggguggagggcuggagaagggcacagacugacuuggagacagggguguggagaauggaagccaagagggaugggucaaacucuuggcaggucuuggcagagguagagaagcccccugggaggaagaagggcuguucaaagaucccaggagguagaagggggugggcuguaaaggaugaguggguuuggggugaaagugaggauauaugccugggaggaguccauuuauagggucacucuagggcaucaucgacucuggaaacucaguguuugcaguagagaacaugaccuauuuacugccgaagagaaagaaaagccuuugcacaguaaagagucggagacaguuuguaacacuggcuggaaagauagaggcuacuguuguccucugcggucuccaggguuacuugccuuucuucuggaaccucccaguacuuccuacaacgaacuuggaacaugaucucuuuccacagagccagggauaaaacgcagggucuugcacacgccagcccacaguucccuacacgcuccugcguuaagauuuuauuuuuugagaccugagagcuagcucucaggcuggccuggaacuuguagccaaggaugaccuugauaggaucuuucuaucucagcuuccggagugcuaggauuagaggcgugcaccaucacauccggcuuaugagcugcuuggugaaugguaagcaggcacaccaucugaguugcauaugaaauaucauuaaauaucauaaaaauauuuagaagagggcucacuggcuauuaaguccuugucaaauucauaagccacggucgucacacucagaugguucuaauaauucaagguagcccaggucugcagcucagcgcaaggaucacacgcuguagggcuacauuguguggguucaaauuuguccuuuguggcugugugauugggcaaguggcucggccuuucuguguuuugcugugcccuuuguaaacgcaauggucgcaguacuuguaaagcucaccugagcuacugcgcgugugcgaacgcugggcggugcagcuggagccggguaaucgcagccugagcaucagcugaggcuugucauuagugguuaagauaagagcucggcugcuggagccagccugucuggguucaaauccuugcucagucucugucuggcuugggaaguaacuucaucucuaucuguaccucaauuuccuaaucuguaaaauggggaugaaagucacaguacauccuucaugggaugaguaagggggaaauuaaccaagcgauccuuggauacuuauaacagagccuugugaagggaaagugcuuggcaaguugcuaagcacaaaccagggucgccauguuuagaugguucuaauaacucgcgguagcccagguuugcaggacugcagcucagucagaaggagcacuuuaguacuaauuaucauuacaauuaugauuuugaucuugaagagaugggaaguggggugaggagccacagagcacccuaugcagucagugugugggugugugagggagcauggagauggggggggggcggggaaacaacuggguugucuuuuucucuccucuuucugguccuccucugauucagguuuuaauggucuuuuacuuuuuacuccacuuauauuuuuauuuagugugugucccugaacuugcaugccacagcgugagccugugguggucaaagcacuucaugcagaaguugauucucucuucucacuguguggguagcaggaauugaacucauguccucagacugcggcaagcaccucuacccgcggagccaucucaguuccucuccuuucggaguuaaagcugcgguccuuggcugggaagaugguucacugguuacagccacucgcaguaaacacaaguagauuauucagauccgccagucagagaaaucuagggaugcacuaaauaguuuguuucuuaacuuguauuacauguuauuuguuuauugggugggugggggaugcuugcaugucaggacacacauggagggugacuuucagaagcaggcucuccuuucaccaagggauuaaacccaaguuauuaaacucuguaugagauauuuccacccacugagccuucuagccagcccuauuuuguccuuuugaaacaaagucucauuguggagcucagacugcacucaaauucccaauccuccugccucaaacucaggagugugggggcuuauacucaugggccaccacucagggcucaggaaagacuccaaauguuucuagacucagaaccucacagugaauuguccacaggcugcuuucuccaggggaucaccacuggcgcagccuuucacgaccuaaaguuaccucccuaauagagauguucacauucacccuggagaaacucuuugagccugaaaagaauugaaugggaaaagcggcauaaaauugucugagccaagagguacucaauuauuuaggcaggcaauugacauaaacauuuccggaagguuuuuugcagccauugacaaauaugaagcucugaucagagucuuuuuuguuguuguuguuguuauuuuguuuuguuuuguuuuguuuugagacaggguuucucuguguaguccuggcuguccuggaacucacucuguagaccaggcuggccucgaacucagaaaucagccugccucugccucccgagugcugggauuaaaggcaugugcggccacgcccggcucggagucguuuuuauugucaggaugaccaacacuugagagauacaagagaggaauagauuucccuuggcuccagguuuuagaguuuggucuacaaucggcuugacagccaccccauguguuuggguggagcaucacagcauagggaacaugguucaucauuucgcagugcacagaaaguagaaagcaagaaagauagagaaccagggcgacuuuccagggccagcuccuagugacccucuuccucuaaccagacgucccuagauagugcugccagcuuggcaccaaccaugcggucaccauacgagccugugggcuacacugcucauuuacacaacaacaagaugguuccccuccgcaauguauggccuucgcccagucucuuaaaggcuauaaggggaaaaagaaagacagagagagagagagagagagagagagagagagagagagacuaggaagauugccugaagaggaaggaagucggcuuucagacgcccucagggccaaaagcgcagcacugccagccugcccugcaaauuauggacuugccagcccacaaucaagcagacugguucucaaaauagauuggucuuaggucucucuuucucgccaucuuuuucugcuccuuuugauucugugucucaggaaacucugacaaauuuaguaauaggaacauauuauuuuccuuuccuuucuuuguuuucuuucuuucuuucuuucucucuuucuuucuuucuuucuuucuuucuuucuuucuuucuuucuuucuuucuucuuuuuugagauaguaucucucauauggacuagccuuaaauuuccuguauagccaagauugaccuugaauuucugauccucuugccucuauauccuauauaauggaauuuuuagauuuuuuuuaaaaagagauuuuaaaaaagauuuauuuauuuauuauauguaaauacacuguagcugucuucagacacuccagaagagggugucagaucucauuaccggugguugugagccaccaugugguugcugggauuugaacucaggaccuuuggaagagcagucagugcucuuaucugcugagccaucucuccagcccucaagaagagauuuaaugaguguuugcauguguguguguguguguguguguguguguggccuguggaggccagaagagagcauugcuucuugccugcuacuggaguuaauagaugauuaugaacugucaaugugggugcugggaauccaauucuguaaaaagagccagugcucuuaaucacucggcaucucuuucuccccaaccccguuuuugucuuuuguuuucuuggauuuucccccacuuugguaucagaguaucccuaaguagccaaagugaaccuugaacuuguaagucucuaccuuguucaccaacucugggugcaaccacucucuccuggaauagguauugcuaaaaauagcuuuugugggaaccagcaaguuagcuuagcaaguaaaagugcuugcugcuaagccugcggggcugaguuugaucccuggauggaguagagaccauucugguuaguuguccucugaccggcacacaagcuugcuaugguacaccuauuucccuaaugaauugaugauaaugaagaaggaggaggagggguagggguagggguaggagaaggaaaaggaagaggaggaggaggaggaggaggaggaggaggaggaggaggaggaggagaaggagaaggagaaggagaaggagaaggagaaggagaaggagaaggagaaggagaaggagaaggagaaggagaaggagaaggagaaggagaaggagaaggagaaggagaaggagaaggagaaggagaaggaagaagaagaagaagaagaagaagaagaagaagaagaagaagaagaagaagaagaaaagaaguccauggugcauccagcauggaaaaguucuggauucuauaggccaucugcuggucaacuguuucaaccagagggcucucucuggaaguagacacagguuaugugugccgcuacuaccucugggaaggaaaugguggcuggaggguggggguuugucugggguccggaaagacuuuuguuuuuguuuuuaaccaacauccuuuuucaucuuuugacuguuauuccugggaauguauuacggacucaacaaaauaaauacaggaaauuauggaaaaaugaaacugcacuuuggacuauacuacaaauagaauuuuuaaagauauuuggaaaaagaaaugagcggagcgagcagcugcuauugauggugucaaagcaguguuugucuucucaauccugcugacugcaguggguccaggcuuggagcggcucaggcuaacagcccugagugggggugggguggagugggaggucgguuggcaagcucuuggcugagguuuccuaaaaccuggaggggccguggcggaggcggggcucuucuugcagaaagccgcacagcccgaggacaauuuguuuuuguuuuguuuuuauguagcuugccauuguucaguuugauuuuuuuuuuuuuucccacacagggucucgcauaacucaggcggagggcugaaacuuaguaugccgcuaucugggcauccagcccccaccucuggaguucagggauaaccuaccaagcccgguuuuuguagugcuuagaauggaacccgggauuuccuguacgcuagucaagcucucuaccaacugagcuacgaccccgacuccuuucuuuaucgucacguaguccaggcuggccucaaaacuucccauguagcugcggaugacuuugaacucuggaucuucaggucuaaacucccugugcggagugugggaauaaaaggcuauguccucgcuccccagugcuagcugucauuguuauuauuuugagagaggaaaaaaaaaaaaaaagaaagaaagaaagaaagaaauaagucgaggacacucacggaaagcgagugggacaggccaggccagcugagguuguccacaaguucuugcccugggucuuuggagauauaauuagcugguuuuuccagcgcugagugggugguucacuucugcaccccuggcaaagcugggagaugaugcaaccgaaggcaagcccgggcaaggccggcagagaguuguggcuauggggcucaggcgacuugguccugggcguggggagugugggucagacugcc

SEQ ID NO: 8500 - RNA, 21655 nt, Mus musculus
ggcagucugacccacacuccccacgcccaggaccaagucgccugagccccauagccacaacucucugccggccuugcccgggcuugccuucgguugcaucaucucccagcuuugccaggggugcagaagugaaccacccacucagcgcuggaaaaaccagcuaauuauaucuccaaagacccagggcaagaacuuguggacaaccucagcuggccuggccugucccacucgcuuuccgugaguguccucgacuuauuucuuucuuucuuucuuucuuuuuuuuuuuuuuuccucucucaaaauaauaacaaugacagcuagcacuggggagcgaggacauagccuuuuauucccacacuccgcacagggaguuuagaccugaagauccagaguucaaagucauccgcagcuacaugggaaguuuugaggccagccuggacuacgugacgauaaagaaaggagucggggucguagcucaguugguagagagcuugacuagcguacaggaaaucccggguuccauucuaagcacuacaaaaaccgggcuugguagguuaucccugaacuccagaggugggggcuggaugcccagauagcggcauacuaaguuucagcccuccgccugaguuaugcgagacccugugugggaaaaaaaaaaaaaaucaaacugaacaauggcaagcuacauaaaaacaaaacaaaaacaaauuguccucgggcugugcggcuuucugcaagaagagccccgccuccgccacggccccuccagguuuuaggaaaccucagccaagagcuugccaaccgaccucccacuccaccccacccccacucagggcuguuagccugagccgcuccaagccuggacccacugcagucagcaggauugagaagacaaacacugcuuugacaccaucaauagcagcugcucgcuccgcucauuucuuuuuccaaauaucuuuaaaaauucuauuuguaguauaguccaaagugcaguuucauuuuuccauaauuuccuguauuuauuuuguugaguccguaauacauucccaggaauaacagucaaaagaugaaaaaggauguugguuaaaaacaaaaacaaaagucuuuccggaccccagacaaacccccacccuccagccaccauuuccuucccagagguaguagcggcacacauaaccugugucuacuuccagagagagcccucugguugaaacaguugaccagcagauggccuauagaauccagaacuuuuccaugcuggaugcaccauggacuucuuuucuucuucuucuucuucuucuucuucuucuucuucuucuucuucuucuucuucuuccuucuccuucuccuucuccuucuccuucuccuucuccuucuccuucuccuucuccuucuccuucuccuucuccuucuccuucuccuucuccuucuccuucuccuucuccuucuccuucuccuucuccuucuccuccuccuccuccuccuccuccuccuccuccuccuccuccuccucuuccuuuuccuucuccuaccccuaccccuaccccuccuccuccuucuucauuaucaucaauucauuagggaaauagguguaccauagcaagcuugugugccggucagaggacaacuaaccagaauggucucuacuccauccagggaucaaacucagccccgcaggcuuagcagcaagcacuuuuacuugcuaagcuaacuugcugguucccacaaaagcuauuuuuagcaauaccuauuccaggagagagugguugcacccagaguuggugaacaagguagagacuuacaaguucaagguucacuuuggcuacuuagggauacucugauaccaaagugggggaaaauccaagaaaacaaaagacaaaaacgggguuggggagaaagagaugccgagugauuaagagcacuggcucuuuuuacagaauuggauucccagcacccacauugacaguucauaaucaucuauuaacuccaguagcaggcaagaagcaaugcucucuucuggccuccacaggccacacacacacacacacacacacacacacaugcaaacacucauuaaaucucuucuugagggcuggagagauggcucagcagauaagagcacugacugcucuuccaaagguccugaguucaaaucccagcaaccacaugguggcucacaaccaccgguaaugagaucugacacccucuucuggagugucugaagacagcuacaguguauuuacauauaauaaauaaauaaaucuuuuuuaaaaucucuuuuuaaaaaaaaucuaaaaauuccauuauauaggauauagaggcaagaggaucagaaauucaaggucaaucuuggcuauacaggaaauuuaaggcuaguccauaugagagauacuaucucaaaaaagaagaaagaaagaaagaaagaaagaaagaaagaaagaaagaaagaaagaaagagagaaagaaagaaagaaagaaaacaaagaaaggaaaggaaaauaauauguuccuauuacuaaauuugucagaguuuccugagacacagaaucaaaaggagcagaaaaagauggcgagaaagagagaccuaagaccaaucuauuuugagaaccagucugcuugauugugggcuggcaaguccauaauuugcagggcaggcuggcagugcugcgcuuuuggcccugagggcgucugaaagccgacuuccuuccucuucaggcaaucuuccuagucucucucucucucucucucucucucucucucucucucugucuuucuuuuuccccuuauagccuuuaagagacugggcgaaggccauacauugcggaggggaaccaucuuguuguuguguaaaugagcaguguagcccacaggcucguauggugaccgcaugguuggugccaagcuggcagcacuaucuagggacgucugguuagaggaagagggucacuaggagcuggcccuggaaagucgcccugguucucuaucuuucuugcuuucuacuuucugugcacugcgaaaugaugaaccauguucccuaugcugugaugcuccacccaaacacaugggguggcugucaagccgauuguagaccaaacucuaaaaccuggagccaagggaaaucuauuccucucuuguaucucucaaguguuggucauccugacaauaaaaacgacuccgagccgggcguggccgcacaugccuuuaaucccagcacucgggaggcagaggcaggcugauuucugaguucgaggccagccuggucuacagagugaguuccaggacagccaggacuacacagagaaacccugucucaaaacaaaacaaaacaaaacaaaauaacaacaacaacaacaaaaaagacucugaucagagcuucauauuugucaauggcugcaaaaaaccuuccggaaauguuuaugucaauugccugccuaaauaauugaguaccucuuggcucagacaauuuuaugccgcuuuucccauucaauucuuuucaggcucaaagaguuucuccagggugaaugugaacaucucuauuagggagguaacuuuaggucgugaaaggcugcgccaguggugauccccuggagaaagcagccuguggacaauucacugugagguucugagucuagaaacauuuggagucuuuccugagcccugagugguggcccaugaguauaagcccccacacuccugaguuugaggcaggaggauugggaauuugagugcagucugagcuccacaaugagacuuuguuucaaaaggacaaaauagggcuggcuagaaggcucaguggguggaaauaucucauacagaguuuaauaacuuggguuuaaucccuuggugaaaggagagccugcuucugaaagucacccuccauguguguccugacaugcaagcaucccccacccacccaauaaacaaauaacauguaauacaaguuaagaaacaaacuauuuagugcaucccuagauuucucugacuggcggaucugaauaaucuacuuguguuuacugcgaguggcuguaaccagugaaccaucuucccagccaaggaccgcagcuuuaacuccgaaaggagaggaacugagauggcuccgcggguagaggugcuugccgcagucugaggacaugaguucaauuccugcuacccacacagugagaagagagaaucaacuucugcaugaagugcuuugaccaccacaggcucacgcuguggcaugcaaguucagggacacacacuaaauaaaaauauaaguggaguaaaaaguaaaagaccauuaaaaccugaaucagaggaggaccagaaagaggagagaaaaagacaacccaguuguuuccccgccccccccccaucuccaugcucccucacacacccacacacugacugcauagggugcucuguggcuccucaccccacuucccaucucuucaagaucaaaaucauaauuguaaugauaauuaguacuaaagugcuccuucugacugagcugcaguccugcaaaccugggcuaccgcgaguuauuagaaccaucuaaacauggcgacccugguuugugcuuagcaacuugccaagcacuuucccuucacaaggcucuguuauaaguauccaaggaucgcuugguuaauuucccccuuacucaucccaugaaggauguacugugacuuucauccccauuuuacagauuaggaaauugagguacagauagagaugaaguuacuucccaagccagacagagacugagcaaggauuugaacccagacaggcuggcuccagcagccgagcucuuaucuuaaccacuaaugacaagccucagcugaugcucaggcugcgauuacccggcuccagcugcaccgcccagcguucgcacacgcgcaguagcucaggugagcuuuacaaguacugcgaccauugcguuuacaaagggcacagcaaaacacagaaaggccgagccacuugcccaaucacacagccacaaaggacaaauuugaacccacacaauguagcccuacagcgugugauccuugcgcugagcugcagaccugggcuaccuugaauuauuagaaccaucugagugugacgaccguggcuuaugaauuugacaaggacuuaauagccagugagcccucuucuaaauauuuuuaugauauuuaaugauauuucauaugcaacucagauggugugccugcuuaccauucaccaagcagcucauaagccggaugugauggugcacgccucuaauccuagcacuccggaagcugagauagaaagauccuaucaaggucauccuuggcuacaaguuccaggccagccugagagcuagcucucaggucucaaaaaauaaaaucuuaacgcaggagcguguagggaacugugggcuggcgugugcaagacccugcguuuuaucccuggcucuguggaaagagaucauguuccaaguucguuguaggaaguacugggagguuccagaagaaaggcaaguaacccuggagaccgcagaggacaacaguagccucuaucuuuccagccaguguuacaaacugucuccgacucuuuacugugcaaaggcuuuucuuucucuucggcaguaaauaggucauguucucuacugcaaacacugaguuuccagagucgaugaugcccuagagugacccuauaaauggacuccucccaggcauauauccucacuuucaccccaaacccacucauccuuuacagcccacccccuucuaccuccugggaucuuugaacagcccuucuuccucccagggggcuucucuaccucugccaagaccugccaagaguuugacccaucccucuuggcuuccauucuccacaccccugucuccaagucagucugugcccuucuccagcccuccacccugggcucuauuuccacaggaagccaacagcgcgcgggacuuucugugauguuugugcaagugcguagaugaccuagaugaccgcgauacaaugaggggaggggguuggaggcuguggccugggagugccucccaaggacacaggugcauuuagagcagggaccuuucgggcuguaggaugcuuuuuaccagacagaacaguccccugguauaauuucaggcuagcaggcagggccccagagagcuauuuuagugagaggcacucuuuugaugugccuuaaacagcuccagggagcuaaucccgccccaggguggggcagccugggcgccugggcccauuaggacggaaugaaaggcuuuugaaggugguggcucaagacagguggucuuuugguuccagccacagugucucugucaggaugggugaguucuggagugagagauguauagacagcccugccagauggagaagucuggguggaggaaacucagggacaggagacuucucccagaucugaucaucguagugaguaccaugcuaugccagccuccccacagguuuuguaaaggaucaggugagauaaagcauagcccagagccaacccccaaaggcaggcaagugugcuuaagccuucuuuucuguuuucuuuuugacagcacaucccuguaucugugagccacgugugacuccccucuagucaaaggggucaaaggggacaaugauuugguacuuuguguucucugagucacuggcaccccucacucuaucccguaccccucccccauucccugcuuccccacccuccagcaucucagauucugucacagggacccagccacaccagccauguguccaugugagcaaugugucaaaugaagauuaauugucccagauuaccugggauugcagggucuucuggaguuuaggagcugaguuucagccccgggcacgcaggcgugguuguucaugcuggaccgacccagaagucacugaguauguuguguauauguuguguguguugaggugcagcuuaagugugaucagaugucuuugugcacagugggucugcugguacguuugucugucugcuggguuucaguugcuccguguaggaagacguaauguguuuguaagauacauagagauggguguguacacuuuagacugcacgaguaaugcuguuagaugcaggaaauauggaggucgcacccccuccccccaauucucuuggguggaaauaagacaauaugcaugguguucagugaaccaugaauucucuggcaaaaaccugaguuguguuuuucaagugagucugauauauugguguggggggcagggaagagacucuuggugugugauugguauaaagcuguuacuggcuguggugaugaguucuuugucugaugggggguguugcugagaccuguagcugguguguguuuggcacaugcucugugcaguagcccgugugggcuugguugggggugggagcaugaggcgugugauuuaugucccuagugcagaaagaaguguuggugguguccgugugaugcggcacauccucugugcgagaugcaaggggaagguaggaaaggauauuuggcacaggugacugugccccauggucgacgggcggggcacuccacuuuuuuuuuuuaaagauuuauuuauuuauuauauguaaauacacuguagcugucuucagacacaccagaagagggagucagaucuuguuacggaugguugugagccaccaugugguugcugggauuugaacucuggaccuucggaagagcagucgggugcucuuacccacugagccaucucaccagccccuuguucuccuuuugauaaagccacauugaucacuccaccgaguggcugagaaguccccucucauugcccagaagacucucaaacguccacucauggauacucaccuagagaugccuaccugggucccccaugcccacacuggaaacaggcacguuuuaggaaauuucaagucugagagucccaaacauguccaaaguguaggcuuuuuuaacccuaagaggccuuuccuuucagggaaaaggaagcaagguuuauacugcaacaaacaaacaaauaaacaaacaaaccgaggcuggagggaaggggaauuccaugaagcuauugggaugggacaccucccagaagcugugagaauuaaaacaguaguucuccacuuuccuaaugcuucgacccuuuaacacaguuccucacguugaggugaccccaaccauacaauuauuuuucuugcuacuucauaacuauaauuuugcugcuguuaugaaucauaauauaaauauccacuguccaggauaucugauauucgacccuuaugaaagggggucaugaccuacagguugagaaaugcuggguuaaguggccagcguaguccuuacuucccuugcggcugcgguaaaaucccugacgcaggcaacugcagggagaaaggaguuccuuugucucagcuugagcaguaggucccacgggcagugggcgucagagagagcuggcuacgugguuuacagagagacaagggaagaccagggcgcagcuugcuuucucccauuuauucagucccugaccucaguaccgaggauggcacagcccacuuuaggguggguuuucccacaucaaugaauuuaaucucauuucucaccaguauucccagagcuuauuccauucccuaagucgaccauuuagauuaauucuaauugucaaccuuauaguuaauacccaccaaaagucuuuaaacggccaccuguagagggcuuugguccccuguagagggcugcccccuccucuccagcuucuuccccuuacccucuuuccaucauugcaucauggguauuuguucacuuaggugucugaacaguugaagcuuccuugguguagaucaaaacuggccaaacacuggugauuucguaguuucuaccuggugugguuuucaaaucucuuuuguaguuuagagcacacagggcagaccaacgagacggcucagugggugcagcugcuugcugccaagccugaggagcgaguucugccccuggaacacacauggaagaggagaggaaguuggguugaccucugaccuccacaugugugggaugacgugcacaagacagccacucgcacaauuuaaaaaaaaaaaacaaaacacgucugaggguccaucaauggucuagaggagguggccaacaaguucaguggcuacagguaaaacgggcaugaauuauggcaguucauaacucaaguucacuuuaguuaauauucauuaaacauuuaccauaugccaggcucugucugaaagacuuuauauauauguuaacucauuugaccccccacaauaaccuccugggcugagaaacauucauagcuucauucuuuuuguuuggggacagggucucuuguagcccaggcuggccucaaacucagcaugucuccaaggaugaucuuggacuccugauccuccgaccuccauuuuccauagucugagauuacagacacacacuaccauccugagcuuaaggucgccacucuacaaauggagacacuaagguuccaggaaccucaguagcauggcacaguuuugugacaagaaagaaauuaacuuuggcuucguccccgagcugucuauuccucagcugcucagccuacacuggagccuugaggcaggauggcagucccaaccccuaggucucuccaccccuuacaaaaauaaagguucauuguuacugacagcucuaaguuuggcaguuggcucagcugugggacugccugccugacauggcuuguucugggccccaggcucaaggagaagccccucucucgugggcuuuucccagagaaaacagugagccuagggucacgugaggggucggccguggcgcaucagggacuccaggggcauuccauuggugggagcuggucuccuggccgcccuugacucagugagggcugggcgggucccccuccuacagcagagucacauggcuaucugcugaguggugaagaguuacaaguacuuagguuaggugccccagaaguggacccugagucaaggguuuguggacaagugauuuauuaaggaugaacugagaaggaugggggcggggauggggacuggggcgggguggguggcggggagcagaacagaagaggcaaagucaagaaagguuauaauuugugacaaaauccugagcucagccuuacuggaguauaaauuaugccuuagaguucaccucaacucaggcuggagagccaggcuuuccuauuuccauagauggcgaucacgguuccuuccugcccaaagcuuuccaaagcagccuggucaaccgagcaaagcuucguggagacagacuggaaggugggcgucucuucucuagaaagcaggagcaggcgcugaggaggcccgaacaaagcaccgacaaccgucuuuuuauacuaauugguucaacaucaaagagugacauuuuauucucccaugguuaacgccuugucuuucaugccaagcccagaggccagggguggagaagcagggggcacgacaagugcuucaguaaccuaguguagugcugguugagcucaugugccuaacacuggccucuucccggaacagaaagacacgcaaaggauauggcgcugagcaucucugcacuugguuggugaagucgagaaguccaacuaguucaaggucauccuuggcuacacgucaggcuuaaggcuguccucugugucucaaaacaaaacaaaaacgcauaggcgauagagagggugggugucuaauagaaaaauaaacggggccaggaacucaugguuagcaagagaaaucgaguugagcaagaucgguaaaagugcuugcaaccaagcaugacaaccuguguuggagcccugucuuagucaggguuucuauucagcuuauaccuccacauugcuguucaucaccaaaggaagucaggacaggaauucaagcaggucaggaagcaggagcugaugcagaggccauggagggauguuaccuacuggccugcuuccacuagcuugcucagucugauagagcccaagacuaccagcccagggauggcaccacccacaaggagaccuucccccuugaugacuaauugagaaaaugccccgcagcuggagcucauggaggcguuuccucaacugaagcucuuuucucugugauaacuccagcugugucgaguugacacaaacccagccagcacaagcccuaagacccacaagguagaaggaaacaaacaacugcuuacagcuauccucugacauccauaagcacucacuggacaggcagacggacagacaaauauacacacacaaaaaucaaauguaauaagcguucuuuuauuagauauuuuacuuauuuacauuucaaauguuauccccuuuccugguuuucccccucugcaaagccccuaucccaucccccuuacccugccucuauaagggugcucccccacccacucccaccucacugcccuggcauuucccugcacuggggcaccaagccuucacagaaccaagagccuccccacccauuagugccagauaaggccccuucagcuccuucaguccuuccccuaacuccuccguuggggacccuguucgaugguuggcugugagcaccugcaucuguauuggucaggaucuggcagagccucucagaagacagcuguaucaggcuccugucagcaagcacuucuuggcauccgcaauagucaguuuuugggguuuuuuuuguguuuuuugguuuuuugguucuuuugagacaggguuucucuguguaucucuggcuguccuggaacucacuuuguaggcgaggcuggccucgaacucagaaauccgccugccucugccuuccaagugcugggauuaaaggcgugcaccaccacugcccagcaaauagucguuuuuuuuuugaaaguuauuuuaaaaauauuuuuagaucguuuuaaaaauguaugaguaucuuguguuuguagacaggcuuuuccuguaagugcucugucgguuccguauagcuacgaugaggaagagccuuggcuucuuucuuguguaugcaccucugaauguaccucucuccauucccacugucuugcugcugaagggaauaccacuaugccgucugaccaccuuaagguagaacagauucuacaguaaauucggagucucagggccaaguccaccuguggaacaacuaccuggcuacaggggugggguucccuuggcuccauggcagcugaugauagcucucagaacucugaagcuagaaacucacguuugcauuuguaagggacucaaagugggacuggcucccugagucuuaguggguucaggaaacugugggacuuccaaggcuggguuacaaagagaaaugcaguuucagcuucaucucccaggaauuugccccacuccuguaauagcaauaacucagguagacaggagcgucaggaguucaagguuaucuuuugguacauagugaguucaaggccaaccaggcacuuuuuaaaagaucuauuuauucaauauauauaaguacauuguauuggauuccguuacacauggccgugagccaccauguacuugcugggaauugaacacaggaccucuggaagagcagucacugcucuuaaccacuaagccauccaucccucuagccuguuuuuuaaaaaagaccuuucucucuuuuuuuuuuuuuuugguuuuucgagacaggguuucucuguagcccuggcuauccuggaacucacuuuguagagcuucaaacucagaaauucgccugccucugccucccaagugcugggauuaucggcgugcgccaccacaccccggcuaaaaccuuucuuuuguguaguuuuguuuuugaaacagaguuucucuguguaacuguuucgguccuggaaauuacucuauauagaccaugcugacuccaagucagagaucugccucagccccagugaugagauuaaaggcauguaccacaaccaccuggcuaagacuuuuugugggugugggugugauuuuuugguuaugaauacuuaugcauuucugugugggugugcacguaagugcaggagcccauagaggacaaagacaucauacccuccccccccuugagcugaaaugugaucaaaauguggaccccuagaacccauacuugggucuccuggaagagcagcaaccucugacucuugaccucugccauagcuuuccagcucccagccugacuuuuaaagguaucacuugaacucaggagguuaaguuuccaucaugauuacggguaacgcuuuugcauugccagacuauacaaacuaugcaucaggaaauggaguaccgcagggagagaucauagguagggaucuagcugauggccacaacugaggccucaucccccauccucaucagucuccaaaccugugagugugcgcaugcgcaaagcuucagcgaggguucccaccagcagccuucgggcugccucaacccagccccgcccagcccggccuaaaugaaaggacugagaaaggaaagaaaggacuacaguaauuuuaagacccugaggugggguucuuuugcucacugcagcggguaacaggaaagaccuggcugcugagaagcugcuccguggacuuguggauuggaccccgaguggauuccuaaccuaaggggcccuuggccccuuaggaacacaaaccacauacguucacauuucgcacuacuagacaaaaaagaagcugacucagacuagcucaggguaggcgcucugaugagaggacaccgagggcucaugggaaucggaagcugaggagauguguaauuauagcgucuccgcacagauauucuuuucaucuugcguagguuugguuuauuuguuuuucagcccaaaaauggauugucaggucuuuucuuucccacguccugggccuuucuuuaccacucccuuuacugauccaguuagugacugcuccaccugcuaauaaccaaaacgagccugugagggccauucucauucaaaccaccacacauacaauauaguuguuucuuucuuuaauuauuauuuagauugggggaggcggguugguguaccuguguagcagucacagaauggcuuucugaguugauuuucuccuugcauccuggauuccagguuuggaccagaauagcucauuuaaaagcugaaacuuugccaauuagugcagcgcaccuucaguucuggcacucaggaggcagaggcaggcagaucucagaguucuaggccagccugaacuacagagggaguuccaggacauccgugcuacucaggugggagguggcgagaggggggagcgcucugaaaccucugugaaugagucuugguuccaucauuguaaaaugggggcacaggcucuaucuagccuugagggacaagaagggauugaacaagacaauucuguacaaagguuuaguaugcagcacuacauucccuaaaugcucaugagcaucuuccacccuggagccacaggugugcuuucagacauuaguuaaaugggaguucauuuaaaugccacaggacagugaugcugccaccaauuuacaaauauuaagaacucaagcaggcagauuucugaguuugaggccagccuggucuacaaagugaguuccaggacagccagggcuauacagagaaacccugucuugaaaaacaaaaaacaaaacaaaacaaaaaaagaacucaguauagggcggccaagauggcucagcggguaaagucacuugccaccugcguucaauccccaacacaugcguaagaguagaagagaauugacugcacauggugccucucuggcuuccagaugugugccauggcacaugcacagcccaagaagaaaggagaaggggaggaagaaaagggggaggagggagggagaggaggagggaaggggagcacagagcagcaucaacaacucaggccaggcuugguagcacaugacugaaaccccugcacucagggagcagaggcagggggaucaggaguucauggcuacuuugugaguucaaggccagccugggcuaugugaagaugccuaaaauacugaagacaaaaacauaacacuggggaauuccuguaggcagaaauggguccucugggacucuacugucuuuguucgguagcaacuugugguggcaauuaaugaagaacaggcccgagguccaggaggaucccuggagcuaguuguauguagcccuccuguaguccucagacaggcaccuuccuucuccaaaucugugccuccuagcuauaaaucaagauggugcaauucccaaggggccucagugucaaguuaggaaggucucccagugagugagacucacacaaacaucaggaggaaugagucucuugggagcuggggaguguggcucugugaguagagcacuugccuacugugugugauacccagggcuccaccccagcaccucugaaacgggagaggugaguguugggcaaaggguacaaugaucugcaggacucguucaguguucugggcuaaccugaagcagucaacuggccaaauaaauauauuaguuaaauggaaaaaucacagaaauacacaauuucuaaguucuaauuguguccucgucuaaggagcaccaaaucuugcgccauccugcucuauccugcugugaauuagcccuuugugcagguuacaggacaccaccaaagaacagcauuagucacucaggggccagcuggcuuaucagauugacagccacagcacugcaggacccuggcucaagugacccugauuuuccuuaaucacaaccccaaagagcuaagaauagagaugccgacacacacgcacacccacacccacgcugaguguguuagggaugugcucuuacaagcccagcauuugagagucaagacagaaagaauugcugcaaaaucaaucaagggcagccagggcuacggagcaauaguguguguguguguguguguguguguguguauuccucuguaucucuguuucucucacucuguacaucucuauguauguguguauguguguguauuccucuguaucucuguuucucucacucuguauaucuuuauauguguguguguguguguguguauuccucugucucuguuucucucacucuguauaucucuauaugugugugucuguguguaccacagauuuaccagucccagucccagcucagugacucucuagcauccugggagagaggcaggacagauuuuucuggcaguacccacucugugaggcccucccgaaaaggauggguauuuucaaucaagcugcugcuucuggacagaaagggcacagcugccuuggggccucggggcacuguggggaggguggagaagagaaaggcaaagaagccagugugugagcugccuacuccccagggacgugggcgagggaggggcagagaggagagagagguggccucaugagugacuuucucuguucuguguaguuuaaacaagaguagagugagcugcccacuucuccagcagcucccacagugggucuccugagacagucugagucaacaaguggaaaagaaccugagagcaacaauauuuucucaucugaguguccaaggagccaaauauuccggucauaccauggucaucaaaacagcucucucguucagcccacugacagccggagagaauuuggcuggccugguagccaagcgugcagcgccucccucccucccucacuggaagcugccugcuuggcugaagagggugcuucuuuccccagagaagaggcccaucuugagucagggcuagaagagcaguagugcuccccuuccagagccuccagggaagcuuucaaaaugucauauuacuguugucaucgaaaaucccuuaucuaagggcuaaagauagagucugugguacagcacuggucuagcauagucaaagcucagaagcaauggcucugacccagcacuaccggaaggaggaggaugagaaaugggaaagaaggggaagaaaaggcacgagaggaggagggaagaggcgagggaggaggggagggagggggacaaggaagagaaagaggggaggaaaagaaagggaagaggaagagggggagagaaggaagagguagaggaggaggagaagagggagggggaggaagggaaaaugaaaggggaggaggaaggggaggagggaaggaagagaauggggaggagggggaguuuuggucuuuugaaagucucuucacagucauaccugcagcaagaacuaggaagcauuucccauugggcuggggagcacugcggggcaggaagguggggacauuaaaucuucccaagagaucacaagagccacuagaugaaagagugagcccacaccagguuugccaguauggguuucccaccucagucacugcugcccuaggaagaucugacagggccuuucccgaggcugggcacacuuuagggguaggcuuucuuccuuuccggucacucugcccugacccagagugagcucugaaauucuggacaucuaauccuuuugauugcuaauuguggaaacaauuuguuguuguuuguugcuguuguuguuguaguuauuguugagacagggagggccucaauagguagccuuggcuggcuuaaaacaacuggggaggggggggggcgcugaguuaucucuccaguuccucacagauaaguguuguuccuuacaaaguuugucauugccucccagauuugauacucucaggccuccuuacuuugugcuuggggaaagaggaggaggagggggaagagguggaggaggggaaagagaaggaauaagaaaaggaggagggagaagagguggaggaggagggaacccuaggauucuuuacaaagcaccucaccuugaaaugccaugggauauugagccaaacacugggcagggucuggcucucgccacuaguguucuuccggcacacagcccagccaucggggcucuguacaacgcaauagugugccuuguuuuguaacaaguaguccaaacuggccuugaacuccccaaguagccaaagaugaccuugaacuuccaaucuuuucugcuuccaccuuccccgugcuaggaucacaggcgugcaccaccgugcccuguuccagcaugcuagcuacugagcgggcugaaugcucagccccccugauauguuccuuucucacagggacaugucaacaguagcagucuaccgggauccaagcagccccuugggcccuguuaagccauugggaacauuggcucuuuaucugccugugguagagcugguuuuguucuggcuaaaauaacaucaaaaccacauaaugagaaguuuggaaaacugagcaaagcaacaaaaaugacccauaaucucgcuccccaacacagccguaauuucugaggacuguacuuggccacucccuucagucacaaaaguaauccuaggucaguuuuuuuaguuguuuuuguuguuuuguuuuguuuuguuuugagacaggguuucuuuguguagcccuggcuguccuggaacucacucuguagaccaggcuggccucaaacucagaaauaugccugccucugccucccaagugcugggauuaaaggcgugugccaccacugccuggcaaugccuggucauuuuaauguuagaaucaccuauuaucuucuucggaggcagucacugaauggguuggguauuucccucuaaucugcuucuuuuauucucuuuagagacagggucucagauaucuccagaugguuuugcuuuccuuugggagcugaggauggccuuaaauuucugauucauucucucucucuuucucucucucucagauuuccccccacccugagacaggaugccacuguguagcccaguguagugaacacuuggaauacaaaauaaagaugguggaaugagacauuccgucuccaguuccuaacaucagaagugagcaccugugugucaccagcaacauauuggaggccagcugccuacaccaaucagaaacagggaccacaaagucugcaggggugagauaggccuuuucagugucuacgauuucaucauggacauuacugucgauuucucuuccugccccuguaugugcgggucuaucgccaucucgccaucuccggcuccuguguuaugaagacagucucaugcagcccagaccaaucucaaauugacuagguaaacugaggcuggccuugaaccagucccuccugccucuaucuccugagagcuggguaacagcuucuggagccucacccagcuucgcuuucaccaccccagccaauccugugacuccucuucauagcgagagcauugacacuuauguucugagugugaaaaaaaaaaaaaaaucacauaguacuuccuacuagaaccuugcccgggucaacugaaguguguguguuugcuuaccagucugcagguuugcuuaaguuuguuuauuuuagagaccaggucuugcucuguugccuaagccaacuugaaacucuugggcuccaacaguucuccugcuccaucuuucuagagcagcugggacucuaggcaugcuccacuacagcugacugaagcuugaaugaaugaaugaaugaaugaaugaguuacuaccucugagggacccuccucauggccuucucaacucuguacuuuaauuaguugcuuagaggugucuccaugccucaguuuccccaucuguaauaguaaacgaguucacaggcguggucugugcuuggagcaagaacaaaaccauccuggccuauacucucuagggacucuacagagcccaucccuuuggcuaucagacuguugagauaaagguucccccaggaaucggaauccccuccgacaggagucucaugcucagagaagaaaaaaagcugaagccugcugacagccagagaggguacuugucugucagggaaaaauucuacacaggacagacuggagcccagacuggucugggucagugacacacggcacagcacacggugggacaaccuggcugugcaucucucucaaaccucaaccucagucugaagauggauugggggggggggucccuggaccucauuacuugucacccuucucacuguggccacagcgaagcgaauacaucucucugcuuuucacuacguagcuccaucauugccuuggggggggguagcgaggaaggucacuggggcccugccucugauaagaagaacgagcaauuaugauuuccaggaaccgagggugcucuugcuguucagugucuccagcacccccggagaccccagggcugccgucaaggguguucaauaaacacguaucgauugagccaacaaugccagaauuggaccugcagaggagaaaauggacaaacaagacagugagccugcaggugagaccagaacuggagccaacaaucuaccucucucucccaacccuagcaacgccagcagcucucugggcgaggggcacaguugcuuccaguuggcagaaccagucucccagcuucccuucagaacccagcaccugcugagccaccgacccacggacugucucucucuggaaggcagccaccgacccacggacugucucucucuggaaggcaguucaccucuggguuucaacacugcccuuuccccuuuccuucuuuagcccuuaggaaucccugaaagcuuccugugcuuguggcuucugugacuucucaacaucucuugugcacacacacacacacacacacacacacacaccagccugugucuaagcaguucauccuguacaaugucucucugauaaaauaacugauuccauuucugucaccugcugaggcuccagcagcucugcccucagaccucuuaaagcugaggcucagaagcacagggaggcacgggaaccuggucccaggcccuggcuugcuggagcgaaggaaucuauugcuucggccacucggucagaaucccucggagauugaugugauaugcacagugacacccaaucgggcuuggaaaacugggccaacaguuaagccacacaaaggaacuaaccacagcuccacuggcaacuggcuccuuggcaagugccaaaacaaacagcuguggugcaggccuuccccgggcugccggcuuccuggacacuggcagaggccgcucaagaagggaguaccugaguaggguguuguucaguugguagaacguuugcuugccuuccaugaagcccaggguucugucugcaccucauaccugugauccuagcaguugggaaaagacagcaagcacccggaucagaaguucaagaccacccuccccuuuauaaagggaucugaggcagccugggacaucugaaugacaaaugaaaagagccgugagcuaucugguguuuucuucauggaaguccaagucucccccucauuccucccaggauucuccgaaucuggcuguugucuuuugcgauauuuuagaauauucuagccagagcgcagaguauaaaauacaagucaaaggcaaugagcauauguuagauggauggaggagggccuaaaaaugcuggugcuggggaggaaaaauggcucagcaguuaagagcaccggcugcuuuuacagaggaccugccuucaguucacagcaaccgcaugacggcaacucugguuccaggaaauccaaugcccucuucugaccucuauaggcacccggcaagcacacagugcacagacaaucauacacacgugua

SEQ ID NO: 8501 - RNA, 9751 nt, Mus musculus
auuauaaaucaucgagaaguauuuauugagcaccagcuuuggggucgggugugaggacucgggacaaugcagggugcugucccuucucgugagacgcuuacaaucugaguggagacagggagggagccacaauacauguucuuggggugcgggcuaaggguagacaguccagaccaggauguuacagaaacagggauguuuggggcuggagucagacccacuaagugcuuugacacccacgguauucaacacugagaaaggaucagccauugcucaguguccugugagcucccuuagcccccaagacaccaucuuggccuggcuccuuguacaacugcuacuaagaaaugggagaagucacugagaaccccaacugggguccccaucccagauaagcccacccccaccaccacacaccauagaaugcucugggaggccugucucaccaccaaggacccacccuagacccacaaugcaggggguugccacuggagcugccuaagguaagaccagggaaucccacuuaguguacccugcauauacauucccuuccaguccacugagcuguggggcaagugccuagauaugccuccugccgaccugcagaaggggaaguauggggugggggaaaagagcagcagaucaccagauuaacccuccaaaauagaggggcagcuggcagagacccacaggagaggugggcuccccaggaguggcaaaggggauccagaguggggaccauuccugucuucacaggucugagcaaugucaagagucgggauauuacgguugaguccuaacugccaucccuguucuaggcugugacugcuucacugucauccuagcuggccuuagaggugacaaggagaccccaaaguccuacucauuuuuccaaagugcuauucaggucugaggaucacccccagguaagaaguggcaaggaaccaggcagggaauggggggagggggguugggugaaacggaugcagauggguugauaucaguaggacuguuccuccgguauaggaaacacagagcuuggguugggaggggcuuaaauaauaauaaucuacauaauagaaaucccccacacuaagggcccuaccguccuacuaauuuagguuuguuuuguuuugguuuuuuuuguuuuguuuuguucuuuuuuuaaauaacuuuaaguuuggagacugggagagggcaggcagcguauauacaggagacguuuaaauuaaaacacaaauaauaauuaagacacacagagugagggcuaaggccgaagauggggaagaggccuccugacccacagcagaagagggcggggcucccgugggcacuucaggguuuucucuugcagaagaccaaucugcgcuuggagugauagaaaucuguggagagagaacagaugucaggccagaugccaaggggaaggacaucauuccccagagucuaagggacauguggcucaucguggggaaaagccacagccacagggcacaacaccuccuggucagagggacagggcucuagagaggguagaucccccaacgcccagaguuaguuauaggaaguugucauuuccggugcugggaaucaggcccucagcaagaguaagugcccucaucugcugagccaucucuucagcccggcucccuucuuagagcucuacugccaaucaccacacuauccugggcauuucggucacugcagagaaaaaugccuggaucauaugaacaucaacuguuccucugagccccacgaggucccacgccuauggaauggcuuggugguggggaagggcuggaauguucucuguaaaggccauccucaaaugguggccucuccucuccaggccucuugcaggaucuuucuccuucucugcuccuguccuuaccugucaggcuggucugccuccguuuucggcccugagauguuccgggcccacccggggaaucuucaggccgcucagacaccagagugcaagacagcgacaaggccacgugguccuccggagcuggccccugcagcagggcagaggaaguacugggccucuuguccccucccaggucgucacggcugcgggacccagggcucagguagaccuugggcagcccuaggcuccgaacgcgcucccagacgaaguugcccuccagcggcgucuccgugacgaagucaaaguuccaccguucucgggccuccuggagacagcccgccaugagcgcaucgcaaucacggcgcaacugcucacuguccacgggaccgaagagacaacggcacacuuugcuccugugcggaacaggucggacaucaccaggauuggacauggugccuguggcugaaacacaagaaggacccgggucacuauggaaacuaccccaucacagucuucaggcucccucugguccuugcaggugcuuuuccaccacaccaugagacuaagguggguguugaguucagccagcccugcaccccaaggucacgggugauguccacagaaguaggagucaccguccuguuuaccccaggaauucuauuagccaaaaucaaugugcuaacguguucuucaugggugugaacaucccaaauacgugugaauugcuagguccaguggucucccuacccugcugucuuggugauuaacuccaucaggccaaucaaaaguacccuggacagccgggcgugguggcacacgccuuuaaucccagcacucgggaggcagaggcaggcggauuucugaguucgaggccagccuggucuacaaagugaguuccaggacagccagggcuauacagagacauccugucucaaaaaaaaaaaaaaaaaaaaaaaaaaaaaaaaaaaaaagugcccuggacuuugggauacuacacauaaacuguauagcauuagugcugcuacuuggcaccaguuuuaaaaagugacuccaugucuccagccucuguuucuuagccagugugguuguggcagcauacucgcgaggcuggcaugguggcugggagagaggcgcgagaaugccggagcuagacugcccagaucagaaucaaggcuuugcugggugaccccgaauaaguacccuaacaucucugggcucccuauuugagaaugaacuaaguuaacauaggcaauccugagaaacagaagccaugagcgugccucucugccccuaauucugacagagccuccucccugccccucccucccucccacugucacugacaggugcuccaggcuggaggccuuuccaaaggacgcuggcaggcaguagccugggaggaggcagcagccugggaggaggcaguagccugggaggaggcagcagccuggggggaggcaguagccuggggggaggcagcagccuggggggaggcaguagccugggggagaggagagucugaagggguggagcgggguuaaggcucucucccaggcugagccacauccugccaggcagaucagguaaucuggagucuagacaccucccagccccagacgugccuauagccugugcccaaggaacccguuuuacaggcacugaaaaaaaaaaaaaaguuaaagguguugguuuaccuggcuccucuccaggaaagagggauaccugaguggcccauccugacuccaagacuaggggaugcagcuucuaaggagggccuuugagcuugcaaggugagccccaguggcuuccugaggcaagacccccugggcucuuaccacauacacuaccacacacauacacacgcccagcuccuuaagaccucagggugaguuugcccacagcuggaagagagaaggggguacccagacuaugauucaagguaggaagccagaagagaugaagcgucuggggccccgaugguaaagccugggccuugugcuaagcaaggagcucucuauaaaacuggguguggcggcacacaccuguaaucgcuggaggcagagguagggaaagaaguucagggucuaccuuggcuacuacauagggaacguggccagcauuguggcuuccauaaauaaguaaaacagccaauucccaaaacacagcacucgggaggcagaggcaaaaugucugugaguugaaggccauccuggugugcauagugagagccuggcuaaacaccaaccaaccgaaacacaggucuaacaaggauucccacugcccgcaaaaggauucucaaggugcagaccucagaggccuaaaggaccucagauggccucugccuacagguagagcuuggggccuauucacauccuuuaguacaacucagucauccuccugccucugccucuagugugcugggauugcaguuguaagccaccaaaagcuaucguuaauagauggcaauaucacauucuuuuacggcagagcuaauccagguucagaauguguguccaaaggcacagggcucacaagcgggguuugaauucagacccuuuuggucuaguauugaucauucucucgucuucucaccuugaggggcaugaccagaggacuccauuaaaaucagcuggaaaagcuuuuuuauuaaauauagacugagcuccauguuauggggagagucuuuaaucccagcacuccaccagaggcacgugauccuuaugaguuccaggccacugggccagccugucuauauaguacugguagcuggggccauuuuguaagcuugucucucugucucugucucucuuucacacacacacagagacagagagagagaucuauauagauauagaaauauagauuggcucauuuccccagacaaacugagccgaaaaacaaguuuggugcccuuccccagacgguagcucacaggggccagaggaaggaagggaagacaccaauggacucggcuaaggcuggauaguccccaguuuuucauagcugaagauaagaccaggaacccaagaggggcacgaucuccaccuugucucucaagggccacgccucccuaauaguccgcuagcacacccugcuaaaaucacuuguaucuggccaucaggcauauuuuaauucccuuuaagccgcgguggggguggcagaagcccguggugccacccgcgccuagccggccuugcaguccucacugaugccgguagggggcgcugugcacucaggaaauggcgcucgguaggcggcgcguaggccgagcaaggaguggugagucaguuuccugcccggcgcugcccgcccgccaaaacugcuugggcaccggagcugcgcgucacccugggguggagagaggagaggaaaggagggggaccccgggccacaaaacacgucacgaugagcccaggcuuccuaaauucccgccuauguugggaaaccagacugagcgcgcgcgcgcgcacgcauacacacacacacacacacgcacguacacagacacacacacacacacacauacgcacgcacgcacacacgcacgcacggacacucgagagcaaagaaagugcucuuagcucuggcccccuccaccuugaucuccacgcccaaagcacgcgaugagucagaucccuggaaaauaaaaauagaugagggcgaggacaacaaaaaaccgccugaguguccucucugaaacgcgacguaggggacagaggaagcugccagcgcgcccccaaaugccaaacccaagcccaaaguauuucccgcacgaccagggugcaaguguagcccuuguccccggagguuccgaguggaauggaugugcccuagugggcgcacucagccuggucaccuuccuacacuggguguggacugggucgagggccccagccccggggcgucugauguacggcacccguaagccucacuccgcgaggauaccggccgcucuacagugcgggcuccucucgcgccccacggucacugguccgggucguggugggcgcggugggugggacccuuugcgcuucccgggcuggcaggguggacaggacccgcccagacucccuguccccgagggcgcgccgccgagcggggaccggacaccgcguccuggaccuccccgugucccggguucccugggaacauacugugcccgccaaauaggucacugugccgcgcgggggaggggacggggcaggaacgaggcuguacccgggcagggaaaggggcuucugggcugccacugacccauccccaguuguggcgcgauucuggucucaauccagugcccggggucuccuugucacaaugagucaccuccucgccuguccucuaggacgugcccaggcacgaucccgagggcggaggacacagcucgcgcugaccucagagcccaguggggugguggcuaccgcgaaacagggcacuugguucacaaggaccggggauccggcggcacccaugggaucggagaaccgcucugcgcuaagcucuagauagacucgccgaagcuugucacaaccgccacccaggacccaucucggggcaccgugagcuucauucucacgcuuugggcgagccgcaccuggaaucccuagaaacauuggcaaccagaagcgagcucccgguagccgauccccgccagccaucgcucggacccggucuccaaggacuggaagaguggcugccauccgugguccuggaguucagacucuguaugccgaguccgcgacauagccugacccucgucacacuccaacaaacgaagccuucagccaccacggacgcucagacccacacccgucauccaccugccgcggacacaccugugacucuggcgggcacgcacaaauacacauauacacacacaggugauccacucaucaccacacacacacacacacacacacacacacacuucuggggacacccacugggcucagcgcauugcuacggggaagaacuauuguucccugccacgaagcucucaccucugaaugucuggauaucgcuguggaucugcgccugacuccaauuccccuagacucugacaccgcggcggcucacaccucucggcugcugcaguuggcgucgagcugccuccuuauagcgucggcccaggccccgcccccucagaggcaggaccaacccacuccuucaccgaucccggggacucgcuggcccgcccuccccucugggaaucuaagcccgcgccagacagcuagaaccggcgcgcguuaagagggcgcgcccuccccucccccacaccugggcuauucucuugucacgcagcgcaccagcagagccacauacaucuaugaacaacaguacaguuagagcugagugaguguuuaugggucugucccugaccaacugugggaaggacuaacucuuuuccagaucacugauauuaguaaauaaaauccuggguuucgggaggugggucuguugguacaguguuugccuaacuugcuggaagugaagcccuggguuggagcuccagggccccauaaacugggcaugcggggucacgucuguaauaacagcgcccaguggggggugaggagggggaaauaggcauucaaggucguuuugacagcuaccuauuccgauggagaccaacuugaaauaugugacacuguuucaaauauaaauaaauugaucauuugaguaugauagcaaaagccuggaauccuauacuugggagauugaggcacgaggggcguuacagguucaagaccagccugggcuauccauugagacccucucaaaaacaaaacaagcccauaaauaauaaaaaauaguuuaaaaucccaagaagucccacuaugucuggagauuuuuuucccccuccucccagaagccccucggacaucggguccagaacgcgaucauuuccucccugucucacagacgaggaaagcaguuccacagaaggaaaggaugcugucaaccgccucagaaaucggggagauugaguccaguucucagaccacggacuaccaagaaaaacagccgccaggcuccuuaccuccccucuccccucuucagaagccagcaugugaacauuucucacaccauaauacauccugcaagugagagcaucaagaccugacugggaccacacuaauggcuaccugcugaccucuggcaagcugcccagaguacucugcuugcagauuucuuucucuggguccaaaaugagggaaaugucuaauacucccccucccaagauccagacaguccacuaaaaugacauugauaaaggacaauucuagaaacaucuacggauguuccugacagacauagcaguaagacauucuccguucccaccuuccuccaugucucuagucaguuuuauuuccuucuguuuggggucuuuugagacgaggccucgcuauguagcccaggguggcccucauauucaaggcaaucuuccugccuuaacuuccuugcuuagaguuaagacuacaggucugagccaucacacccagcagaaggggguuuucuucagucuuguuacacgauccagccuggucacaugggcuacauagcaagaccaccaucucagcuaagcauagagguacaugccugaaaucacgguacuugggaggcaggggggauuuggagcucaaggcuagccugagcuaucugagaucaccaugcauccaaaaagggauguagcuccguuaauauagcgcuugccuaacauguaugaagccaggaguuggaucccuaguaaggcaucaucuagaugauagcggcauacaucuguaaucccggcacucaggagacagaaacaggaggaccaauaauucaucaagguuacaugacauccugccucuaaaacaaaaacaaauuccucucucucucaaaacaaacacaaacaaaaauuuuaaauaaagcagagacuggagucuuaguuugaacggauaucuuuaguuaaaagaucaaaauccugcuuuggagaagcugugaguucugacaucugcucuccgaugucuagagaucgcugcccagacaugcccagucuuccuccucggauuuagcugaccuagacaggccuccucuucugugaugggggguggaagucugggaagggcuuggccaccuucccaaccccccucaaaagccucauccuguucagaaacacaguugaaggacccccuucagacccccaaaccaggacagacauaauggccacucccacaaugccccagcuccugaacgguccagucccugcauccaagucguccaucccagggcugggcugucaggggccagcacaggaugucaaaacugcccaaauccccuuggccuccaggcuucucagauagaagugacauugucugucuguuuacuuugggagaaaacagcuugaauaaaggcuuauacugaacugcugagugcugugaccuccugugccuuuacccuacugguguuggagagauuuauuuuaaacaacuucuggcuucccagagcaccacaaaaguacucaacaaauauuuauuaagucugggacuacucagucuuucuaacaaacauucuuggccuugcacuugaauguauagucaggcacaccauugcacgugaauguauacucagaaacaugguuggaggagcccuccagaccccaaaaugacaaagugacaaaaugacuacauacaguaccugacacauacacaccccaggcacacacacacagaugcacaaaagcauccuucaccugauacaugucacaagauacauaccaccuuuuauucugcuggcaaagugggacguccuuaauuaucuggggucucugucuccauucaugcuccuccucaccccacagcugguaguuggguaucaucaggucuccaccacccugcacug

SEQ ID NO: 8502 - RNA, 27643 nt, Mus musculus
auggccauuuggucuguccugauagcccuggcuaguuccugcauucucuuuuuuaucuuuuauggccggacauucuuagcuacaggguggguuuggcugugccuggacccgccugggucuauucuuuagcccugaauuucuugaacuuagauaccacaaugcuauaagacccaaaauuauaaguuuuugcucuucaggaccuucagaggacagcaggacauuauuuaccuuucuaucuguugguugaccagugauaaagccagggccucgucucuuuucugccucacuugucccuggauucccauguggaauucaauguuuucuggaccauucuuuggaaaagcagacuuggucgugugguuugggagugacaaagcaggugcguggccugaguugagcaguggcuaccauauuacucugaucggucggaugguggucggaugguggccccgaugaagcuuagguaggcugugcuucucagcccuuagugucugucucuggccuugugcucuguuucagggcuucucuguggaggggcaggagaaccugcaggagauccucagcaagcagcugcugcugugccaguuccucauggcccugucuguuguccgcacaggugauguuuccccagcuccauccucuccaaggacccacugagacccugcuuauagcugauaaguacagggguugguuaagaaauguaaaaaagaaagaaaaagagaggagaaagaaacguuguaucaaucagguggcugaccagaagaggaauacagggagggaaaggcaagagacaccccccccccccaaaagcacugucuacagcuggcuguagcauaaguuaccuugggcuuguugucuuuacugucugaggugaacucccccacauccugcaguagccacugauugcccugggcauuuugucuccaauccaggaggccacuuugucugcaaaaccuuugaccuuuuuacaccguucagugugggccucauuuaccuccuguacugcugcuuugaacgcgugugucucuucaagccuaucaccagcaggccugccaauucagagcgguaagacuuccucucugucauaucuggcuagucagccaucagccgcaaacccugugcuuuugucuggcaugaacucucaaacuguuaggaaccuugacuuuggagacgugauucuccaguagaagacaggguccuuggucuugaauggugccaccuccacagcuguguuuaccaugcuugcaucugggauucucauguugguccaugaagaaugugacuauuaagagaggguuuagguuggcaauaggcaaagggguugucauacagaaguaugcaggcaucuggugcccacagacaacauuaagagaaaacaaggcugaucgauccgaauuaucagguagccuguuaaagugcagccuucgcuggagaccuugauccacuacgucuguuaacagccucuccaagucaugucuguugguacaggacaguggggaacaccucuuagauggacauacagucucacauauaaagaaaagaucuuauauauuuuauuuugagauaggguuuuacaguauagcccuggcuggccuggaaccuacuacauagaucaggcuggccuugagcauaaauaagauaauccgauugccugugccucccaaggaggauuuaaggcauaugccaccaauuuguaugaaaaggagggacuugagguaacauuuuuuaaggcacaguuuguguugcccuuugaacucaggcuuaagguugacuagaaagacuguuuagcucagugacuccagcagcagggugaaggaaugggcggggagaaggcucuugcuccuuggcgugacaggguaucuccugcagguauguggugugcaaagggcugaaggugggcauagaugauguucgggaauaccucuucuccgugaauauuaaacucaaccagcuucggaacacugagucugaugucaaccugguaguucccuugauggugaucaaaggagaccaugaauuuaaugacuacaugauacgcucuaaugagagguaagccaccuggcugucugcugguacuguugggguguuaaggauaccuagagaacauucuguuaucuggguuugcucugcugguccuguuccaaggagucaggugggucccuggcuccagaguccugcccacaggagucugggacuuacggggaaaagagagccugagaagagaaguggcgguuggugccuugagauuacgugcaaaagcaaggguagagcauguucuauaggagcccaaaccuuugucaguugagggguucuucgguggguguugggaagcuauguuucccccuucuuuaauugauaacccccuuccaaucuuccacccucacccaggacuggaguuacaggcaggggugagccacaccccacauuggugcuaggagcugaauuugaguuuuuugguuuuucaagacacagagaaacccugucucaaaaaaacaaaacaaaacagguuuuucuuuguagcccugccuauccuagaacuuguucuguagaccagguuacuugcuucugccucccaaguacuaggauuaaagguguggaccaccccacuuggccacugaaauguacuuuuuuuuuucuuuuuugguuuuucuagugcaauguacauucuuaacugguaagccauuucucuggccauuucuccucuucaggcuuuuuuuguuuuguuuuguuuuuuuucgagacaggguuucucuauagcccuggcuguccuggaacucacuuuguagaacaggcuggccucgaacucaaaaauccaccugccucugccuuccaagugcugggauuaaaggcgugcgccacuaccgcccggccagacuuuuuuuuuuaauauuuauuuauuuauuuauuuauuuauuuauuuauuuauuuauuuauuuauuuaauguauaggaguacaccauaguugucuucagauccaccagaagagggcaucagaucccauuacagaagguugugagccaccaugugguugcugggaauugaacucaggaccucuggaagagcagucaguacucuuaaccgcugagccaucucuccagcccgacuuuuuuuuuuuaaguguuaguuuuuuguuuuuguuuuaguuuuuuuguucuuuuaaauaaguacugcauuaaaggcucuccauguauuuugggcauuaaucucuuacuagacuugaaugugaaauacuguuuccuggucuguauuuucuuuucacuguauuauguccuugguacggaaguuuguaacaucaguguggucuggcuuacucauuuucuuauuguacuucuaguaugaggccucucccuguguuuuuuuguaaauuuauaaguuuugcccauguguugagauauuuuauuuuuaauuauuuuuuggauauggcauuaauuuuuuucagaucuuccagaccguccuuucuuuaugaaauggacuuggcacacuuuccaaaacucuuuugcuacuugauuagcaaugcuaauaaacaguaguaaaugaguauuuauuucuaggcuuucuaucuuguuccaggggcaugucaucugugaagugagauaauuuuauuuccuuuccagguuggcuaucucaaacuuuaaaauuuugauaaugagauccaacuaggcuuuuuuucuucuucuucuuuuuuuggugaaugauucauuuucuuuccaaaaagucuuaguuugcgugcucuguguagcucugggugguuagaacuugcugucuuccugccucggugaucauccugagugcuaggaucacagugucuucucuguccuugguauuuccugacacacugacucuuccaaaaguucuagcuuccuuccuggagcaccaaguuccuauuugcaaucauuccguuucagccuguagacuucauuuuagagacacuagcucuggcuuuuguuuauuuaaaacugcauuuuuuaggcaucguggugugcaccaguaaccccaccacucaaggcaggagauuccuguacuuccccggacaggcauggcuacauagugagacccaaacucaagaaacucaagaaacaacauauaaaauaucacagaaaagcacgucuuuuauuuuugaggaacauuugaauuggauauggaauuuuucuuugaccacuuuaaauuagaccauuccacacuuccuccuucccuuucuucugaugggaagcucacccuuggguuuuaaaaauauuuauuuucuuuccuuuuuguuuugugucugugcacaugagugccauugcccauagaagucagaggcauuggaaagcccuccccccaccaccagcuguaguucccggugguugugagccauuugaugugggugcccuuaaccacagagccacuccagcucccaccauuggccuugucauugucuucuuguguaucaugugucguuuccucugguuguuuucaagaggccagagguugacaucagguugucaguugcucuucaccuuauguauuaagggaggaucucucacuugacccuagaguucaccaaacucaccuagucuagcaagccagcuugcuuggggaggugggcagccaccuccagagugcugagauuccaggugaguucccgugcucguccagcguuuauucagguccuggggaugggcuuuguuguuccuuagucaguucuuuaagggaaggggaagagccuucucagcaggacuugugucugagugucucccgaguuccacucaguucucuucugcugucuuugggccccacggaacugcugagugggcccgcuuaccucaccgcgacuccgguggcuucugcucuggcuacugugcugaugucgaugugugucuucuuuuuuccuagcuacugcagccuacagaucaaagcucuggccaagauccacgccuuugugcaggacacgugagugcugcaugcccaccggcucuuucucuuuccuuucuuccuucccucccucucucccucccucccuucagguuuuugagacagauuucuguguagcccugacuguccucauacucagagauccucugccugccucugccaccugagcacuggcauuaaaggcaugugccaccacugccuggugacagucaacuccuguuucuuuaacagugauuuaaagccacucuuguggguuccuuuugccuuguggaauaucagcauagugacacuucuuugagaacaaaggagaaaucagaaugugcugguggguggagggaagggcguguauaggggaugcuggccuccugguggugcuggcuacagucugugggaagggaagugauuucagucuauaaguucugagcugucucuagaggcuaguccauugucgcagguguacuccuuuaggucauaaaaggcuccgcuuuuguucccuaggacccugagugagccuaggcaggcagagauccgcaaagaaugccuccagcuguggaagguaagcagccuauugucccuccaggccaggaagcuggaguuaacagugggauugucaccuuuauuccccaccugaaagggugcccagcuccuuagcaugcugcaaguuaccucuuuggcucucugacagcuuggccagcagcugggucaaaagaacacagguucugggcaagcugcauuuuacccugauggcaccauaugcguggcgaggaaaggauuugguguggguuguauugaugucguggcuugacagggagugaacguuauaccuccagcucccuugccaggcuuguaugccauuucuucuuccccagucuggauccaucuccuuacacauauguccacaagguacuuagaaaccacagucagagaggcagcucagcagcagagagcacuggcugcucuuccagaggacccauguuugcagcaacccacaugauagcucucaacugccuguaacuccagguccaggagcuuggacacccucuucuagccucggcaggcaccaggcacaugugguauacagacacacaggcaggcaccacacccauacacuuacaaagcccuuugcugucuccuuccagaucccagaccaggcucgaguugcuccuuccucuucagacccaaaauucaaguuuuuugaacuaaucaagguaaaucugauucauauggcaacacauaagcggccuuuuuucuaggguggacagugucacccuggcuucuguaaguaaggcuugcgaaggcgucagccuuggaccuaaaggguggucuagucuccccagugagcuaugguauguguagguuuucccaagagcuucccaggcuggcaacagcauucugcuaccaaagggcgugcuggcugcugggguccagccccaaccauugacaggguggcccaagaggagagaaggagucucaagggaggagugagucagguguuguggucaggggaaucuuguagcucugacugacuagcaaucagguuguuucuuuguuuauacagguuucacagagccaaggcagacuaaugguuacccaagaaguacagauuguaucguuuugucuauggacauguguuugaccuuuuuuuuuucacuacauggcugggguaacaaguucagucacaauuagaaaguacaaauagaauagauuuuauucuuuuuuuuuguuuuguuuuuuugagacaggguuucucuguguagcccuggcuguccuggaacucacucuguagaccaggcuggccucgaacucagaaaucugccugccucugccucccgagugcugggauuaaaggcgugcgccaccacacccagcucuagauuuuauucuuauuaucacuacuguugcuccaauuuaaagaaucuaaagacugucuccuccaaaacaaacauguuaauuauauggcagcuugauuuuaggcuuucggcauuugcaguuuuaaagugcuccagacaaacagaaaacugcucuuuuuaugaauagcaaauacuaauggcuaacuccucuuauuuauauccuuucaucaucacacuauaauuaggaaaaaguuauuuuagucaaucuaucuuauuuacuaagaucuguauaaucccauaucuuuaaacuauguuuucagagagcucuaaguguauuguaaaacgaggcuuugaauuuguuaccuguucuuaaaauguagggucauaagggauuuguaggggaagauagggauagugggaugaucugaggcaggagaacuguaaaggagccacauugggcuagccugaaccaucuucuccauccuguuuuuggugagcuaaucuugaguuuuucugcuauuagccuccagcauuuucuagggcaucgcuugaggcuggcuuaguugugggcauuguauugguuuugugagggucaaagacuaaagaaugagguucaagacuuuucugaaugggguagagagaucauuccccugcucucaggccgacugcuggacaauccucacguuuggugucacugagaguguggcuuccuauucuagugacauucccugguaaauccauugugcuuuggauucuguguucuuccuuucuuaguuucuccuaguagguccuaaaggaauacuugaaauggauggcaauagauacuauucagcgaugaguuagguagagaagaggaugcaggggagccugcuucugagagcagaugacuccugugcuucaccucugccagccuggcccagccgcgcuuucucugauccaugccgcaggacacugacaucaauaucuucagcuacaagcccacacugcucacugccaaaacucuggagaagauccguccuguguuggaguaucguugcauggugucuggcagcgagcagaaauuccuccugggcuuggggguaagucagcaagcagcuggccuccuguuggcuuggggugguggcagugcccuuuguguauagauguagacagcuucuggccacacuguauguguucguuccauuggcaucaaagaggucuuccucgaaacuuuacuucccuucuugcccagacuuagcaccaacucaugcuuuuguuucuucauuuguugguuucuuucccacugccuaaucuugccuggcugaagggaaggcuguugcuuuucuugagaugcagagccaguaaguaggucaucuggcugauccuggguggccaggucucugcaaucccaccccugccauucauugacugucaggaagacaccucuuuuccucuucugggccauugggggcuaauggaaggagggaugaugagccuguuagcuucacaucuuccuuggcuaggcagccucugugcucuccuacccugcauccuggacuugacuucuccccagucacuucuuuguauccacgcuucgucuuguucuccuuuugcuuucucuucuuccuaucauacuaaccuccacguggauauugaacuugaugaaggucuuuugcuggguggaaguugagaagugucauaagacucaucuccccuagacauuugcucaugaaauuagccagucuuugucugcuuggagcugccaagaaagcuccuuugagaacaaagccuuucauuccuuagucuccauaaccucccucucucugccugcagaagucccagaucuacacuugggauggccgccagucagaccguugggugaagcuggaccuaaagacagagcugccccgggacacacugcucuguguggagauugugcaugaacugaaaggggaggucagcaggguuucuguucacagacggcccugaggcaggaggauggggcccugugaagacuagccuuucaccugaguuugguuccauguugugguagaauaauucccucuaaggccuuguacugugggagguacugggaaggggcagacucagaaaaucugucuucaguccuuggauucuacuagguguuuaguagucgauuuaguucauaaccaagaaucccuuaggaaagaagagaccugccauuuugggggagcuuugacuuauuacaggguaggugugacauucagaacacucuguguaaacaggccacagugggaagcuagcucugguuagagcaaucauggcagcagucucccuggauuugagguucaugagggcucccaucccuaaagccugcucuuaagcccaagcuagccucugcucaggaccagugggcagggaggcuagaugcagccuucccccagcuuaguuaugggugguugaacaccagcauggcacacaggguaggcagaguaggccaaaggccugcaccugcacagcagacagcaugcuugucguuguaggggaaggcccagcggaagaucagugcaauccacauccuugauguccuggugcugaauggcagugacguccgugagcagcacuucaaccagcggugugccggggcccuagggcagggagggcaggacuacucauguccacuacaggcugggcccaaaggcaggaggaaagaccaguuaggccuuaauucuagcacauugcaucaugccacaguugcuuagauuauugaggucauuuuuguguaaagauugaacaaggguaaucuuguuugaagagggaggguuucuucuaaaaaucauggccagagugugggcagucucaguuuaggguuccugggcuagagugacagagcauguguguacuguaacaacacuugaaguccucauggagaugacugaacacagcagaaggacaucuuaggaaaaucagaggucagaauccagaggauagauugggcucugggggcaugaaugcugccauuuggaugguuuguguaggucuggguccucucaccugucugguggaaaugccuuagcacagguaaggucccugccuugccucuaaggauuauguuuggauuauagaauucagcuugcugagaaauuugugaaagcagucucuaagcccagccggccagacaugaauccuaucaggugaguaugucguucuccucccagagcccgugggcuuggggcuuucuguugcuugcuucuccucuguggcaggauggguuaagauuuccucauuugagaugcacgugucugcccugugaguuacccauucacauuugaacauccuuagcugacugcauggaauggggauuugacuaugaaacuuggugcuugaggauaaagagggcccugucaacaguaagcauuaagaugaaaguuccaggcaggaggagggaggguaaguggagcaggcuaccuucuaacagaggcuguuacagcacuggaagguacagugcuuauuccuacauuagcacagaaguguugguaauacuaaucaauaaacuuagaauugaacccagcauugaggaugcagaacagucucaaagugagcuuaaucuguguuguaugauguccugccugcugguuucaacaggcagcuuacucaggagcaguucccaaggcagguuugguacccccagauguggagggcugggcuucagacuagagcccuauucccuguauaaggucugugccuacaagaauaggacuaccagggcuauuuaauuaagcugugggaagaccuaacaucaacguagauguagccaggacuuguggccuguaguaugaggaaagguuacucaaggauaaggguaugguuagagaaauggccugaaauauuuuuccucuuuuaaccccccugucuucaggacuuccugcugaaucccagcuacuggugcagucccaggggccuaugugguaguucugcaaccuaggcaggcuguaugauaguaaugccacuggcucagcagccucauuuuugugggcugcugguugcagggagggucugaggacaagggcagguguagcccuccuuaucaugccuuucacgagcauaucccacgaagcugucaucugcucugcucacagggugaaggagguguaucggcuagaagagauggagaagauuuuugucaggugaguaacuuauccauaugcuuuagauugguagugggauguauagcugagccaagacucauuuuaucugcaggguggguuauagagcugacccuggcacugccuaccacacacuuacacucccucucacugauauccuggugagucccagcugugagcuagcucagcaccuaucaggaaggaggcagggugacuuuauaucaggcagaaguauggucaaaauuaauacuggaauaguuaagauuguccuugcaaggagaugaugcaagcugcuuggaacccuaaaucuuaacucacagacugagcccagagugggcagugggcauagaugugguuuauaugcccucagugugccuacugcacucagcaaaugagucccacugugagagagcuccauaguagccaucugaagaccaagugguggaacugguuuccgauuucccauuggcaugguugaggggcaguaccucugcaccugcugcuuggccggcgugcagagccugugcucuacccucagcucugccacggcucucccuaguacggcucggagcaguauugguuucuucugccaagccaggguaggauagugggauuccugucacugugacuuacccugagacugacauuagcauaccaacucuguccuugugcacaugcuuccuggacgccuguccauuuggggagaccaggcuagagaugaagcucaucaagggcucugguggcaccccaaagcucagcuacacaggacgcgacgaccggcacuuugugcccacaggugucuacauugucaggaccguaaaugguagguacugagggacugucccugcccccuagccagcaagggggacuugacucaaggcuuccuuguugagguggacagcagucagcuggcaauuucugagguaccugcuggaaacacccccaauuugggccuguucuggccuuuggcugggagcagggagagaugaaauuguagaugccuauaagguauucucagcggguaagcauggccucuccacuguguaccccucccuauaggcuggagacgucacccuuguaaugcugaggaccaggcuaggccuuggggagguuauaaucugccauuuggguguggcuauuggaagcuggagggacuaggcaggggaaggaaggaugggcacgcccauggggacuguccugagugccugcccuugucucccucagagccauggaccaugggauuuagcaagagcaauaacaggaaguucuucuacaauaagaaaacccagaaguccgucuaugcucucccuacagaauccauugcccccuuucaguaaguagcccuccguuggcuuggaacccaucauugccaugcagaaagaagcugccccaaguguggaccugauucauccagauccuggguagagagcugacuggcuaggugguggaggggaaccugccagagaguuuggaggaacauguuguaagaagcuugccccuuaugacucagggucucagguauuccuccuuaagacguguuggucagauugcugcuggacaugagcuucuaucgcagccccaauagggccucaaauuagccaugagcacuuguuucuguagcuggcuaauacugaccuuaguggaacaggugagcuaggaacaccaauagucuagcuggaugcagguuguggcagcaaaaguuaguucuuagaggcaugggaggaucuggggccuacuggguggaaccuuuagaugccagaggggcaucucucaacuugagucauugacagaacccaguauaaaagcaccuaucuggggaccugcuagugguuucuugguccugcaccaccuagauacagcacucugauggguccuuccuccaccccuuuauaguaccugcuacuacagccggcucuucugggaguggggagauggcuuccacaugcgugacucccagaagccccaggauccagacaagcuguccaaggaggacguccuuuccuucauccagagucacaauccucuaggcccuuaggguuuccaccugaugaauguccugucauucuuaaggcagggcccagugucugguuucuucugccucuuggaaaggaacugggacuguucucccuggucguaagggagaugggcuccuccccauucccaaggagcucuuucggggccuuaggacacagcugugaaacucugcugucugagaacuggagucaaccugaaaagcagcugcucaagggcaggucagcgcuuaggacuugucagagucauucccucuggaauuugucgacucaguguucugaguuccauuuacugcccucgagagcaaucaggccauuguuuugccccauuucuacuaggccacccaaauaugaaggcccuccaucacaugcuggccaggagcagcugucauaccaaucaaaguuguuucuuguggucuuuucuucaccccaauccuggaguuuguccuggcaggucgggaaggaguguggacccaguaccuuucaaacaucagcgcuuuggguacuggguauaauugcuccuugaguuuccaccucugguaagcacugggcagcuccaggggaagagcagccuaaaaaccugcccuuugacuuccugucucagcaguaacagaaaguuacucuagcaguccaggccaccugaagcucuuggcagaguucugagcuagcaguggcucuagcugcuccuuccucuccacuaggagguacauagcgaucugcuuugauuugucuauagucagucacuccauuuccugucucuguaagagggaggaauggcaacagcuuuggguuggggagggcaucugugguuguuucuaaugggaaaucucuuucaagagauguucaugcaggcucccuagggccccaugccagugccagacugguuuccauggagauagggcacugaggcaccugugagguuggaauugauuccaccaugggaggucccuuccaccagcccccaaccccaauccuagcagcaagugcugggaugccauauuugcaccuaauucugggucuaucagugugucuuacagaaucuuggaucauuaaacauauuuuuacugcucauguggcucugugcugggcugcuguuguccacagugcuguguaacugaggaaggggaguguuuguggaagccaagcuucuccagcuccugagacugccaucugcuagacagggagcccaaaggcuuaucaaaguacaguuccgguauaaagcagaacuugggggugaaugagcucaccacacaacucacugcauggcauggcagcacuguggcaguccaggaucagucugugugacuaacauagcagaggcuucagaccaauuacugucacuagacgagacaggagaaaggaucuucugcugacucuggcuagccgccuccacaagaggccacauucugcaugagccccaggugagaauuccuucaccugaacaucgcacauguuggugagcugccuccagccgauucuucauguuucacagccuggcuuuacuuggcaggcuccugaauggagcagugagcauucuuucucccuuagggcccucuacugugaguggagcuaggggagaauccuaggggcugcuccugacugaccaccuccuccuucucacccccacccuacucacuggcucuugucaccaugucagucuggucauugccagacuugcuggccaugggcaccugcaggccucccuggcccugccugucucuggaagaggagaugauuccgcauaccccuggaaccuccacuucaagcccaggccaccuuuucccgugcaugcugcauuuucuucagugguaauaaucacaggccagggcaggcuggagcugcggguggcaggcacagagcuugcccucccagcugcacaucucccuuccuccugaauuguacauaagaauuuuggaacaucccuucaucuuugaaauaagagugccucccuugcucacccucaccuugucagcaggaaauaguugccagacagcagagccuggggcucuuuauugccccucuacuaagcagaaggaagcacuaccacguccuucuaguggcuggagauggcugacucacauaguccaguaagcauagagcagggcgaagacagugaagauggccaccgagaggagcguguucuuccgguucucaugucgaagcagcuuuagcucuuucucugggaggaaaaagauggaaacgaaacagaacacuggggcucaccuagcugcuucugcuucucagaauggacauucugaugaaaagaggcgucuccuuccaggcacugucgcaucccaaaacccggcccugucuuucaucugcccagacccucauaauccuaaguuagacuuagacauaagggcaggccugacuugcucaaccacuccucugugaguacaguacgguaugugugaggcucuaccgugcucauccuucaggacagcugggccuccucgggcucacacugcuccugaauucagcugcuccauuggguacagguucuaccuugcaaaggcuaaacugauguccuggccaccaccucuagcugugcacuggacuaagaggagaacuggcagccggcuuugggcugaguagaggugggaugggacacaucugaagagcucucugcagaccacaguucuagccucagggcagagggugcugggcucugccuggcucugcuuccagcaccccagaagguggcagcaucgcuccacccacagaaugccuuuccugccccgaguaaggaccauccucuaccacacccagucuagguuguucugguggggugggacaugagaugcagaaaccagugucuguagaugugggccuuuuuccugaacauggcccagauaccccaaagaauacagaccccuuguuacuguuucacugcuuccuccuuuggacaaaagaaaaaaaaaagaaccauuuucuucccaggugccaggaccaggcuggugacaggagggaacuuucuuaccauacuuggaggcuuuguucaugaggguguguuucuccuucuccagagaccuccuguggggaaggaguuuacagcucaagcccuuuuuuuuuuucugucuaaaccagagaaacaguaauaauucuugucuguuugaauaaggaaguaaaaaacuuagggcacaggaguugaaacucuaaaguuagggaccauucugccuuggcuuagagggucauuaccuguccucaggacugagcucugcccuguaaagcugggaggucacggccuccagguccuuccgacaccgggacagcuuuuccucuagcccgucaaucugaaauagacagaggcacugagcuuuccugacacuggcaccucagagggacucaccuuuagggcccccacccugcccaugcaccccaugucuguacuggacagggcacagguugagggugaagcagaaccccagguuagcugugucuuguaggaacagggcaccaguuguuuccaccagagccugguacccuguagcacucccccugugguguguacucaagggaaaaagcacugcagagccagucccagguccugagcacuccucguggcgugggagggguuaagugucaaggguucuuccuuguagauauccuaacagugcaguuuguguugucacaagagacauuuuucugagaaucaauaaaaauuggcgaaacaaugcaacuuaaaaccacuucuguuucucucugauguggcucuugggcagaaaaguugcuaucaccaaggucagcaaaacucaauggcaaaguagccaagcuccuggaagcuggagagcugccagacguaucuucucccguuuucucggucaguucagagcugugaucucagaaaauacccaagcugugggaaaaugacuauccacaccugugugccaugucaugcgccuggccuucacuuggucuccaagugucuaaaguggucucuggcugggucuaggcuggcuggcuagcaccuugcuuuuuggcagcuggauguguugaaggcuccuuaggucccuguaacacucuuuuuccaucuccgacuucacccacacccccaggagagacagcaaauggaaggauaggguucccuagaugaaaucuuuuuucugaggagucacaggcccuucugucggucucagccccgcuccuuauuggagcuaccccuggaagacucuaaccuucuaagcaggcugcucagagucugaauguccgaggccacuagucuggggcugugaaucaggaaaguuaagugucugggccccugccuucuucccuggccagcagccaucucagacaacccugggucagcuccuuuccugcaauggggucaggagggcucucugcguggaacaaacugcagagcguccagguuaccucaugguuaacuuuaccaucucucugcugaugaauaccagccucagccagugguccccagagaagccacagccgccuuugaacugcacuguagggagguaaacgcaggagagccaggcuuagggaaacagucuaauauagauacuucuagccgccaugaauaccuggccccaagaaugcuugaggccucaguuucuuaggccaccugccaccucugugcccaaaaggccaggucugcagucuuccuauuuguggcuagagugaguggcaccucaguguggauggacugaagggcugggggacagggacaaacugauaggaauuuaaacuacugacuucugaaaaccuugggcucacuaaaacaagaaaacagcugugcuugcacacagcuaaugcagcuugcuccagauguccaguucagguucaguucuccugcugcucuuugggcagggccugggagggaucagguuaaggauuuccaucccugaacgccucuggaacgugcccaggugcccaaacaagugguaauugccccggaacaaggccaggugcucuugcugagcagucuuacagcugaggcuaugcccaggcuucucugccaucaugcucuggacagggccugaggggcuggcagucaggggccuuuaucugaacaagcccaauuuauuugcaguuacacugaauaucccccacuuucauuugccacuuuuuaaugaggcuuaaaugggcgaacacaaaucaagguuuuagggacucaguucugaccucccucuaugaauauuuauguccugcugacaguucugauucccuucuaaauaguaaguucucuuuauaauggccuguaggcugcgggggagggggaugcaggaggcugggugcugagccugaaggaggcuuuucagcaagcaguagauucauccuuagaaggggucuagacaccagcuacagaaggcaaaguuagaaacuguaguaauggggcagagggucugggaagcaggcuguggaggcaggaaggcagggaugguccugaugcugguuuuagaugugacugggagccacauagguggcugcagaacggacuuaacccaaaagacaggucaaaaaggcaagaaaagaccagaaaauggaccuuacacaaaguccccaguuggagugccggcucucaggcacauggguuauggcugcugauaguucuccuugggucacucccugcccucaagcaaaggaagccaggcccaacagcuaugagcuuuaggaucagaauaaggagacaggucucgggaagauucuagaagaguagggucagggcugggccagcaguuggacugaaagcuggaagcuuaaaaaugggauaucaugggaagugccaguacagggcuccagcuguaacuggucacuugucacuugugaaugaaugacaggcuccuuaagauugcuugugccucaggugacaaacaucucagaguugugaggguaagguugagcuuagaagagcacgucacacaggugaaguuuaguaccagcugcuguuaaaagaaugguacucacuggcucuguggugagaggaagaccaugagggcagugggguugaggguggcaugagaagcccugcugcuaugggcaggcagcagcgggagggagcuuuguuggcaggagauggcugguccuuugucuacggaggggcaguagggacagcagggccuccacccugagucagcccaucagcuggcccagaacauggcacauuggcaaccccuguaaucuuguggggaugaugcugggauagguucaaguggcaaaggccagaugugggggaaccccuaagggugaggccaacagagccccaggcagagccccaggcagagccccgaggcccagggaagcaguaguccucugaggaaaugcagcaacauagcggcccuggcagcuaguaaggcugcaguaggauggggauguggcagaaagugguucaaacagagauuggagcuauuccaguggaccaggaaggccaucgaaccacccagagcaccugccuggcagaaagagcggccgcuggcuacucagacuaaccuggaacuaaagggggcaguguggcccugguaaauggguguccccugguagacuacgaaacauccauguucacacccaggaacaaggugguaucagagagaagaggaaccaguggcuaaguaggcuggcagucuuguagaaggagcagagauacugagacacaaggguggagcuggaguuucugagcuagcaaacuucuggcacugaacuuccgccccccccacguggagcaguuuggucuuauagagacuagccuggacccagcggugacccagcagugacuagguaguagcuaagccugucuggaggcagggaagcagcagcagauaagguggagaggggagggcacaacucucaagauggguggaaugguuacucuugugaggccugcacuuagucuggguaagaacagaggccguuggauaucugcagcugggcaggacucaagccagccgcgaagcuuagugugcuggagggcagaaccgcuggaauggaugucagcgccuccucaagggcuucccucuccagcccacagcucugagccugucugcuccaggugagggcuguagagcccagccccaggccagacuaagagcccuucccugacucaggaauauagccuuacucccagagcuuuagacaagucucccugggguccuaugcacuguaaaaccacuguguuaagagaaacuguaaaauuugucugaaauccccaggaggcaucuuuucagaggauggagccuccaggaaucaaagccccaaauaggcuccucagaggcgggaacucguggcacuugcacagacagcugccccugcacaggucaggucaggccccacagggugccagcucuagggcugcuggcaggagcaugggcagcuuuuauuccuuugauaagcaggagucagcaggagccacaggcucuucaguaggagagugaaaaacugaauauaacacucaacagagcaccuggacgucagaaaggcaaugccuggcccgcagcgcugccacugcagcuaccugaaggccaggcucuacugggaaagugcagaaguuccccugccgcuugguucaaggccacaccacccacccccuccguuuucuagguugagaagagguuucugccucucaagggccuuggcuccugggagcuucuggccagccagugacaggagggugggaaaggacuugccugggggcaugcuccacccgacuggccaggagcuggcuggguacugaggacuuagauggugucaugagucuggaugaggacauaaggagcagcacugggaaccaagagucuaaaagguggauacaacaccuggaacacaucugcagcacugccaggugccaggcucuguucuagacacuccacacaggggaggauggcagacaaccagcguccacgucuuacagacaggcagacuuaaguaaggaagcagcuuauccagguguguccucuaaccucaucaccccacagcggaaagcugugacuuuuuagccuagaagguaauuccacccccaugcccuaggaugggcagcuguccacauuuagucugacuuugcauccaccuugcaaaggggcugucacuacugugcagagagccaacucccagcagagaugaucagcagcuuacauggcugaagguggugggauuaggucccgguccgugcacguaccuccagucuucuccagcaccaccauggcaaacaaccacaaccaacaaggacuagugacauucagaaaaagagucaagcauggcccccgaaccuguagaagccuguuggucuggcuucaacagaugcuuuccucggggugaccuugugccuggcugugcuuggucucuuuucacacaacagaugcgcugccuggaaggaccugccugcaguccaugugcugggagaucgaggcgccaggagccuggcgucugucugcauacuaagcugacugucccuucacaaacacccucccccacauugccacgcugucaaaaguaaccucccaaaugcacgcaaaacaugucggaguuuggauaaggaagugugugggcuagcuaguaaacccucuccaucccccaaagggcaucaaagcuuccuccucuucuaauucacugccugggaagcugguccaagaaauccacucauuuucacacaucaggagccccgggauguuuacuguaauggguaaaggcgauagaccgccuacccagauggucccuggcaauaccacuggggcuuuccgucuguggccuccaagucacacagccaugucacaggggacaguguaccuuaucuuccagguagccagcuucacaccuaaauggcugauccccaugacauugguuaagcgauauuuuuccguggaggaggcuuuccgaacugucgguaagaaagcaaaccaccagagccccccaaaucaacaggccugguguaaacuuucucuuccaggcagagcaggucaagaaagugggccucccaauaucucguagguggcuagugacagcaaccccacccaccccgcucgugaguaugagggcugcagugguccaguagagcugccaaggucagcacagggaggagcuauacagcuuuggaagucgcucugcaggccagaccuugcccuaagccuucagcugcucuaggccaaaauggaaucugggguuugguuucuuuucuuucuccccagaucuauuuuuugauaaacuggcaaaagcugcuccaucgcugaaaggcucaaagcauuuuucaagagcuggcauccgccccgugccuuaugaauucauuaauuaggacgcuggcaaacagccacuccacacaugcugacauccagcaguguuagguaaugagguuuuagucuccugaccuccguuaaguggagcggugccagaugcaggcugccgagagaaucaccugcccgauggcgaccugucgccuccaccugagcaggugaggaucauuuaguggucaacaggcccugaacggcccaugugccagacucucccagcaaggcagcaguuagugugagaccccaacuccacacccagccggaaucgacacugccuucugccaccuaggccaacuggguaaguacuuccuuccagccaggacacugccucucacccugucccaggagauugggggcuuucccacagcuaguacacagcucacccuaggacuccgagacuaaccguggucaguuaaugcaggcuaaaccauuucuuucccaaagccuccaccugcccuguccucagucugucugcugagaaccaggggacacuaacugcuucccaugugcuuuuaucccucacugaagacacuguuagcugccaguccagggccaacacccagcccuucugcucagcucaccugcacugcagacguugggauaaaaagucuguugacagccagggucacacacagcucugcuccaggcaaugagauguuccagaugucaucugggagacuccuaggaguuuaugcuuggcuaguuaagagccuugauuuauggguaaaugugacggcugagcuauauggcagcugucuugugacuauggacacaguuaaggguaugcagaaacacuagcccugcuauuaaguacuagcuacugaacuucugaaccagggcaggagccuagccaccauucccaugugcguuaagacacacacuccagucuucugaaacccgacagacaaaacucuccaaacggacaagaauuguguacuaggaccaaaucuagcccaguuaucuccuucaggaugucggcuggggacuuagcucggcagcagagcaccuuccaagcaugcagaaggcacuggguucaaacacgagugccgcaagguggaggcagccgagacucauacuuaguaucuuaaggccaaguggcugaaggcugcaggccagcuucugucacagcucaaaaugcaagcaaguuuccuaccaggccgaacuuucccuguccaauuugggguggugacuucagaaucuaacacauagucaguuguuccugacugagucucacaggaagcagaguugaagaguuaaaagggggucuggcuacccuagcgguaaccaccuggcacagcuggcccguggccacccucgagugagggccaccugcuugguaauuguuucauuacaacaaguaagcgagggcuguuugcaggugcugagaucucacuugugggcuuuuauugcacucgucagauuaacaaacauuuuugauuaaaucaccacuucacuagcucugagcgcaagacuuuuaauaagaggacaauaucuacugcuacagagcaucagugcacauucaauacucaagacccgcugggggcaacagaagaggaagcggagaaacagccagaugccaggucucugcgaaggcccaggauuacagguuucaaaaccuugacuaucccagcaaaaagucauccuagugacaaaaccgaagauauauguuuuuauacaucuguauauuuaccaauauuuaaaacauccaugcaaacaucuguaagagcguaguguuacugaggggguaaaaugugcuggggauauagcucagugcuagagggcuugccuacugugcgggucucuuguuaaaucacagcagguucuucagucacagcugaccagagcuacauacauguucucaauacaaaccagccuacggucaguccugagcgagucuucuauuugcccugaaacguuacaagccaggucuccaaggucugugcugcucuggguucuuuuccaggcucccacaaacagcucauuaagcuuugaucacuaaugguauuuccagccccacguucuaaaugccuccacaauccucccuaaacaacauggucaggucugucacugcaguaaccaugaucuugguaccaggaucagcucugguuugcucuucuguugcugugauaaacaauaugaccaaaagcaacuuggggaagaaaggauucauuucaacuuaaauauuuauuuauuuauauuauuuauaugaguaaaucauagcugucuucagacccaccagaagagggcaucagaucccauuacagaugguugugagccaccaugugguugcugggaauugaacucaggaccucuggaagagcagucagugcucuuaaccgcugagccaucucuccaguucucacuucaacucaagguuuauaguucaucaugaagggaacucgaggcaggagcugauacggagaccauggagggugcugcuuacuggcuugcaaccauggcaacccaguacuuauauauaucagccugcuuccuuuuuuauuuauuuauuuauuuuuuuuuuuauuuucugagacagaguuucucuguguagcccuggcuguccuggaacucacuuuguagaccaggcuggccucgaacucagaaauccaccugccucugccucccaagugcugggauuaaaggugugcgccaccaugcccggcuagccugcuugcuugcuuauacaacccgggaccaccugcucucaccucaaaucauuccucaagaaaaugccccacagauuugcccacaggccaaugugauggaggcaauuucuugaagguccuuuuuagaugacccuaguuugugucaaccagacaaaaaacuagccagcacccuaccauucauaaggcugcaaaauggguagaucugcucccauacaaagcacuaagagaauacacguugugucaaacucaaacacuucaaaaguugaugguguagcucaaugguagaucaccugccuagcaggcaggaagcccugggcucuagcccuagcguagguagagguagauagauagguagauagauagaagauugauuugugucagccugacaaaagacaggaguuucuccuccauauuacagauguggaaaugaaagcaggaagaaggggauagauuuaaaugguuggggugaugaaggagucccugucuguccuccgccaccuuaugccaggcaugcuccgggcaccugacagccacauggugaggagaggugugcucugcagggagaucugcucccaacuccccuggugaugagacugcagcugggcauguggccucuuagcugacgagcccagcccagucuccgcugcccugcagguaguggggggugcaccuugguucguaggaauagaaagugggcaguucugggcccagaguccuuaacgcagcaggcacuuucucuauucucuucuugacgaagagcauaccaguggggugguccuaaucuugcugauaagauggcagaacccugguaagcggaaaggcuguggacagaauauaugccaccuccucuucuuacgaagaaguggguuuugguuuucucacuauugucuacgcugaccuuaaacucacgagcuuccuaccucagccgccuaagcacacaauuagcuuuaaaugaggucucaccggagcugcuacagucacacugcccacggccaccuucauauuaagacagacugauuaugugauugcuauacuuuuuguuuguguauuugagccaggaucacauguagcaaggguugagcuaugaagguuuugugaucuuccccugauucccaagugcuggguuacaggcauuaugucaccagaacuagccauacgaguucuuacgaauguuuugcuuauauguuugugcaccacauacauaucugguguccggagaggcaagaacagcccgugcucuuaacuacugaaccuucucuccaaccccaguacuuauauucuuuaaaacugagauaacauucauuaacaaauacugaagugggcugggcuuccauaaugcucuggucaacguuaucaucaacucauacaauguucucugguguguacuucuguuaaagagaucuuauuuaauaaacguacaguucucauuagcguugaacucacugcccaaaggaccacauaauacugaguuguuccacaccugaaaaaugguuuauguaacaaaccgauugucgcucuaagccccaucacaguccuggagcacuagacagcacgucagcgcggugcuuacggaucccucaaaguagcaaaccaccacuaaagagaacaaaaaugcagccaggcaugguggcacacgccuuuaaucccagcacuugggaggcagaggcaggcgaauuucugaguucgaggccagccuggucuacagagugaguuccaggacagccaggacuacacagagaaauccugucugaaaaaaacaaacaaacaaacaaacaaaaaagggaucacugaggagauaaguaaccucugggaggaugccucgagggcguccaauauuuugacauugaagccugaugcugucaucuacaagcaugcuguaucacauuccuagauguacuggaacaccaguggcccaagggcccaggcugaacaugccuucguuguaagggagaggaaacgaguccccacuuccaggaagcccaccugagcauuauucccugcucuaucaccuucaccacuuuaagcuggcuuccgccuuuucguuuccuugcaguguugcucuguaucccaggcuggcuuagaucucugagcccugggacuauaaccaugugccaccuauguccugaguuccacguagacccucaguucccucgucuauacgagcauaacagacaugcaacaauucauugaacaugcaaacgaaacaugcaucagacggcuuuuuuuccaugcaugacaaacuauuuuaaaggccuucccaaacaccaauucuaggaaucucugcagauuuccaaagauccucaagcuacaaggcugauaccccacaggaaaaacuuccccucucuggagacguuuaagccacuagcaguauacugaauaauagccucgcacucacccuggagucuuauuagcuccaugguggucccucaccuacaagucccgaacaccuuugguucccaccugucucuuucugcuaaagucucccuuagucuccgagucucuccuuuuagaauacccacuauggccugucuucuuugggacuccccugaccagggauggagcugaugguucucagcuccaucccugccuuccucaucgugacccuucaccucccuucacagccucucccaaagccacgucgcccucgcuuccuccaucugacccucgacgucgcagccgccgggccgaucgacgccccugcgucggaacacagugacuaaccacgugacucgaacccgacuucucccccucaccuccugagcgacaccaagauucucccgcuucuuuuuagucauauugcuugcugucuuuuccgcgcuggaccagcccauuaagucg

SEQ ID NO: 8503 - RNA, 739 nt, Mus musculus
ugccucuccaguauucaguguccacacuuccugggauaaaucccaccucuggguuuuccuuuuuggggagaggggcagggcaggaauuugaagcugucacuuccuugugaagugugaauacaguuuagccauaggcaguugugauguccaguguuugggaucuaugggcaaguaguuuucccaaagcaggcauucaguucuggagcaggcuugacucaggccaaacccugagccacugugaauuugcugguggucuuccgacuuacuggagugauuuuuagguuuuccaaaucuuauaugacucuuuuuuuaucucuagcugauagaccgcauguaguuagguguacauacagcagacucugggcaguuuuauuccugagacuggccuuccugggcagcucuuugaugucagcaccucagaccuggcaaggccuggcccuuuccugagagcuccagcucugcauuccagucacuccagcauugcagggacucucuuaagauggaggacaggccaccugaggaaguccaguguguuccaccaggaaauacaguguacagacuggcaaggccucuccccuccuaggugugucucacuauaggagaucgcugugauccggguaguugaguauauguuaauuuaaaaugcacauauuuugcauuugauuucuacggaguugaaauguugagagauuuaaaaaaaaaauaaagugucuuccauuguuaaaaaaaaaaaaaaaag

SEQ ID NO: 8504 - RNA, 21415 nt, Mus musculus
cuuggccugucacucagccgacugcaaaggcgucccccgggccuuguggagcgugugguccgcuggccuguuugcuacuagggcagguuggugauucuccagggcagccauggcagagccacagccggcguccaguggccucacugaugagaccgcuuucagcugcugcuccgauccagacccuagcaccaaggugggugacagggccuccuuuucggcggcuggagcgaccuggggcucuggcccugccugacggaauccuaacccggucuggccgcugcuugcaugucggccggcugacggcgcaguggagugagcuggaaagagggcgaugggggcaggggcggggggacagugcagagggauccccaucuucagaaaguuauuucaaaacuuguaaacgccccccagagugcguuaacuuguuuauuuugggcacggugucuugaagccagggcgauucagggucagauuccgugucugugggugcaguuauccuggcuuaggcgccaugucccuuuagacgggcaggcacuuucagaacuuguauagcucaaggggccccucuguaacuggucccucucagccguacucuuuuucguagucgccuugccgccaggguucacuccuccaaacuacugcgguugcucgaauuuaacugccuuugcuugcuuggcuuugccauugcucaaguccacacuucuguccaccaagagucucuggagagauuacagauaauaaauaggaccucgacuuggagggaaucuuagacacuuuucuucggacccuuucguuuuguaguuacaaccaguaaggagcuuaaccgauggcauugaaaaacuuucccuuaaacacggcuguacuuacaguaaaguaggcaagacucauucagguguggucccugccucugcauggccaaaaguuagacgugguggcugacggaggaauuuauuccuguauagucauccgugccaguaaacaccuauauucaauuaggugcugcaucauugugaauuccuggauugaaugugggcuuuaugcagaccucuaggaggggcagauagauggugaagacuuuggucccugcuuguucuuugccuuaagggcaaacaagagucagacauacuguaauugccaaagcuuuugacuagcaccagguguguacuuagggacacucuuagucacuacaaaauuaaggcaggaaggaaaggccgaauacaggcacacucacacacacuucuccccauuccuucuauuuacccauacauaaccuuaguaugcauuuaauuuuuuaacauugugugugugugugugcaugcguguguacgucagugaacaacuuucucuccauauuuguggguauugggaaauucaggucuuugccuuggcagcugaaccauaucguugaucuccuagauauuuuauacacuauaaauugguucauuccaugugaauugguuuccuacauuacugaaaauuuguucauccauccuucccucccccccacucucucucucucucucucucucucucucucucacacacacacacacacacacacacacacacacacacacauuuucuuguuuagacagggucucacuauguagcuuugccuguacuggaacuugcuguauagaccaggcuggccucaaacuuacagagauccaucugccuguuucccaagugcugagauuaaaagauuaaaacucuugcugggcuaugugcuauuuucuacaaagcacacccggauucuggguauuguucugugucaguugacucccuagguaacuggggauuuuagguagcaggcuguucaaacuguaagacucuagggccugggaauguggugugguagggagcaugcuugacuuugaauucagugcuuagcagcagcaacaacaaccaacaaacccaauaaaacaaacaaacaaacaaacaaacaaacaaaaacugaaugaaugaaugaaugaaugaacuagaaaucucagggagauccuuuuuuuuauaaagaugagaguacacuguugcugucuugcugucuucagacacaccagaagagggcaucagaucucauuacaguaguugugagccaccaugugguugcugggacuugaacucaggaccacuggaagagcagccagccaguguucuuaaccauugaaccaucucuccagccucagggagaucuuuaaaaauauacgaagugcacuuuuauuggauuuugauuuauauuucacagucuccuaauuucucuugauuuggaauucuccuuuugagauuagucauuuuuggcaaaugggcacaccauuuggagauguacagcuaauuauauaauauaugguguguguugagugugcuaagcccuggacggauguuuuaaguucaucuguagcaacucuaugaggaaaggagaauugucuccauuuuacaaauaaggagacuuagacccagguacuugaguaacuugcccagagaagagcccacaugcccagccucuuccuucuccccuucugagauaacucaagcguaauuguacaacuuguagaggggcagggaaaaagccugcaaccaaugaaaucuuagcuugauuauaugcuaaccgcaaagagcaugaaaggcacuuuggggcggggcgagggggggguugacuucauccuaugccaaacauauaccagcuccgauggaaucggaauuaaaggcauuacaaagcauucugguguacugguugcuuuugugccugcugaaaagcaaggaaagcgucauuuuggcucacaguuugagggugcauuccgugguggugggagggcucggugcaagggaggcucaggagcuugagguagcaggucacgugucugcagucacguauccgugacuggcacauagcuggcugguuuccuacuuuuacucagucugaaagccuagcccguggaugacgccacccacauucagggugggucuucccuccuuaaccuacucuaaaacuuuaggugauucuaaaucuaguuccaaguugucagcaaagaugaucucucccgguaggagcacagagaagaugggggguuuucaaaguucacaucgguguuauguuguaggcuuuggaaucuggaguccugccuuuggauccccaucugugggagugucugugaucacucccaucuuggcagggcuccuggggcucauaaaaggaacauaaagaugacucagcuguugugaggguacagugagacaaaaugcauuucgcuggucuauggagauagcacucacggugguauuuuagcuguuagggucgaggaaugcauuaggaaugcauugagcagaagguggugguagaaccauguuuucguuggaugggauuuccacacccagagaguuacgcaggagagaguucaggggaaggggaggaaauaucuuagcaaaauguaguagugggguggcagaaggucauaguaugguggaguucacaugaagcagggguagagaaagcuagccuggcagauuggggaccagucauuggggacauuaucuuuaucauugcucccuuagaccgguuacuccaaucauuuccuaugucaaaugcucaucaccgaggaaaaagaguugccuuggucguggugucuauucacagcaguaaaagucuaacuaggacagggugggagcauaaaacaaccuuugggguacucaaaauuugacaacucuuguaauaauuauuuuuuucucauccuauaaagauuggagugugugugugugugugugugugugugugugugugugugcgcugaacccagaacuuuggacuugcuaagcacauaugugcucugagaccgagacacaccccuaggcuagaguuguaguagaauaucauacauguauguaauggcaauaaagauacauuuguugggagaacauaccucuuuuuccuaagugaugagcauuugacauaggaaaugauuggaguaacuggucuaaggaagcaaugauaaagacaauguugaauagguaggugcacagcgaacacaugugcaggggguugguuugguuuuauuaaccuaggauuuugauuugagaacgaccacuccagauuguauuugaauaagccugcaagaagcagagagcaguccagguggaagcgaggaggccuugagcccugcaguaguuauuagaaagguuugaaggagaauucccaggaaggguaagcagccaaggacuugguagcaugcauggcugggcuuggauuagaaccucuucaguucacuuugguuugauaugauuugagucgggggagucuguugagggccaaagcaggagccugucucacuugggcuaacagugauuggccgaggcaugcucccuggggauuaaagcuugcuugggcuggagugcuucugauauucugacugugaagccuaggcuggggaugggaguccagggcugcgcuuacugggcuggacaauucagauuugggaagcaaaaguaauaguggaaugccugccaccucuggguguguuuuauaacgguagcagcaagacaaaggaagcaguuugcucuggaccagacauuccucuaaauucuuuuauacauuacugagugaauacuuccgcucagccguauacuaauugccuucauccugugagauggaaacaaccggaaagagaaguuuuaggaaaguaauggcucccucaauuccaaggcuauagagccgugucauugccaugcuugaaguaaaaagauagcaauuccucuuccauauuucacccguuuauaugcgaagagaaaugcccugugacacccacgagaggacacaugauguuggguacagcuggggagaucugaguacaacucccuuguuaaaaaacaaaacaaaacaaaaaaacaggcuugguggugugcauuuaugagcugagaauuaaggaggcagagguggcugguucccuggaguucucuggccagccaggccugcucuggaagccucaggccagaagagggacugugccucccaaaacaaaguagacagcuucuaacagcguccgagguuguccucugauacagagguauguauggacacacacguaugugugcaccuguguauaccagcacaugcuacacacacacaaagaaguguaugaccucagagccacaccccggucggucucuuugguuuaaacaggguauuggcagagcuuuguucuucauuggcucuggagaagcaucuguguugccugaucgcauuucccuucuguggcagggcccacauuugaguuucccugcuggcuguugguagcuaaaauggcggcauugaucugucucucagccagcccccacagccugcucugacauugcaaccucucuccucaccgucucugccaugucuggucuucuucugucuucugauguugucuugugugauugaacuaccucacaaaccaaggcugaucuaaugcaaccccuccuuucuucccccaagauugauuuuuaaauauguugugaggguguugggggagggggggggcuacgugcacgugagcguaggcgccuauggauccccuagagcugggguuauaguugugagcuagcuacccaguguuaggugcuggaacuaagaguuuauguucuucaacccugaucucugucuuuaaggccaucuggccaguuaauuucagcuucagagcagcugauaguagaaccuaaguuaauguuugauaaaauaaucugcaccauguuuagaacugacucuauguccaauaccuacacacacacacacacacacacacacacacacacacacacacacaccccuguguacugcguuggcuaauaaccaagcccagugugggaagcuggcuuucucugaugaggcuuacaggaaagccuuugaaauuaucggaagagcacgcaucagcccuguuguggacuugaccuccccacgcaagcgcaguaauugauacggaagcagcaggcacuagcuuuggccgggagagggagaugcuugcuauuuucguaguuuuaguaucuuguuuuaaucucugcuucgaccagcaucuggcaugaaaguggucucgcugcuucguaaaaaggucugagacuuuugccucauuuaccgugguccuagagugacuuuguaagguguuuuuaauaccuguguucagaggagagaaccgggcggucagugccucagggagccagccgcuuaucucuuucuuaccugauugucaaaggggagaguaucagcucuggauuugaaagggcaacguggguccagaaacauggaacccugagccagcugccuucugcccgggugccauacggcuuaaugagagaaccagaccacaagagccgcacugaggcccugaggcaaagcuuuguucaggguaugaauuuccuggcugccccuaggagaagggaacacagcauccccccaaaagaaguuauagggugcuuuuaguugggcggaagagcaucuaauaggcuaaaggaacugcagugagcaguguucuuuucagggggagguguggccacuagaccacuagguuagcaggaggcuguggacaagcuguucugcugugacaaggaggccagcagacuccugggaaaucuagaaaggucaguuuccauuuuccuuaaggggcugggacccacgcuggucauccaucuugaugucuuuuuuuuuuuuuuuuaaagauuuaucuauuacuauacauaaguacacuguagcuaucuucagacacaugagaagagggcaucagaucucauuaugggugguugugagccaccuugugguugcugggauuugaacucaugaccuucagaagagcagucagugcucuuacccgcugagccaucuuaccagccccaucuuggugucuuaagugacucccauguugggccaaagaucuagccagugcagcaguugccaccucugaacaaugaauucaaaugcucuuuagaucccuucuucaugacaugacaggguuucucuguguagcccuggcuguucuggaacucauucuguagaccaggcuggauuugaacucagagauccuccugccuguaccucccaacugcuaggauuuaaggcaugaaccaucacugccuggcauguguuugucuguauuuuauaugaugugaguuagaggaggaggaggcuguguggccgccguauuacguucucacagcugugauaaauuaccccgacuaaagcuacuuguggggcgggggggggggguguuggcggcuuauuugggcucucaguucaaguuauccuccguucauagacaggaaucacagggugaggaguguuuguguuuagcuagcuugcuucuuucugugcagucuaggaccuaauaccuguggaauggugccgccuacuuuuaucguggauguccgcuuugauuaaccuaaucaagauucagcucuggguuugguccuggggggagcaggauggggguggggacaugggacacagggauggggucucaauuaugccuuuaauccaggcacucaggaggcaaaggcaaguagaucucugugaguccaaggcgagccuggucuacagagugaguuccaggacagagagagaaacccugucuuggaaaacagcaacaaaacaaaaaaaagauaaaaaggaagaaagaaagucccuaaaucccucagagugcccagaggcugggccucaugcugccucuggacccuguaaaaucggcaguguuaacccugaauucugugaagugggaguggaggcgagagggguggagugaaagggagcugaggggucaccaugguugcucacaccuuuaaucccaguacuugggaaguaucgagguuaaucucuggguuuaaggcuagcucagauuugcuuagugaguuccaggcuaguuaggcuguaugaagacccugucaggggaacagaaaauuacagagguuggauucuuuguuaugccauauaaaguuguaguuuacuugagaagggcuauacacuuguugguaguucauuuagaagagagucaccagaagcccugugggguggggccucagauagaugaugugggagucacuucagaauugucacugaagcaggugcugguggcucaugcccuuaacuucagcacuugugugaaagcugggcggucagggaguucaaggaccaguugguaaugcagcaaguuugagccaagcaugggccauaucagaugcugccuugggagccccgaaccaaaccaaaccaaccgcgaaggccccgcuaagccuuagugacuaaggagcagaaaggccagguuucucaaaugcuauuaguuaagggcauuucuggagcguaacucacuggcucucagcugccccuccaccccagaagccagccagcacugggugagaccuugggagugugagccauuggugugggaaccguuuccuggaaguaccauugaggcuggagaugggcuuuccucugcuuguuuucuguuuguaucgcugcgcugggcuguucuguuacagaaggcuuagugacgcagcuaggaaguguugaaaguuaaagacacucaccaugcgcugcuguuucuccguaggauuuucuacugcagcaaacgaugcuaagaauuaaggauccuaagaagucccuggauuuuuauacgaggguucuuggacugacguaaguaacaaguguuucuuggcgccuuacaauugaaaagcacgguguuagggaagauggcucaggggaggaaggagagacccgacuaccucagcguuguccccuaaguuccauagcagcgcuguggcaauacucccuuccucucaaaaaugauguuaggccagacccuuuacugcucugcuucugaaaucauggcugucuggacauggcauuuagagagugcauggaucuauuuaauuaaaaucggccccugagauuaaaagcaugcgccaccacugccuggcuuucuuuuuuuuuuuuuucccccauucaaagugauuuuauugcuugugcacacaacagcauuuaugccacuagagcagaggcuguggacgacucacucauauuuccaacugggugggagcacccgcuuagucuuacaguaucgagccaaucggagaauucugcucucugucagaaucagguggacuuuagcauccuuauccuuucuguuccucucaaggugcuugcagacagcaaccgcuuucuuaaucaaaugggagagauccccagggaggucaggggcaaggccuuuggacuuaaggauucucaagauuuuauuuccagucacaaaacagaccugugccacaccaugugagucccucaggaucacccuuaauuugggagggagucgggccuuucuuggccaauuuguaaaucuguuccuuuauguccucagaugucaacuucagccgacgcuaaggugguagggcagcgccaacugggauaggcccuucccaggaggguccaugcgacccaugauggaggaggucuggcaacaaagagcacuugggaggcagagacaggcggauuucugaguuccaggacagccagggcuacacagagauaccgucucgaaaaagaaaaagaaaaaagaaaaaaauuuaaaaaaaaaaucagccccugguucugucuucacaggcugcauugucucuugcuaaggaguagcggugggguuugcgacccucugagcacgugacccucugagcaugugaugugcugcguuuuccuuccaccagcuuuaacuaaggcacacuugauaaguuagcuuuucuugguucguuuccucagauagcgugaggcuuuugguaauacgcgcacauaaaaguaaugaagugaccuuuaauucuccaccuuucauuuacuuccacgaacuuuaagagagcagcccaaguguuauguacgcucagaaaauguggccaguucugaaaaacacaaagcggaggaugcagaauggcuuccuucuccccagacggcuuaguucuugcucuccuccccgaaaagguggcuuuccaugcguguacagcagaguggccggacagugguggcacacgcuuuaaucccagcacucaggaggcagaggcaggaggauuucugaguuugaggccagccuggucuacaaaguuccaggacagccagggcuacccagagagaccuugucucaaaaauaaacaaauaaagaaacuaaguuucuggucuccggaucccacagucaccccacagucggcccuuggcagagcugaguccgucugcgcuugacugaaccguccguugaccuuguguuugcagagauccccgcuagagugcagcuugacccuaaccuggguucgcuacucuaccggaagcggaagcgagcugcucccuuuccuuccguucccaucugauugcucguuaaggcuggugguacagucauguuaguaaggaagagaguuucccccgaugguucuguuuaagguauuaggucuuuuauggaguaaauuuauuuguggcuaauugaugcauaaaucaaguaguccagacauauugauaacaggaguaaguaaauaagagguuggacuggacucuggaaacucugccuuaggugcagggggauggcucaguugauaaagugcuugccccugcaucccuguugcuggagggacaaagacuuuugcuuguacucaguaggcagaggcggaaggaccucugugaguugagcccagcuuggccuacuggucagucaauuccaggccagcuaggguuacacacugacacugucucugaggucagaggugagugaaagacuggguagccacuaaggguacccuguugccagccucuuaccucugcaugcauacucccuugccugcacacacaacucuacgugcuuggucuugaguaugaacagagucaucuuugagcauaauuaauccucaauguccuaaaaaaagauguuauauauauuguucuacuugcgugugaucuuacaaucucuaagcugacugauaagcuaaccucacuaauuguuuggaaaaccucgggauuuuucuucacuucccgccuggcuucucuuguccaggagauucucucuuguccucugaccccuugcuugugcagagucacuuucucugcaucagauaugcacagaccgugccgcugaaggugguuuugcuugcuccccuccucccuccucccuccccugcuucaccugcucggccauguugaagccgcccccagaggaccuuuccgugucccgugaccuuuuccgcgaggucuuaauccuguuucaccuuucugugguguucucggcuuuaacugccuguuguugacauucacguuuuuugugagacccaccuggccuucucuccugucaccuacccuguuugcuuuccauggguuuaguugaaagaaugacagggagaggcgcugcaguauucaccgagacaaagccuuacaauaccuucccuguuuauaaacaagcacugagauucagcuaaauuucacuaaacuugaauaaugagagcugauugugcagggucaccccuggagucccagcacuuggaagccaaggccugggacaaguugggaguuccaagugcuaucuagggaguuuaggcucuccuuggcuacacaguaggauuacgugucacaaaacauuuaaaaacaaugagugacacagaccccuguccugcacagcuugguacuggaacccugaccaggugcagugagggagugaguuaagagcagacucuagagaaccagauaccugggcacaggaaagcuggggucggucagcuggucugugagcagcgauggagugcuagcagccacagcagcaaccuggagcuuugguguguuuguuaugucgguucaggguggacuagccuccggaggagguguuuggaggcuagcaguuccagguggggaggaagcugcaguugcuagcucuugcacauaugcgccuauaguuuguaaacacuccuauguguagacacuguuagcuuaucacuguggggugugucaggggcucgcucuucccguggcucugagcguugguccuuccaugacagacacggccaugucagcaguauacguucccucaagacuucaugcacuuggcugucaaggcuuccuuggcucucuacuuagaaccuuuuauuuuauuuuagucaagugugugcacgcuugggaacuaagcacuucgguuuuugagacagggucccucacugguuuccuucuaaguuugauggccagcaaaccccagggcugugucugucucagccccuccccaaggcugcucuugugagcgcacgccaucauguguggcuaggucaugggugcuagggcucagacucaggccuucacguuugcaugguaagcacuuagagauggagccagccauaaaggagaucuuuuccccugguuuuugcccaggcuaucaccuguagcccucguuccuaguggagcuuacauguuacuccgagcucagccugggucagccuguguuguugucaaugacccuggcuuuucuucugauuccagccuccugcagaagcuugacuucccugcuaugaaguucucgcucuacuucuuagcuuaugaggauaagaacgauauccccaaggacaaguccgagaagacagcauggacguuuuccagaaaagccacccuugagcucacgcagugcguacacgcuuuuugucucuuuauggagccuagcuuuguaaagguauuuuaaauaaauguuuuugugcucaccugucuaaaucaguuauaaucaauuaauuuguuuauuuagguuuugggagacaggguuucucuguguagcccuggcuguccuggauggaacucacucuguagaccaggcuggccucaaacucaaagagaucugccugccucugccucccgagugcugggguuaaaggccugugcuaccacugccugguaauuuucaauauuuuuaaguguggacauuugagucuuuguguuacucuuaugguauccauaagacaaagagaacauuuuucuuuuagagaauaagacuccauguggcaaaauauuugccagauuauagcuuauuaauuuuauaauuuaaagauucuucuaaaaaccuucugauauucacauuuguguccucuuguuaucuugguaucuuucggauacaaaaauguuauagaauauguuccuuuuaaagagcuagcacaucauuuuauaauaacuaacauuccaauuuuaaguuauuuuuauacccucagcauucaaauguacagaauuaaggauugcccgaauuucuuuugauuucacuacauuggcagguuuugggguguuuuguucuuguauuuuuuuagggacuaacaaaagagccuuuguugcaguaugccuguguuaguauguaucccuaaguggaccucucaaaucuaaaauggaaauacuugaugacauaucuagaaugugucagcugcugugauuuuuauuggugcucuucuuauccaggugccugaguuugaguaucuuuuuaaccuagcuacagucgucuuugccagcuugcccuuuguacaggugaaaacacauuugaaguaaaguagcggacauacagaauacagcucuggggauacuccucauaggcuguucgcaggucagaacugugaguuacugucuuaaggcaaggaucuuucucuaaaagaacagaaccauucaaauguccauauagaauagaaggagaucuauuagaucggcuuccauggaaggggcucgguagucccagcaguggcugccugaacucaggaagaagcagagagcccagcuccauccacagagguggcugcguaggcagucccaagccaggguccacggccugcaguucccuggagaagcacugcuauuaaguccaccgcagaaggccagcaagcuggagucucuuagcagcaauagaugcaguguuguaagccagcccgcggccuacaugaaccggguauuucuggaaggcaggccggggcugaaagagacuuagacuguaagaaaagauaaugaaggaagccaagacaaaaauuucucugaucaagguuuacuaagagagugugcuuauaagggggaagacccauccucccgcccccaguccauucuugaugucuggagccagccuguaggagauauguaggauaggacgugccuccggaauaucucuggggccucucagcagguagcagugucuuggaggagagcagaggcaggugacagaacaauagagccaucuaggucggaaggcuccaccccagguagucucacucucagaggcagcaagguuugcaucagucugcuucaggcugggggaggcuacaaugcaggacaguuggaaggcauuacccacuuugacagugggacuuccucucuggaaauucacucgaaaauuuaaauuaauuaaucaaauuauuauaauucaucauuauuauuaaccaguacagauggaucauugugguuaauaacauauuaaucauuaguaaaauuaauaaauuaauuaaaauugauuuagacuagugagcacaaaagguuauuuaaaauacauuuaaaaagcugagguguguguacuagguugucucuaagucccucaagcugaccaugucugccagccgucacucuaagucccccaagcugacuaugucugccagccaucacccuaagucccccaagcugaccaugucgaccagucgucauucuuaauucccccaagcuaaccaugucugccagccgucacccuaaguccuccaagcugacauguugaccagccuucacucuaaaucccccaagcugacauguugaccagcugucacaguguucuccuuuccucuguagcaacuggggcacugaagaugacgagacucagaguuaccacaacggcaacucggacccucguggauuugguacgucugccucauuguauuugaugauugugugugcaugugcgugugcgugcgugugugugugugugugauuuugcaugguguacauauuuauggauacauaaaacuuuagauaugaaugaccuaauuuucuuucuuuuuuuuuuucccccuucgagacaggguuucucuguguaguccuggaacuuacucuguagaccagucuggccucaaacucagaaacucgccugccucugccucccaagugcugggauuagaggcgugcaccaccgccaccaccacccggcugaaugaucuaauuuucaaguauagcuuauuagggacguggauauuuuuauaucuugccaaucuuauuuagcagcuauguugguauuagucuaaacaucguguuuacuuucuuauaauauuauacaguaaaaccacaguauuauacuuccaguaaaccuuauuguagggacaggguuagagcccaaggccuuuaacaugccgggcaggcuuucugccacuagacuguaccuccaucucccucucagagagcauuugguuaaaaacaaugggaacuguggucagucauuuuuugguagugucuugucaagggacagagagacggugcagugguuaagaacgcuugcuguucuuguagcagacccgugcuugguucccagcacccacacugugguuugcaaccauccaggauucuaguuccagagaaucugauggccucuucugacccugucagacaucagcacacacauagugcauauauguauacacaggcaaaauacucauuacacacagaauacaucuaaaauaugcauccugucaagauggcacaauaaaacuucgauuggguaauguagugaaugcuaacaguuaacccaaaacacgaauaaguaacuuuuuucuuauagauuauucuaaacagguuaagcuauacauuauccagaacugacuuuuuuuuuuuuuuuuuuuuugguuuuucaagacaggguuucucuguauagcccuggcuguccuggaacucacuuguagaccaggcuggccuugaacucagaaaucagccugccucugccucccgagugcugggacuaaaggugugcgccaccacgcccagccccagaacugauuuauuugaacugacuuauuuaaaauaacaaugcagagcaacuauuucacuguaaccagcuagucagacugugguuaaaguacauagauuuugaaccaguuaaaucuguuuucaagggccuuguguuuugaaguaagcuguggaagccauuugagacacucuuguaacauuucuucccgugcucuguuucuuuuuugggaaugccaucaccaaaggucacauugggauugccguuccugaugucuacagugccuguaagagauuugaagaacuaggugucaaguuugugaagaagccugaugacggugaguauuugcuaguauuuuuauugugcaccaccgcacucgguugagacagcucagugugagacaacccaugagcuggaacaguuaaguagaucauugguagagcccuugccuagcauguucuggggucuuggggacagcccccagcaccaaaaaaauaaacaaaaggucccagaccaaccaaccaaccacacaaaaacccagagagaaauaaaugaaacauuuuaauaaaauuguuucaaguaaaucacuugcuaugggaucuuuucagugaggaagcagcuugcccuccauucagaucagcugcugguaccugaccugguuuccuggauuguugucuuuuucuuuggucuucacauuuuuuuucaaagauaauauagugcgguucuuugagccuccuuuccuccauuucucccuugaagcaucuuucacauuuccccgucuuagcaucuccaccgggacccuuuccuaaaguuuugugaggauugauuucugagacugaugaaugcaaaccaggcacagauagaugcguucugcugaggauaccagguuuguuuccccucacucuugaaaacacggaauccuugauaaaucugccgucaggaugcugauauuccuuugcacuuuauuuuuuuuuuuuucuggagacuuuuggcuuaccaguuacuuaccaguuacuuuccccccucaaauguaucuauucugaguuuucuuugugucugugugugaugcgcaugagcaggccucuucccuuguauucucuacauugacagggcgcuguuuuccccugauuuguagggucauugcuacuguucucaucccuuggcucccuaacauuuuccugggcuuaguuaacacugugauaguucauagugcucaucacaucuauauauucuaguagcccuuugcccacuguccuaauauuucauggauaauucaaauaauccacuguuuuguuuuugucuuuaaauaugugauuaugcucaauuguauauuuaauuauguucuuggauuaguuaguuuugccucugagcuauuuuuuccaacaacuguaagcugcuguaauccaccaggccacaugacuggcagaagagaauaguccccaaggauuccccugauuucaggaagacaggcuggaugagcccugggcuggguuuccugccuacuggaaaugacaacucuucucaacagaggcuuuucccccucagcgcaaagcagccuuuguaggagacaggucugcugucuucaucccuggccuuggaugugugggugggggaggggguggggguggagggauaccgaaguuagcagguuuauuccuucugguuuccucauuagacaagcauugugucccccuugacucuugagggcgccuggcagucaguagcagagguccuuccagugugagggcuggcucugauuaccuugggggcggggcagaaacaaacaucuuguuuauucucgcucagccacacguucagagcuccuguucugacucuaaacuacccucugucuggaucagguuaaaucagcaggccaugcucacccguuccuccucagccgucuuccuggagauugcuucacuguuucucuguuuugcccugaucuguauuccuugaccuuggggucaggaggcagaaacaagagucaaaugaguucagcaucuuagucuccaaauaaaucaaucucucagggcacauccauacgucuaagugaacaacuccaucuugguuacaauccccaggagccacagucugauugacagggcuuagguuaccccaggauauugucuaauaggguuugcgugacccaagccgccguugucucaguugugcagagaggccacguugccugcucccuugagcaucucucuaucuucucuuccuuccuaaaucauuucugugauuggugacauggugaccucaaagugaggcaaggacuggguacuuaauagagcuguuccuagguucugguaggucacauucuaggcauugggauaaccgugcuacggugaaacaaaccuuuuagagugaaagcuaucaacaacguauuuuauucaagugcaaauuaaaauuguaaugaaaacguguuuuguuuuguuuuguuuuuaaugugccuucuaguaaugaaaaguguucauuauacagggaaaaugaaaggacuggcguucauucaagacccugacggcuacuggauugagauucugaauccuaacaaaauagcaacgauuauuuaguuucgggagaaugugccuuugagguaugggggacagcgggaacaaagcggcguggaaaagaaacagcgugauucaagaugcugcggcgaccagaagcguuggggacugaugggucucucugcuccaguucaaauccuccugaaacccuuuucauuguccugauucaguggguuuuuaaaaaucuccccucuguuuugccaaccuaauuuucaaguagcaauuuaucuuaugaccuugacaaaguugugugacuuuacauuuaagauaauaauuagaacagcucccuuuagagaucacaguugcuacugccugucucuuaaagacugcucaagucuguuucugauucaucauuuagaauuuuguuucaaauguuucuuuuuggggucuguuaccuucugggguuucaguuccucagaaauaacuuuccauaaugggaaguacagagcagugaacagaaaugagauuuuuuuguguguacuucaaacagcauaguguuuaucuuacaaaagagaagguacuccugagagcaauucggaaucaugcugacaaggacacagauagaaauacuaauuuucuuuuuuucuuuuuucuuuuuuuuuguauguauaaaguacuuucagaauucaaggacuaacuuuacuuuucugggaauacggaggaggaagggauuagacaaugggccaugcuguagcauccuuuauguaaauaaugaguacugugguuacgacagacaaagccaccugauuggucugaaggcuugggcggucaguguuucuaguagcuggguuaugccuaugccucaugguaccuccugcccuacugaggaaccugccgggagucuggccuaugcucucugcucacacuugggcuugaauaccacagagaaagaagcacagaggucaauaguacaaggcugcucuaggggacaccugugagugagccccacauuggagggagucuuccccaccccauggucuucaugaugcuuguaaucacguagcauguuauguucagugcugagucagaugucgggcauuagcucuguggucuucccugcugacaggauuaauggauucucagaggugauuugaagacucaacaacuggaggacaaaacccaauuugaggucagacugcagcgaaguuuccugccugcugcaguggaagacgggcgugggcaaugccaagcgcuacacagcuaugggcacuuggugaucuaugugagcaguuuaaacacaucauaggcugaaauaaagcuaacacuguuuaguacauaaaggucugggcagcaagucccuuuguguaaaaggcuggucuugaggccugaaaggauucaaaagaaguuugcgcugaaccagggauacacaugagucuguacagacuaagccagguagcuucuaugguugaaaaagcaugggaaagaaaaugucaaaucaaaagauuugggggaaugaaguacauucaggagaaagaccagauaucaaaaggugggucacaggaaucuaggagggccaguuucaaauguccaaugcuggaaucaccaaaugggauucuaauacuggaccuacccaauuuaacaaugugaaccauauuucuaggggugggaaguacuugcuaggugagucuugccaggacauaauccuuauuccuuaagugugcuucuguaugcauugaaaagcauguauguggccaggccuuggcaggaguugggacagugcacuugcaaauacacuuaccuggcaaguagcggugggaagaacaggcuggggguuggggaccuugcugcugcucaggggagacaguccucuacugguacagucgccuggagguugcaggaggcuauagacgugugaacauuuccuuuucacacugcaggaggcuacgacuucuucuucuucuuuuuuuuuuuuugguuuuucaagacaggguuucucuguauagcccuggcuguccuggaacucacuuuguagaccaggcuggccucgaacucagaaaucagccugccucugccucuugagugcugggauuaaaggugugcgccaauaccgcccggcaggcugcaacuucuuaugaagcagcagccuuugcagugucuggcaaggguccucuugacuuguggacaggcacuuugccuuguggacagguacugugccuucucggggcagaaguuuacugcaacaugcaucccauuccaggaggcuccaccuaaguaauuugccuuguaggagcucauuuccaaguaccauuuuggggagugggccuagucagaggaauuucgaaggaccccagaguugucccauagcauaguacacagaccuugacaacuugguuguggagggaccuuuguucucaagaugcuguuagaagcaugggaaggcccaagggcaugcacugcagaguuggccugcaagaaguccugauaccuacagcuuguucaucccgucacuugacacauauaugaucaaagauggcuaaggccagucagugcuguguguccacuaaaaacggccauugaaaggaaguaaccugggauuccucacuugucuaagggcugaaaguguuuuccaaggcucugcagccaaauugaucuccuuacguucuggaagaccaacaguuuuaugugauguuacuuauuuaccauuucccaguggggggggggcucugacuuuguguggugacaugcugaaaugagguuuuguuucuuuaagugggaguugaaaugcaggugaaaugcucucaucccgaggccacuguauccagcaagaucacuaacauaacucauagccuacugagguuaugcuugucaacuucucuccuguaaacuuaaucuccggccaccuccuuuucuacacuguucucuucagaggaaaauaaacuaugugaaacuccaaac

SEQ ID NO: 8505 - RNA, 608 nt, Mus musculus
ucuuuuuucuuuuucuuuuucgagacgguaucucuguguagcccuggcuguccuggaacucagaaauccgccugucucugccucccaagugcucuuuguugccagaccuccuccaucaugggucgcauggacccuccugggaagggccuaucccaguuggcgcugcccuaccaccuuagcgucggcugaaguugacaucugaggacauaaaggaacagauuuacaaauuggccaagaaaggcccgacucccucccaaauuaagggugauccugagggacucacaugguguggcacaggucuguuuugugacuggaaauaaaaucuugagaauccuuaaguccaaaggccuugccccugaccucccuggggaucucucccauuugauuaagaaagcgguugcugucugcaagcaccuugagaggaacagaaaggauaaggaugcuaaaguccaccugauucugacagagagcagaauucuccgauuggcucgauacuguaagacuaagcgggugcucccacccaguuggaaauaugagugagucguccacagccucugcucuaguggcauaaaugcuguugugugcacaagcaauaaaaucacuuugaa

SEQ ID NO: 8506 - RNA, 608 nt, Mus musculus
uucaaagugauuuuauugcuugugcacacaacagcauuuaugccacuagagcagaggcuguggacgacucacucauauuuccaacugggugggagcacccgcuuagucuuacaguaucgagccaaucggagaauucugcucucugucagaaucagguggacuuuagcauccuuauccuuucuguuccucucaaggugcuugcagacagcaaccgcuuucuuaaucaaaugggagagauccccagggaggucaggggcaaggccuuuggacuuaaggauucucaagauuuuauuuccagucacaaaacagaccugugccacaccaugugagucccucaggaucacccuuaauuugggagggagucgggccuuucuuggccaauuuguaaaucuguuccuuuauguccucagaugucaacuucagccgacgcuaaggugguagggcagcgccaacugggauaggcccuucccaggaggguccaugcgacccaugauggaggaggucuggcaacaaagagcacuugggaggcagagacaggcggauuucugaguuccaggacagccagggcuacacagagauaccgucucgaaaaagaaaaagaaaaaaga

SEQ ID NO: 8507 - RNA, 5047 nt, Mus musculus
cggucaagagacagcauggaagcaguuuauuuagcaaagcaaagcaagccagccaaacagauugaaguggauugucccaaggggggauagcggcacagggaguccucuguuguggauuuuaaguagcuuguuuuaaaaauggauauuuaugagguggauggcacauucacagguaaggugacucuuuccuuuacaaaucauacaggacuggacccauccuccaagaugauucuacccaggaugcucuagcaaaaccuauaaagaaaaaauggaccaaaaccacggugucaauuacuauaagguuuccuugucucagacaguugacgggucaccaugcaaaguaucugaaaaaaaaaaaaacaaaaacaaaaaacaaaaaaacaaccaaccaaccaacaagguaaagcaggaacgguuucuuuuggcucacagucccaggguucauuucagucugugagcgcugaagcagcagcuaaugucagacauugggaagcagagagagauggaugccgauccucagcuccggucucuucucaccuuguccaggaccucaguccacagaaagguggcuccuuuuguggaugagucucccacuucaauuaaaccucauuaccuagacagucccucgcugacuacccagagccuugucugcuaagugaugcuaaaucccaucagguugacucuguuaugugcuaggccuccaucuuaguacuuaacgacuguuugcccuagacucaaaucccuggaaggugaguucccagaaaacaaccugacuuagugacucucacccaacgaaauguauagccauaaccaucugcuuuguuaucaugaggauaugacuaacuccugguuuuguuuuugugguuguuuuuacuucuuggcuucugauacuugcuuacacagacacccaaggacucuguuggguugccuggaccacuuaacuuggcagaucagacucauuuucugcuugcuugcacggauaucaaagguccucuugugguuuucccauuuaaaacccaucucuggggggauggagagauggcucagcgguuaagagcaauggcugcucuucccuuaggcccugaguucaauucccagcaaccacaugguggcucacaaccaucuguaaugaggucuuaugccuucuucuggcauuugggcauacauguggguagaacacucauauaaauaaauaaauaaauccuuuucucuuuuuaaauucuuagauauuuucuuuauuuacauuucaaaugcuauccccaaagcccccuauacccuccucccgcccugcuccccaaaauaaauaaaucuaaaaaaaaaaucucuguacccuuccagcaggacacaccugagacuuggcuuuaugggugucaaacaauagauccuguauuuaaaacuggaucgagucugagguuuuuaucccaggacucucaaagucuauaacaucaauuaucauaucccuuuuccuucaugcuccucagccuauccccagucacucauagcaaacuaacacaucuauguaauuccauuauacaaauauaacacuaugcaguuucuggaaaugcaaaguccacagaaaacauuguuaacaguuugcacagcucuaugacguuuucccccucaaagauuucuagaaugcucucaagauacuggaacaugauugaauucucacaggggccccacccucacaauucccaucucugcugugcccagaguacccuaaacaaaguuucaguucaucaacugcauaggugaguuaccugaugauggucaagcucuggcccccauagcgaggcacccgaggcacccgaggcacccgcgggcgcgcagcaucuugcaggagccagcgcgugaggcgccucgcccaacuuccuuugaacucucaacggcugagccaccgcccaacuuccuuuguacucucaacggcugcgccccgaguggcagcagagacugggggcagcucuaccagagcagccacuguugggaccugcuuuggcggucuaagguucaagacagccucccaccaguuuacaggcaggcgagugagugguggaugcgaagcuuggaguggcggauguagaagcuaccaccugggaagugccgggauccugucaggugcuggugagaccugucaauccacgucugaguaucuuacuccacaaccccgccagcuccuuucaaaaagugaaaguuagaaguuaguggugaggcaccuggcaguacauguauguauggugggggugugggggacggaguugaaggaaagaaacaaggagggauggggaaggagaaagaaaagaaaccaggagggagggaaaaaagcugggagagggagggagggagggagggugggagggagggagggagggaggaaggaagggaggaagggagggagggagggagggauucaaaggacaaaaccaaaccaaaccauggcuuaccauuuaagaguacuugcugguuuugcugaggcccagagugguguucccagcgccuauguucagagcauaggcaugugaagaccguugaggcucuucuggccuucacaggcgcgugcacguauuugcccuugcuugcaggaacacacacacacacacacacacacacacacacacacacacccuuccuuucagacuuguuuuccauucuuaugcuuaauggcaauucucccacagcucaaacuucucaucacagaauucaccuaaauugcugagcuagcuguggcuuuucuggcuucccugccuuugucccccaacaggacccaccuucuucacuucugcauagaccacaccccucuuccuuccuuuucuucuguuaauuuauuuuaugacuccgggugcuuugucugcacguauaucuguguacuaccugcaugccugguacccacagaugccagaagagggcaucagaucccuucauacuggggugauaaaugauugugagccacccugugggugcugggaaucaaucuagguccucuggaggagccaccagugcucuuaacagcugagccaucucuccagccccuggauccaacagucuauugacauuaacccacguuggcuguauuuaacagugcaucuuagcugcuuuccuuuagaggagcuccuuacuuugagguguagcugugagaucaaagagaaacuggggacuaauggcuaacugaggugccuauuagcauaccaaauaggcuaauuguguagccuguuagcuucccacucucaaccugacuucccacuuucaacaucacaaauacccauugcagaguccaugcugguauacuggcucuucacaccaugcccgcccccuacccuaaacuucucccccccaagggacuugccuucccucagcuucucuuuacugccauuuuagcuauguuccucacagaccccucuugggccccucuccuuugucuuccucuaggucuuccuguuucucucuuguccccccuccccccuccccuccccuccccccaucccauucagucuacuggccaucuuuagucuacuacuuucuuccccagcucuggacucuuccacaugccucuggcagggcucuccuucauauuuauaauaaaaauuuuauuuucgggcuggugagauggcucaguggguaagagcaccugacugcucuucugaagguccggaguucaaaucccagcaaccacaugguggcucacaaccaucuguaaugaggucuuaugccuucuucuggcauuugggcauacauguggguagaacacucauauaaauaaauaaauaaauaaauaaauaaauaaauaaauaaauccuuuuuucuuuuuaaauuauuauuuucuuuauuuacauuucaaaugcuauccccaaagcccccuauacccuccucccgcccugcuccccaaaauaaauaaaucuaaaaaaaaaaucucuguacccuuccagcaggacacaccugagacuuggcuuuaugggugucaaacaauagauccuguauuuaaaacuggaucgagucugagguuuuuaucccaggacucucaaagucuauaacaccaauuaucauaucccuuuuccuucaugcuccucagccuauccccagucacucauagcaaacuaacacauuuauguaauuccauuauacaaauauaacacuaugcaguuuccggaaaugcaaaguccacagaaaacauuguuaacaguuugcacagcucuaugacauuuucccccucaaagauuucuagaaugcucucaagauacuggaacaugauugaauucucacaggggccccacccucacaauucccaucucugcugugcccagaguacccuaaacaaaguuucaguucaucaacugcauaggugaguuaccugaugauggucaagcucuggcccccauagcgaggcacccgaggcacccgaggcacccgcgggcgcgcagcaucuugcaggagccagcgcgugaggcgccucgcccaacuuccuuugaacucucaacggcugagccaccgcccaacuuccuuuguacucucaacggcugcgccccgaguggcagcagagacugggggcagcucuaccagagcagccacuguugggaccugcuuuggcggucuaagguucaagacagccucccaccaguuuacaggcaggcgagugagugguggaugcgaagcuuggaguggcggauguagaagcuaccaccugggaagugccgggauccugucaggugcuggugagaccugucaauccacgucugaguaucuuacuccacaaccccgccagcuccuuucaaaaagugaaaguuagaaguuaguggugaggcaccuggcaguacauguauguauggugggggugugggggacggaguugaaggaaagaaacaaggagggauggggaaggagaaagaaaagaaaccaggagggagggaaaaaagcugggagagagggaggaaaggagggagggagggagggagggagggauucaaagacaaaaccaaaccaaaccauggcuuaccauuuaagaguacuugcugguuuugcugaggcccagagugguguucccagcgccuauguucag

SEQ ID NO: 8508 - RNA, 1456 nt, Mus musculus
ugaauucggaacggcccugugaauagugauaugggaggaagagacaggcgagcaauagaagugucaacuguuuaauugagggaggguaaugaagcaccuaucaggcaggagacauaagcaugucugaguuucucaguggcaagcuuuuuucuguguggcucuccuggugcccacggcagauagagaugaacuuacuugaugucacacaagagggccaccccucucaggauccagugauccggggacagcaccgugcgcagguacaccacggugaugaaggugaggucaguccgccuggguuucuuguagauaggacacacguacagcuucggauccuugggcgccguggaguuaauggcaaaaauaugcagaacaggaagcugcgugaagagaaccuucgggguggauucugugagcuucccguuccgccugucccaggaugcuccauccauauacagcccguaaauauacacgccuuccuggaggaccaagcgacagagaaggagaggugcugaaaacuaggcaucccuuauguaaugagggcugucaguucggaaagaaaacacaagccagucuuaaggugcuagcugauaagaaaacgccagggggggcaaucgcauucacggaaacauuuggccuuguuucccaggggacacagugaaucuaacugcaccucgggagugcccugcugcgaguuauuggaacguggaguggucgaccugggaaacaggaaggccaagucaccucugcggggaguuguaaauccaguuugagcuguugcaagccuacgacuuggcgcuguugucaauggcaccuugcgcugagucaaucuaggcaacccuaggcuccaccccaccuccuccacgugaugaaaugagaguagagcgcccccagaggccuggggugguacagcaagguagacacgagaaagugggacagaguuggcccuccccugucgaugaccaaccaucuucccuacguucuuuccuacaaacggacuugccuuugugggccucaccucuaaaccgaggaagcaagacccccaagaaaaggugacagcuugaaauuuguuaguggagcugccuggugaugaguucugaggguaaacgcagugacuuuggacugaggucaugagggcuuuagccaugagaguggacuguggcaggaacggcuugaagagaucccugaagugccgcaggaaguguauggaaaggaggaggaggaagccagagcaacuccacagagauggacaggcugggcugagacaauacuuuacuuucugacagaggguuccaagguaauaaagugagguaucacuugaccguggaagacgagugugccgagcugaaaugucugaacucuaucuugcaggcacgggggagccacagaauauguauucauuaagacgagaaagggcuggagaggaccaugugagccauaaaguauauuuauguag

SEQ ID NO: 8509 - RNA, 873 nt, Mus musculus
acagccugcuaauuuaaucaccguggcaggaagagaggaagaaacaauugcugcuaagaugaagaggacuucuuccuguuuaaagccgcaagacccuugggguuccauuggacagaacagcaaaucaacccggacucacacucaagggcaauugcugauggguggaauuggggcuuccgagaagaggccaugagagaccugcccuuggaaccucagccaguccagagcucagcaaggugagccggcugugcugugugcauggcugggguugucaccugcaucaaucagccuuccucccgacaagaggcuuucucugugcaucuggauugcugacauucccccaucugccuguucuucugauauccuguuguuuccuuggggaggggaauuuguugaagucauaccgugcagcucucucugguguugaggagaugaugcucagagguguucuuugccuggcccuuuaagccacuuugcucuuggccucugcagugccuaggguacuagggcaggucccacggugagaagcccagaugugggguguggacccucaguucuguuguaaagaugcucagauacccucuaggguucaucuaaaagauccccuagggggugcugcugacaugaaugacucuagagaaccaagggauccauugccaccacaccuccaccucaucugugaccagagucuaugacuuggaugagaauuaggguacauccucugacuucagaggcuaugauccagaagagacucuuccacugaagccaacccccccucugccuuugaaauccucccacuuugagcauauuuagacuuuuucccuuuuuucuuuugugucuauucaaacguauaauucugauuucucucaccca

SEQ ID NO: 8510 - RNA, 2495 nt, Mus musculus
auaagugaaggggaaagacagauauaaucugccugaaauaaauuuuccaagggaaagaugcugagagagucuaggcaacccagugggagcuuuaauguggaguuucccccccucucuggaacucuggauucuuggguucacugcaccccacauuccaagacuguuaauacacauuucccucccagauucuugauacugaagaagucuuugccugucccugagucccuguacuauuaauguuuuuuuuuuuuuuuuuuugaauggcaccacacucccucugagcucucugcaaacuugccuacgcuaaauauagcucccccgggucugggaacaauccgaugcuauguacucugaaauuccacuagcuguuuacaugccuccggccauaagucuaagccuggcacuugcugggaacucucugaccgccccgacccuuuccuggggcuacuauugcuagccuaucggauauaugaggcagcuuuguuggagacacacagccagcaggcucaaguggugguuaucaauguuugauggcuucagcacucuggccagcucccgggaacagaguaagggcugaaaucuacucuucuucuauccucgucagucuuugaauaccuaaaucaccaaacuuuacaagucacuuacccuccaagacugccuucucuuucgaaugacuuuggggagggcagacaugauuacaagugcuccagcgcuccucauacugaagaccgcaugaauagaguucugggacauucggcaggcaggaaagauccugacaguuccuccugacuuuggccuacagaagccaggagagagucuugcaaggauuucuggggucuacagcacuaggcugccagggcagcuggaccucuggaaagcacauggucuuucaagaccugucaaguucgaguccuugugugaccaaaagggaauacuaaaggcggacccauuccauggcaaagaugugaugagaggaagcuggguguguuuuaaagugugcucuacuuuccuuguucuuagaguuaagagaggaggacuggagagaugguucaguggucaagaaugugaacucuuggagaggaacaacauuuaguuuccagcacacacaucaggaagcucacagcccuaguaacuucaggguaccugacacacucuuucggcuuccacugacacacacacacacacacacacacacacacacacacaccauaccugacaccuuauuuuggccuugacuggaaccagcacauuuguggcauacaaacacgucacacaaacauacauauacacauaaaaaaaaauaaaaucugcaaaaccaaaauccaucggugaaauacacaugagcagagaacagggguaauguuugagagcacagucaugagauuguuuaaugccuugucuuagauguuuuuccagauucaucucuuuguuugaaauaugcugguaggcacacaaaagugacugaaagaaaugaaacggugaccaggcaccucaucuuuccaucuccagugcuccccgaauucuggggaggucucacagagcaccggaugguacagugcucugaaggaccgguagagucucgucuucgcucaugccugagcugacugaguuucaacccuucaaggcaaagagcacuaugcgugccuguguuuguccugugcauuccagcccaaggugaggagaugcuggaguuagguucagcccuccuccaccaugaaggucaccaggccugcacaagccaggguggggcuggcugggagucuggcagauguauccccgccaugcacggacagggcucccauuaucgcuaauggcugcgacgugcucaggggaggcagaacauguuucaaagguuuauauuccaucugcugaauugauucuaaucuacagggcugacucuacuuugggcuccuaggaagcaaacaauuuuuuuucuuugauccucaauaaaacacagggauugauucugcuaagacagcuaugcaaauagcauguuaaauauucaacagaaaggaaauuagaaucaacucuaauguggugagauggguuucccccucaaccuuuuuuuuuuuuaauggcucaaaugaguuuccuuggugagaaaagggguccaguuugagaaacuucuaucaacauuaccaugugucuaugcuauugucugcaaccugaaccguuucucugguccuggggaagaccacaucuggaagcaccauucaggaccagugagauggaucgguggguaaaagcacuugccuccaagccaaauggcccgaguuuaauccugcgucccacgugcuagagagaauugacucccaacguugucuucuugaccuucgugugcauggagugacaugcauguccccccuuccacauacacauacccacauaguaaauaaauaaauguaauuuaaaaagaaaaucuaaaagaaugguaacagauguguugcuuuggaaaauauuuucuuaaauaaaguagcaugggugaguggcgugau

SEQ ID NO: 8511 - RNA, 2495 nt, Mus musculus
aucacgccacucacccaugcuacuuuauuuaagaaaauauuuuccaaagcaacacaucuguuaccauucuuuuagauuuucuuuuuaaauuacauuuauuuauuuacuauguggguauguguauguggaaggggggacaugcaugucacuccaugcacacgaaggucaagaagacaacguugggagucaauucucucuagcacgugggacgcaggauuaaacucgggccauuuggcuuggaggcaagugcuuuuacccaccgauccaucucacugguccugaauggugcuuccagauguggucuuccccaggaccagagaaacgguucagguugcagacaauagcauagacacaugguaauguugauagaaguuucucaaacuggaccccuuuucucaccaaggaaacucauuugagccauuaaaaaaaaaaaagguugagggggaaacccaucucaccacauuagaguugauucuaauuuccuuucuguugaauauuuaacaugcuauuugcauagcugucuuagcagaaucaaucccuguguuuuauugaggaucaaagaaaaaaaauuguuugcuuccuaggagcccaaaguagagucagcccuguagauuagaaucaauucagcagauggaauauaaaccuuugaaacauguucugccuccccugagcacgucgcagccauuagcgauaaugggagcccuguccgugcauggcggggauacaucugccagacucccagccagccccacccuggcuugugcaggccuggugaccuucaugguggaggagggcugaaccuaacuccagcaucuccucaccuugggcuggaaugcacaggacaaacacaggcacgcauagugcucuuugccuugaaggguugaaacucagucagcucaggcaugagcgaagacgagacucuaccgguccuucagagcacuguaccauccggugcucugugagaccuccccagaauucggggagcacuggagauggaaagaugaggugccuggucaccguuucauuucuuucagucacuuuugugugccuaccagcauauuucaaacaaagagaugaaucuggaaaaacaucuaagacaaggcauuaaacaaucucaugacugugcucucaaacauuaccccuguucucugcucauguguauuucaccgauggauuuugguuuugcagauuuuauuuuuuuuuauguguauauguauguuugugugacguguuuguaugccacaaaugugcugguuccagucaaggccaaaauaaggugucagguauggugugugugugugugugugugugugugugugugugugucaguggaagccgaaagagugugucagguacccugaaguuacuagggcugugagcuuccugaugugugugcuggaaacuaaauguuguuccucuccaagaguucacauucuugaccacugaaccaucucuccaguccuccucucuuaacucuaagaacaaggaaaguagagcacacuuuaaaacacacccagcuuccucucaucacaucuuugccauggaauggguccgccuuuaguauucccuuuuggucacacaaggacucgaacuugacaggucuugaaagaccaugugcuuuccagagguccagcugcccuggcagccuagugcuguagaccccagaaauccuugcaagacucucuccuggcuucuguaggccaaagucaggaggaacugucaggaucuuuccugccugccgaaugucccagaacucuauucaugcggucuucaguaugaggagcgcuggagcacuuguaaucaugucugcccuccccaaagucauucgaaagagaaggcagucuuggaggguaagugacuuguaaaguuuggugauuuagguauucaaagacugacgaggauagaagaagaguagauuucagcccuuacucuguucccgggagcuggccagagugcugaagccaucaaacauugauaaccaccacuugagccugcuggcugugugucuccaacaaagcugccucauauauccgauaggcuagcaauaguagccccaggaaagggucggggcggucagagaguucccagcaagugccaggcuuagacuuauggccggaggcauguaaacagcuaguggaauuucagaguacauagcaucggauuguucccagacccgggggagcuauauuuagcguaggcaaguuugcagagagcucagagggaguguggugccauucaaaaaaaaaaaaaaaaaaacauuaauaguacagggacucagggacaggcaaagacuucuucaguaucaagaaucugggagggaaauguguauuaacagucuuggaauguggggugcagugaacccaagaauccagaguuccagagagggggggaaacuccacauuaaagcucccacuggguugccuagacucucucagcaucuuucccuuggaaaauuuauuucaggcagauuauaucugucuuuccccuucacuuau

SEQ ID NO: 8512 - RNA, 22364 nt, Mus musculus
cacucuuucaggcggagagccaaguggggcgggcagugucuccaugacgacgcgggacgcgcguggggguggcugguaacugcuugauagagacguugcuccugagauccugucugaaaccagaucaugucggaccugggcucugaggaguuagaggaggagggagagaacgaccuuggggugagagcucuugaccagggagggacuucuggaguacgucgcagcuccggagcgggaggcguggggaccgaagggccgaaaggccggggacagaaccacgccggccacacuggcggcgcugaguccaggaagucgcuugaaaggugaaacgccgugacgucuaguuuccacccuccuuccccgcucccaucccgccucccauuaaaggcgaagauuucuaggcagaggguaugaguuaaagggauagagaagguugccuccugacaacucaccacugugcugagguggcccgggcucucaagguuucaccauguaggucuugaaucagugucucugaaccaucccaagucaucgggaucacuucccuaguguagacaacagagggaaggcaaaggacccauagccaggaugugcucucauggugagugcauugugggccggcuguuuauccuuaaauccgagaaugaccacgcccuggcugacaaaguggggacuaggccugcugugugugagcaaacgggaguuugagcaucaacugaagagcccagcccuaugcucuguaaugcaguguugguaccugcucagaccucuuugcaggcuucccuacuuaacuucuucauccaugagcaggagcagcuuggucagugggaagaugcaggagugcuuuggagucccuugcucccaacaccaaggagcuagugcaaaaaaacaggacucucucaagugugaaaucuagaccucauggucuccgugcuggaggcugguauugcaccugaaguuugcaacaugcgcccuggcuuagcugccuccuuuccaaucugacagaccugguuucuuaggguucuccuuccauggggaagauggcucugucaaguaaagugcuugcugagccacauggaccugaguucagauaccacuaucauguaaagagcuagcacaggaggaucccuggagcuggcuggccagccuaccugaacggggggggggggggggguguccagcuuucagugagagaccgguuucaaaauauaagguggagagauucgaggaagacauugcaugucaaucucugguuucuagagaugagcaugaacguucacaugagcaaacaccuacauggucauggauauacccaccuuacugcacaucacacacacacacacacacacacaccacacauacacacacauaccccauaccacacacaccacacacacacacacaccacacauacacacacauaccccauaccacacacacacaccacacauacacaccauaccacacaccucacacacacacaaaccacaccauacaccauccacacacacucucucaugagagacacagaggucauuaaucuacccucugcuucugcucauacauaucugauuuacacacagucucgucuuccaucgggguuuccgguuuguuccccgcccgcuccuacugauuuguaacauguuuaagccuguagucaagacaccaaaccaccuuuaggugaacuuaaagaaugucucuguuagucacccauacagcucagucaguguuaggcauacugggaggucccugagauggcaguagggauccacuucugugacucagcguuggccauaaugggagaccuccaagaugggagcagugacuuugugcauuguggguauuagcuaccuuucuauugcugugaucaagcaccauggcucauggaaggaaggguuuauuugcacuuaugauuccaggggggugagagucuguccuggugaggaagcaggcacaggggcagacauggcgacaggaacagguagcugagagcugacaucuucagauucgagcagagagcacaaacaggaagugguaugaaacuacaaacacucggaaguccgucccuagugaugugcuuccuccagcaagccucuaccucccaaagguucagcagucuccccaaacuaccaccaaacggggaaucaaugcagagauagauacaugagcuuauagggggcguccucacucaaaccaccacacuguuguuuggaacaacccugagaucaaauuuguaggguuaaacacuuauauucuaggcaggaauuucugagcuaaacugcucacggguuuguuuaugagguuucccacgugauggccuguaccaaccccgugcauuauauuuuaauauguaauaauauuuaauguuauugucuauguugaaaguauguagagugauguuauaagcuagccauguuaugucauuacugaaugcucuggccauuuuaguauguauuauaugugcuacauccauguauuuugagccagaaaacauucaucuuaaaaacuauaggaaaaaaggggaggauugcaaccuuguaucacuuuuuuauucccuugauuuuaggguuggggcucuguggcucagguguggccuucaaccccauggcucaagugaucccacaauccugcuucagccccuacaagugguacuccuugcaaaaguugugugugugugugucuguaucuguguuucucuguaucugucucuauugcccucugucucugucucucuaccuuuauguguguguaugucaguauguguaucugucucugccucucuguguauguauguauguucucugugugugcguauauauguguguuuuucucucuuucucucuccuucucccuucucccuccucucucucucucucugagccugugcgugugugugugaaggggugaaacccagggucuuacacacgcuaggcaguuucacuaacacugagauccaucuccagucuaaucagcuuacaagauagauugauucauagcaauuucagauugguuuagaagugguuuauuuuuacauuuggguuuuuuaaaaaauauuaauuuuuaaaauuuuggguguauggguuuuuuucuuuucugcuuguacauuuguguaucacaugcauucaaugaaugaggaggccaggagaggucauugaaaucccuggaacuggaguuacagaugguugugagccaccauuuaggugcugagaacugcacagggaccuucuucaagaccagccagcgcucuuacccacugagccaucuuucuagucucugggucaaguuugucuacagacagcagacagaccaggaaaccuaugaaggguauuugcucuuuaaguccugaaugacuggagaaagugacuugggaggugucugugcagucuagggaccuauuuuaccugcgugugcucucuaugagcauuccugugacaacacaguucacaaaguguuucccguauauugguucauguuuacagugucaggauuagcauaauaagugacagucucucagaugcuaaagggagcgaggcucccgccauggacacccgcacuaagugugagaucauagaccagggcucuggccaccaggcuuggcuaccugcuucuccagcgcgcaaccucaaaggugcaugcagugcccaagguuggaaggcuucagugggacaauagcuguaaacugcuugccaugggccuggcaggaacaaacagcagccacaauuagcuugauuucuuuugcccaggaguacgaaggggagcgcaaugaggugggagaacgacacggacaugggaaagcacgacugcccaacggggacacauaugaaggaagcuaugaguuuggaaaaagacauggccaggucagaaaugaugauggagggaguugguuuucucuauuaaauaucacuuuaguacaugugggacucaggacuuacaugaacuguuuggucaauguguuucaggggacuuacaaauuuaagaauggggcccgguacaccggagacuaugucaaaaauaaaaagcacggccaaggcaccuuuaucuauccagauggauccagauaugaagguacgaggaagccuuuucuucccuuucuuguucuuguuuauguguagaggcuguuucuguuguugaauaugucuguucacaauaccaaagcauacaaguucacugaucgaccaggaaaugaagaaaaaaaauuguucuucuuccuaauauugucauagaggcuagaguguccuuuugggagguuggggguuucucuguguagcccuggcuguccuggaacucacucuguagaccaggcuggucuugaacucagaaauccgccugccucugccucccaagggcugggauuaaaggcaugcaccaccacgcccagcugagagucuuuuaaguaacuaaaccucuaauuaaccaaccuagguagcugguccugugggcagcaauguccuccugugagccagaaccuuggaguaagggaaggggccuugcugaguggacacagacucuggguguggcuuagauccaugacagcccuaucacacccucccucggaaggggucuuuauuguuuacuggguuugcccaaucccucuucugauggucauguuucuuuagaccuuugggagucccuucaucuaaggcauuuugccucacuaugaugucuuuccggggucucugaugugccucaagaagacucuuauuucuaagaaccucugggcccuauguaucgcugcuaccugguggaugcaugucuaguccccgagccagaaagggagacggcuggaugaguuuacugauuuguaggucuugaguuuuucucuaucccucuccacuccuccgucccuccuauuucugaaaaggguuuucugguuuccuucugauuuccaaaaauaucugugccuucagccuuugacuguggggucagucgguguggcucugugcaucccuuuucuugucuugauauccuugcugguagcaugcagaugggauagacugaugugugugauuccuauagagaguugcuugccucgagggaagaucuucuuggcaagaacugugaugcacuuuggugagacaacauucuuuucuuuuucucuuucuuucuucuuucuuucuuccuuucuuuuuaaagauuuauuuauuuauuauauguaaguacacuguagcugucuucagacaccccagaagagggagucagaucucauuauggaugguuguaagccaccaagugguugcugggauuugaacucagggccucugaaagagcagucaguguuccucacugcugagccaucucuccagccccaacaacauuauuuucuaaugagaaugacauauccuuaagaugcaagccauauucccacaacuaacaccuggugcauucaucuucaaggagaggaaggcuuaauuugauuuuagaggucuuaagauuugcuuacuugcugggcaguggugguacaugccuuuaaucccagcacuugggaggcagaagcaggcagauuucugaguuugaggccagccuggucuacagagugaguuccaggacagccagggcuacacagagaaacccugucuccaaaaaacaaacaaacaaacaacaacaacaacaaaaagauuuguuuacuuuauuucaugugugugggcauuuuacaugcauggguauuguaccugcauguaugcugaugaaaugcauccauaaaguguccacagaggccagaagagggcacuggagcuauagaugguuguggguucugggaaaugaauuggguccucugcaagagcagcaagugcucuggacugcggaacugucucuccagcaccugauuuuaaagagacggggcgggcgggcgggcgggggggggggggcuggggagaggggggugagagaagaaugaagccaagccaagguucuuaucaaagcuccaaguugaauauucagcacugcauuuauauagggcaagcccacagaccccauccuuuguuucaacuguguugcaaagcaaggccagggggcagucuaaucuucuaaauuccugugggaacuugcgcaugccaccaagacagaugacucccccaagguugauaagguccuuugugguaagcccucaaggucuguucagccugcuuaaggcugggaaggaaacagugggagugaggaugugugggucugaaggggaguaggggacagggguggggaugugggggggggaagagcuggucagaguuccuccuaugcucuggacaggcagacgugggagggcugccagaugcuuuccacucagccccgggugggcaucuaagccacugaccccacucgacgggggugggggguggggggugggggugguggugagcaaggggcagccccugauaccaggggacccagggccacaccauugggccuggaguuacaggagagagggaaaagggagagaaguucccacgcaggugagaguccuuaggccaguccguggcuggagcacaggaaggccuuccaucggaagauuagaaauggcucauuagaggaaagccuaucccauuguccaagcacagcuggccuugaugaacagagacaauauaugguuuuagagcuuuauuguagaaaggcagggggaaaggagagaagguagaaagagagagcgagaccagccauggucaagaggagagaagggggagagagagaagaaaggcuagaguaagagguuagagagagagagagcaaggagagagaguaagagagugagagagaaugaagagaggagaggagaguaagagagaacaaggagaggagagagugagguggggccaagcagccccucuuuuggugggcuguuaucuuacuguugcuagguaacugggaggagucuagccugaaggucagaagcuugggauauugucugcaugacucauagccaugcuucuccuguagaggcuguggggggcgguaacuucgacaagagccuuggguuccaggagcaugagggaacaccaaucgugccauguaggugaauuaucaccaccagguccccggguuccacaccucagccugacuggagaccagacugucuguguauagcccaaugccccucaguccccaugugaucugacugcuuucaccagcuucuaucucucaaagguuccaugccucccaacaauacuauauuugaggccuaagccuccacacauggccuuugggagacaccuagccaaacuauagcaguuaccugccuugcuuucagacaaaacaaccccccaaaauaacagauagcaaagagaauucugccggacucugggguaguacuuuaguuaggguuuuacugcugcaaacagacacugugaccaaggcaagucuuauaaagaacaacuuuuaauuggggcugacauacagguucagagguucaguucauuaucaucaaguugggagcagggcagcauccaggcaggcauggugcaggaagagccgagaguucuacaucuucaucugaaagcugcuaguggaagacuggcuuccaggcagcuaggguuuggguccuaaagcccacacccacagugacacaccuacuucuacaaggccacaccuccaaauagugccacucccugggccaagcauauacaaaccaucacaggugggguagagacauuuaugcccuuuguuuuaagacauggaacuuaaauuguuugguuccuaaaccuuggcaggcuuggucgaccagaaguaccaucugcuuuuuaaugagcuuugaacaauuugauuuaggacuuaauuuaauucuucccagaucucugugagccuaaucuuguugucacuuuugaucuuaguguagauguuaauacaauuugggucacauauaaaguacauuaaaaggggggagggauuugggaauucuuuuuuugaaacagaguuggguucucuuuacuaaagacauuuaggugugaagauuaggugaaaaagaggagcucugcugguaagacauacccaaguauggguacagccucacuccaagggaaagguauuaagaagccccccccccagcauuuuuuuauguaaccuuggcuguccuggaacucccuccuuacaagacuaccccaacaaugcaggagguauucugcagucuuuucaaaagugaaagaggacauuuaagcugcaaacaccagauuucauguuggugaggaccugacaucucuugcuacuccccuugagaaacuugugggaggcucuggccagcccaggaaacccugugcaauggggcagggguucucagaggaagcuggccuacaccugcugcaggcuucaaugaccaggagucaaggcuccuggacgccauuuggaaacauuccuguuuugaauuugcauguaaccuuuaaaaaaaaaauuuuucggaacaguucuccccuauucccuucucuccucuccuggucuugucaccagacccagagcauugaagggaggggauuaagcccuuaaaaucccuugagugagauuugccgaggcuuuggguuggaauggccuaucuaugccagcaugaccaugcacaccagcuuccuaggaacacaggcucccagcacuggacccugugaaagcucacacugcacacccuucaucugaccauucaucggcaugaugaguagcauccuuuaugacgaacaaccaguuuccaagacuucugcaaacuuuaagggaagaucaucagacuggagacaggguuagggaaacaccuaguuggcacugagcuggacagaagucucaguaacugggaaacauccaccagcuuccucugagaaccccugccccauugcacaggguuuccugggcuggccagagccucccacaaguuucucaaggggaguagcaagugaugucggguccucaccaacaugaaaucugguguuugcagcuuaaauguccucuuucacuuuugaaaagacugcagaauacacaacaguuuucuugucuugucagccuugagcccaguucccaaggaaagagaugggcuuuuuuuuuuuuuuuuuuuuuuuuuuuuuugguuauggucuuuuuuguguguguggggugggugcagaugaaguaaguuugccccagggugugcugagcagcuccaaguagcucacagaagccaauuuugcacuucuugaagcuucacaaacugcuccaaauuggccuccacaggaauauuccaccacagaaaaguggcagaugcugcagacgcagccacagugcugccaccaaaugcucacuagaucuuuguuuauggucacuacacaucuggucucauggucacuacacaucuggucuuaugguuacuucacacccagcaccaaaugucuauuuuagugaauuaucuuaauuugggggcucuccauuucucuggcuuguguuccagucuugcaucuuaucaugggauugagugcuuucugaauuuguagaaaucaccaucccuuucucuccaugaauguuugucuguguugagcugucugucacucaccuuugagggccuguucuugccucugccccaggcuacugaccacacccuuguuggcuuuugucuucaucugguggacgcucgugggggcugcauguuguccauuuguacagaccuucuccuagcucaugaggcagccagaaaguugucacuguuaaaucguuaucggagaagugaggaaaguccuagaaaguaccuguuuucuggauaaacuuugggguucauucacggaaacaguuuggguaauuaacauuuuguuagcauaguguaugugccgguguuucuagugcuuguguaagccagaaguuuacacacaugcuagggucuucuaagaaaaaggauauaaaguugcuguaaaaaugaauuuuuauuugucauggcaaaccgaaauaaacuaaacaacuugaaauuaaaaaaauuaauaccauaaacacuguauugaagagggcaucccagauguauuuuuaauuaaugacagacauccuugucccgaauccuaggacagcuuucucccaccacugucuucacuuuucuucugcacugggauagaauccagggccucccacauucgaggcaggcaucuuccacccaccuguguuagcugaugcucuuuccauaugaaaacaguuugcauuguuuucuaaagagacaauagaagauggaaccgcccuuucccucucuaaacaaacugaucucaauugguuuuaauuauuuguagcuccagucuagaaaguuccaccugggaaguaaucuagaaaguccuauucuagaaaguuccacccaggugcugguuugcuguugcucacaggugacguuuuagauaauguccaccucaggaauccacugguugugugaccugugagaggugaggaguuuuugagagacugauuucaaaucccucuuuggcugacaacauguuguuuucucauugauacaauuuccugucaagugcaugaggaauuaccaggagucacacacauggaggggccuggcaggccacaagagggaaugugugagggacccugaaggagcuggcaggaggagcagccuuggaacugagugccuaggugggagacagagugaaggcugaggcuagaccauuaagcagcaccuccgaggaugaugggauguggccgggcucacuagcagugggucagacaagcuuguuugaacccucaccgugugaccaccggccuaugaaagcaugaacaugccuggggcucaccugacauguguccacccucccgaucugugucucugagcuccuaacugggcccuccuuaacuagcucucaccagaaguuggcacaagaggaaggggugcagaggcaggaagucagagaggagagagacagcaggcuuaacccuuaugguuacaaagcuuagauccugcugggcuagcaggggccaugaugucaguuugcucuuuucaacucacuuuuuaaugaguguguguuguccuuuguaggggagugggcugaugaccagaggcacggccaaggcguguacuacuaugucaacaaugacaccuacacaggggagugguucaaucaucaaagguuuggcuucuuccugcagucuugggggucuguuuguggcguaagcauagaaugaugucggccuaaggcaguuccaugauguagggcagguguguaggggaggugcugcagagaagggaaggggggauucucuguccacaagccucagggagugaaggcacagagggcccaucuaguggaggucaagcagcccugcauccucaguaguuugugugcuggcaguuggcuugugcgcguuagaugaugcuggccccaugcuucucuuaaugucccaugugugggguggcaugccaagccuucgaguggaaacaccucuccuuagcucccugucugucuuagggucaguucuccacccuggacagugaccaaguggcccugucuugucuucaccaggcacgggcaaggcaccuaccucuacgcagagaccggcaguaaguaugucgguaccugggugcacggacagcaggagggugcugccgagcucauccaccuaaaccacagguaccagggcaaguucaugaacaaaaaugugagucagugcgccgugugccaacacuaaacacccagaggaguccuccauucccagcagaugaggcaggcugcuccacuccaggcuguccugaugcccacggaacacagagugggguggggguggggggaggcagaccucugggcccauuuccuugggcuucagaaaugcuuugugccucuguuaagaccagugcccuugguaccagagcaucuuccacuggcuaggugugcuuucugcccucugguaaaucauguugaauaggagggagacucuagggcucccccucaugccugaggccagccugccucuccugguuggggagggcucuaugcacccugaaucuggaaaccuccacauuuugaccuacuguuccuguuuggugggcucugcuuugguugcuguuuugugcagaggggaaagucaguaacugugagccuucuacccaggcauucgcaggagcuuugggcugggcuggaggaagacucccuaaaagagagaguuugcugagugcacuggcauagaagccggugugggguguggcuagcuacauucaaggggaagcucugggucauuugcauguuuguaacuugaggcucaacugcuggaguaaucaguaggcucgcccugaggcuuggcucuaccaguuaaguaaaaaagcuuccggccauacaauccaggcaagaacaaacaaauuauaaagcgucuuguguuaagaugcuuugugccucuguuaagaccagugcccuugguaccagagcaucuuccacuggcuaggugugcuuucugcccucugguaaaucauguugaauaggagggagacuccagggcucccccucaugccugaggccagccugccucuccugguuggcucccccucccucccguggcuacccuucucucgccccucccucaggcccucugaacaccacuugcacacacaugcacacgugugcacacaugugcauacuuacacaucagcuuaugaagaaucaguuuggcguguucacgagguaccaagacacaaagagacaucugcuauccucucacacgucugaccauguggaauaaaaugcagaggaaaccccccccccacgcccuucccuggucuaaacagagcuccugcccuggcuuagugguucauucaguucuacaucacaagccagccaucugcccuaaaaaaccgaauccccccuagcugauuuuccaggugcagggugagggcauccccucugcucugacccuugcagggcaaggaacuuugaaugggccuaauccacauuugguucguguuucugcuuuuguuggcuccccuguuaaucacugcccccuccacucaccucaccuggaaacaauggccgauuuacagacaggugguacccaccuccagaaugaaagacaauaagacuuuuuacuuaaguucguuguugcuuugucuucugauaaaugcauuuacauaggcuagaguccugguuacuuuccuguugugguguguuaaacaccaugaccaaaugcaaccugggaaggaaaggguuuauuuccuuuuaaaaggccgaaguccgccuuugagggaaaucagcucaggcacugaagcagggcaggagcuugaaacagagacccuggaggaacacuuuacugucuuguucucaggccaggccuuucuuauacagcucuagcccaacugccuagggauaguucugcccacaguggauuccgaccagucuuacaucuacuaacaguuaagagcacagcccaugguucaaucugaugaagcaggcacuucuuagguugaggcuccuucaucacagguguguugucaucuguguggaugagacaucacagcuagauaauggggcagcggaguguaaagggcugacacuuugaaacaccaaaaacaccgcccauugucuugaaaggcugcaucaauuugcccccucaccaacaacagagccugagucuucauugcuuuccuccucccccgaaucuccugcagucuugucucccaccccccaaacuguguuuccaugguuacggguggggucaggcaucuuucacccccuuagcacuaguguuucuuucuuuucuuuuuucucuuucuuucuuucuuucuuuuuuuuuuuuuuuuuuuagacaggguuucucuguauagcccuggguguccuggaacucacuagaccagguuggccucaaacucagaaauccaccugccucugccucugccuccuaagugcagggauuaaaggugugcaccaccacugcuuggcuaguuaguguuucuuucucagauauuuucccucaucccuguccuugcuggcaagccauuaaaacaggaugaggcaggauggagauggaagguaggccagaaggagaugaaguuguugaacgucucacuaggacaucccugaagacuaaugaagaagugaggggcaauaacaaacugagaaacuagauaacuagguaaacccaaaucacauugcugggcaaagucugggagggauacagaugauaacagaugcuucugucaacucccagcuaagggaacggcuaacauuguauuuuucaaagucuucauugugcuuuagcacuuuauaaaagggcuagggagucgguaaaauugguuuguccuucagcaaagggagaaagguauuuucuggaaggaauauuuuuaaaauugaccauggaccuucuaaaacgaaucaaaauaggugacugucugccaaugcagaaaugagggaaagagcccuucaacagaauugaaaagaaaaaaaaauagauuuaauuucauaagaaacagcauaaugacuagaaaaucgaaagcucaguguggcgguguaggucugcagacucugcugagaccagcgccaaagagacuucugagccagccugagcuguggagggagacauaguuucaaaacacaacaagaguguuggcauagcaacagucaacaucaguauccgaguugggcacauuauaauuccuggucuuaggugaaaucaaaugucagguugacaguugguaauguguguguguggggggggaauuuguaaaucugaggcuagguucacgccagguuuuuaagucaaaguggugucaguguaauugugacgagguuuuuacucaaaacaaaaaacugaaaaccucauggggcccaguaaaauggaucaguggauaaaggugucugaugucaagccugccgacuugaaugugacaaggagagaacggaguccugcaagauguccucugacugacacauaugggcuucgacucgggcacccugcccccacucuaaguaaauaguuuuuaaaaggugcuuugcacuaaauccagugcugguacaagcauaccaaagcauugguagccagccccucucuagugagucugcccauagacgcagauuucuuucuuucuuucuuucuuucuuucuuucuuucuuucuuucuuucuuucuuuuuuuuuuuuuuuuuuugguuuuuucaagacaggguuucucuguauagcccuggcuguccuggaacucacucuguagccucugccucccgagugcugggauuaaaggcguucaccaucaugcccgacuggcagauuucuuauggguucuaaaguggaugcauuccucuuuccuuugauaaagcaguaagaccuccccauuagcugucagucgacaaaaccauucugcaacccucucagacugugcacagugaggucauucggggugggcuuucugggcacggugcuugggaaguguuuuguugcuuucuguucagaagaauuucuggagccgggcaugguggcgcacgccuuuaaucccagcacucgggaggcagaggcaggcggauuucugaguucgaggccagccuggucuacaaagugaguuccaggacagccaaggcuacacagagaaacccugucucaaaaaaacaaaaaaacaaacaacaacaaaagaauuucugaagaauaaagugcguugaaucccucucucccccuagccugugggcccuggaaaguacguauuugauauuggaugcgaacagcacggugaauaucgccucacagauacgguaaguggacuuguugcaucugcuuucaaggguuaaauaaauaucugcucacucauauugaucccagcagacagcccaacugccaaaguggucaaugucauuucacaauggcuucgggggucagagcuugauuuuguggcugggaacagucuaacccugaguuccggcaggugucagucccagaauggcaucugaacacuguuaaccaucuguaccgacgucagguggcugaucacaaaagucccaaggguggccugcucuuaaagccuaguuaguuaauaaguuccuuugcuacacugagcaugggcguuaauagccgauugcucuucucuguuuggcaacaguguagccauucucaggguacaggauugugugaagggguuguccaugugugagcucuugaugugucaaugccuggcgacugccuggguguaaugagguuuaguaaaaauuuccugguccuaguacuaccucugagccuuugccuuauuccuguuguaagaaguuuuguuuuuguuuguuuuuuuagugacuacggacaauuuuauuagaguuuuuucaaacaaacaaacaaaugccccagggcaagcaagcuguaaaccucagcuguuuuucccagagaaguagaauggaagaaggaaaggaaaaacaauacaaaacaaaaacaaaaguuugagcuaagcuggcauaggccccccccacccccacccccgcgaccccgccaugacaaggaagaagugcuuuagagacagugaggaagcccaagcgaucaagaacaugcguagguucuggcuagcaucucaguucucaagcuguagauugagacuccuucagggggccaacgaaacuuucacaggggccauauaucagcuacccugcaagucagcucucuacaguuacgauucauuacagcagcaaaguuaacaguugugaaguagcaacgaaaauaauuguauggucgagggggaucaccgcaacaugaggaccuguguugaaggguugcggcguuaugaagggugagaaccacugcucuggaaguugaccuuucugagucaggauucagcagagugggcggggccagccuuaccucagcugaaccuaauggcacagccaagcccgggcacagccaagcccuggcacagcccagccccagucagaagcuuuaggagccaggcugagccuggccagagaaaguaucagaaaguaucaaauugugcuuuuuuuuuuuuuuuuuuuuuuuuuucuccuuggucccugaaccagcucccuuccuagugaacuaggaacuggaacuguauuguaagcugacucucccaggacuauccugacuuuccuggugcaguagauaguacuggaccacagaguuuaaucucaggcacaauaaagaggagacuuagcaauaguaauuaauaaaauaaaaugaaacagugauaauguggcaaacaugaguuacaugaauguucucccucucucccucccuccucuccccuucccucccuccccaagguuucugcaaccucaguguuuuguuucuuuucuuuucuuuucuuuucuuuucuuuucuuuucuuuccacuuaaagggagucuccccagcacaucccacaaauguucccagauguuuuggcuuaaaggaaaaguauccaucccucuguccucccacccccaucucaugaggugaaugcuggaaacuguagaaguggggaccuaauuggagaaaccaucagcagggggcgauauuucagggugcugcaucucccuugguccuuuccgauuuguucccaucccuguuucccauggacugugcaguaaacuguuccaccaugacggucugagccucugaaaccuugagucaaauaccccuucccucuuuuaagcuguucccuuagguaguuugucucagcuacgcaaaaggaacuaaaauaccacacauaguaggaccucauuuuuacauggaccaccuaaucuucaaauaauaggucaugcucuaagguccuggggggcuaggacaaggucacaguuuugggaguggggcauaguuuguuucaucacucugagaaggucaacuacaacacucugaggcacacacacacagaguuuauugggaguugaccugaggagggucaacugcggaagaaccaggauuggcuagaaacaggaggugaccagugcugugacgucucugaagcugggaccugccugaaccaggggccgugcagcaggugugggagauggggguggugcagugcugaggcuuugcugaugggagggggggucacauccaugggaggcacccagguucugagcuaucaguuguggauugccagcagcugaaagaagggucacccaccaccuggggaaagucagcuagugccagagcacaugggccccuuuggggauagucucugaguauaguuccuggcucagcagccucaggggucacuugggauccuaugcaaaugaccagucugcaauccugaccuggaaccuacgcaaauuauuaguuucuauucccaacuggccaagugagaagcguguguguuucagagagcauucugagugacucugaugcagggccggcuugguuaccccucuccuugaauacuugucucacccuaugggugaaggcacugagaaccuauggaacgaaaauggaagaauucauuucugagcagccaagcagauguuuggaauucugacuaccucccccagccccuccccccgcacccccuccccacccccgguugucauuuaguaucccagaccaaaugacggcaauacagauggguuuuuuuuugccuuaaaauaggaaagaggagaagaggaggaggaggaagagacauuagugaacaucguuccaaaauggaaagcucucaacaucacagaauuggcccuguggacuccaacccucuccgaggagcagccucccccugagggccaaggccaggaggaaccgcagggacuuacugguacagacaccccaugcuugucagggucgcccuggggcaagcaccauacacaccuguucccaggccugguguagcuggggccucugggaaauggccagugggucaguuggggugcaggauguuauaaggggaugagacucucccagggaguagaggaggagaacaaagaucaacuagauggaagacauguccugcuaagaugcaggccccaggaacccugggggauucucuaauagucagaguuaucgccuggccgugggagugacuuggguugggcagccgacagcaaaugggaucaggugucccuguuggaagaagguugcauuucucuguauccguuuuacuguggcuuugccaagaaagucuggagacaggucagggugaucugauggccaggccugggcuggagcguggggggugggggguggggugggaaagggggccaugcucgaaagcacaggagacauugcugggcaaaccaggaggaccacucgacacacagaccugcacucauguucucuggugaucucauucuaucugccgcugcugucuucaucccaggcgugggugaccccucagaagacauccaggcagaagguuuugagggcgagcuggagccgaggggggccgaugaagacguagacacguucaggcaggagagccaggagaacagcuacgacauagaccaggguaagaaagcacacccuuuggaguuggcggggcuagugugagguaccuuagaaggagcagguuucucccuccucuaccgaacuauccuccggccagucugagggaccugagugagccuggagagaccagcauagauucucauaaaguccagcuugucugcacuugauccugaccucugcagggacuggccuggugugacugguccucuacauuaucccaagagggagaaaacuagacguggcagggaauagucacaucugccaacaugguuuagggggacaaacuggaagcuuaccccucugcgauccaccgagagcagggauuagggcuuguuucaguuggggcuuuauugcugugaagagauaccaugaccgcgauaacgcuuaugaagggaagcguuuaauuggggcaggcuuacaguucagaggcucaguccuuggcaucauggccagaagcauggugacgcacaaggagacaugguacuggagaaggagccaagaguucuacaucuggaugggcaggcagcaugaagagagagagagagagagacacugguacccaugugagcuucugaaggcucaaagccugcccccauuaauucacuuccuccaacaaggccacaccccacuaauaaugccacucccuaugagccuauaaggggcuauuuucuuuuuuaagauuuaguuauuuauuuauuauauguaaguacacuguagcuguuuucagacauaccagaagagggcaucagaucucauuccagauguuugugagcaccaugugguugcuggguuuaggaccuucagaagagcagucagugcucuuaaccacugagcuaucucuucagcccgagggggcauuuucauucaaauuaucacagggcccccuuuaaacuagauuuugauuacaaauuaagagugaacauauuuccuuuuuuaaaaaauauauuauuuauuuauaugagugcacuguagcugucuucagacacaccagaagaagacaucagaucccauuacagaugguugugagccaccaugugguugcuggaaauugaacucaggaccuuugaaagagcagucagugcucuuaacugcugagccaucucucccgcccuauuuccuauucuuaaaaaaaaaaaaaaccugaaacaaaaccaggcaaaacuaguuuucuauguagcucguaggaacgcagagguggccuuaggcucuuccggagauaguugaugugaacaguguaagaacacaccuaagaggcaggguccauugagcaagcucugguggacugcucaccuuucuccucucaucccguaagccgguaagaacgacuccuugaggguacaaugccugcaggaugccgugggcacuuagagcaguggccgcccugaccuuuggaaaagucagcaagucccacugcucauuugcaugcaguuuuagguugcuggcaccugcaguggcggguggagagacaggggugucauccagugccaccccugcccacgauuucacucuagaguauuagggacagucagcacguugcccgaagacaugggacaagaacaggaaguaucuccaggaaaggucaacuccaggugaguggagaggcugagaggcagagagaaaaggcaaaauggagaaugaaacuccagacagcaacacacccuggcauuagggggaguugcggggaggagguggucacaguuuucuccagcauccuuucuugaccuuacauggugggcuuucggacuggaugcucagaucugugguugugacagaggauacuuugagaagcauaagucucaaguugguugcucgagcaccggggguaggguggggggaggaccaguggaagacgaguauccccaaacacuaaugugggaggaagagagggcgggaugggaugaagaugaagaauucuuagaaccagaggagcggaugauggcuggccccugaguaagaggagcuuuagcucaggagcuggucccagggaucugagugccuuugggaaacaaggcuuggcaaggacuaagggcuuaaaaaaaaauugcaauuggggcugggagagauggcucagugguuaagagcacugauuuccagagguccugaguucaauucccaacaaccacaugguggcucacaaccaucuguaaugagaucugaugcccucuucuggugugucuaaagauagaaacagcaaauucacacauauaagauaaauaagucuuuuuuuuuuuuuuuuuuugguuuuucaagacaagguuucuuuguauaguccuggcuguccuggaacucacucuguagaccaggcuggccucgaacucagaaauucaccugccucugccucccaaguguugggauuaaaggcgugcaccaccacaucugucaaauaaaucuuuuuaaaaaauauuuauuuauuuuauguauaugaguacacuguagcuauacagaugguugugagccaccaugugguugccgggauuugaacucagaaucuucagagagcagucagugcucuuaacugcugagccaucucaccagcucccaaauaaauaauucuuuuuuguuuguuuguuuguuuguuuguuuucgagacaggguuucucuguauagcccuggcuguucuggaacucacuucguagaccaggcuggccucgaacucagaaauccgccugccucugccucccaaaugcuagaauuaaaggcgugugccaccacugcccggcgcuaguauacuuuuauugauagugagccuggcucuuaauucuuuuaaaaagagucuucagcauuuuuuuuauuuuuauuuuuuuagugugugugugguuuuuuuugcuuguuuccaucauuuuuauguuauuuuuucugguguuuucuuuucuuuccaggaaacuugaacuuugaugaagaaccgucagaccuccaggauuaagauaguggaggcagaagaccacagacacaccaggcgugccuuaguuaacaccagucagcuagggcugguauccaccaccugucaaucucucucucuuagcuguuaaguuguuuuuucgguuaacaaaauaaaucuccagguguucaguguugacaaau

SEQ ID NO: 8513 - RNA, 90078 nt, Mus musculus
cggcggccgcggcgagaaaguaaggugaaaaaguccaagugcagcugcgggcgcgaugggggccggcuccucaagcuaccggcccaaggccaucuaccuagacaucgauggacgcauccagaagguaccccgaucccccucccuccgaggccuccgugcgcccuaauaggcgcagguguccccaccgcgggcucggagcccacggaucaagcugaucuuggcggcucgccccgggagguacggcagccugcggugcagacccgcggggccgguuccagguggagggugacagucuugagggggauccugccucugcacccuguggccucgcggcgacugaagggacccgcuuuugacugugccguacgcuguccucccaaccaacuugagccacguaggagugcgguucgccacagacccuuuuuguucauggcccuccccagcccuucuaaagacccuucucugggcacagagugcccuugacuucuguugauuuugacaaagggacaaugggcaagcuggccuggaggacgguuggggaagggggugucucauuagcuccuccuaaagugccuauggaaacgccuuuuuuuguggggggaaauugcacccggacaucucaggaaagucgggcagcuugcuguggacucagcaaaggaagcuaaggaggguugccugcugggugugggcccuccuuucucaggugugcgcucucuuagcuagcuggcugguuugcuuccccaguaggagaaaccuaccuuccucagccugauccugggaaaaugggaagucccaucccuccuccaaggugggcccuuugauaggcucggugacuugggguggccugagaggcaccuucaagcaucacugcucagcuucuuacuuaagcaggaagggcaggugcaggcucugacuccaaaggcacaacuacagagauuuaacagccgccccuuccagaggaaggaagggcucuccuugugugucuuccugcuucaguccacacgagcacagauguguucaugcauguaugcacaguguguauacaaagcacauaucuguacacauacauuucccccaucccacuaaaugagaauuuauuaaagcuuuuuguuuuguuuuaauuuuggcgcaagggaugggcuucaugcauaugaggcaaacucuuugucauuaagccauauugcuggacuucuuugagcucuuuaaagaggaaagagaaggugucaccuguucggcagugguagguccuuccuaaauucuccucaaagguccucaaagagcugcucagcaaugcacggaaaguagaagaaagguuuaggcccuccugaucagacuggucugucacuguggggaaggugggcuuuuccaguggacauaccugaacuuggguaaucucuggaaaggucaccuauaagccaagccugggauggguggggacagguaccuacacuaggcuagaaagacauagcccuggguggaggcagaccugaugugggugcuggcucugcaguucugggcuccucuggcuggcauuccucucugugaugggaucgucguaucuguuuuauagacuguaaugagaguaaaugggagauagaaacagugccuggaacauugcagaacacaagaggcauuauucuccucucagucucugucuguucauaaacaucuuuguacucacaccaggaaggagaggcugguggagcaagcggggccuccacccugucacuguggucagcucaucacugauccugggcacucugucuuuagcacugggugcugaggugaaccuuuccccuagugacagccaagucuucggguuucucugugucuguguccuuuucuuagacuccacacccugcaccccugcaccccugcacccauccauauugaagggcccuuguacaccagugcaaauguuuccucuuccuaggugcugggcacaucugaaaguucccagcgugcaacuguuccugguuugcauuuacucacuccaucuccucuccgugggaggucaagaagccagccacuauugcuuccccagagaaggcuugggauguuauaaggcuauacguugcuuucuaucaucguggugaggagcuugcccauggcuccugccaacuccuggucaucacugcuucaggcagacaaggcuuuugccaguguuugccugcccggcaaagcucagggagaagacuccaggcccucuuggucguaccagggugggacucaaagggaccagugugagcugcuuggugcugcuuuuuauguauggagacaauuccagaugcacccagcgcccagcuuucuucaacagggaugacagcaagaauuuuuuuugggggggguggauucuagcuucuaucgcuggggcauuucauguacaagauaggagagccccaaggacuugcccuccuaaacccuacguaaaaucuguaggguccuuagguggguggacaccaugcguccucagggucucacuuccagggaccuucacuucccaucuugcuuagguuaguugcugcgucuguuuucucagcugugaagugaggguaggggugggcaugcaguccagguagccagagagccacacacgcccuaaaguuggauguuggagguuagggaccagcaaaauggagauacucaagguacugcauuagccuguaugagccaucacugccccucugaccuggggauggcaggcucaccaaugguagguacuguaaguuauuuccagguggcuaacauguuacagaaggacauaacagggucuguauuacugaugggaccucauggauuggcguccuuccuuuguaaagauagggaaggcucccaucauguagacccagaagccuuuaggguauacuggguuaaagucuuccaaguggccaaggggcaguguggcccuacauuacugucccacuguuccuaggcucgccaggaugcacagaugagaaccaagagacccucaaggaagcuguuaaagaagcagggaguuggggcccgggugugcucucuagagaggaggccuccucugucuuugcucugagaaaucucuaugcccuuucuuaguuuucuacuugagggggaggggagguucauacccccagaccucaguacuugguccuuuaucuugucugcagaggacgagaacacugagcauucccacuuagggaugacaacuaugaggcacuuuaaaccagggagccagagagccccugccugguagcuucaccagaucuggguuugcagacuugggggggggagcauaagaggccuuugggggggccucaggccaacuggccuuggguugguugaaaagccaguggcugagcaagggggaugcuuggaagccuuuguuggagccuggcccugggcccuggucugguaaugccucuccuuaagcugccuguggcuuuguuccagcccaucucugcagcuggaacccuggucuuacuauggaaacagccacuugaguuuugcugagcuguuucuguuugaaaugggaaaagccacaggcagggcacaguagcagcaugaagaagcuggucaguaccccugguuuagaaauggucugucucuggggauguggcugccuggccuuuguccugccagagugcagagcucaaggugccaaggccugcuuggggcuuggcaccacacuccugggcuccaccuaccugguccuuuaugggccugacaggcucucaccugcugucuccacaaugaagguuuccuccuuggugcagcuccccucugcacugagaguccuccguccugccugcugggucgcucacugggucgcucacugggacugugguucucugcucucugcuucucuagcauccucugcccugccuaggccuuuuccagcuguccagggcccucgggaacucagccuucauuccgagccuguggcuccaucucuuuggugguuccaccuucugcuguuugaaggauguaccugcuucagcuuggcccugugguaagcauugggccaccuacaguguccccugguucugacuguccuauccuuccccaggauagucucucuugcccuuucacuuuggaacaggugggccugcccauccagacacacaguggcugucuugcuacugucugauccuccucucucucucucucucucucucucucucucucucucucaagauuuauuuauuuuauuuauaugaguacacuguagcugucuucagacaaaccagaagaggguaucagaucccaugacagaugguuaugagccaccaugugguugcuaggaauugaacucaggaccucuggaagagcagucagugcucuuaaccgcugagccaucucuccagccccucaucuucucuuacucauauccgcuguccucucccucaucagagcagguccaguggcuccccuuggcucguccuuagcaguugcagaacaacccacguguuucccuaugcuauguuucuaucuuagacucucuaaacagauaacaggcacagcaccuugagugcagugagccagaagaagagggguguccucgucuuucaggggcccagugcgaggcuagggaaggaguagaggccauauggauggccagcucugugucuauccugaccacuggccugagauagcccucugggucucugccaggaucaaaccuagcugugaagauaagcaagaucaccucaguguucaguuucuuuugcaauaagcaaacugcuguuaagggccucaugggaccacaguaggagcauccuaaggggacauuggaaggucacugagaaagguccugguccagucccuggccccuucuucugugcccagcuuugaucugaggcuccucuuuuuuuuuuuaauuggauauuuucuucauuuacauuucaaaugcuaucccaaaaguccccuaugccgucuccccgccaccccccacccccgcccugcuccccuacccacucacucccacuucuuggcccuagcuuuccccuguacuggggcauauaaaguuugcaagaccaaggggccucucuccccaaugauggccaauuaggccaucuucugcuacacaugcagcuagagacaugagcucuggggguacugauuaguuucauauuguuguuccaccuauaggguugcagaccccuucauaucauuucucuagcuccuccauugggggcccuguguuccauccuauagaugacugugagcaucgacuucuguauuugccaggcacuggcaaagccugaggcuccucuuaagccaaacauucccaaugaccuuugaucucuagggggugcuacaggcuccaacccagccugcugcugucagaggugacugcugauaaacugcagcccucuggaaacauugguguugcccuguggcacaaagagauggcucugcucuugaugguuacagagcagugucccuggucccuugcagcauuugauucugcucuugccgacugggaggugguguccuacuuugguuucugcagcugugacaaacaccaugaccaaaaaaacaacuuagaaaggaaaggauucauuuggcuuaugcuucgggucacaguccaucuccgagggaagucuuggcagaaacugaaauugaaaacuauggagaaauguggcuuacuggcucaccuacccugguuuauguucugccuucugagugcugggauuaaaggcguaccccaccacacccaacucugcuuacuuucuuauauaguccaggccuuucuguccauggcacugcucauggugggcugggaccuccuacuucaaaucaacaaucaaagcaauucccccauagagauggauacaggccaaucugaucugguagucccuugagacucucuucccaggggacucuugguggugucagguugacagugaaaaccaggacaaagcugggcagugguagcacaugccuuuaaucccagcacucagaaggcagaacauaaaccaggguaggugagccaguaagccgcauuucuccauaguuuucaauuucaguuccugccaagacuucccucggagauggacugugacacgaagguaagccaaaugaauccuuuccuuuucaaguuguuuuuuggucauggcguuugucacagccgcagagugaguucuaggacagccagggcuacacagagaaacccugucucccccccagccccccaaaaaaccuaaccaggacagaugugaaaaucauuuucuucucuggagaagugggaagguggugacagucccacaaagggacuaugcagaggcuggugacucuuggggcagguggagaccugaggaacuaggugauguccaacugcucuuugggccuaagugaccuuucacacccugagaccuggcaagguugaggucccagaggaagcuguggcacagccuggcucucacaauucuccccaagccacugaguuugccccaaaguagccacaaacagaaagacaggaccaaagacccugcacuccagacacuuccauaucugacuuacagaagccacaccuauugggacuaauucaugcccagagucaaaggggccagagaccucgccagacugcauuccaggugaaggcccaucuggccucagaaauguguaaaacacaacucuggucacugguggagucccucaagaguguaggaaagguaugcccaguggaacugacacuaaaccagagaugaugcugggacaggucucagugccagcaaugggagcaccucggggcauccuggcugaacucugcccagaugacugacugaguagcagauauaugccauaguaucccucacuucacaagaaagcccccucccauccggucaaucaggcugccgguaagccagcaagcugcacucccugagagauggggugggggugggguaagagggcugauaggacugacugagucaccagagaaacaccuccuucagggucccugcuccauuucaagaccugcccugagcacaggggcuucagccucccaguagucuagccacagccuggcaaugccgcccacagaaacugugcucugcggccugaccgacuccuagggucugagaagugaucaugaccucugacagcccacgguguugcaucuccugcgugugcaucugcauacccugagcgcaggucgcugguguucaugcuggaagcaccggagugugcaguuguauauaaccucucugucucacccugcacaccucuaggccucuucuccagucacacgcugggaccuucugccccaaacagaaacucccugcagcuguuauucuuugcccuuuaaaccugcugucuaauuuguuucuaauugugauaaacuauauguaacauuguuaaaugcauggcucagcaguccuaccuugccucucagugcccuguggccagcacuucagucuucuagcacuuucucuagcagaaaagcagcuuggucucuguaaaacauggacucuguaccaugucugggcccugguacccucucucuauauccagucuccaugacuggauggcacuguggaggccagcuaggaagacagccccgccaaaggcauggguagaauaagacacacagaccuaguaucccuggcugugggcuucagguucauuuguguguguguguguguguguguguguguguguguguguguguguguguguguguguguuguggguugaaagcauugcccaagagcugagugaugguucuacgagcaaagccaacuuggcagugaaagggacuguguggaagcaagauuuccacucuaccacacugccaccuggccccuugacaaguucccagucccuugcugacagccucgugggacuggccagccuuucaugggccuuugggaaaacagagcccaccuguagagugguggaaguagagaaucuguuuggcccaggauucuggcauggugggcaggcuguuccuccaaaguaguuugagcugagagucuagaagucaccacaagaaguguccaaggguagccacauggauccguuuauagucagguagccagcagcauacagcugauuuuguuuguuuguuuguuuguuuugauuaagcaaucauugguguugaccaguuacucaggcugucucccaugaugccuuucucugcaguuguuucucuagucucaaacacagccagaagaguggcacguuuggcauuacugcuuagugggcuucagugugucucagccuggaacucacauuccuaaggagcccaugacccggaaggcuggguuucaggacacagccccaggcugcugcucauggagcaaugucaugccaguccugaguggcugaaucaaagcuuaagcugugguuaaaggcucaaaaagaacugacugugugcucuuggaaacaucugagacucacuuugagagccgagggugccaccauugcuaaaggacaggaaagucacagcuuagagucuggcuauggagcuagcugggagucuguaucgauuacuuuuccguugcugugacaaaauaccaaggccaaagcaacuuuauagaaagaaggguuuauuuggcuuacaaguccagagcuaagaguccauuguggagaagaggcauggccggggagcagcaggcaugguagcaggagcuagaugccauucacaccuggaacuaguucacgccuggaacugcaagccugaagcuagugguagcaaugaagaaccauaaacucuaaaagccacccuauuggcauacucccuccauugguuccaccaacuggggaucaaguauuuaaacacccuagacaguggaugacaucuuauucgaacagccacagucuaugggacaaguucuccccugggccccugugucuaggcugagucccucaaagccagugugggaggugauguugucugugucaucaucgcuaaggugaaugaugaacuagucacuaguucagcaacuccaggugcagggaggagccuccagaggcagcauggggggaaucagucacauuucggcuauaaugacagaauaccaugaccaaagcagcuuagaggagaaaggggacuugucuuacugaacagggggcuucaguauagaaagggaguccuggagguugaaguuccaaggucauagugucucaagcaaggcugguuccucccgaggccucuuuccuuggcuugcaggcaauaucgucccggguccuucuguaugugugcgucugugcccugcucgccuccuggaagguuaccaguugugguagaucucuccaacauucucaccacuacagcugugacucccaucaccuugugaagcccuugucucuggaacucagucuaaaaugcagggcguccagggguuugagggagacacaguccagcccccagggucucuuuggagagguagaaacaaguaccucccugacaaucucccagcuucuggaguccuaagugacaaaaagaaaggaauggacacaggucaccagggauauuaugaugaccccaagccucccaucugugguggcuucucugcuaucauguagcccaggcugcccaucugcuaucuuguagcccaggcugcccaucugcuaucuuguagcccaggcugcccaucugcuaucuuguaguccaggcugcuuaugccuguuucucccuauacugagacagaugccuucccacucaggacuucuuucuacauacacucaccucaccacccucuuggcucacagaaggccagauaagggaaaugcaaagaccuagaauguuuacagccaaaaagguucuaaggagcccccacccacccacccacccccagaugccuacuagccuauugggccuaacuauucagauaccaaaucuguagaggagggguguuauccauugguaucaaaagggagagauggugaagcuccuggcagguagaacagagggaccaguguggacaugguccuuagcuggauggauggguagagcacaguacuuuaaggggaauuuaaauuacacugaaagcaacacauacuaacccugucuauaugggcguagggugacauuugaggaacccaggccacgaagccaucacuagucccccucuagaaggaaagcucuaccuguuuaauccuccugcugcuucucugaccaagggacucaugaagacugucugucucuguuucugggcucauugaauaaacagcgccucccuccuguggguccaguggaagcucucuccuuaucacucccacuggaacuaguaauggcaggauuuaugacugccugucuuccccagcuuucuaucacgguuucuaaggaggaaaguuucuagagguuuucaucaugaccauugagcaccaucacuuuggcccauggggagaucggacaugacggugagcaucuugugguaggguagaguugcucuccuucuggagggcaggaagcagagaacgggccgagaagaggcugaguccaaguguccauucaggggcauaucacagguaaccuuccaccaaugagguuacaucugcugaagguucugcuaccucucaaugccuuuaucagcuggagacaagccuuuagcuggugggaaauacugaaaagccauagcguggccugaggucucaaugcucucugcugagucuuggguugaggagagcugcaaaggauucucucaagaauucucccaguuucuucauacugcuccguucucaggugccgucuugaagccaggauucuaggggcaaccugguggaagaaggacaccagauugucacuaggaaagccccagcaauguccccccacaaaccaguccugugcccugagcucugcagagcacguuucuuggucuuuugaucuccuuuucucucuuucuaguuagcuccugugauucauuauuuauagcgguggcauuggcuucagacacuaaaaguguuaaaaaaaaaaaaaaggcaaagugacccagagcuuugacaagagagacaaguguagcaaacaugacagaccaacccaagcagaggauccugagacaagcagggcaggcagagacacaaguccuggagucugcuggcagccaggcaaccugggaagcuggaggagguucagcaggucagaguggccuugcccagcuucacaaaaugggauccccauagacaccaggcucuuuucuuucuuucuuucuuucuuucuuucuuucuuucuuucuuucuuucuuucuuucuuucuuccuuccuuccuuucuuucuuucuuucuuucuuuuaauuagguauuuacuucauuuacauuucaaaugcuaucccaaaagucccccagacccucccccccuccccuacccauccacucccacuucuuggcccuggacaccaggcucuucuacuggagagaguuuugggguuguagcucaucagagagauggguguaacaucugccuguuagcauugucugaugcucccaacucgaauguuuuccuggauaauagaaugucgaaugcauaguacacacucuguuuggugaaagaauacacacccauuugucucagucagggcuucuauuccugcacaaacaucaugaccaaguagcaagcuggggaggaaaggguuuauucagcuuacacuuccacacugcuguucaucaccaaaggaagucaggacuggaacucacccacgguaggaacauggaggcaggagcugaugcagaguccauggagggauguuacuuacuggcuugcuuccccugccuugcucagcuugcuuucuuauagaacaagaggacuaccagcccagggauggcaccaccuacaauaggcccuccuauccuugaucacuaauugagaaaaugccuuacagcugaaucucauggagacauuuccucaagggaggcuccuuucucugugauaacuccagccugugucaaguugacacacaaaaccggccaguacaccauugucccaagcucagggucagagcugacaugggaccagaaacucugacgcuagacuccuuuugcaguguaauugggucuuucuaggcugauguauuccccaagcuccaaccucuuggccucagggaugaaguuggaaacagguggaguuggcguuguucccacccugggaguaggaaagucuugguacacuaccucagaacuaugauuuccaucaacuagauggugugguuuggauaugaguauucaaagacccauguguuggagcuuggucuccagccugggacaacauugggagguggagggaucaucaggagauggagucuaauggggguacuuagggcauuggaguugugugcucucaaaggagauguugggaacuggcgcccuccucuuucuuccuuucaugucauuucuauaaggcaagcaaugauguauuucacugccccgcaaggaugcugccuuacugcuggccaacugcaaacuagaaccacuaaacuacaaggcaaaccauacauccccuucguaagcugacuguccuggcucuuugcuccaggaagggaaaguuggcucacacaguggccuaucugggucucucguuucaugaucucucuagggacaggggguuggggaggagggcaggauaucuagggcuggguauaugcugaacaucagcuucucauguaggcagcucuggacuuggcuguucuccuucaugcgcucaaugcgcugugggcucguucagcucacagcugcccuugcaggagucgcugaaucccacguccuguaggacaucacucugucuauagauugcccuucauuucuuucccuugcccuugaugugugacuuugggaaaauuauuuaacucucugggccuuggagucugcaaaauaagaguauccacuccagauggguguuuuagguaucagaaguaccacacguuucaguaaauggugaaaagaggguacugucaccaccccugucuaggagacaucgguuuccacacuagggccugaccagggcagauugcuguuagcuuucuucugugcacuuaucauguuguguuugucuuaauaagcaacccuuacauuuagaguuguaccaugaaacacaggggaaagguaaugucggccgugagcuuggcggucaggccauuggacagcgaggcuaagcagugguggggccagagggcagaugcuggaacccguggggccgggaguggggagcugcagcugagucucaccuccuuccacuucagcacaccugugaucuugccccuagaaccaagcaccccuccuccagagauaauuucaguaauaggucuggcacgcaguaauaaauggaaauuucuguuaucauuucauacucuuuuucaaacgcaaugaccagaaaaauaucuccugcauuagaaagggaaaugaggccuaauacaguuuuuauuuuagcaaacaaaacagcaugauuugccugcugguuagcuguaaccaucuuagauaugacaucauugcuaagcacuccaaaguaugagacagcgcaggaagaauggagugcugaaauuuacauguagaauuuauaauugggggugaaaaaucaaacguggaugggcgguggguagguggauggauggguagacggaugugucaugggauagauguaagguggcugaugcuagguaggugaauagauaagcaguguaaggcuaguuggugaauggaugguuggauagaugguagaccagauggauaagcgguaggcaaugacuaaguggguggauggagauauagguguuaguguagauagugaguggguagaugggugggugguagaauggauaauggggaguuagaugaauggaugauggggacuuggaugaaugguggaugauguggaauggaugaaucgaugagugaaugaaaggauagagagacagauaagguugaugauggacagagauggacaggagaguuagugaauagaugacgcauggaugggcagauggauaauggauaaauggauuacagagagauaggcguuaagacagguaagcgggugggcagauggguggacagacaauacauagauagcuugcaaugucuucuuugguaaacauguuauuuggggauagaauaugcaguuuugguacuggucucgauauuaaauacuuucguguuaaacacuuguaucucaggcacuguaaaggcaguagaacauaugcacacgcacgcacacagacacacacacacagacacagacacacacacacacacacacacacacacacacaccuuuuaauccauccaaaaaugugaaggcaacgccccugugcuggaguuggguguucuggaaaguggcccagcugguuuucacucacccagcaaccagccugagaggcuccggcagcuuuggggaugggcaaagcccaacaaucccacagaggcuuauguaaaggcuuaauagcuggcaaaagcuuuagaaaaugaaucagucugugauggacaaaguaaaagggccaugaauugguuuguucuccacggaggaaggagcuaaaucaauacucacuccgaggauguagcguuaaauaccagcagucgagagucaggcagaccugaacccuacccuggcugggauaucguggcacagaacugggagaccccuucugucccauggagagcaacugaaccagcuuuagacaccaccggugaucuggcaucccgggcucggagacaugcaacucaggcuugcaucaggaccaguaccuacuccauccuuccgugccuacaucuguccagcugauaauauuaggcuccugagguccacuucuccaucucuggcuugagaacugucucugccccaauagcucuugauaauaauggccguggcaauguugauagaacuauuaaaauacagcauaaaaccaagggacauaaaaugugcccuagugguccucauugagaguuggagcuuggaggcuggcaggaccuauacccugugcacaugccuaugggcuucucuaggccugugggaaggaacuccccgucuagagcgugcuugcuaaacuaggggagaccucaacccuccuggagggagcucagacugguugcucaccugccaccauuggaauauugcugacucugucaugguuuuuacuaagcccuucugucuuccagcaucugcugcccuuaggacacacugggacacagugacucgucaguagaggucagugggccacuuaggccaaggacagacuuguugacagaauucuggagcuggccuucuuuugccccacacugguggaaacuuccagaaauccuagccggcaggcugaggccacauguccuuguugucuguugcuuaugaaaugguuuuucucuuccccccuuccccuuuucccuuuugcuccagcacauagggguuuuuuuguuguuguuguuguuuugguuugguuuguuuuuauuuguaucucauuauggaugguugugagccacuaugugguugcugggacuugaacucaugaccuccugaagagcagucuuaaccgcugugccaucguaccagcccgugaaauggucuuugagaugcugagauaccuggguuuaagugacccuuccuguagucacaguugccacuccaccagcuguucaguugcuauguaaagcucugauccacacgggugaguucucacagcaugccuguagccaagguaggauggucuucgcuuuccaucuggagaaucagagccuuagcaggacucagacaucugcgcuacucaagccuuccugaauccaugugccggauuucucucgccuugcuuuacugccauacauguacuugaaccagugcacaaccccagcaccugagcagagcaauccuggggauccgagacaaccaggagagcacaagcuauagccaguccugggccugcuaagguggggcacagccagccacaggcacucagaagucucugcuuguagacuguccuugcugccagggucucacccuccucagcccuaauggcugggaaguguagggcagaagggcuauacuucaguuuccaaaacugacccauuuucuuuucacaggcuuguacacaggccuaauauuuaaagcagauauaggccauuaagcaccaugucugaaauaucacuuauuuugcaagccauguuucuagcacuuaguauaguauuaucggcaauaaggaagggcauguguggccuuguguuuggaauugggggcccagguggcaacuguaggcuccugucagccuuggggucacuuugccuucaugcauugugucauggcagcucucaaauuaagacaauccccuguuuggacuaagaugauccuggcuguuuagcuucuucaggccuggagaggccugaauaccuguggacaguggccugugacucaccaggagagucaccugggacacucgggucucuggaauauugaagaugugggagcuccugagguguggacucacagggcucccucucugaauucaguucgaccauuaggaacaccuuguugcacccuuuggucugcacgcccuugaggucacuaggcaugcacacucucaaggcccgcagucuuuguaaaacggugcucagacccugcuugccucccuaaagaaccuccaacccugcuuuggagucugugccuuccgaugccucucuucccuucugauuuucucugggucccuccugcucauacauacagucuccaugcccagccauaugcuauuuaagucccaaccuccauccucugguugacugcuuaauuuucuuuuguucuuggcuuugcgccaaggaauuuucgcuccgaauaaaaauggagaagaaagacccucucuccucacuugagauuuuuuuuaauacacauacagagccucuuacucacagcugccccuucaucagagacuggccucggcuuugggagcgaguucuccuugguuauaaaaagccaccguguauuuaugacagaagacuggagauaugcagaggauuaucagaaugaaaagaaaagaaaccauuauccuaccgccccaagagccucuguugcuaccucaggaccuaggcugcagggugcucaugcaggugugcaugcaugcaugugugucuuucuuuuucuacacagccucccaucagcaacuuucccacuguugccuuaaacggcuuucagaggaaccguuugaacgcauuuguagcguucugucuggagaugcacucaauugaaaccauuccacuguuuaugagacccauaugguuuuguuuuuuuuuggggggggguuguuuguuugguugguugguuuugguuuuuucgagucaggguugcucuguguagcccugacuguccuggcacucacucuguagaccaggcuggccuugaacucagaaauccacucgccucugccucccgagugcugggauuaaaggcgugcaucaccaaugcccugcccauaugguuuucauuccauguguuugugguaaacgguaccagaggaacuuccccaacagcuggcgaugugcugugccgagcagugggaugguugcaaauccaggagguggccugguuugcugggacagugggugagcuaaucggcgggcugucccagaaugaugucuggccagcaugaggucaaugcuuuuauuuuacuauugcuguuauuucucccuggcagugggauucugagucaaaggccgugcgccuuaccuaacggcucuccucuaggguugcacggagacccguuccuuagcuggccauccuccauaacaccucagaacccauauguaguguuacccccauucucaaggacuaugguggcuucauauguaguguuacccccauucuugaagacuauggugacuuuauaagacgcuguagagagagcgcagugggaucaggguuccugcauucaguuucccagcauggcaucuuacacccccccccccacacacacacacacuaacacacccuaggcgccaagagugucaugguucacguaggggauuugggcucuccucauuccuggacccgauuuguuccauacauaucaccuccugugccagguucacuucucagccacuauaacacccgucaccucagggcaucccuagccuagaacccacugcuugcugcccucaccccacccauucccauccaaguacagaacaaaugucugcuccccuugagauaggcacugaugacuggcugaaggaccgauuccauccaaguccagccucacauggcauagugugggugaccccaaagcagucauaugacggaaagucucacccagcauggaugacaacuuccccauagcugcuuggcagagcccccaccucaguuaacccucuaccuccuguguacucuagcccccguuuacagcaggcccagcuacagcacaggaaggggcaagcucaccacugagggucuaaugaccuuccuggcuuucuauaagucuuuuuuuuuuaaugauacuugagguuggccucugacuuuuuuuuuuuuuugaaaaaaggauuuauuuaucuuauuuuauguauaugaguauacugugagccuucaugugguuguugggaauugaauuuuuaggaccucugcuugcuccagucaaccccacucccucauuggccccgcuugcuccugucaacccugcucaauuuggucggcccugcuggcuucagcccaaagauuuauuuauuauuauacauaaguacacuguagcugucuucagaugcaccagaaaagggugucagaucucauuagggguaguugugaccaccauaggguugcugggauuugaacucaggaccucuggaagaacagucagugcucuuaaccgcuaagccaucucuccagaccucuauaagagucuuaauaggcuagaucuaaaagguuccuugugauuacagcugcccugauuuaaaggcccuaaggccaugacagucuuggagaacaauguucuacaggacaggguguagggauaacauaugacaguugccccagaaagcacuggguuguucccaccaggagaccugcccuuuacuuuuguuaccaauucaauugucauuaguauuugcuuugaucccuuggggccaguaugguugacuucugaccccauuaccucccaaugcuagcuugacacagaggcucaaugaacaccaccaucaaguuaagagaacaaacggguaagacuguucaaaugaucugagauucgagggucuguggguagggguggggcugagguagaggaccgugggaaucgagcagcaggagaaauggccacuguaggguccuagcacccugagcugucguccuccacaguagcugugaagcugcugaggggguuggggcagagacugcagagcuccuagcaagagggguuuacuggagauuuguuacucugaguucaaagagacuuggugaaacauuguuguuaaggcaauugacugaaaaacucuaccaucagggcuccgguaacuaugaggcaugaaaagcuguauguuuuccagcagcuaacuccucagugggaccugcccagcauggauuuggaaaaaaaaaaaaaaaaguuuugaaagguagcaggggcuuucagugaaacucaugucacccagauucccagccagccuugcaggauggugugucuuaauggagcggagcuggaccacagaggaaguucccaggcacugcagcucccuggaggguugggggggggggggggaggcgcuugcuguggggcugcugcuaagacuuaagcuugguuuggguuuuucuucccagccugucaagucaacccaaaccucaguugcuguuugauuaucgaacuugccccagagccugggagaauuuccuaacuuuaguaccacacagggccauguuuugaaacccaguuuuugguggucacuggcuuaaggccaaucuguguaagccgaccacagaacugcuacaugguguggcuaaggggaagguuuauauauauauagccuauauauauauuauagguuauauauauauauauauagagagagaggggggguggagacagagacggagauggagacggagauggaaacagacagagacagagaggagacagagacagagagggggagagacagagucagagauagagaagagacagagagagagagagagaaaacgaacauccagaagauucugaaaguguccauuagcagagagacgaagaaguagacugaacacguccuaggcuaucuuugagauaaugaagaaucgcaggggacagagaauaaaguaccaggaggaggaguggagaauagaacacuagcaagaccuucagguagcaagaguagcaggcaggagagaaggcccgggagacugguguggugucucugagcuguauaacuugcuugugcuugugaguugggacggagggaaccuggaggcuagccagcauggaccuagacaugccccagguauaguucauuggagagccaugugucuccggaguuugcuggaggugagggacgugacuccuuugaugaaacucagcuuuacaaguuccugaggaauguuggcuuuuaucuaaccaccagaaacuccccccacccccaccccauaaggggcuaagcuccuugcuggaaauugggacugccuucuggaguuuggggaacuggaguuuccuuuggaccugacacaaaacaagcgucuucuaggcccagcaagacacaugcauagaaguuucagggaagugcuucagguagacaugcagagagaugagcagcucugugaucccucgggguaagggaguucacgaaggagccaccagcagaagugugccaggcaagaggcuggcugcugugccccugguccccucucuaugggauucuggcucuuccacacaggcuccuaauugcucggaagaggggacagucacagcugccguggcagccauuuuuagaauaaauggaaccuggauaucaggauagagaucacagcaaagucucuuugugucuggaacccaaaugcaagcuaacauaccacguuugcucaugcgccagugggggcuucuucccaucagcucuccaaacagcuacugugagcugcacgccuuggagccagccuggcuuccagaaaucuccuuuaggguagauugcugucuagcacuacuugguuaagaaggcaaccaagcgugccuuuaaucccaucacuggggaguuugaggcaggaggauuacuuuugaguuuaaggucagcuuguucugcagugaguuccaggccaacuagagcuuacccuuuguagcuuacccugcuacaaaaacugaggcgguggcgggggucggggguggggguuaggaauuaaaacuaguucuucauaaacguuuuaagaaguuauaugaauauguggauuuuuagcguucauuuuacauuuaugcugcaaaaauccaaaccugauccuuuuacagguggggcuuacagguuagcuuugggcaucaccugagcaccuacccaguaccuaacccagagaaggcuugaccuccaacccacccaccaugggcaagacacugagucugcucauaggugcuuuggaccaggacacaagugaaagcuccgagugggauccagaggcccuuccgguagggcgagggcuggaagggucaggguuggagucugauuccugguccuuaaaaccuaggccugucaagucagccaguuccccuggugugacaugcugguuaucugagggacggugucuuaguuaggguuucuagugcugggaagagucacugugaccacagcaacucuuauaaaggaaaacguuuaacuggggcuggcuuacaauucagugauuuaguccauugucaucauggcgggaagcaugguggcaugcagguagaugugguccuggagaaagagcugagaguucuacaucugggucagcaggaagcaggaagagagaaagacgcugagccuggcuugagcuucugaaaccucaaagcccacccccagugacacacuuccuccaauaagaccacacccacucccaacaaggccacaccucaagugucuuaggaaaacuuaccugaaauagugugaaggcuccgcacuacccccaacccucccagcccccaaccccaggcucagucccaucagcauaaugaugggacggggucaccaggaaccagggcuaaggcuccaggggacauaucuagagagugcuuguugaaaggggaccccgugccugguuaccguggcucuccaagucuugcuucucuaaucuuuuggaagaaggcauacaaagagauguuuaucagaaagucucuaccagugacucucaaccugugggucuugcucguccccuuugacaaaccucugccuccaagaauacuuuugugaugauucauaacaggagcugacucacaauuaugaaguagcaaugaaaauaacuuuaugguugggggucacaacaacuugaggaacuacauuaaagggucaaagcauuaggaagguugagaaccacuagccucuacccagccaagcugacagggccaaugauuuccaguuagcccaagcccugacccucucccccuugcuuucuuauacucccaagaggcugugcagcccaagaaucacugagcugggccaaaacaucuauucaaagccacaggggcuccaccauacacagcuuuguccauccuugaaugauaguuugccaggucaagaguagcuccuccccaaggaagcugugggcccugaggagauccacucacccccagaaaucccucagggaguacacuauuaucucaccaaaauacaaccgggugcugcacaaucauguggcuggaagauacucugguugcauuuggcaacucagagacccuuggagacuugagucucauggguaaccgagaugguaugauauuccuccacacgguguucagccagccgugcuuccgugguucauuccugguguuuuccuuugccuucuguucacuacuucccagagagaccaggggcgcccugguucuguugacccauuuacagaaugguaaacugaggguccuguggcugcagccuugcuuacaguauacaagagcaucuaauguggagagaaggugauucaggcuggggauccagcccugugccuauaaccagguccacagcagggggcugacuuaaauacaggcauaaguaaccagggucaguauauaccuugccaggguauacccucaaggucagguggccugagaugaaaccuugacccuggcuggacccaagggagcacacacaugccuggguaccuguuucuuugcuccacucuuuggauugugcucagcuucugccaacucugggcaacauggagacuggggugaggaggggcugcuggaugcugcugcuaugugacagucacaguucucagcugagguagagaagaaccaauucacagugagaagaagcucucugcuuccucgucauuucucuuguccagguuuuaacaucacagugcugaccauucagccucauguaagacuucggggugguuuuuccaugcuugccuaugagccccagccccggucugucuccggaagcuggaaggcacuaugaaugccuguggaucuggcugccuugguaucuuguuuaaaucucaacuucaauuuccuugugcugucuguuucugaguaaggaacaaagggucuagaaaauuacucaacauguaguuucuuuccugugcccuuucucacgaggcugucugaggcucccacggccacacacugcagccagcuggucuugguagucagagacaguugguccaagcuggaugucuccugacucuaaccaucccagcauccugcccucuggcuucucccaacucacacucuccuggcuuuagccccacuggagacuaauuaacaccaaagaaccucgacucuccuucacgugagaggaccguguuucaaaggauuucugcucaguuccuguuggccuccaguucaaaaaaagacuucaaaaacgcgauuguggccacggaauggacgaauguugggucgcugcuuucugcuggaagcaccccacaggagucuuuucugcucauuccaaguuucuauacagcuccccuaggcuauuugucagaaacaaugucaggagggagauccuggucccagaacaaagccugucugcuauagauccagcccagcuauuugcacaggaacagcaagagugucaggugccauggggccuucuauuugauuggcuggaagaccaaucucucucucucucucucucucucucucucucucucucucucccucccucccucccucccucccucccucccuccccccagucccccccacccccccaccacccccaccccacccccccgccccaggucucacguagcacaggcaagucacagacucaaauucaugauccacaagucccagccucgcagaugcugggcucguaggcauauagcaccauuccaggcgaggaaguuaccuuccaacuuuuaaaggccuacgaucuuggcuauccuaucuuugaaggcacaagcacaaaggaaauccucuuuccuuucuacuucaucggcagaccuuauaaaacugcucaaagacauuucaaagaaucgccaggacagggcaaggcgcuuggccugaagaagguguagcuguuucuuuucacugagaagacccugaccuucuuggggucagugcagguuacuacccacccacccacccacccccucagaggaaguucaaagcuuugacccgauaugguagccccugcuuuucugggcauagcccacugcucuggaggaaccucagcagauaacccgguugccauggaaaagaaagacuauuuaauacaaguuucugaaucuggggaggaggcggagauggcaguaaaaaaacagauauuauuuuaacauguuucauuuugguuaaaaaaaaaaaacuaccaguuuguuaaaaaaaaauauaugccuacaaagaaacaaaaagggcuucuuuguggagcuagaaaaucuacacaauaaaaucuucuugggguucauucugugcucuggagugaauuccucugggcauggcccagagccucaccuuguuguuuucuguuuguucuaugcauccuggacuuccuauggaggugggcauggaggucugaaguuuacuguuccugguguggccccucaaugcagccucugcacuuuuucagaaucccaaaauuugacaguagaaccuuaaacaacaucugucacucaggcuagccguuucuugaugacagcugcugccucugggcccagucuacagaacuuaaaaaggcaccaagaagcgggugaggcccagagagaugcucaguagguaaaugggcuuaacuugcagccauggcacgcaugcauauucagaacuaaauaaauguaaaguaaaaacaaaagaagucagggaguuuucuccuacuuacagaaacgaagagggcagagagucccacaggauaccacaugggcucuaagagaggccuugguguaagugguucucagcuauagagaggaugcaacuuuaggaucaguucuguagguucggggggggggcuggagaagccccuuccauggggagcaagaccuucuguagagagauagcugguccgcaucuccacauccaauauccuguagccucucccaccccucagaggcccccucugugccuaguaaaaacaaaguauacauuccuccgcucacccaaaugcugugcacagcaucccugagcuggcccaggauccauugcuucucugacugcaagcacacuuugaagagucucuuacccggcccucguuuuuuuuuggaagucucccggggaagauggaucauaaaaagggccuucauacccgccuccuuugcugcccccaccucuagcucauacaagugugagacaucaaaaaccaaaccgcacaggcagagugagcuacaagaaagacccggucugccuugauggcugaauggcuagaaccccaggcugacucaggacuccugguuagcugugccagaaaaucugcaacauuguggccuagggguccaugccaggaugcucaugguaaaauaaauaaauuaauuaauaaauaauaauaaauacuggcacuggguaaaagugugcucugcugacagcaggaaccaaagaugcugccaccauguguagauagcaggguaagagggcaggagggcuaagaaagagcauucaugggguuggagccagagaccgaagugaagacacuuagccaggaugcagccugggaggaggcaagcccuaggacgguccaugcccagcagagagcuggaucuccccuguggaugacaggagcuagcagggccaggcaaagaaaaauggcacaauucagggguguggcagggguaggaugagaugagaacucagccagggagaaaaaaaugugagaguuaggguaggccagaggagagcugcaauggcacccagagcuguggacaucugggacagagccaugaauggugcauaucacaacuguggcccaugguacagaaacaaaagggugggaugcgcuaggcaugaauccaagccucuuuuguaucauuuuguaucauugacccgcaugagggaaacugccuuucagaguaaggccaaaaugggagagggucaucucuuugcucuauuucacuauuuugaaguagaacaagaagcaacucagcugaagagacagugccaggcaucaaaaauaacaacugacuuaucagcccugguccucuccuacacucgagaauugaaugguguuuacugcagugagccaggggaaaugucuauggaauggaaguggggcuuggggggguaccagcacuccaaagcuggagaccagggauucaaauuaugguccacaguguaacacugucucagaaaggggcugggugaauuagcucagugucccacugaccgcagucuguugauaugggaggcccuggguuugauccucaggaugagagagaaaggagaagagagagggagggagggaugggaaaaagaaagcuaugauauagauauauagagagauaauauauauuaauauuuauuauguacaagaagaaaucagugaugauaauaaaauaggcuaccagaggaaaagagcugaggaucacaucagggcucucguacauaccaggcggaugcaaggcaagcccuugcuguccugcaggauggggaugggaugcucuguagcgugcagccacagugcaaaugguuuacauuuugcugugacaaauagcgacuggcagcuguuucuuaugauugugauuuccccuuuugaucgagucauucagccccagacccucauuucccaaagacuaaaaggcaaucuuuuaaaggggggggggggaucaagaaauuuaaguguguuucucccguaauuucuccacgagcugacuggagacuagcugugcugcaguacccuggaaguucauuuucaguuuugugccgcacacagccugggucacugcaggcacaaagaagcuggcaagcgauuuauuuucaccuaacaaacgaauugagcauucccacaauccauauacaccgaccaaaugaaaaggugcccacguggcauccgagagcccacagcuuugaaaaguaacccucaguuucgaauggugagggaacgcguggaacccaguaucuccauggaaaccagugggcacucugcuaccucacugccuguggauugugcuuuuucacguauguacauguguguacacauguguucacguauguagccgcacaugugcacacgugccugugggaaaacagagaucaacuuuagccgauauuccccagaagcuaugugucauguuuguugagggagaaccucucacuggccugggugaccagcgaguacaugaguucuagggacugaacuugggucaucacucuuagguaggaagcacauuacucccugagccaacucuccagcucaacuucuguguuuugcaggugguuuucagcaaguacugcaacuccagugacaucauggaccuguucuguaucgccaccggccugccucggugaggaucuccucgugugcucugugaugagaguuguguuauccccacagcagaccagacgagggugaagcuacaaguugggguuagugggcagaagaaccccccaggcuucugcugugaugucucucaaaucagcgaagcaaaccccagcuccauccuggcuugaccgcugccccaaccccaggguccagcugccccacagagcuccgcuagagcuccaucuucagagcuggguuuucccagcuuucaugccuucgcucacuguugaggaaggaggacaguuguguuuagaguugccccggccacaaauaacuaaguaccuuugcuuccaggaguauuggacacgggacucauuucagagaugcgcuaaaagcaguugccuagccuacaaaaucuucaaaaaauccaccccacaguuucuuuccuaaaucuagccuguauuagcacaggacuuuucuaguuagaggcugagccuugggggcuggagagauaacuagcucagugguaaagagcaaugacuccuuuuccagagguccugaguucaauccccagcaaccacaugguggcucacaaccaucuguaaugagaucugaugcccucuucugaugugucugaagacagcuacguguacuuauauacuguauauaaaauaaauaaauaaauauuuuauaaaaaaaauccacagcugaggaucagagggcuuaguucuuuuggcagagguaucagcuuaucaaaagccccuggcugagaggcugagagggacaguuuuugaccauuuaaguccgcacuuuaugggagagagauggaacaggcucagaagccuugaggugagcaaugguucccaucucuggucuaaagcuaguuuuugcagcuucccagcaucucccaacccaauaaauuauccucacuccaguucccacuuuaaauuauuuaaaaguugacaggcucuuagaaugcacuuggccuuuucacuugacuugauaaggggguggagguacauaucugcaggacaaccagcugccccuaccugcucuuaacuaaggucaccugaggcccaugugcaacuugggggcggggggagagcagagcugacaugaguguuuugcaggaacaccaccaucucccuuuuaaccacagacgacgccauggucuccaucgaucccaccaugccugcgaauucagagcgguaagcgacuccuccuggggugucucacuugucuaugaugugugccagggagucugcaauuuggcuuuguuuacuacugcuaagacgugugaaguuucagcagaagagggaaggaggcagaugggaggcaggcggaggcuugguucacuccugcuggggaaaccaucuucccugugaggaggccaugugcagacacaggggacugggcuaggagcacagcuccagccugaggaacccucgugggagaacucagguuuccuaaccuucagugcauaggagguaggaggcugagggcaaaagguugaagguagccagaggcuguguguacccuugugagaauggguaggacagcuagagccaguuaucuggacccuuguggaggacaugggaaggguccugaaaucaaggaugucacuuuuccagguggccugggaaagccccugaagucuccaggucauuugugcaguucagcaaaacagaacuuacaaaugcagccucugggacuggcagaauggaucaguggguaaaacccuugcacgaaagccuaaagacacaaguucaagcccaggacccacaugaagauggaaggagagaccaaauucuacaaaguuguccauugacuucugcauaucacacacacacacacacacacacacacacacacacacacacacacacacacaaucauuuuaaaauguuuaauaugcucucagaagaguaccggagguagacaaugagccacuggggagauguguccucagcauccucugggacuucucuguuccuccugagcaccaauccacaggacucagaggaaguuugggggccucuaucagucuggucaucacaguuccugugaugaacccauggccagcucugagcccacaggagaaagcagauaccaggcagacacaccaacauccuugguugcucuggguaagcaauaucugaguucagggaugggccagcugggaccuccagcuaagcuccagagugguucccuacccauaggaguaacaugaacacucacccacaaagaaacucuguagcuccuuccugcuuucagaaacacagaucagugaggccccagugauuacgugugcucgugugugugugcgugugugugugugugugugugugugugugugcuugaguacauacacacacauaugcacacauacauaugcacauaggugugcacacagguaugcacacacuugcgcacauguacacauacaggcacacacacauguauacacacaugugcuuucagaaacacagaucaaugaggccccggugauuauggcugacauacuuuuugucuugaacauggcugcuacugguccuaacagcccucaaccuuggccagaucuccacacuaggcauaauugguuccuucaucuugcccccaggagucaguguuccagucagacccacuggcccucacucugauccagacuccaacaaggcucguggcucauuggcuccccaaagacuccagugacagucacaugcgacaugugugacaugugugucaucuccagccuaccugacccagaacuccaucaagacaaagggacuaaggggccccucuucucaacacccagacuccuaaaguggccaugaugagggugggauuucucuaugcccugucuguguaagcaagguuucagucccacaaagccauguggguuuugcugaauucaguuauaacagauguaacaauucaacuagcagagauaaucaaacuguacagggaacagagaacaagugucuaugugaucccagggccuccugaacaagaaaacacaauaacacacauacauguguaugugcgcaucaaaaugcacacauacaugcacacacauacacaugcauguacacacagacacacaugugcaucaaaacacgcacaagagcacacauacaugugcaugcacacacagauacacacaugcacauaugcauguacacacauaugugcauugaaacacacuugagagcacacaugaacgaaugcaugcacacgcacacacacccaaagggucauaaugagcaccgcaucauuuguggcaugcugaaaacuaccucucagaugcagacaagauggaaaugcaugagguuggaugggugucuggugcuguuguguguggggguuacagacagagguguggauacagagacagagcuagcuacacagaaggcugagugaggcaggaacaugaacaacacauuugugggcucagauguaaccuaggucugguuguggccacauacaguggguagguagaggugaggcacccuuuggacacauggaagauagggagguagcagacauaugcaugguggaccacacuugcccaaggugugagauuucugucuucagggucuccauguccuuucucauguccaccuuccuccucucuucccccuucucaguaucucguccugagcuuguguggugggaagggguugucaccuccaugcugaaggcccaugugugucagggcauaugggucaggacaugucuggccuggagauucccaaucccagucuucacagggcguccuugcuugaggcaugccugucuguccugaagacaugcaucugccugcccacacugguggcucgguauaaaccagguuagcugaacaguggccccugcuguacauuaaaacuggcaagcucuuuuaaaggggucuaguuuacccagaagucccucuaagaguuauuaacccaggucuuugugaagcuuugcaaaggguucuagagugcagacccugggguagcacccacgggcugaagggaaccccugaaaccccgcuggacuuagauguggcccucugagccaggcugcuaccauucucagagggcacaguacaggcacauacuccuccaucugugugacccccgcccaacuuccccacaaacacaggcccaccccuaaccacacccacgcccaaccaugguugcagguggccacauaccugcaugccugaucacuugugcuuacgguuuuaacuuuccccaccucugaagagcacugaauucuuggacauggucaccuacuccccuccccugcccccaccacguuccagccucccacugguggaagggacuuggcuauagauggcaacccucauucacuuagagcuguuuccuguccucuggauggauuuuccauaacuccuggagucuccaagguuucuggcuagccaccuccaucccggccggagguguaacugucuccaucucucccggcuucuugcuuucugggcuguuucucugcaucuguuucaaaccuuaagucacaucugugagauggaaggccaguugguuggagcuggcaagaccugacgaguggccugucccucaggauaagugagaacagacguaucagagcauggccagauggagcuacaguuuugcucauagaggcccuuaccccaucuggcuccuuucucugaccaaagaauguucuaggucuggucauguucagcucucggcuaugucucuuggacccugcccuuacugucuuucuggggaaggagaacagaugcuuggaugguaugaggagaguggggccauaugguguagcauacggagagaggagagggccaaaauugacaccgugcauuucugacauaacacaaacacaucuuggguuuccgauuuuagccaaguugugagacgcauagcuuucugcuggguaaagcaaacgggcaccagcgaggaggguuauacagccaucccuccgcucagugcacaugccucucagauagaugcccagcuggcgccaggcugcugcgucccagggcaucauaaggaaagccagugcccgggcaguuaagaacagacacgcaaugaaaguccaaggucguuuaucagcuccaaagggggaaggguuuaugucacuuacauuauauuaacaguguccaggaagagaguaaggaagcuguaacucaauuuagauggagccaagaguuuauucagucccggaagacaugucacuggcucugcagaacugagcuucaaggauuuggaaacuaggagccaagacaaagcaggaggccaugagauguagccaggaagcuuugucuguggucugagggucuugcgaucucuguccaaaccccccuuaucucuggcuaguggcaucugcuugcugguuacauucaggccaaagcaccaugagaugaugaacgggucacccaucccaaagacagacaccguaacaguaggucugucccuucagaaacccacacuugaacauaggagaucauugcucauaacaggaacauuucagccuuguucacugccagcuccuaccacagugggcucucagaacauccugccauccagagagcccaagccuucugcauagcuucaaacaggauggcaaauaacgaauggggugugguuuuggcagggucagcagcuccaauacagaguaguguacagagacaagggggagccaguuugcacugcuuuggggguagaacugggcaagaauaucagagucuuugggucccaccugaugauguaucucugguucuuaauuauaucgacaauagaaauuugcuuccuuauaaucaaaugcgaacacuaugaaggaacuucaggucauuuauaucauuuuuaaaaaugagaagcauccgaaugagagaacucagaacagcaagguugcagggaaggggugucugucaggggugcagcucaguggcagagcaugagcuugugcugugcagggccugggguuccaccuccagcaccucaagauaaaacaaaucagcugacuggauugaaaugcccccuagggagugcuuaucgguggcagcagccagagccucuggcagcuacucauugugacacucucuucucuuacagcacucccuacaaggugagaccuguggcugugaagcaagugucugguaaggcccuguuaucaccuuuuaaauaaggagagagagagagagagagagagagagagaauuccagccuccccuccccccuccccgugugauguaaugcacauugauagguguuugaaucugcuaccacugcggagucugacgcuguucacauccagguggccccucugaguucccaccccaacaugaucagggguucauuucaccucauucuaccuggguucccaggcccacacccaucuccauuccuaugagcugcaaagucaggucuccacccacaagguuucccaagggugcuucagccaggcaugggauucuuacagaaucccauuuccuuuaggauuuuuuuaaaaaaaaaucauuucuauuuguaugugauuuaugcacaauaagaugcucucgcucaagcgugcuagcaccuggaugcauccuggagcaucugcgcgggucgcugucaccaucggugaagucaagguuccgugcauauuuauucucuugugucccuuggucagcugccucuguccacagcuggcucacuuuuggagaccguccaguaggcuguguuucccagaguuugugugaggcguuagggaggagggguauacauguuuuccauuccugacucugcgcauacguauggagcccagacuugaaccuccagucgauguccuuccuugugaaccagcuccucaugaguuccgucuugcuucuugagacagggucucucguuguccugggucucgcugacgaggcuaggauggcuggccugugaaucccagggauucucuugucucugccuauccagcccuggauaccgugugugugugugugggggggcaccuuaccaacugugccagucuccccaacccccuuuccagaguuucaugcagaaaaaaugacccaggaagugaguuugcaugaggcuucuuggauccaucggugucacgagcaccagccucugugccugguaguugcuaaggggcauccugauguuuuuccuucauuuccgggugaccuuggggucguuuuuuuuuuuuuuuuaaugaaucaagcugcuauggauuaaagagugggggguggggcucgaguggggcugugcaguccuggggucaaguauaaguuuagcuccauccaagccugcugcuuccuuuuucuggcaucucuguugcagcugcuccuuucuuggagcucuggaagugucagucccucugauggcugcagauguagagugugccgcgguuuccauuugugcauuuuuuuuuuuuacuuuaguuugugauucccuaaugaugacugaccaugcguaucuuugaaguaucuguuuuauuuuuauuuuaugacaucucuggccagcuccucaguagcucucgguggccacucccacacucaccgggucgugagucuucuuggcgugaggaagagucacgcuuagugucucgccuguugacuugauaaaauacucugacaaacgcagcugagggagaagggguuccucuuggcucacaguucaaggcugcaccguccauccugguagggaaaucaaggcggcaggagcuuaaaguugguuacauggcauguauaagguucuggguuaaauuccuaccacugcaaaaauguguguccauauacauauacacauauauauauucauauaauacaucauaugcaucauauacauaugacucauauacaucauauacacauauacaucauauacauauacuacauauacauauggcuuuugugcuggaaaagucaaucuugauacauucucaaagaaugagguuuuguguaacucuggagccaagcuauacuggaguuagguucugacucgcuaacaggagcuagagcauagccuaaguggggccuuugggaaguaagagcugagcucucagagggcagguggagggcaggugcagagggcacacucaagcagcugauccacagcugcugaagcucuucccacagcugggguccugggaguuaccgaggacuuugagaaacagacagcacugcagagaaccaaggcuccucuugugugcacauccuagcuucaggaugguggagugaacgcagagugaaagaugacucgucucagugggccagggugggacagaaccagaaagcaccugccucacaccaucagcgugagcacccuuuaagugagggaagagccugggaagguggcuucucugagaacugcagcagagugaguguggccaacaauaaacuucugcucaacagaaaaggccaagagguggcagugcacaccuuugaucccagcacuugggagacagagacaggcaggucucugugaguucaaggccagccuggucuuauagaguagguucuaggacagccagagcuacacagagaacaaaacaaaacaaaacaaaacaaaacaaaacaaaacaaaacaaaacaaaaaaaggcaggucucugcucuuggagacagaagcaaccaaccaggggaaguaugggccaggucugggucugcucugcccuccagaucaaccugguugugccaaugugaacucugcaaugagaaagaacuguuuucaaaggcagugucuguccccuacccccagagaugucagcaccucccucacgaaucuccucaaucauguuccuagucagccuaaaaggcucugggugccagggcacccuuucuuccaguguacccauaugagggcaaaguuggugucccagagauggcuggcaccuaagggcagaaaagggauucugccaacccuuggagcagauucucaggcauucuugauuuuucuauuuucccagcacaacuuccacucucacuucuacccccacccccaucccaaccccacccuaccuuuguaauuaacccacucagacauccuugaggucaaggccugucagcugcuccauuggccccucaacaaacgggccacacccaccacagcuuaagaacaaagaagaggaaguggaauucuucuucuaaaacuggccaccagcaguggggccucuaccugcccuucccaggggguucuccuccugccaagugucaaaggaugcccccaccagaccuagggguugugccuugcaaaaaucaucaggcucugccguuugauacuuaaacacccaggagacacccagagaagagcauccucaagagcuagcgugacuccagaagagagggcaggccagucuuggccaccggauuguacagaguucuacugcuccugcuggguuuagccagggaagacugacuucugucugcagaugugacaaccucugugaauguggaagucuguguuugccuugcugcucaggaggcuggaaaggagacagccugagccugagauuucaagauaaggcuggguacacagaccuuccaaaacuuaagaaagggaggcagcagaagggaguguguguguaugugugugugugugggugggggggucuuuuucccuagcacugggagacagucccugcuucuagauugcuucuccuuuuaugagggaaauaaagucacaagcugugacagaagccaucggacaggcuuuuuuaugucaaugguguccguaguccaucauuuuuauuuuaaguagcucaaauuaaggcguuucucaauggcaauauauaccauugugguugacagcccacugcagcaugccugccugcgagagacaaagaugucugaauacuagccacaguccugagcccucagacccauauaggaccaaagugugauccuaugaaagacgcaagcuuacccuggucugagcugcccucaggcaaagcagaggcugccacgcugcacaguagccacagggaaacagaccccuguuucacuucuugcccaaagcaagaugcaaagcaaaauguguggagauaaugggaccuguagugucccuguggucccuggaagagcugggugcccgugguuuucucaagacacagcggcuguugacuacugagucacacucaaccuggggacaggcaucuucaguuucugaacccugcagagagcuugcagguucuguaugcccaccauucccccagccuuccccuagagucuaggucaggccugugcagccacacucugccaguuugguauccaucugguugaggcagguccuguguaguccuuuacaucagcauaugccaucagcaccacuggguaaggcuaggaugcucugcaucuaggcuacagugcaggggagguccagggccuuguuuacagcagcuuccuuggcaccacugcuguuuccaaaagacagagggcaggguacaaguggcaaguggccagugauauacagugcucagaauuccugcuggggacaggcacaccgccucccccuuccuuguggagauagaggcagccuuugcuggagaucuaggaaagaccaggucaaaggagccguguguccuugaggaugaaacugcacccugcgcaugcucccacacgcugugugccuagugucucagugacuaaaacagaggcauccgaggccagaagguaccccugagagggcuucagggaugucuauagugccaccacggaacuccaggcccugccacacagagcauuccauuccgccagguccgcuuggacuagagaaagcagcucugucagccuggcgugcaugcuuaucuuagaagacagaggaugagguccaccccucggggaauuugcauucagcuucccuguuugcucagacaucauuugcaugcugcuacacccaagguucagcccgcgguggaacagguugucauuguguaucuauccuguuuauccuuaaauguuuccaucacccauggaagcccgcaccugagucuuccuuuccuaccccuccccuccccucccaggcuuuggcagccucuagccugcauagucuauuaggucugccuaguccccauguuucagauaugccacuguggcauuugggguuacaucuugggggccacacaaucugugugguacaaaguugcuauaccauucaaucuagggguaacugauggugccucauaugggugggccacauuuugacccccauuuaucaggggacacaccugaggcuuguagcuauuguuugcaauaccgcucugaauuuuccuguguauuuuuggguggauguuacauucaucaacauuguuacuguuucaagauacacggggaguugaauaagcccaucauucuuuauagacaccuaacagacaugaggggaagggacugaagguucccagcaaagcauaggacuccagccucgccuggccuuaacgucuccaugucucagugggcaguucugaaacccaccaaccacauccuucuccauccuuguguccccucugccugaggacuuccucugaucagggaagacccggaguacuggauggccagugcuccagacaucuuuuccgagaggacagucuccugauaucaccaaugcaggagcccaaagggaccccagaguaccaaucuccauacuuccacaauggucacuuccucaugcacgugucucuguuuccccuccuuuggaagacuuucugcauaaccucccuaaaugaucugcagaucccuuuugugggagcccagucuuagagcuuugaacuugaaaauaggaauccaagaauaaagggcccaucugaagcugcauucauccgccagcugcgugaaguggccuuaggaaaacuaucucgccccauguucuuccauuuccugugcagaauaggaauuaaaauagacaccuccgcagggcucuuuagaggguaagugauguaauuuaugcagaaugccuauugagggcuggccacuuagcaaugcucagcaaacgguagcuaucauuuaaaguaaccucccaggcaaaccacugggcaaaagcuugucucaacaaaacugcaggauuucaguggagcagggacgagaucccucagggccaaaccuggaguguggacucugguuuugcucggaagccaaguuccugcucugaauuuggacgcagauguguuacuugugagcaacaauaauguuucuuaauaauauuuucuauauuuagugccauuucagcccaaagcacgaaggcuuuuaggcuucauagacacauccuuaaucauccuugccugcacuacuuucuaaaaacaaagaggaugcagcauauaaaaugcaacauauaacuguuccuggaguugcuugcucaugauucuccuccagggcgggcgagccagccagggcgucaagcaguccacagccagaaauguggguggcaagcaggggugguccugacugcaggcuuccuuuuggcuaagaacagcucuggcauugaauacuacuagugcuucagggccaugcaugguccagcuccccucuguacugagacaucccugaguuccagcagaacacagcauucagccagaucuaaccugaaugcgcaguuccacaggguaccaagcgaggaauucgauaaaggcuagcuagccaucaugcagucaagacagauauuuccaccaaccuugaaagcuuccccaaacgcacuccauaagaagccaccaucucugccuguuucggcagcuugcguugccagcucucaagggccacucgugcagagaccuauugugcuucacccaccuuguugucuggacucucugguucagugccacaggccuuugcccaccucugggcugcucagcaugcuuaucucuaagucccuauggguggacaugggggggucacuucuaaugugggguucagcugcuuugaucgcugugaaggccuuacugugggcgugcuuguggacauugcuucaugguugcagccuggcagcaagaaugugccuuauauguguguuaacccucccacaugccuggagaugaaaccaggcucuccuggcauugagaugaucucaagaaguccucugagaaaggggaagcugaggcagagaaggacugugggcuccugaggaaguaggugacugcuguaggcagaugcagcauucauugucacaguuccugagucuuucacagcuacccaguaccagcugagacauuccaguagguaugagauccgcuguaucuaguguagguucacuugcauuucccaggcugucgggcagguguuuuauauauguacuggccauuugaauaucuuacuuggcaaacuguucuaagcuuuugggccacuuucuaaacuggcugguguuguuuuaugauggcucacuguaggaaacuauaauccgggugguuuucuucuaucacacauagcuguguuuucuuggguccccggcuuguauuuuuccauccccaccaccaccaccacucacgccccccucccaaccuuucccaugcucagcaaugaggucaucagaggggugcgugaauuuggaaauaacacauuuucuuugccauuuuagugcuucccucgucuucucucagauucagcuuuugucuuaaagcugugauccaucuaagaucgauuuacagagaggucaccaugcagccuucucucuaaauacacacgggcaggagcugugacagccagaccugcugagagugugccugcucaggacacacuugcacuuucacggaaacagacugccaaucaacacagcuccuucuagccuuucagugacugcucugucugucuguccuucugucugcucugauuguuucuuagaucacagaccagcugcuuuaagacucaggugugguagccuggggaaaaaaauaccuccuugugugugggaacugguggguccugcugggaaugguuagaccacuggagaaacaagcccagucccuucccccuugcaacuauaagguaauuuacaguccugccccgugcaugccaccuugccccuugguauggugacaaggccaggcuaacucaggagguggggacuuccugccguugccugaaaaccugcaaaguaaagagcuuucuuuguuucugaggacccuugcucccuccaggcccuucacggugcuaugauugacagcugucucucuuaaugcagccccucucuguuuuagaaggaagucucucucuucccccucaaagcccauccugcugccucugcucucuccauggcucucuacccuccacuuuccuaugaaaacuauuaaguuacuaauuucuauguuccgucugggcuucucuuagcuccaauuggccagcccacauggccacuuuuuucuguuuuuguuuuuguuuuugcuuuuguuuuuguuuucuuugauggcugagcuaauccauggcuucuccucucccauacauucuucuguuucacaguggcuucucucugcuucucucaaacccaccauaccuuaacccuacucagcuucucucugcccagcuauuggcugucagaaucuuuauucaccaaucacaauuaacuggggggcagggucacucaacaucaauaucucgacucuggagugccaguccuuguuuguuuguuuguuuuguuuuguuuuucgagacaggguuucucuguauagucuuggcgguccuggaacucacucuguagaccaggcuggccucgaacucagaaauucaccugccucugccucccaagugcugggauuaaaggcgugugccaccacgcccggcuugggaugccagucuugagaaccccaaauuagcauuagaauaccaacagcauuaggccaacccauuaggcagcuccuuucccaucagccacccuuguucccagcaucaguauuaaacaaacuacauaguaugggcaaggagacccccauacauacaugucuuucuuuuuggguugauuuuuaaaaacuugauuguuuucuccauugucaguuucaaaagaaauguaagaauguaucuacaacauuaugaguacuuucaacguauugauggauuuagaguaccuugaugucgcuccuauauugaggcuucccacccaagucucaucuaacagcucagccaauguuuugagacaggcauuuugcauuaucuuuuaaaaagauuuauucccaaauauuuucugcucccuggucuauaaaugagguuguuuguuuguuuuagauugcuaacuggcugcacaucuaaucagaauguuuguauguugacauugucuugugaacacugcuugauucuuuaguaauuguuuuguaauaaaagucuagaauuugccaugcagacaaucauguguaggaagauccaauuuuaguuccuauauucuaaccaguuugaccucuuaaaaucugucauguuggggcuggagggacggcucaguaguugagagcacuggcugcucuuccaggagaccuggguacaauucucagcaccuaccuggcaccuugcaacugccugcaacuccagcaccaggggauuuugcucccucuuguggccuccagagguauugcaugcacuggguacguaaauagauacaguuauagcuacugacuggcuggauguggauggugucugucugagggucucucuuuguagcccuucauugccuugaauuugcuuuguagacaaggcugucuuugaacacacauguuacacaucuacugacgaggcuaggguugacuuugucaguacaaaggaaacuccaugccccuguuuucuggcaguuagacaaaagccagcauacuucaggaauuuguaaagccaguuccccucuaccaaaggagcccuuucccuuaucaguggcagaagggacaaaugacuaccuguggugccuguuagauaccagagcuggguccaggcucccucaguaucacaagcaccuguuacacauuucagaguccacgcuagcauccuggcucuucucagcuccugauacccugccuccuacccuaaacuucuccagcccauggucuucccucccccagcuauucaguucuccuuauaacccugcuaggucagcagugcucucucagacaucucuuggccucauucucuuugucuucaucucucaccagcaccaccccgcacaugcacacacaugcacacacacacaugugcacacacacuuauauaagugugccugcacaugcauacucacaugugggugcacacauacauguacacacacacucacacacacauacacugaugugcacauguacauacacacaugcacacucacaugugggugugcacucacagacacuugcauacauuuacccacaugaauauagaggcucacacauacauauacaagcaugcaugcacgugcacacauacacaugcacacucacaugugggugcacacauacacacacacacauacgcuggugugcaugugcucaugcacacaugcauacucauaugcaugugcaugcacacacauguacacauaugcacacauacacacacauacucaugagggugcacacacacacgcacaugcacacucacacacacacuugcgugcacacaugccugcaugcacauaugugcacacacacaugcacacucacaugugggcacacauggauccaugcacaugcacacaggaaugcauacacauacauacaccuucugcaggauauguucagcaaaacaucuauaauaaauuccuucccuaucaggaggucauaccaucaaguuaugcaggcuuggccaugaggccccuugagguuugguggugguggugguggugguaguguguguguguguguuuguuuguuuuucugaucucagguuuuguuguuuuuccuuuucuguugccucucauguugguuggacagauguccacauccugucucacuucugcucccugcuccucagccaccuucagcaucacucggagcugcugcuauaagcagugcggucuccaccuuccacaucuccaacuaauagacuugauaguuuuagauuuauagcaaaauuaaaugaaaaaaugcaguuccuaucuacccucucccuacacccucagugacagacgugucauacugucauacucucuggaguccacaguucacugugggccacucuuggcuuuacauauucuccaguccuuauaacuacacagugccauguguccccccaguguggccucauaauggauagcuuuaaccuccucggcuuccagaagucugauggcgccuaaagucccaccuccucaggaagcugaggguggggaaucauugagacuaguaugugagaaucaaagccaagauggcuaucagggaguaugugugugugugugugugugugugugugguguguaugugguguaugugguuggugguuguguguguggugcauguauguauguauguggggggaugugugcauguguguguguguguguguguguaguguguguguauguguaguguguguauaguguguauggugugcguguuugugugguauguauguguggcauguguauguguguauacuguguuugugauguguguguaugugguguguauguguguuguguguguauguguggugggugugaugugcauguauaugugguguguguguauguauacauaguguguggugugugugugguauguguauauguguguguaguguguauugugcuguguguguaaguauguauguguaggguguauuguaguguguguguaagugugguguguguauguaugugugguguguguagugugacugugugguuguguguauguguguguaguguguaugugugguguguguguauaugugguguguauguguguaguguguguauaugugguguauaugugguguguaugugugguggggguguauauguguguacuguguaugugugguguguguauaugugguguguauguaugauguguguauaugugugguauguguguaguguguauugugguguguguauauuuguguaguguauaugugugguguguaugugugguguaugaauaugugugauguguguguauguguauguaguguguaucgcguauguguguaugugagguguguauauguauguuuaguguguauguguguguguauaugguguguauguguguaugugugguguguguguauaugugguguguaugugugguguauguauaugugugauguguguguauguguauguaguguguaugugugauguguguauaugugugguauguguguaguguguacguguguaguguguaugugugugugguguguuuguauguguguguguuucaacuguuccuugcugccucccaccacccaucuucccugucuccaugguuuuccuuuuccuguaguucgaaccuuucugaccagcuucuuucgcuugcuccugugcaguggggcccuuucucugccuuucccaucucuuguccauagauaccaaucucuguuccuccauucccugcugcaggcagcuugguggcuuccggcaccggcaguuaugaacucugccacucuguauaccucugcccaggauccugagaagguggggugggcacagggaaagaaaguaugcugugugccugagaucacaguugugcagaccacacagauggggacagacucccacccccaccccaagaacagugcugugcuguauacacacccccaugccugauggcuccgaaucaccacaacauuggcuugaggacaucagaguccuuggcaccuuggcugggcuggucacugaaaugcccucugccaguccuccggcugcugagacacugacuucccagcagggcgaacuccgaggaccuguugcuuuaagaaggccaggcaaagucacuguuaaucauauaacuuuauuguccuccugggucauaaaggaaguguguccccccuccccccucccucugaaugucaguuuuauggagcccauaaacaaugagcccgccagugaccccuuccagucuuagcacauccccacaggcuguuuagaagguagacugguuuggagggcagcugcagggccugggagagacaagaagugggacaggaggugagucuggucccucuugguucccagggcaagggcggagagucaguccacucucugauagggggaggguggcgcugagagggaaaauaucugcaccuucuguugacuucagggcuccugggaggcuugucucguugagucuaaggaacggggcuuauuuucccuaaugugguggcugauggugaugaugacgaugaugaugacugaugaugggacccaaagaaagguagaacuaucgucguuguuguuguuguuugggucucacuccauuuugguuucgguuuuucggagcuuuaggaaguuucuauugagugcaugcagcugggagaaugcucgggaccccgcaucugcugcuugcaguugagccuguggcucaccgcgccauaugaauagaguaguagcaagccccguggaguugugagccaucacugacugacugcugggugaggcuuggcagugugugucccuuauuuuccauuucaggaaggaucucacuguguaacccaggcuggccuccccauucaccggcucccugccucggcugccccaguuggaggauuauccaugugugucagcaugcgcaccgccccugaaacucauaaagcuuuuucuauagggucagagagcuaagaugaaguuggcacccaugcaggagacugagacagggaagagggaagguguccaaaucagcuuuggggucagggcacagaaaaacccacagagcuauugcccuauucagcucaguaugcaaagaacaccagccugccugacccagauagcauucccuguacaauugcaacagaaugacagacuuuccuggcugucccuuuaaccaaaucuuuguguccuucugccacucuaugacaggaguccugggcagggucaggaauugucugaaacauaaacaguuccuggaagugggcgaggcagggacagguuccuugaauguucguuccccuauaacccaagcuggagucggacuuaagacucagcggccauggucugcugcacggggaaaccccauagggcagggcaccuaucccaugugugccuauuugaauccuaccagcuggauucugucugggaaccuugaaccuaacaccccgguggcucccccagaauugacuuccagaccccuguuuagaggacauaagaguuggguuuccucugcccccccugcuguguuguccaaacauucucgaagagggaccucuuagauuccccuaagacuguccuagaaugaaacucagcacuccugagcuaacaugugagaucuccagcuccaggcaggcagcguuuauuguggacgcuugccuggggaaguccgcagcagcagccagcaggagcuaaggcgacaacaagcaagaaacugccuggccugccgaggcugugugcaaggcuccucagccuggaggaagcugcucuuuggaacacaaggcccuugccuaccuuugcugcacucaguaccaggcaguccuccccggugugucccaucagccagcgguuauucugcauagccugcugcucucugcuccuggaguuucccuaggaaacaaauugccugugaaugccagcgagcucuucccgcaggucagggcucagcaucaguuaaaccgacucccucuccucagacucuuucucuucuguguuuaaaaccuuugcgguccagagggaucccaaggagaugacaguugccugcagcaaugacuuacgagcauccuugacuaacgcugacuuuucucggagcuacuaagacguccucaaaacacaaugucugucugcaugcgccuaaacuccuucuaaccaggaugugccaggaagccugggaagcagggaggagcgucauccacggggugaauugugcugacaggggaugggcuuugccaccagguugggagggaugaaucacuugacaauuagaaagaaacugccccacccccacccccaaguccagggguuuuaggcucccugaggggaaugaauguuagcauuuugucuaagcuccaccacacaguuaccuggcaacagccaggugugccugacucacuauaaaaggggcugccugcccccuccucucucucuugcuccugcugucugacccuucaccccuuccccccucuccccauucccuuccccccucugcuucccuucccuucccuucccuucccuucccuucccuucccuucccuucccuucccuucccuucccuucccuucccuucccuucccuucucucucccuccuccuccccccccugcuuuucucugccucuacuauccucuugacuugacuccccucuccaugcccugaauaaacucuauccuauacuauaccauugucuguguggcuggucccucagggggaagggaugccuuggcaugggcccauggaggcacacccuucccccauaccugacuacaccucugccaaaaccuauuccuccucucuuuaucuuuuuauaaagacaucaaugaagacaaacaaugcgugcuuuuucucauguggaaaucuauucaacagggaacagggagguaaaagaaagaauuauuaagaaagcagaaggagaggaugagaagacagaugggugccaucaaaacuugaauguguucacgugcagaaaugucacagugaacgcccucgaucugugcuaguaagcuccaucuauaauuacgacgggauaaagcauauggaagauacgacagggagaccccagaugcccaggccgauggagguguccugagcaucccaugucccaaagacugugacacaccaggaaaaggcaagccacaagagagguuaaggcaaaucuugucugucagcuggccuuagugacccuggaacagcaaggcggcagcagggaccggaacgaaggcaguggcguuugccacaagcccacauacugcccugaggauucugcacagguuccuugcuugcuuucaaguccacugggaggaagcaguguuaucguguuucccugugauggccgacaaugcuuccaaaucagggcuguguuuguggacauguggcuggcuggcuggcuguguuacacgggaguuuucuuuuccucuuuucucuuggaaaagaaucuguucuuugcacucuguauaaagaguacaaagagcuuagugagcucuuugugcugaauuauguauaugucacagccugacucuggccccagcgggugugccacucacuuugucucugaacaaagacacccuaagagaaccacaggcuaaggcuaagguucauccuuaauguagccaggaauacuggugucugcccaaguccugauuccugcguccccuagaauccaauacaaguaugaaaaugccgcuucgaaccccgagagauuccaucccucaaauccaaaggacagccccucauuaacuccuuuuugaaaaguuauuuauuuauuauauguaaguacaccguagcugucuucagacauaccagaagagggcaucagaucccauuacagaugguugugagccaccuagugguugcugggauuugaacucaggaccuucagaaaagcagucagugcucauaaccucugagccuucucuccagaccuauuuauuuuuauuuuauauguaugacuguugccugcauagaugccuguguccuaccugggugccuuauacccaaggagaccagaagagggugucagauuccccuggaucugguguuacuguaguugagacugccacagcuuggugcugagaaccaagucccagaccgcuacucagcauaucucugaaccaucucucccagcuuccuuauuuuguuguuuucuucugagguggcuuggaguucacauucagaugcacaugagaaaccccccccacccccacccccccacccccacccccccacccccacccccccaccaccccucaccuugcacaaccugcagcacagggacccagcuagcuaugcacacuggcaugcuccuguguguggcuccccuccuccacccccagccccaccccuaucccuccggcugcgccuugguaaccacuuccucccugaccccuguuagucacuaacccaagaucacccgauuucuuuuuuuuuuuuuuuaaagauuuauuuauuuauuacauguaaguacacuguagcuauccucagauacuccagaagagggagucagaucucauuacggaugguuguaagccaccaugugguugcugggauuugaacuucggaccuucggaagagcagucgggugcucuuacccacugagccaucucaccagcccgaucacccgauuucuaaugucacuuagcgcauugaauaaauacagucauacccauaauuugggugacuagccgccucacucggaaccagcacucuaacccauccaaguuguuccuauagaaggagguucuuuuuaugacugccuguacucccuguccugagaggagcgggguuaguuuauccagucacgcaggagggugucuggcuuguuuccagguugggaccauuuccagccagguggcuagcucacaggugagcauagauuuccugcccucuuccccggaaggucagcuacugucaaacuucuccacagaauccccaugacaccaacaggauaugagugacccagguuaguccucccuggcccuggguauggucagccuuuuugaucgcgggauaagcauucggauuugccuuucuagcgacuguggaugcugccuaggucucaugcucacaccugucugcacacagccuguuuccaaauugagcugucuucugcuguggaguccugauggcuuuucccacacacuguauucaaaucaugguccgauacuccacuugcaaauacuccacccgagcuguagauuugucuucugcucuccuuuggggggggggggggggcgugacuuauuuuuuacuuauuucauuuuuauuuuauguauuuguuucuucacuuauuuugacuuuucaagacaggguuucucugcauguagcccugacuuuccuggaacuuguucuguagaccaggaccuggucuauacacacacacacacacacucauacacacacacacacacauucacacacacagacacucucacacacucacacacacauacaccaaaacacggaaucuguuuuguguuggcaaacuaccccugagcauguggcugccugaagcaugguuucaggcugucuuuucaucccccuaacacuauucuucaauuaauuuugaucaaguggcuuagugauuuccccuguguauuuggacgucacgucuaggaagucccugacuuccuccacacucugcagguugugucccuguguguuaugguuuacagccauggacaacacauuuugcaugaguuuuuugccugugaaauaaucuauuuccacaaaagagcuugcugcaugguuuuuuuuuuuuuuuuuuuuuuuugggacaggaagaaacuuaagccugcaauacuggauuaaggaggauugacaucuuugcugugucaaauuuacuaggucauuaacaccaguuguuauuuacuuauguaucuuuuccagugacauuuggagcuuggggcauauaaauucugcauguuuuguuauguuugugccugagucuucaagcuuuucugaguaacuaucaaugcaauugaaauuuuaauauaaucguuugcauauuauuaguauuguguguguaucucaugaccuuguuaaauucacuuguuggcuccagaagagguguguguugcauuuuguagaauccuuggaauguucuguguaaagagucguggcaucagcagucaggggcugcuggcuuauuucuuccuuucugaccugugugcuuuuuuuuccuuuuuugucuuuucgagacaagguuucucuguauagcccuggcuguccuggaacucacucuguacaccaggcuggccucgaacucagaaauccuccugcuucugccucccaagugcugggauuaaaggcguaugccaucaccgcccugccuuuuuuuuuuuccuuuuaaagauuuuauuuauuuauuucauguauaugaguagacuguagcugccuucagacacaccagaugagggcauauggaucccauuacagaugguugugagacaccaugugguuacugggaauugaacucaggaccacuggaagagcagucggugcucuuuuuuuuuuuuuuuuuuaagauuuauuuuuauuuuauuauaugugaauacacuguagcugucuucagacacuccagaagagggcgucagaucuuguuacagaugguugugagccaccaugugguugcugggauuugaacucaggaccuucggaagaacagucggugcucuuaaccacugagccaucucaccagcccacagucggugcucuuaacagcugagccacgacuuuucuucuuacaggaugugaagucagguggccauggguuaucuacacccacucgcuugaaauguucugggucuuagguagggagcacccuuuuggaugauuaggagacacaagcuugaggcaaagaugccauuauuuaugauagacaggugacuguaggccauacagagaagccagcagcauaagaacaaagacagaaggugaccuguaggugagugccuuuauugugaccuguaggugagugccuuuauugugaccuguaggugagugccuuuauuuugaccuguaggugaaugccauuauugugaccuguaggugaaugccuuuauugugaccuguaggugaaugccuuuauuguguccugagaauuacugcaugggguuccuccuggggaauuauaauuggugauuuaaagcaagcagacaugaguucugaaaggucccaguguuggcgaaaugguuaccauagcauagggcugcacauugugugccagguguggggcagcaggugagucagguaggcuguaucuagcugcccagagggcgguggucagcuggaggaagugguuuaaggcagacaucuggguugacaccuggguagaugggaggcagacaaccggaagcuggguuggggugacugaaccugcauucaaagugaacccacagggaguguaaggucacgagacaccagaagaccagccuauacacaguaaaauagagaaggcuuaacagguugaucuaggccagagguucaaccuuccuaaugcugagacccuacaauacaauucuucacgauguugugaccuccaacuauagaauuaucccuuugcugcuucccagcuguaauuucacuacugugaucuuaggcgaccccugugaaagggucguuagugacccagaaguugagaaccacugauugauugauuuggguuuuugguuuuuuguuuuuauuguguccagugaauaaacacuagcaaauauauuuuaggaaggaaaaaagggaaaggagaggaggggaggggaggggaggggaggggaggggaggggaggagaggagaggagaggagaggagaggagaggagaggagaggagaggagaggagaggagaggagaggagaggagaggagaggagaggagagaaagggaagaagggaggggagaagauaggaaaggguagagaggaagggaggguagaagaggaagggaggggaggggagaggggaggggagaggaggggaggggaggaaaggggggggaaggggaggcauaauggcugaaacccgugcuccuaucauaugggaggcugcaguauaaagauagcccaagucagaggccagccuggacuacuuagcaaauccugccaaaagcaagguaggaagggaacacaaagcgcccggaaauagaucagaccaggccagugcuccugucauguugaauguccauaggaggggguguuacaacagcuuguuguugaagacgcacggagauggagugugguguccgcacacggaagcaucuuccgggguucacauagcaggcuauaccauccagccccaaccgcagaacuuccuuaagggacuccaugccaucugcaugugccagcacagugucgccuagcccugugcugcuugaaaugguauucucacggcugaugaccggacuugcuaauuuuggaguuuuuagggucaugagccuggugacgaucgauguaccuucauggcagguucuugcuauggggcaccgaugcaacccagucuccgcaguagacuaagacagcaguuagacacgggaggacaugcacggcaccccugcauucccgugaagcccaugagccggcaucugcuuagaucaggacagagguggccuggggaggggcggcgacuaagggagcccaaggagacuucuggugccgaucauguucuguuccuuagacugaaggugaccaagaugugagggggaaaacacuucuuucucauuguaaaauuaauauauacguucgugguagaaaauaaggguucucugagacaucaaaaauagcaaaauggaaucucauaaacaaaagauaacuauuguuaguguucuggaaguuucccucccaacauguuugaaaaaaauggaagcuuucuauguuacuuuucaaagaucauuugaaugaagcuuuuaagguuuguuuaauguguaugugcuugucucuguacuguguaccugccucauaccuguggagaucagaaggggcaugcgauccccugggacuggagguuuguguagcugguugacugugggccucuguguggugcuaagaaucagacccugguccucugcgggaacagcaaguguuccuaaccuccgaaagauuucuuuagccccuaaaaaccgcuuuuuaagucuaauaacagauguuaacuucuucuguugguuuuuguuuuguuuuguuuuguuuuuagagucaaggucuugcuaugucauccuggcuggcuuaucauggguagauccuccugccucugccucuagacaugaacauuuuaaaauaauuauuuaaaauaauuauuuaguuuuucccucuccuuuccauuuuagacaggaucuuguuaugcaguuaaagcuaaccuuaaacuugcucuucucacccaccuggccugcuaacuccugccccacucucccugggauuuaaaggugugcugagcuggauuuauuaucaauaguagaauaugagucuacaaugcacacacaucuuauuuaauuuaacaaauccugaggccacaagauggcuugguaguuaaaggcacuugccaacaagccuagagaccugaguuugguugccaaaauccacauagcaaaaggagagaccagacuccuacaaguugguuugcuccguuuugguugcuggugagaguuaagcgucaggccaacaaagaagagucuaugaauuccuuucuagagucucugaguuugggggccaugaacaaaugcuuagcugggacacgaaggucuccccuucccaagagcacagauagaaucacuucaaagggugaugucaugaccgucugcaagucccagaacugggcuggucaggaaauaggaaagagacaaguuaugaucagccugggaccugaaccuuguaaaaccaaccacccagcccaguuuuacagggcuagccagaagaggccaggccugcuccacccagcccgcuuccucucugcaggcccauccugagaacaccauguuuucacucacuggcgcauugaccccacucugccaugcuaauaguccccauaaaacgagcaccgugagaacgcugcccauauuuagagcccccgaagccugccugccuuaucuagcuguagcagugucuggagaacaucagcccuggggccacuggccauggaccaggacaagcaggcagcagagaagaggagaaaccgguacccagggaggcccugcuaccugugauggacagcccaaacauccuuccacaguagcaccuguggcucacacagggauaguaguacccuuagccaccugccugucuccacggcuguccugccagccucaauugguuucucuucuucgguuuguagaacgagaagaacuuauccagggcgugcuggcccagguggcggaacaauuuuccagguaccguaugcucucuguacauccuuuccagacucacgggagcuggcccuuagccagucagcccucuguaguuucuguagccagccuagcaaaccuucaccauauccccaaaacccuguccaauggccgcuuguagaacaugaguucuggagguggcgaauacaucccccuucauucuucuaaggcucagagcuaucuacaaaacacccuucuaccaagggguguuucccacugagaugcugucaugugaguggauggcuucccuuuaguuugccaacacccuagaauuccguugucaguuucccaaagugacuucuguaugguauguucuugucacuuagaaccaaaugauugaaccaccauggggcaucgcaccccacagcugcccuuacugggcagggcagggcauaggcaugggucaacccagcuuaagucuacucugagagcccaggacagaguaguaauaacaccagacauuauucguucuuuaaaagcaccuccugcugucuugguccccuccccaggcucccuggagaccucaccccaggcagggaccuauaaacauuugcuggucugggucuuguguuuuaucuuuuuucccugcuuuuugcccccagagcguuuaagaucaacgagcugaaagccgaaguugcaaaucaccuggccgugcuggagaaacggguggaaugugaguggaguuguuauuguuguuguuguuguuguuuuuccuuucugcuuauguugucuuuuaaccucuguuggaaucagccacuuagaacagugagcaguucguugcugaaggcaaaugcgagcuuucugugugccacucugauuugacagaggcuggccaagggcagaucucagcacacguuucuguuaaagcaccgcuuguaugaagcuuugugcaccgaacacaacccauaaaccccaacggccucugucuggcccgguagaagcucugccagggcuguagcucuuguuccucucuccaugaggcaggagggggggaggggcgggggucuucucuucucuucacacggcugugcagcuugcuucugcagaguguggaagaggugacauuuuggucccaguuucugaccacuacaagcaagagagagucaaguccaguuuccauuccauuuccaaagagccagccagguuuggggagggaaauagcuucaagucaccucauccgccgugacaggaucgaugaaggaucgaugcuucugcuccacaggcccauggagcccguguugcacccucggcuucacagccagguucucugucacugucaggcucagucuggugauaacugggcaccugauuuguuagcuugggcugaguaaacaaaauuuaaacaggagaccagcaccccugaaacauaugugacugacucuguucauaagacaaaaugcugcuuuuuuguggggggauuuuuuuuaauugcuucucauuaaaaaaaaaaaaauucuaucauacaagaccuggcucuucggaauaagcugguacacguuucccaccguccuguguguaccucucagcaugcauuggcuuuccccaagucagcuggucuuuggguccucaagacuaucuugucccaccuggggauggugaggagccacagaaaaguuagugaccgcuccagcaaaggacggcacacaggaggcauguguaagucacagcagugcccacuccaacgugcuggaagcugaccgcuccagcuugggaagugucagcaaggcugguuccucugggaucugagggagaguccguucuaaccugacuuccguuaguccuucccacucccuagcuaguauggcugccgccugauccugucguccaugcccugucuguuucuuguaaggacacugccauuugaaucaaggauguucccauugcaaguucuuuaccuaauaucugccaaggaucuuuuguuuaaaucaagugguagucucaggauccuggcccuggguggcugggcaggcugccaggaagacaccuugagucacuguuccauauagacacacaaccaggcacaaacauauacacaaagacauggauagacacacuggaaagcaugugugcacacgcaggcccaucugggugucauuaacuguuaucugugucucaggguuagggacauccagcuguaaacccccacaccacacugaccuuguagugaacggaauuuccugcuugcucuuugaccuuaaaccaaauacacguuucuccucugugacugucagcacuuuuuccccccguucuguguaaauguuuagcuuuuaaggagucugggauuacuggagggucaaaggugauuucauaaccauggaacagccuggcccuugccuccuauccugccuggagcuauucacuuccuuccugguauguugugguggggacacagggcaucccugcuccaucuacucuuuguacucgugcccuggaccgacaccaagacuuaaacaccaguguggaccgcagccagagcugaugccagaagacagagguaccaggguacgcaaacaauccagaauuuccauacugaacugaauuggaaccagucuuucggugucacucaggaacugugccugaggcaaacuuuaagagcagucccaggagaaagcauugaaaagcagcucucuauucccucuuggagugaaguccaucccuuagcuuugcagauaggagagagagagagaaagagagagagagagagagagagagagagagagagagagagagagagagagagaguauguccacaguuccugugaguucuuaguguugaagaagguaaaauuguuuuccacagagccaacaucucccuuaggaauuuacucuuaaauaauuuuuauggggaggcaacaaaguacagaagcccacagaaaccccuucugaaguuggagcuggagaggcagccccacgauuaagaacacuggcugcaguuccagaggaccuggguuugauuuccagacacccauccacguagcucauaacucucuguaacuccaguuccagggggacuccaucacccucucgguccucugcaggcauuuccccucuucugaaguccacaugcauuucccaugauuccaaaguagguaacucugcaggccagcaugucagaaggccuauguaggcugugucaccaggguacuggccauggaaaaugguucagggcgacuccuacuuuagcuuggaauaucugugccuaccuguaggucaaacuuagagggacaggggaccugucuuagcuaggguuuuccuuuuuuuuuuuuuuuuuuuccgagacaggacuucucuguauagccucggcuguccuggaacucacucuguagaccaggcuggccucgaacucagaaauccgccugccucugccuaggauuaaaggcaugcaccaccacagccuggcaaggcaacucuuaaaaggacaacauuuaauuggggcugacuuacagguucagagguucaguccauuaucauccaggugggagcaaggcagcauccaggcaggcaugguauaagaggagcugagaauucuacaucuucaucugaagacugccaggagaagaguggcuuccaggcagcuaggacaaggguuucauugcccacccccauccucacccuacccccaugguuaggaggagggucuuaaagcucacgcccaaagugacacaccuccaaauaguuccauucccugagccaagcauauucaaaccaccauaggacccuaauggaugaaacuugggucaggccaugaguccaauggucugugaagacaucacaguauggagcacauggcuuccuucuacaggaucugauaguaggaggacugaagggggccugcgaugaacaacagaacaccaggucacaccucuaaucccagccacuuacaaaccaagacaggaagauugugcguuagagccaggcuguggucucucacauacaugccaaguggagucugccacacgucuccuaggaucuguuggccuuccuccaugcucugccuuuuaaacauugaugauugauugauugagcugcagcuugcucugcuugucuaucugccucauguuccgaccaugucccagaggcaagccuucaaccugcaaagaaacacaaccagguuuacacaagaccguggcagccauauugaacucaucgcuacggaacgaagggugcuugagugaugcccucggaagaauguccaguggccuucaacagcuucuuugggugccagugauacaagaaagcaugaagaaccccacuuaaaagaaagggugaccaagugggugaccaaaccugccuagccucuguguuccccacagcugcuaccuagacuuguucccaggcugccaccacccuguccccagacacugaugccaaagaccuucauuuuggucugcacauaccagccuuguaugggacaggcagaagcuucucuggcccagaaacaagucacccggaccagggcugaccguuucccuuugugcagaagagacggugucccuaugaaacccuaucccagguuggccacugccuuggacaguucuggagaacccagaaggaggcugagucacaccagguugccuuugcacaugcacccaaucugcaguuccucuucuuggguuagaggcauugucaggaacccgcuaaguccccaaauggcuguuuuccuuuagaaagggucacgcuguguuuuuagcaauuauuggcaggaaggggaauagcucacaccauggguaguguccuuuggcaggaaacugaggugcagucauaaaguuacagacauaauuuuuuucuuccucaagaacccagcuuccggcagcauuccaacuguucccagcuccgagggagcagauuggcuacuggcuugugggcagccacucucauucguuagcugggaccccagggauaggggauaggacugagucuggucccucaucuccuugacuuugccuguuucucuccuggcuggugggaaggugagggaaccccaauaucaguagugugggaagguagagauaccuuugccacauguccagcauccuucugggacccucagcugccagucuggcuagacgccccccccccacgauuaccuccaguaacacacccccccccgucugugucucuuugucaccaguggaaggacuuaaagugguggagaucgaaaaaugcaagagugacauuaaaaagaugcgggaggaguuggcagcuaggaacagcagguaaguccuguauccagagccuguggaagccgguccuggacagggcucuguggaaaccgugggaugggcuauggcuaaugugccuugaucugcuuccaaccuggauaacacagccuguuguaucagacaucaacuacucucccauuuucuuuccuuuucauuuuuaaagauuuauuauauauuacauacauauauacuauuauauauauacucugucuucaugcaccacauccuauuucagaugguugugagccaccuugugguugguagaagcugaacucaggaagauguauuuuuaugucuauggguguuucccuguaggcaugucugugucccacuuguaugucucgugcccaugcuggccaaaagaaggcaucagaacuucuggaacuagaguuacaagcaguugugagcugccacaugagugcugggaauagaaccccagcccccugcaagagcaauaaaugcucacaacugcugagccgucuuuccagaccccuacauuuucuuauaaagggguugguugguuuuguggcuggaaaauguccauacaugcaagggaagcagcucuucucuucuccagagccccgaguaacaguaaauuccauacuugaaagaauuugguauccauuuuuuuguuauuuugauuggggggguuauuuguuugugucuuuguuuagcccuggcuguccuggaucccacuauguagaccaugcuggccucaaacuaacagagauccaccugccucuguuggggguuaagggcaugugccuaacugauaccaauaaaaagacaaagguguuugguuuauagugaacaaguacccaguuuuuaucccaaggucuccuaguuccuaaggguagcccccucuguuagaggagcacagaggauacucccauuucuauggacugggucacaugacccuucaagggugauauccucagaaaccagugaccaauaauaauccaagcaaagcaugccuccagcauggcuugucaguaggaccauccuccaaagccacaacuacagcuacagggcagcauccugaguuaagaaccaguccugaaccaaugaugucaguugucugaggaccccaaccucaagcauucuagagacaacacucucaggcugccugugagaguguggcguggcucuugccugcagggaggggguacugggaagucuggugguccccauggauucccaccaugguggccagccugguugucaccaagagggcacaguauagggaagagagguaaaucaggguauucuauggggaccgugucacacucaggaucauguggaguggcuagcugguguagaguuaaggagcucuuuauuauuauuauuauuauuauuauuauuauuauuauuauuauuaaagauuuauuuguuuauuuauuuauuuauuauaaguacacuguagcuguguucagacacaccagaagaaggcaucagauuucauuacagaugguugugagccaccaugugguugcugggauuugaacucaggaccucgggaagagcaaucagugcucuuaaccacugagccaugccuccagcccaaggagcuccuguuccauuagauuugggugaagggcagggcaaagaaucuugcagccauaggacacugagugaucagcucacucccacuguuccugugaagguagccagaaucauagaucccagccuagaaucauaaaucuuccauaugcucucagggaaggcagaagacagaacguagaucuucaggggccaggacagucccauaugcaugaccucuaagaagaaccagagucaccuggaggacagacacucagugaggcugggaaccagcgcaacagccucugacccaagaccucacuuagccugugaucaccccagaaggcaugguucccagcaccaggcaggggcagguggccucugugccagcccccaucagcagcgcuggcagucugccuggaguggguuuuuggcuugucucagugacgggugugccucuguaccccacaaguacaguuuagagacauaaagcagagcccucuggugccuccacaggcaccagagacagcauucucugcagacagcacuggaggugucccuuguaagaaagagacagggugagaugcucaggcucugccuuccaaaugagcaaacagaugcgaagcucuggccuggcucaggcaccuggagccacuuuucuauucugagccagugcuuuaauguucaggaugcaggauggagaagguaguauuugugguaccucuucugucuuauugauggaaggaguccauuuuaagugcagaagcacacucagccaucaagccccuccccgccccucaggaugaggcuguguaaaucaccuagacuguggagaaaaguugcacccuugagaggugcagacacuaccuuccucaaggaaccaaagggacaggagaccaggugagguagagccuagcucuacgcuuacaguagcucaugagccugaaggacagacugacauuugcccacuuuugaacacacucugacaggggcuggauccaccagaaccuaccuagagacaagagacgggcuguacacagccuugggaagacgguauucuccuuagacuuacugagguuucuguuucccugaaaggaauggauuccaauagccagcucacauucagggcagaggcgcacacauauccuacugggaaaauaugguugcugugguucccaugcaaggagggaaagaauauccugcaaggccgguguaggguaaugcagacagagaguacugacugaggcuugaggucuguacucuucugcaugugucucagucgaauggccuuggccaugaacugagccccgggggguggaaggcugggaagcccaggaaacgaggcaaaaaugagcuccagacagaacaaaaagaagaggcacuaggccagcugcucugcccgcuggaggaugcugguuccuguggcaacggggcucagagugggaaguggcuggccaaggcagggucagcaggcaucuaccagcccagucugcccccaaggccucaguggcuaggaaggagcuggauuccagcagucagcuuccugccugggagggcuuccauaugcucucagggaaggcagaagacagaacguugaacagaacacagugaggauguguguauaggagagacugaaggagaaacaauguuacccuauauagccaagagcagagcggaccucucauagucaggguggaggugcagauggcuucacuggagcacuugauuggcuccuucuguugguuccuagagcaaauccuauacauuugcuaaaucuguuagaauccccuugguacagcgacugucacaauaagcugguagguuuugcaaguggugcaguugggagagaggcaacugaaggcuguguuucaaaaggaaaagauuuaugauucuaggcugggaaaccgcacaggcucaugggagacuucagacaacacagcuggaggcuggggggggguggcggggggggggucacugguucaguugaaaucuauugcaaagcuggacuccuggguuuuuccccuucuagguguguucaucuaguuuugaaggaaaagaaacuuaaucuacugcucugugaucuuuuuucacuuguaauguugugaaaaauaaguagauucaauuuuaacccuccagguuguaggguuuuuaucucuucuuuuucuuaacccaacaccaaauauaguugggaggcucagaaguguagccauguguguccuccaugccuuagaaccuucugagggcugucgagauggcucagcgguuaagagcauugacugcucuuccaaagguccugaguucaaaucccaacaaccacaugguggcucacaaucacccauaaugagaucugacgcccucuucuggugugucugaagucagcuacaguguaauuauguauaauaauaaauaaaucuuaaaaaaagaaagaaccuucugaaaagacacucuaagauguucucagaguggcuuccagggugugggguuuagggagaaaauggaagacauugggauuucucuuugguuuucuccuggguuuguuguuuuguuuaguuuguuuguuuguuuguuguuuuugagucaggaucuccaacuauagcccuggcuggcugcagacaaaugauucuucagccucauugguugagugcugacaucacacguguguaccgaccgucacauccagccgcaucuucgagaauaaaaauguuuugcugugagcaggauagugcuggcacauacauuuaggcccagcacucaggaggcagaggcaagcagaucucugugaguucaaagccagccuggucuauagugugaguucuaguucagccaauguuacacagagaaacccuaucucaaaaaaaaaaaaaaaguaugggacgugguucaguugguggaguguuugccugcuaugcaugagaaucuggcuuccaucucuaaacaauaccacguaaacugggggugguaagacaccucugucauccuaccaagcaggaaggucagaaucaaggucauccuugauuacauagcaguucugaggccugccuggguuacaugagauccuaucucaaaaauaaaacaaaggaagacaaaaagagauuuuuuuuuaacuugugccauuuuaaaagguguuguagaaacuaaacuaacaguaaacucugacugcauuagcaucuagcuuuauggguguuuccuauugcagacugagagccaagcaucucacagccccugugacucauacucccaggaugaauccaguggggugggucuauguguuccagggcuggggcuaagggucccagggcuggcugguggcugugggcuccauuugcuuugguguccugagcagcacccacagugccucugagccagagcacauggcuguaaccaaguucucccucugcccuccaggaccaacuguccauguaaauacaguuuuuuggauaacaagaaguugacaccucgacgugauguccccacuuaccccaagguaagauagauuucuggcucagggacaaauuuagcucuguguccccagcaucaggacaggggaacccagguuuggcccaucacucugcacagugacaacagccccgcucuaucucugucucuggcugaggaaggaugggagguucucgggcaggauauuuuucucuuggacauuuguuuagagaagugauuccagagcauggagguaauggcccuucuggcucccuccuggacccacagcugacaguaaaagacaucugcauacaaacauuccgccaagaaacuuuaacaagcuucuuuaaaaucugcaccacuggcuccccuguuccugaacagauuuuuuuauggaaaacuuuuuugcacaaaaguuuuugugaauuuugaaagaagccaagcuuuuagucaaguagcugugaccuagaguuaaguuauuuuagaugccucugcuuaagcccuggcucacaguuacucugcgguuaggcuggccacccacaaguccuccuggaaacccccauagguccccagugcccacuagucagugauuugcucuaucuggguccuagccauccacugaguuaucaucccagagaucaauaccuuuccaagggaaauagggcccagaucuuucuggagauuacacagcccaguccuggaauaaacugagcuggccuccacaccagucccuucuuagggaaauggagaaggcuagcccgaauggcuugcuauugcugccucaugucuagacuaucaaccuuaguucugacaguucacccgaaaccuuagugcccggcggagccgaccucgggccaaggccuucuucagccagugugugacuuagcucauggcugauuccaggggugguucccggcaagacaaaccuaacuuuuacuguugagaucugauugacagcugagagcucaucaucuucuuggaaucugaguuuugaugaacguagucaugaaauugcuaucgugacaaauauaggaaauauuucuuuuauuuauguaugcugcuguuccuccuccugcccccucccaucacagagcucccuauccccccauccucccuccccuucuucucuaagaggguacuuccccccaccccacccccaauaucccacaacccuggcacaucaaaucucugccagauuagguacauccucucccacugaggccagacaaagcagcccuguuggggaauggauaccacagucaggcuacugcuuuaaugacagucuccccccccccccccccgccacacccacaucguugagcaaacuacaugaagacugaacugcacuuuguuaugugugugccagaggccccauucuagccugugcauucucuuugguuaauggcucagucucugagagcucccagggguccagguuaguugauucuguugguuuuccuguaggguuuauaaggaauauuucuaucucucauacaucccuaagaagccccuuguagcccaggacacuacagaugggaguccacugacagucuccagaguaaggcaagcuugagucuauacacagugucagacuucugacauaccacucccguccuuuccaguaccugcucuccccagagaccaucgaagcccuacggaagcccaccuuugaugucuggcuuugggaacccaacgagguaggugagggacauccaaguucccuggucacugggaacagcugcucaggauugcaugaaugggaacugagcccaggcuagcccuccugugcauuucuccugucuuuuuuuuuuaaguuauaacccccugaauucaaaucuauagauuuuaauuuaaauggacauuugauaggcucagggggauacaggagacagagccuaaggaaagaggcuuucccaagggaaacaaacaugggcucccaggcuacugcugcuggagcauguccagcugucccaggccccaggcugcugcugcugcugcuggagcaugccccgcugacccaggccacaccugggcugcucccggagcaugccccgcugacccaggccccgggcugggugcacccacaucuguaggaggugugggaagauggaggcaugcaggagcauagcaguugcuuagaacaccuauuuccuguagaaaggggccuccagaggagacaugggaagagucgccagcagagcccuccccacccccgccccccgggcagcuggacacaagauagcggagauaugagguuugcagagaaaggagucauuugugacaggaaacuguuucuuuaacauuucucauucacuaggaaguaccaacauggaggcuaaaagaauauguugcucuuuauggucagcucgccaaaaccuaaggacucuucccagauuuucuaaagcacggacauauaaaaauaggcaaaaauguucccugcugccuuugacaagaucagucacagccaaugggacucugugccucucgauaagaggaugcccaaauuucccgaauagauuucuucuuccaacauguugcuugcccggcguaagaaggccuuuaacuggggcauguuagccagaaaagcagagaacaggcuggugagaugcucaguggcuaaaagaaccugcugugcacagugaggaccaggguuugaaucuguuacucccauguagacaucagguggguauggcuguugccuguaauuucagcgggagggaggcugagucggccugagcauuuugauuagcuuagucuuaucagugagcucuggguuugguugauagauccugccucagucuaugaggcagagagcaauaaagaaagauacuauaugaaccucucauucaggagcacaggagugcacacacacacacacacacacucccuacaaguacacgcucaacaacaagacagaaaagcagaacccagcccagcuuacuuagaacuuccugggaagcacagccaucagcaagccaccagaaauuaagcugccaaggggucugcccuccagcucugagggcuggggcuggaauguagaaaucaaaaguucaggcagcaucuuaguugugcaguccuccuaggacagcguggggucacacggcccugagcacagauacaggagaccaagauagagcagguggccagcccugcuucuggcacauccuugaggaaggucccaguacauagucauugaccuuaaccggccaaagucacccaugagaaugacugcauagaaaucagugcuugaguuuucuucugccaccacuaccugcuccgugggaccuccaagcccugugcuacccgagguggaaggugacgguuguccccgaggcuaugacagagcuugauuccucugcccucgcuuuggagacuguacucauagcugcucucugccgggcaggcgagugggcguggugagugccuuucacagcuugacccagcugugagacgucuuccaccacccauagcuuuggcuagggaggcuaacaggaugcuucuggcgguuucucacuaccaucacgugguaagccagaaaugccucuggcagauccaagugugggcagcagugauguguaacuggagauucgcugaggagcugggcagcugcccagcccugagaugucaaggaacaucggggcccuguuggggcucaccugucuuuccuggugggugucaugccacaucgauucacaucucuacccaguauucuagcccuucucaacugaaacccaggauaugaucucauguuauucugcugccucugauccaugggacuccaucccaaggcugcacacaauaagguugcugcucugucacacugaagggccacccacuggcauuucauaaguccucucugucuuauucaguacucauggccacauccgggaaccaccuggcugacuggcucagcugggguugaggaaugucaaggaaacagaccgucacuacugcuccgaagcuacugcauccaucacagaguggcggcagaugguuuagucuggcagcucucuguaucuugcaacucugauuucauagcagaugcuucaucucuccaggguggcucagaacacugucugggccucugagcccaaggguccugagggcugacauccaggauggugcagggccgggaaguucuggacagaagcugccuacagccugagaaccagccauccucaagccaagaucagaacaucugucacucuguaggaaggcccuucugggaccuucagcuucaaagucguugguucucaaggaagaugaaugugcagcuaccucugugacagucuaaagucccccugcuuaguugcccugcucgcccuacuaggucugaauaagagguuguuuucuguuuuccaaaugaacucuucaccugacagaacugaaauauuguagccacacagcuucaccuuaucuauggcaugcccagcccauacacauuacauaacaagcccuuuggcuucagcugcggcaaaccaccagagacugggcgacuucaacaacgccagugucucauugucucacugcccuggagccggaaauccaaggucaagguauccugggcuggucuuuccugaauucucucucaucuuagcaucuucucucagucaccucuaugugucuguguucugaucugucccuauggagucauggucagaucaaauugggacucccccucucuugauggccacauuuaucuuagcugccucugucaaaaccuaucccuaauauggucacauuggagggucacaguggggccucaauauauuauguccaugggacacaguucaauguccagaugcaggggaaauaggccaggcuagagcacuaacaacuacugcccugugcagguacugggacacugguacccaggaccaggcaagcacugauauguggccucuacggaagugcucucugcuggggucaugccacgugcccacagggcuggcucacucagcucuguacuguagaucugaaucgcugagaccuucuccccagagcaaagcagcucucgccaggcucucucgguuacaaauuccuugcuggcuuaguucaugucaaaacucugggagaugucuacagagaccugcaaaaugacugguggcauuaaauacagugucuguuucgccccccaccaaguguccacagacaaccaaauuccuggaaaugagauuuguucagacaagcaguucacccuucagaucaagaagacaucagaaagcaucuccagucccaauaagaggagcaaacuucagcucaucaaagcccuuuccaucuagccuugagcacccaagguggauggaggaugucaacugguagauggaggauggccuccuccugacccuuaguccucugcucaaauuauacauccucugaaguagugucagcauacacagaguugcuaucuugccuggaauacucaugggcuucugaacuuaucacuucacucccaggagaccuacaggcugucacagacccacaguccaucugggugauccuaaaauuugauucucucauccacggcugaaacucaccuucccaggucacccugguggcacuauccaggacaguacaugggaacgaggggaaacugguauaccuccuccuucugaccccugaccccugguccuguucucacagaugcugagcuguuuagaacauauguaccacgaccuuggucuggucagggacuucagcaucaacccaaucacgcuccgcagguggcugguaaguaggaccugucccuuccucccuaucacgcuggagugaacugcccugcaugcccugguggcggugggcuuccguagaguggguguugguaucaaggaaguccuaugaggucauuugucccaucuguuucccccccccccaugucccucagaggagcaaggaaacaguacaaccgucagaaagagacccacaagauagcgcacgaaagcagggguguguggaguugcaagugucaugugugucugggcaugugccugggaggaugcauaugauugugaggguguauaucucugcgguggugugggugugagagugugucucugggaguuugcgagagcguauuugucugggguuaugcauugugugcauggugagauggguguauggaggacuucauagcagaucuuucucuaagccauggaauguuacuucuaaccaagaacugaaauccuguucauuaucccauaggcccgggguccuagacauucugaugaaaugcucccugauucacucccaacuuccuacgccaguguggcucagcagacaccugggggaugcccuagucacugucccagaugguagaguaguaguagauugcagggcuccuggaccacgcugucccguguuggugaacuugggaguucccaaggccuugggcuugagcaugcaaaaccccgggagccuuagaggagcaggggacaccaagcucaggggacucacccuuuccuccccacagcucugugugcaugacaacuacaggaacaaccccuuccacaacuuccggcacugcuucugugugacacagaugauguacaguauggucuggcucuguggccuccagguggguccugacagccccuacccucugucccuaacccugcuguguacccagguccuccucucccccagcccaggggggaccguguccuccccugucacugcagcccagucugucgcccaccccuccugcccucccaugaggaggacagaccgcuugacucucaccugauccaggagaaguuuucccagauggacaucuugguccugaugacugcagccaucugccaugaccuggaccacccaggguacaacaauacguacguuugggauuucuuucucgguucuccuuugaaaagugucccuucucucaggggaaguucggcuugucccuugagcagcucucugacagagcugccaaccuagccccccccccaacucccaucccucauuccugcaggaugcaguucccagcuuuuggacuuuguccagggcccuaggccucccccggaauggaaccuccaagaccaccaaacccuacaggcagccacagucccuuugugucagcccaggcucuggaggugcagggcagcagcagccuguccccuccccgagguggagacagcaggucuccuuacuauuuucugccaggaggcuucuuccucaggcugcuuccaaaggcaagggcagagggggcuggggguggggcagggugauuaauacauugggacagagcagaaggaauuugcauguaaugaggccaagaggaugggcccagaucuaggacacuaacuaagcccuuccugucugcauuggguagaaugcuaccacaugugaccgacagaccaccgucauggugugagcuugcauucagugacacguaggguuguuuguuuguuuguuuguuuguuuuuucccuaaugaaucuuugugguccugcaucaucaucaucagaugcaccugaggcuacugccaccauuugucaggacaguguggguccucaaaagcuggucgggacaggauagaugccaacuguggcugugagugcuccuuaagagcugucccaagaacguaucuguuauuaccauucuaccuauucaguggucggcacagcugccaacaagaggcuggcaaaaaguucuucauuuagcauuaaccccgccccucaaaacucagcccuuagaauggcacaguggggugcuccuguagccucagcucuugggagagaagcaaaaagaugccagguuccaggccagccugugcuacugaaugagauucuguuuuauauguauauuuagauggacagaugacagacacuaagagaauaaaccuguuucuucuuuccaaaauccugccuuucccuauacugacaaaccuggcaguuuuuagaacccugauaccuucaagacgucacucagggagagaguuaaggucucagguuagaccuaaaggcacaggauaucuaguuauagucaggugcagcagaaggaaguuccuggugugcgcagaugguacccggucacugguccuaagugcgccccuccagccucuguagccaccacgcacaccaugacaugccaaagccaguguucaugcgucugagccucccgcucucuccacguacccuagauaccagaucaaugcccgcacggaacucgcugugcgcuacaacgacaucucaccgcuggagaaccaccacugcgccauugccuuccagauccuggcaagaccugagugcaacaucuucgccagugugccacccgagggcuucaggcagaucaggcagguauguggggccagagcuucaugggcucagagcagagcuccacucuucagagguuuggugacagcagugcccaucaggguugcccacucuuccaccagggcccagagugguccccaagaagaugggcuuugccauauaucccugaugucacuugcaugucacagcuauuauuauuacaaccuuaaugggcucccuuuaaggugacuccuaugucccugcagucagggaagaagcugagaauagaaagggaaauaucuggcccaaggcuacaguaugcuuucuggacuggcaccuauguaacaugcaaccugguagagcugguaucugccauguagcuucagcuacugcuacccacuggaccuggucauucaucucccccaugaccuauacuagcagauuauccugccuagucaccccugcccugagacaaacacuucuaguagcuuaaaacaucgccauccccaugcagaagucccaugugaaccauaacugagccacuggugucauuuacaggggauggagggacccagagugauuccugucaucucagugguagcugacccccagaaccuaugaaugagcccuuauuuggggguaagggggaugucuuggcauacuguacuuggauaacuugucuuaguuaagguuuuacugcuggugggaacaggcaccaugaccaaggcaagucuuauaaggacaacacuuaauuguggcuggcuuacagguucagagguucaguccauuaucaucaaggaggggaacauggcagcauccaggcaggcaugguguaggaggagcuaagaauucuguaucuucaucugaagggcugcuggcaggauacuggcuuccaggcagcugggaugagggucuuaaagcccacacccacagugacacaccuacuccaacagggccacgccuucuaauagugccacucccugagucaaacauaugcaaaccaucacacauaccuacuucaguuggaucuccuggugggacuguggcucuaaaccaauggcaaguguccuuauaaaggacagagcagagcagagacaugaacauaguaaaaggccaugggacaauagaggcagauaccaguauagacagagccaggucauggguugccacaaguuauaaugggcgggaaggaggcuucucucaacccuugggaagaaugggaacaugucagcaccuucauccuggccuuccagaccccagaacuacaagaaacuauaucccauaccugguaauacucagcaagaccauccaggcugugcccauagggagcaucuccaggcccucugggaaucaucuguugccaucccuuugagucucagcuggcuggcuuccaucccgacacagcugaacugaugcaggggagauguucauucgucuccaggggaaccuacaaucuuggcucugucaaagagcagcccgccucauaaaacauuacuucguuauuuguccauucccugugagguuccaagccaacuguugugcuuaugacagucaauauugaacuccugauucccaguccagcccccuccacucucuccucuauguguaggcuuccgcccuuucuuucauguuugccuacagauggaggcacccuaucagugugugccacagguuguuaugaugacuauaaccagccuuuucugaaguggcuaaagggcaaugugaggaaggguaauggccacacacaccagugccacccagugacugcccaggggccugauggggucagaccagugccacccagugacugcccaggggccucauggggucagaccagugccacccagugacugcccaggggccugauggggucagaccagugccacccagugacugcccaggggccugauggggucagaccagugccacccagugacugcccagggccucauggggcaucccuuagugugcagcuuucccugcaagguacaucaggcagcaucccaagaggagauggagagucaucuaauugggugaggagacaauaaauuccuagaaacaggaucuucuucaugcuggccaccauggggauagcaaggcuuggccuacuucagaaguuuaugaguuuuaaaauaagacuuugucucaaaaaaaucauuuauccacauuuuaaaaacauuuuaccacagaauagggagaugggucaauaaguaaagcacuugccucacagucggacaaccugaguucagaccccccagaauucacaacaaagcuagaugcagcaguacuagcaucuauaaucacauaguuacagggaguaccagcaucuugaagugcacagcuacagggagacaagaggcagagauaagagaaucaccugaugcucacaggcaaaguagccugguguacacuacaacaaacaacagugguaggcaagggccaacagccacaguugucccccagccuccacaugaacuaauuacagcacaugugcacccacacuuacccacacaaaauaguuuugucagugaagauuuugagggauaacuaaauguccuauuaauauuagucuuuacagaaaaaaguucauaauucaaaaugcaaagugaugucacacacaaaaaauacacauuugagauucuucauauugacuguucaacauuagcauuugaggcugguggucuuguuuuccuggaagagugaagcucuacaccuggcaugaagauguuauguaaauguuugugggaugggugaauggcuggauagauggaugguuggauagauagaugauggauggauauggauagauagauggguggaugauggauggauggauagauguaggauggauggauggauggauggauggauggauagagaaugaguggagaauggauggaugagugaguggguggauagacaggauggauggauagauggauggauggauagauggauacacaagauagauggauggauagaggaugguuagaggauggauggauagauggauggauaaacagaggaugaacagauagauggauggguggauagaugggcagaagauggauggauggauggauagacagguuagauggaugaugggugaauaaaggauagaugaacagauagauggaugauggauagauagaggauggacguauagagguuagauagauagaggaucgaagaugaauggaugcuggaagggugcuagauggauggauggauggauggauggaugaauggauagaagauggauggaggauggauggauagauagacugaggauagauagauggauagaggauggaugauggauggauagaugauggauggauagauagauggaagaugaauggaugguggaugggucggugggugauggauggauggaugaagaauggauagaugaggauggaugguuggugguggauggauagauagaugaagaaauggauagaugauaaauggauggaugguugauggauggauagauauauggaagauggauggggcaaauagaugaugggcggguggaaagauggaugaauaauagauggauagauggauaggacaguagaugaugggugggugguggcaaauggaugguaaauggguggauggauggcuuggugguagaugggcagguggaugaagagauagauggaagaguugaaugcagauggaugaguggaggagcaugcagcagaugcuugggugauugauggaaggaaggaugggugggugacuggguggcagaugguuggaugauggauggaugaguuggaggguggguggguggcagaugguuagacggugaauggaugauggauggaaggaaagaugggcggacauauagacaagcagaauaccguagauucaccgaaagcuagguaggcaggagaaaugaaaguuauaguuucaaauuaugcuacuuuuccuaagccaguauuuaguuaacaaagaaacugccuuagucuaguuucagcugcuauaaaauugcacagacugggaaauguaaaaagagaagagguuuguguucacccacaguucugagguuggaaugucuaggagcuugguauccacaccugcucuguuucuggugagggauguggacagacagacagucaagacaagagugagaauucacucuguggauuuaacccagugcuggguggguuggggaagacuaugaaugcuucgugaggguuaaaccccuacacucccuaaguaucccaccuuguaauacagccaccgcagggaccagauuucaacgugaguuuaggagggcaucaaccauguucaaaccacagcacggcuauagccucaaggccauuuacaaacuucagagugggaauguuaucagguauguucugacuuagaaaaccuauacauagucacauauaaaugaggcacugggaaaaccaucuuggaaaccccauuacuaaaacccaucagugagcucugaacagggcuaauugcagacuuggugacaaaaucuaggagacuucuagccuuggcuaaaaucuguuugguuucacaagugagcauugaugacucaucugucggccugugaucugcagcuuguagacgugggggcaaugguugcaccgagcagagugugagguucugguaugugugacaccguguccucuuucucacuguccaggggaugaucacauugauccuggcuaccgacauggcaaggcaugcugaaauuauggauucuuucaaagaaaagauggagaauuuugacuacagcaacgaggagcaccugacccugguagguugugucuuuagaaagcugaacucgggugagaaaccccaagagcccagugucuuaccuagccauggaguauuggagggacuggauuacaguaucacaacccuucccaggccagcaguaggcaaggcuaccuccuggagaguauucugugacucaaguaccgccucuuuccuuaaggagaugaccugaguguguccagugucugucccucucaaaagaccaaaaugcaaacccaguauguguucaucccuguaauccacagcacuggaaaauuaauuaauuuccaagugaguaagacucguuaacaaaauaaauaacaacuaauaucccauuauucagagauuacguuaauuguuuugugcuuuauuucagagacauguaccaaagucucuuuuaagccauuuaauuucuuuaaaacuaguaucauagugcuggagagcugacucaacaguuaagaacucuugaugcucuugcaggggaucuggguucaguucccaacacucaaaugucagcucacaaccauguuuaauuccagaucuggggggaguagggugggggugucuggugcccucuucuggccucuucaggcauugcacacgcauacauacauacauacauacaugcaggcagagcauucaugcacauaaaguaaauguguuuaaagcaaauaccaccacuuugcccgucuugaggcaaacugauugacaguaggugagaguuccuuucguagguaaggcuuaauuuguggcuuccaucccaugacucugagccuuuguggagccacuacuccaaaaaugcugaaucccauuaaacagacagggauacagagaaggaagggcccucgugacuaauaucuaaacagugggaggaugugucuuccccaagcuggggccuucaagagcacccccuuuccaaggaaagaagagagguacaguugucuucuuguccauagaggauaccucucaagaucccagugagugccugaagccaugggaaggccaaacccuguguauagcaugcuuuuucuuauucauacauccaggcacagaagagccuaacaccaagcuaaggcagaguaacaagaggaccacauaguaaauaauaggcaguugacaugucaaaauggaccaaggacagagggaagacccccauccuggguaggguggagggaaugaaaucuuucuauguugcucagaggagguuaaaacagaugggcucuuuauuucuggaauuuucuauuuaauauauuuuuggguaacuaaaagcauagaaggcaaaagcagagacaaaagggggcgcuauuguacagccauguuggauccgugguaagaucugcuaaggaaagagccaagaaugaaggaugaugguaaggagcuaaaggaagcaagguggcugcacccugcguaccuuacuucugucugugacagcuucaggacuuugugacaugcaaaaggucaaggacgcugcccauugugcagguggcuagauaggaugauaacccagaccaaagcaugcacaccuuuaggcucugcccacccacccacugaugaggaagugcaagaggaauaccaccccccauccccccacccccgcccagagcuccacuucuccccugcgacaagaucagacuggauggacuugcaggguccccaaaggcucagggagagacuaagaaaggucugggagaaagaguucaaagucuacgccucugccagaggcuccugggccaaugaaguggaagugcccagaacacagccugaagacauagcaacugccugacccagccacuaccgaggccacaaugucuagucuggggcaguucccccaugaggccagccagaccaagcuuguaacugccucuagauuggagccaguuccaauacagaguggcaaagaaggauggaugcccaggaacccaaaauggggcugcacagcaaauaucuauaaguccuucaaggcccaggcagagugaaagaauuaauccacccugcuaugcugacacaagguugugugcauaaucaggccauguucccucuccuacaugggacugucaacaaagcaaguagacccuggauccguagccuacaguuauaugccucagacagauguuccugccuguucacccucagagccuggaugauggccuccacuuucacgaaggaaggucacaguaucuugugauguuugugcuugcacaaggccagagcaccaggaucccagcccccacauccaggcaguuaguucucuagcuagcucaggauaaaaacgugugcagcagaauccuuugacuggcgugacccgggccugaugagcuccagcuagcagccagccuccuuccuggggggaagguaccuccuccugggagaccacacccaagagguugcugugggcccaagacaauauuacaagggacaugugcucugggguggcuuaaaagcugacaggaguugaccuacacagucacuuccagucacacacuuggugccauuaugggagaugugucugcaggacauguagacccaggcauggagacaagcugauuaggaaggcucuguguuuggaacaagacagugucuccuccauauauuuuucuucuguuuuccgcagucacaaaauuacuuaacuugucaagguguugaaguuacugugugacaggcaaacacugcaccacucagccauguccccaacccuguuuuuacucggcacuuugggacgagagucucgucaaauugucccugcuggccccguaggcagaccuugaauuugcagcuucuugcuuuguucuuguuuugacaaccagaccuagugacccauauaaccugucauccuagaagcuggaaggcaaaaagauaaggaguucaaggccagccuugaguucuaaaggccagucugagcuguagagugagaccauuucaaacacgagagggcauguggcuccuccauugcuuuguaacaugacaguuuauagcugguauucuaaaagugugugucugauggguccccaucuuucccuaggaaucugggaaauucagacugcaagauccuaguguacaguacagcagcagcaguggggggugggggaagcgggggagagacagguagggagugagagagagagagaacacaaagaaggaaaaguaaccuucaagguagaaaaccucuugucuugauggccaauacugccccccaguucccagcccccaccccuuccccgcccauccuguucuuuuucccacuuaugauggcggauccagucaacccacacaguggcggugguugugcuguaucuaccaacgcccuaaaugccagcgucuccuuucagcugaagaugauucucauaaaaugcugugauaucuccaaugaaguccgucccauggagguggcagaaccguggguggacuguuuacuggaagaauauuuuaugcagguaaaagacacggagccaucagauuaugggugccccuuccaacucuguggacagugcugcgcuugaaaaagcagaccaguguggcuggcauaugcaugccacaccccagcagcccccacaacacugucuguguagauaucuggcagaaauggcguucugcuuuggcauuguucugaguaggcauggcaacggcacauaccuguaaucccagcagcugggaggcaagaagaucaggaguucaaggccagcccugauuaggguguacuguauaugugagacuguaaccaccagaaaaaccauaaugguggaacugccagccauggccacuuauagacacuuuuggaagcagacucaagauaaguggcuaagggucaagaagugagacccaaggggaggggcagccgcuauggugaauccaaacaagauuguucauaugguaguuaugaacgaggauagugguuaggacgggaugggagaugcagacaaggagcuauugagcucagccuuguaagcugcccuggaaugcccuugagacagacagacacacucagccuguguuuagacuugggcccuacagcuucaaccugcucaccuuggcucauauguagccuuuaugcugcaggcucugggaccucaccacugaacugccuuuguguggucgggaggaucacagcuagacagcuagacagcauguacuguucuucuaagaacaggacugcucugugucccaaaguccacgggccuuuaugccuucaaugucaccgucacucuguucccugcagagugaccgugagaaguccgaaggccuuccuguggccccauucauggaccgagacaaagugaccaaagcaacagcccaaauuggguucaucaaguuuguccugaucccaauguuugaaacagugaccaaggugagugaucaugcugccuggacagcagcaguaaacacacaugugcacacaugcaugcaugugcacuuuaaggauaugcauggugaguacaugcuguugguacagcagcaguaaacacaugugcacacaggcaugcaugaacccucuacagcuucaucaucuguugccauggugaugguugccuggcagccauucuuuucagcuguguuaaaugcucugcccccccccccccccgugcucuucaaagagcucccugugugugagucgggcccucggugcccacuuuccacugcccaucucugccagcuuuaagacucagccaguuguaccagcuguuggcucuccuguccuuccaggccucaccuuaaaggagcgacaggaaucgguacccacaaccagauccuagccuucuaucacccagccucuguagccuccaccuuccagguccuaagcugccuauggguccuguccagucccuggcucccaaacacacacucaucuuuugccaccccauuggucccaccucuaaccacuguccaucauucccuggguaucucagagccacccacaugguuucuauuuuuaagacuaccaccaggaauuuuaucagaucuguccccaucauaagccccucugggaccauaccuacuggaaggaguggggaacaggagaagauuguaggcuuucugggguccuacgaagagugacaggaaccugagccagaggcugagaugggagguggguaaggaugcacugaggucuccaggucucggaacuggcuaggagacacacacuccuuggauuucucuugaaggcccugauuugaggccacuggagagugauaucccugaggcucacaaguacccacaagggccugacagcccuucuccaguguucuucacagcuuaacacgaugguggggucugaucuugaacccucugcucuccagcucuuccccguuguugaggagaccaugcugcggccgcucugggagucccgagaacacuacgaggagcugaagcagcuggacgaugccaugaaggagguaaaggcagugcagagggugcaggcagguaggucagggacuggcaggaaggcaguacaaaggccgggcgcaggagccaagccuugggcuggagaaauggcucaucgguuaagagcacugacuguucuuccagagguccugaguucaauucccagcaaccccaugguggcucacacacaacuaucuguaaugggauccgacguccucuucuggcaugucugaggacagcgacaguguacacauacacagacuaaaagcaguuucuuccccagcagugcuccucugagccugcuggcuaaugagagccagcacacagccguguggcccuggagaacugccucugcagugucucuuagcaccuccauguccguguucuccucccggccaggaugccugcucaguaagggcugcauugaaaaagacagaggaacaaagcaagcgcccaagucccugcuuucagaaacagugcacgcagggccacucagcuaccccuguggucuggaagauagagagguuuuagggcacuauggaugcugaaucccaaaagaggguaggagccacuacccucuuaacaguuucuuaaaaggaauauggcuuuuuuuguuuagccccugugugagcaucucuucuuccacacaccuggcacuagggauucaguucauaccuccugcccgauguggcugccagauguagucuuucuccacccaccugaugguccuaccaggacauccaugacccagaaaacuucccccacuucuuauacacuccagaccucucuuuggccaccgugaccccaccauccaaccuggcaugccccucgggaucucauuuccuauucgguacccaucuacccaggcucucuaguaaugaauggcucuauauccaucuuuucugccuucuuucccagguguggccuggcguuggucacaucccccucagccacaucugccacacacauccccagugugcaaugccaggcauguuauggaccuauggugaacucauacagguugacugaaaguacagaccagcaaucccaaucucccugguuggcaucuccugccacaggcacaaggcagcucugaaaaucuaaaaggcuaagagcaaaacacaccaaagggccacagcaagagugcauuccaggccagauucccacaggaaggcugcaggggccucugcuaucacagccaucccaucagccauugcucugagaggaccugagucugcaauccuacauucugcugcucagugggaagggaugccaggccucucuagggacuaacuuugaccucuguucccuuaguugcagaagaagacagagagcuuaacaucuggggccccggaaaacaccacagagaagaacagagaugcaaaagacagugaaggccauucuccuccaaacugauggacaucucaaugugugcaguaaguaagaggccacugaaguucuauauguggggaggacuggguacaugcaauaugagugaguuuauauauguguguaugugcauguguguguguaugugugugugugugugugugugugagagagagagagagagagagagagagagagagagagagagagagagagaaagagagaauaugugugugugcacuucugcuuguguuuguauaugcauuugugcauguaugcauguguguguguguaugugugucugugugugugugugugugugugugugugucugugugucugugugugugugugucugugugugugugugucugugugugugugugucugugugugugugugugucugugugugucugugugguccuccaccuucuucuuauaaagcaccagaaacugagucaugggauauccacccugaugccuuugccuauccuaaucgccuccuacagccuccuuccaaauaguacagucagguguuuuuaccuuuaaccucacaguggagauugggcaucugcaccagaacacuccagaagcaccagggacacuccagggacacauacaaaguaucaauugccugauacacuuagagggcaagggcagagucaaaccacagcaugaaguccgcuuuccaauaagugaaacuuuaauccugugcaucccaauuagaaccugggcucugauuuggaaggguucacacuuuggauagagaaaggauuaauuaucaggaugugugccacucuuuagaugaaguagucugugaagugcaucuggaguauuaagagcuuuuuaaaagcauuugucuucgucaccacaagcauguccccugacaucugcugacacagugcuccaaacacccaucagccagcgcuugcuccagcucgugcuccagcgcucccuagccucucacuaagcacauggcuguuaggucugugaaauaagccucggguuucugcauggagcuggagaagcuggguuugaaagggaagcagcaaaaaugucagccuaagacgugcuuuuuaguaaagucuuuugagcagcagccgugugugaaccccagagcugucaucuguaagccugaugacaugucaccaugccgauacugggacuugagcaguggugugaacugcuguuccauacugcaguguccauccagugaaccucaaagccaggucauguucuugagaagaaacuggcacugacauuguuuaauugugcccacguggguuguauggcugacaagcucuuuuuuuuuuuccaguuuauuuuauuuguguguacguguguuugccugccugaggaugugugugcuaaaguccauagaggucagaagagggcauugaauccccuggaacuggaguuccagguguuuguggacugccacgugggugcuggcaccugaacccaaaagcagccauuguucuuagcuguuacgccaucucccugccccgaccucauucuuuuauaucauauuaauuuuuuagauucauauacaaagucaugguuuucacccuggugucuucagacaugugcaccguuaucccuucugcuccugccccucccccacaccugcuuguccuggccagaggguucucuuucauucuccaguuaguagcccccuuuggcucuguguguguggcguguguguguguguguguguguguguguguguguguguguugccuguggaggucagaagagugcacuggaucacuuggaacuaaaauuacaguuauaauccaccauguggaugcugggaauuaaaucuagguccucuggaagaccugaacuaccucuccagcccuacuucuguugaaagaaagaaagaaagaaagaaagaaagaaagaaagaaagaaagaaagaaagaaagaaagagagagagagagagagagagagaauaggaaagauugauugauuuaauuugauuuuuagauuuauuuauuuauuuuaaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuuacccacugagccaucucaccagcccuauuuauuuauuuuaugugaguacacuguaguugucuucagacacaccagaagggcauucagaucccauuacagaugguugugagccgccgugugguugcugggaauugaacucgggaccucuggaagagcagucagugcucuuaaccacugagccauccuuccaccucuauuuuauuuuuaaauuaacacacacauacauacauacacacguacauacauacauguacacacacgugcagguaugugcacaugacugcagguacccacagagaacaggagagggcauuguauacccugggacuggaguuacagguacuugcuggggcuagaacuugaguccucugcaagagcagugcuggcuccuagcacuccccagcccaggucuuucugcuuucuucucgcauguuugguauuaccaucucaaauccccacucaguccuguggcugugccaucucccuccaggcccagcagagaaaaacaugccauuuuccucuuuuuccagcagacuguaccaguuagagcagaugaauuguggccugugaguggacagagccaagcgaggcuucccaggaucuuccacacaaggauggucacgcccagacgaccccugaugaccugcuacagaccauguuuucuaagaaccauuuuguucacugauauaaaaacaggaauucacgaugcuguacagaauuuuuauuuuuaaacugucuuuuaaauaauauauucuuauacagaaaugggucuguauuuuuuuucuuuggguuuuggacucgggcuuccaagaacucugguuuuccccuuggaugaaucuucauguggaugaaccgugggaugggaugugagggaucauguaaauuccacauuaaaugucagaacggugcccgagua

SEQ ID NO: 8514 - RNA, 11223 nt, Mus musculus
ugcgauuggugaacguggacgcggggcggagccugggguggugcgugugcacaaguaggucacguaccuaagugcgaccuccgcucuuggcauuugugccauggcggucucucuccuccugcggggaggacggauccgggcgcugaagguaaagggcuaacgggcgggacauaccgggcccuuagccugacccuuaacugcacccgugggcccggugcggagagggguccuagggccugugcucaccugacccggacagaaggguuuucucugcaggagugaaaccgagucacugaggcuguuuuuaaaacgaaaccuggcuuucucugcaaaacuaguauuggguuuuguuuggguuggguucgguggauggaaccuagggcccugcgcuugcuugucaagagcugucauugaacuggccccaaagcaggaaaugcucacagcaauauaaaauacaggugacagagggcucccgucgucaaaugggcacuguuuaauuauuccuucagguauauugcucccagcgauuuuuuuccagcguguaucgguacacauaauuuguacacacacggagaaucaucaguauaaauagaaguuuuccgguucuuuugcuccaccccccaacccccucccuagcaugaagcauccuaggaucuaacacauaccuuagcgguugccggcugaauuacaauaagauucuucucaaauuguaacacuucugaagcaauuaucuacauccuauuuacuaguagauaguguuucugcaacuuuacuaacuguagggagauaauuuugcaaaaagaaacauaguauuuuguaaaguaacaaaauagccaguagaguaaacuggcugcccuguauuaagacccaggagucuugggcugagagccaacugggccuugcauccaggauccaggccugaguguuacagccggcaugauggcugccauccagaggccagcacuucccuccccccucccccaugcuaacacaggcucccccccuccccccaacacaggucugucuaacugaggcuuugcaggacacgugacagcaagagcuuuucucagaagcaucugucucccauccucccaaccccugagccccagguuucugcagaacauagaaccaggcucuucuccaagauauccugaagcuuuguauaacgaagcuggcaaagucuuuauuuuuaauaaaaacuuuccaagugccuauuuugggaaauuucugcaaagauuagggaaauaaaguuguuuucauuuacccagaugcuaauagugauuuuccuggaacuugggguauauuuuucuugcagcuuuugggguauuugucagagcauucauaauucccauauguuaugaccauuguaauaagugugccaugugaauaugaauauauaauacauuguaauggcuguuaucgaagugaguaucuuugcuugucugcucuccccaggcugugcuccuggaggcaaggguguucccgggagaacugguuucuguagugaggcugucuacagagucagagaagagugcaaaggagaaagagcuacaucccaagacacaaagugugcucaaaggugagauguuaaauaugaucucgggggugugggggaggcaaagaacgaaaagucaguagcaugaagugaggugggccagacgcauaaccuaagacuucagcucacagugagauggaagauuggaccucacugguaauacaaaggcuuugacucuauguuagcucuagauauggaguagugcuuccuaaauggccaacccagcagggagaacagaagggcgcuggcauuuccaaggcccucaggaacacacgcuauuuaucgugaaauagggagaccccacccuaccuucccgucccugguuuuugguuuuuccugacuccccaagacucuggugaaguuuuccuggugugcccccucaccauuugggggccaucaugaccucggggagggaauuaggaacgagcacuucuccugugcugcacgcagcuaggacccagcugguguccagcucucuucaaaaucauuuugauuucugucacuuguuccucucucugaaugccagcguaggauggccucaugccaggcaagaugaaaugcagugcauuuuuaaugcuucuccucugaggauaauuuuauuuccuaugccuugcuuguuuuuuaugguuuguguauuggguccauugaauuuaaguuuuuuuuuuuuuuuaagauuuauuuauucauuuuauguauaugaguacauugcaguugucuucaaaucccagcaaucacauaauggcucacaaucaucaguagugggaucugaugcccucuucuggugugucugaagacagcaacaguguacucaucauauacauaaaauaaauuaaaucuuuuaaaaaaagaagaagaagaaggaagcaaggaaagaggccuucauuuuuacgaauguaacuaaguuguguaccauauauggcauagacuuuauuuuauuuauuuauuuauuuugguuuuucuuuuucuuuuuuuuucuugagacaggguuucucuguguagcccuggcuguccuggaacucacucuguagaucaggcuggccucgaacucagaaauccaccugcgucugccucccgagugcugggauuaaaggcgugcgccaccacacccggugcuuuuuuuuuuuuuuuaagauuuauuuuauguauaugcguacacuguagcuguuuucagacacacccaaagagggcauuggauucccauuacagaugguugugagcuaccaugagguugcugggaaucaaacucaggaccuuuggaagagcagucagugcucucaaccgcugagccaucucuccagcccaaaucuuaucuucuagacacaugauuguagacuacauggguuuuaggacccaagagccuacuauauaagaacaggggucuguguggauagaagugcugucauccugggaagguuuucgaagggugaccuggcccgggaguuagccuuggauucccaggaagcuccuggcccucugcagccaucugagccugcagcuuugccaccucccugggugcuacggggcuguagaagcuguggugugugcacgcacacuccaagugcaugcucauccacuuugugaauggcauuuuacuucaggguagaauauggucuucagaaauaauaaguuguucugugcauauuacacuuguauauucuaauguaaaauacuuucuguacgagcucacacuccuaaauuuagccacauaugggccuguguuuucccuugaagugccaaggauuagaaaccaucucaauuagaguggcuuugggagccccugggucucucuacaucugcucuuaauccccagccacugggaguggguuaggacccacccuccggggcaauauuuucuguccuacucuggaggcuccaauaucuuagcacaagcuuccuuccccaggaaagcugccacuccauguugguaccaggaugcucccacaggcccuucauggagacaugccuggguuuccuugcuguuuguugaauccugucaccagagcacauuguacaggucuauaagauacuggcugagcaguuugcacguugcuuucugucaguuuguuuuguuuuguuuuguuuuguuuugcuucuuccccagauucugucauguaguauagguugggcuugaacuccaauccucuggcgugcugugggguggggcgaggggggcuacaaguaugggccaucacaccuugcuuugggguagcucuuauaaagacuauaaagccaaaguugguucuccauuuagguuccagcccagguuuaaaaguguguaguuuugccggaaguagaaguuagacauauuaaccagagccacgguguguguguguguguguguguguguguguguguguguaaggagcauggugugaacaugucuuacacauuacccugcacaccucuuaguauugaggagcugaagugucacgucaugccagagagguuugccuucaacuuuggcauucuggcccauguaguauuacugucuuacuucugggggggagugugggggggaaucuggauucuucugaauuuuuuaguuauuuuuuuacaaauguauaaucccaagccuaugaaaucugagugaucuagccgggcgugguggcgcacgccuuuaaucccagcacucgggaggcagaggcaggcagauuucugaguuccaggccagccuggucuacaaagugaguuccaggacagccagggcuacagagaaacccugucucgaaaaaccaaaaagaaagaaagaaagaaagaaaucaaucugagcaauaucacuucuccagcauguuuaaaguaccuuugugagagagcuuuguuuccuggguuaguuucauaaaccauuggguugccaauuuguuuuaucauuucuacacuuuauuuauuuauuuauuuauuuggguaugugucuaugucauuguguggcuaugcauacaugaguacagugcccauaaagggcagaagcgggcauugaaucuacugugagccacccagcgugggugcagggaacugaacugagguccucugcaagagcaauaccuguucuuacacaccgagcugucuuuccuguccaaccacugcacgguagccuuuguuucuuugaccaaaagcuugaagacuguguucuccauuuucagccagagaaucaggaauuugaguugugucuugagaggagauggcacugccacagggagaaccgguuagcgcuguuagauaguauucguagacuugguuguguguaggcugccauggucccuuucugugcucugagaggaggcugcaggagucugggguaggcuguuuguuaaagaaagccaggcugugagcagaugcaacauccuguguccacacaccaagugcuuccuggaggccacaguuaccuuuuaugaccuacaccauggugggggggggggugaauucagacuuacuguggaugccgguuagugguagcaacugagacuugaagaugagggcaggacagaaacugaccccccuccaucaaaagcaaaacccgcuccuucucuguuagccuuuuccuggaauucuuccaguaaucaaugagaagaugaacugucaggccuucucauuucaaaauacugugaagucuccuugaaagacuagucugccugucuggaauguucuuucuguuuuaguacguaaauaaucuacaauguaaguuuuuauugcguguguguguguguugggggaaggcuguugaaccaaggaccuugcauaugcccagcacacacuauaucacuaagcuauaacucaguccugauaacagcuuugcaacucauuacaaccuucuaaguucccaagcacuacgguagugcucagugguggcuugccugguaugcccaaagcccuggauccagcauaucuuggaagagccaguccaucauuuugauauucaaaguagccaucugagaguuuuuguuuuuuuuuuucuuuuuuuagauuuauuuauuguuauacauaaguacacuguagcugucuccagacacaccagaagagggcguaagcucucauuacgggugguugugagccaccaugugguugcuggaauuugaacuccggaccuuuggaagagcagucagugcucuuacccacugagccaucuugccagccccugagagcuuuauuuauucauuuuaauuuugagauagagccuuauguagcccaggcuagcuuuagacuugcuguguggcuaagggugaccuugaacuuaagagccuccuuccugccucuacccccucuagaaugccaggaucacagucaugggccaccacaccagcuuuaaugcagggcuggguuggagcugagggccuuguguguacugagcuagcaccuggccaggguaaccacaccccaacccucaggcuaucuccuauuugcaagaguccagcucagagaaauaccaguggugguguagacagugggggggggggggggggaggcuggagagauggcucagugguuaagagcacugacugaucuuccagagaucaugaguucaauuccaagcaaccacgcgcgccaccacugcccggcacguaccccugucuuaaggauuguacaucugcucaucuggagaauguuuggucccacuucggcucagaugguaauuaaccauuuacaacucguccuguguuuuccuucugaucuguaugguuagaaagauugacaacgagccgggcgugguggcgcacgccuuuaaucccagcacucgggaggcagaggcaggcggauuucugaguucgaggccagccuggucuacagagugaguuccaggagagccagggcugcacagagaaacccugucucgaaaaaaaaaaaaaaaaagaaauaaagaaagauugacaacugagaagacucaacgaaauuagcucuaccgugauuuuuuuuuuuuauuucgcucuuucauaaaugacuaugaaauguaaggguuuuuuuugguuagaauuuauucuguugggcuuucugcuguuguuguuucugcaguuuaacaucugucuccagugauauaugugguauuaaauuauuuuagacuuuuggguuuuguaaaacuuguuuucuuggcugaagaaguccccacgugaccugugauuuuugagggcuuuucuuccuuuuuagggcagcuuuacaagaaaagcuauugccacucccuccguccuacugacuugucucacgucucaccggaugcaccaggcacucuugucuagacuucugaugcuuugcucaggaagggcaaacccugaacuuguuaauauuccagugguguuagcgcuucaagacaccauacaccuguaaaaccugcguagccaagggaaagcaucugccgucugcauuagaguuggccugauguaaaucugaguggggucauuuaagauguccucugggaagcaaugcgugugagaaauggagucaguuacggcucuuguuggugagaaagucccuccuugaagguugcacucagaggcaagucugcucacuccuaaugcugucccggcgcacggggagguucccggaaccuguguuaccuugacagcguuauaacacaacaugcugguacgcaaugaaaugucuguggcuuugaguuguucuuuaaauaacaaauguuccucuuuaugccguuucccagaugugggagcagaggagaggggcaagcuccuaaccgcgcacacagcagcggcacuguccaaaaacucaccuccacccaguucuuacccaucaguggagaacacagguggggcuguggcaggcccgcacccuggcggcagccugcugcccacagaugaagggcuuccgaagcauuugucaagaaagacuuugguagcguuuccucagaaaguuaugccuccaccccaagcacgggguucugacucaaaggcucaggggcacgugcagaaagugacaaacgauucaucuucaucuuccucauccagcuccucagauucagauucugauggggaggaacaugacucagaccgugcuccccgaguggcaagcaaaggcaaggcagggucuuccaaaccggaggccucccggcccuugacgacuggagccccuaaaaucacaguuucugcaaaagagaaggccaagguccaaaagccacccacagaugucaccuacccagagaagacccugcagccuaagaagaaauggaccaagccuguagaagacagcaaagaagccagguccaagcccgugacauccaggccacaguccagugagauguuggagcaaaacgugaaggaagaacaccaacgggggaaaccgagaccagacaagacaggaaaggaaagcgcaaagccaugugaagcugaaggaaucuuacccagccacgggaaagucagaguacccacacagcccacuagugggccagugcccacaacgcaaauacaagaggccagugcagaacauccgccagccguugcccccaggaagggagcuagauauccggaaccaaaagugccagagcccggauggaagaccucuucuccccugcucagaaaagaaagcgcagagaagcaggugccagaaggaggcucccagguccaggaggucuuggaagaucagaaaccagugagcuauucgaagacacuuccuguucaggagaaagauacuguugaagagagugccagaccacaucuggaggggagguuccagguggcagucgaagccccacccacugaugcaguccuaccccaggaagccccggccgacacacaggguacaccuugccuugguucagacucuccuuguccuuuaggguguauagauccuaaagacccucuugaguuucuguguauuuagaaaggaguauuuuuuuuuucuuuuucuuuuuuuggacagugucucugguagcgcaggcuguuuucaaacucgcuauguagcuaacacuggcguugugauccugaucccccugccuccgacucccaggugcuggcaucucucauguaccacuuggccucauuuaacuauuucuuagauggcauaauuuaugaaaacugacagucuagaaucaccacgcauaaccuuggaggauauccacgcauguagcucaugaacuugcccaauacucagcugaguggaaagcagcacaaaucuuguggugcucucaaaagucaggagcagcagucacacggcagugauagcccucggguggacugaacuagacccguaccuuagugaacugaaggaguguuaacaggcaggcaaccaggcuggagagauggcucagugguuaaaagcacugacugaucuuccagaguucaauucccagcaaccacaugguaguucacaaccaucugcaauggggucugauaccuucuucuggugugucugaagagagcaaugguguacucauauacauaaaucuuuuuuaaaaacaacaauaacaaaccagacagguaaccauggacagcaucugcgggcuuuucccagcacaaugggcuguauaaucgucuacugugaguuuccaaugaggggcuuuucaagggguacuauacuccuaucguacuaagugguuuugcacaugugugacaccucucugagcagcucccuaaagaacagcaauucucgccgggcggugguggcgcacaccuuuaaucccagcacuugggaggcagaggcagguggauuucugaguucgagacuagccugaucuacagagcgaguuccaggacagccagggcuauauagagaaacccugucucaaaaaagaaaaagaaaaagaaaaaagaaaagaaaaagaaagcaggaauucuuugauuuaaaauccgaaguucccgaguccuccuuaagauggcagcaucgccgcuaacgaggccuuccugcaccugcgagucauucccagccacgcccccuccucaccuaauuugcaucaccauggugugcuaacuaucgcucuuccgggauguuuacagcauuuauguuuucuuccuuuaacauuucuccuccuucacuaguuaaccauguaccagugcacgccugacuucuaagaccucgggaccugccuuuccgaccccguuccaguuuucagaccugaucucaacuagagaucuuaaaccuagcacggaagcacaggcauggggauuucuagguuaacucacagggcugccgauguagcuuaauauggggcuuaaccagugaguaagguccugggcucaguuuccaacacugcagaaacaaaaacuugccuccccuccaucccuagcccucuuugcuggcagcugaggcucacaaaguguccaugcccaaagcuccuugcuuacaggugggcucuuauugauagaguuuauaacccacccagcucccaucaguuuucaccggcccugccauaacuguguacuccguggcuuugaagguauaccuuccacacacugaagauugucagcucaccgaggaagagaagaugccauccuuuuguccuuccugcuugcuugccugccuuccuuccuuccuuccuuccuuccuuccuuucuugaaauuaaaugaagagaaacagcuuuuggauuuggaauagcgaaccauguauuuaaguuggugggguguuuguuucugugucgugcagugugaguagaacugaggcaggaagccucacgauucccagggauccaggaagauauccgcacagacuugccuugcggcuacgcugcauugcuugucuccugccuuguugcauuugaguugcagaagagcccguccuuuugcuuuagucccaugcuuugaguuuuaagauuuucaauuacuuagguacauagauuuaauuuuuucucauuuaagauaaaaggagaaauuacuauuuuuuuuccuaugguuuggaagguaacaauuuucaaaaaguuaaaauggcaaagcuacagcucuuucuggguuugugugcccauuuucaccaauauuguaacacucagguuuuucucauaucugcacaugcuuauuucuaucacagacagacauccaaaagaaugugauuucucuccuguguccaucuguaauuccagauccuuccaaaugcacagugugaacccagggcuuaaaaauacaaaaaggacgggcaaggugcuccgauccuguauaagaaacgaagcagccuuguccuguccccuaucugagagguuagacucugccaucuuauuaacaacaacaacaaaaagcagagagucuccuggcaggccugugccacaaucucgggaaagguuagcguuuuuacaauggcacugccuccgugugcuuugugauucugcucagccauaagguucggcaugcacuucaggugacucuuuuacauugcccuugaagaugcagggcucucaaggucuccugucugcuaguuagaaagcucacacacuauaaacugguaguguggagacuucugcuuccuaagcgccccagacagauuugugugucugacagcugucuugucaccuuucuccacagagcccgagccgacugacaccaccaccuacaagaaccugcagcaccaugacuacaacacauacaccuuccuggaccugaaccuggaccucuccaaauucaggcugccacagccgucuucaggacgagagucaccucggcacugagcucagcucaggguagaccccgauguugguucccaugaauccuugccugugagaauaaaaggcagagucacaaagcucacuaug

SEQ ID NO: 8515 - RNA, 1990 nt, Mus musculus
caguccaacugggcaucaggacaaagaagcugcccuugcaugaagacauuuguguuuacuuccugaacuucacugaaaaaggauuuuacagcccugggccuggagggucacccccgucaucccaacauuaggaaggccgaagcagaaaaauugccaaguggaaggcuagccugggccacacagcgagacucugacccagacaggacaaaccaacacuuuacaaaaaugucggcaucccuugaaucugugggucuaaucuggaagcuggccaacucugaaaagaaacugaagguacaacuagcuauacaaauuggugcugcuugccaauaacacaggguggccacuggcacaggguaguguggccacuuguggccugggagacugggucugucuaacccacagcguaaccacccuacugccacaccgaacagaauggguauaaaaagccagcgucuggcccugcaucuaaagggccaguaugaccccaggguuguaggaugcuguaccagaaacacagcuguucuggggcaggcgugggacaaaggcuuugcaucuggaaaccauccaaagcuuccagcugucagagucaaaccaggaaccauggaaaccagacccuugcagcucugugucgcucucugcuuacacuuucagggaccaugccuugcuggugggugaguccugaccccagcacaguucuuccagggugaaacccccaccaccccagcaaacauuuagcagacgagcagguuuuacgugucuguguuggucgguuauuacgguuauuacgacuccaaggucccugagauuaucuacuuaagaagaaggaagguuuaaaagacuuacuuuuuuuggagguucugacccguggucuaucagcccuguugcacugggccuaggcugaagcagcauauuaaaagccugggggguggggugggggaaggguguguguguaggagcuccucacaaagcacccaggaagaggaaauaggauggggugagcuaacuuccuuccccuaggcucuaccuauuaaaggcuccaccaccucccaguaacaucauagacuggggaccaagccuuccacacacagcugagaacuguucuccaaaccuuagcagucaccacugagaaauaccgugggaaacuguaucacucuagcgccccggucugagcccaccacauggacagccagucgcaaacuggagcugugggaucagguuuaauccgguuguggagguggggaagugaacaacagagacuccucaugcagcaaggaccugguaccuccaggacagcgguguccagaucggaauucccucgugcacagggcccagcuugcccaacuguguggguugauuagugcaugguagagcgggggcuaagagaaccaagcaaccugguuucucugccacagaucugagggauagggaaggcugucagggccuuggagggcacuacccuccacagcucccacaucuggaaguucucugaauccuauggaugcugcagagugcaucugugcucuuagccugguagguuucccuucucacaucaaucccuaggugggaagcuucagucaaccauggcuccacuuggaacgucagaucccacaggccaagacuccaccccgccacaggauggaccucacuucacacuucagguccuggcugguauuggugcuuuggauagauuuguauaaacugggaguggggggugguuaugccuugaauuugaguuccucugaguauacuuugucauuugcuagaauuguucguagaacucuaaaagacauuuuauauacauugaccucuuuauuuucaagggggaagcuuuaagacugagcaugucgcagagguucugagggauagggaaggcugucauggccuuggcgggcacuacccuccacagcucccacaucuggaaguucucugacuccuacaguuccucuuuguuggugguugcggggaaauauaaaaaaaugaacgagcgagc

SEQ ID NO: 8516 - RNA, 1990 nt, Mus musculus
gcucgcucguucauuuuuuuauauuuccccgcaaccaccaacaaagaggaacuguaggagucagagaacuuccagaugugggagcuguggaggguagugcccgccaaggccaugacagccuucccuaucccucagaaccucugcgacaugcucagucuuaaagcuucccccuugaaaauaaagaggucaauguauauaaaaugucuuuuagaguucuacgaacaauucuagcaaaugacaaaguauacucagaggaacucaaauucaaggcauaaccaccccccacucccaguuuauacaaaucuauccaaagcaccaauaccagccaggaccugaagugugaagugagguccauccuguggcgggguggagucuuggccugugggaucugacguuccaaguggagccaugguugacugaagcuucccaccuagggauugaugugagaagggaaaccuaccaggcuaagagcacagaugcacucugcagcauccauaggauucagagaacuuccagaugugggagcuguggaggguagugcccuccaaggcccugacagccuucccuaucccucagaucuguggcagagaaaccagguugcuugguucucuuagcccccgcucuaccaugcacuaaucaacccacacaguugggcaagcugggcccugugcacgagggaauuccgaucuggacaccgcuguccuggagguaccagguccuugcugcaugaggagucucuguuguucacuuccccaccuccacaaccggauuaaaccugaucccacagcuccaguuugcgacuggcuguccauguggugggcucagaccggggcgcuagagugauacaguuucccacgguauuucucaguggugacugcuaagguuuggagaacaguucucagcuguguguggaaggcuugguccccagucuaugauguuacugggaggugguggagccuuuaauagguagagccuaggggaaggaaguuagcucaccccauccuauuuccucuuccugggugcuuugugaggagcuccuacacacacacccuucccccaccccaccccccaggcuuuuaauaugcugcuucagccuaggcccagugcaacagggcugauagaccacgggucagaaccuccaaaaaaaguaagucuuuuaaaccuuccuucuucuuaaguagauaaucucagggaccuuggagucguaauaaccguaauaaccgaccaacacagacacguaaaaccugcucgucugcuaaauguuugcuggggugguggggguuucacccuggaagaacugugcuggggucaggacucacccaccagcaaggcauggucccugaaaguguaagcagagagcgacacagagcugcaagggucugguuuccaugguuccugguuugacucugacagcuggaagcuuuggaugguuuccagaugcaaagccuuugucccacgccugccccagaacagcuguguuucugguacagcauccuacaacccuggggucauacuggcccuuuagaugcagggccagacgcuggcuuuuuauacccauucuguucgguguggcaguagggugguuacgcuguggguuagacagacccagucucccaggccacaaguggccacacuacccugugccaguggccacccuguguuauuggcaagcagcaccaauuuguauagcuaguuguaccuucaguuucuuuucagaguuggccagcuuccagauuagacccacagauucaagggaugccgacauuuuuguaaaguguugguuuguccugucugggucagagucucgcuguguggcccaggcuagccuuccacuuggcaauuuuucugcuucggccuuccuaauguugggaugacgggggugacccuccaggcccagggcuguaaaauccuuuuucagugaaguucaggaaguaaacacaaaugucuucaugcaagggcagcuucuuuguccugaugcccaguuggacug

SEQ ID NO: 8517 - RNA, 4369 nt, Mus musculus
acagaguuuuuuguuuuuuuguuuucaaaaauuggggaaauauauuccccaaaauauuagggaaacauccagagaaaccccaaaccguaaacaaaauuuaagaguggcaauuccucauuuaguuaaauacagucccguuugacuuagcaauuucacuucuucccaaaagaauugagagcagaacuuaacaauguaucugugcacauaauaauguuuacugcugagcuauucacgggagucacacaaaaccagaagcacuuaacaguacccaucaccaggugagaagauacgugcaaccuaauacugccuguuccuaaaaaggcggggaaucuuaaaaccugacaucacaggaggaaaccuugagugaaagauguuggaaauggucuagucuauauagaagccagcaugguccuguaagucucuuaccccagcaccagugaggucacaggagggucaggaguucaaggucaacuucaccuauacagcguuggacagucugggguacaugaggccuugucucaaagucucuagagucagauuuguagacagaacacagaacgguggguacaaaggauggaggggaccugagggaauaugguuuaguuagauuaagcguuaguguggaccaaugagaaguugauggcagggaccacugcccaauagggagcacguucaguaccacaccuaagaaacgauucaaaugggccuggagagauugcugaggggcuaagagcacuggauguucuuccagaggaccuggguucaauucccagaaccugcacugcagcucacaacugucugaagcuccgguuccagaggauccaacaaccucacacagacauacaugcagacaaaacaccaaugcacauaaaaugaaaagaaauuauuaaaaugauaaguuguguguguuugugaccuauguaugagcaugcaugcggaggacaggggucaacacuggaggcuuccuccaucaaagccuuacuguuagagauagaaucuccuguugaaccuagagcuugcugauaaggcuaggcaggcagccugugagcuuggguggcagaugcuuucaaucaagccaucucuccauccuuacgaugguaaucuauugagaaaagagauaccuaaggucauagcuuagaccuucuggccacagacccaugugcugugcuugggagccauuccuucugcugccugcaggaaauauaggcagaaaagaacuaaaagguguuucagccugaccuacuggucucuaaguggcccacaguggccccaguugugagcugccaagucgaaccuuccuucuggaccuuuccaugacaugguccuaucagaagcuuccugcugagucuuuguugguaacccaugagcuuaacuccaaggacuagaguuacuuuauagcaggaagcccugagaauugagauacuuccugcuaagugccagccugacuauguguguguuggugggaauggccuuccagguagacagucccccggagaggcuguugugacuagacuucucucauuggccaggcucccaccuucaggggagggcuucacccugggccucuuguuauccuggguaagcacacagcuaccugcagagcucagugcuccuccguggggcugggcuccuccuccccagcccugccuugggcaggacccgagcuucuagcauauccaggagagagaccaaggcgguugggcacagugugcugaccaugaagguauggcagcacucugguagaauugggggguaacaaacugggucccugugacaggauguccaugacaaaggcagagcagcaguggcaccauuaaccagagaugccucccugacuacugccacuccccacagugggacagaguugacacugggggaugggggaagaacuuuugcucagcugugcucacagccagcugccaguuucaguggaggauggugccccuucccuuuucuguggauggggacauuugcauucuuggguacagccuguucaguuucugcuuucgacugggccuccagcuacauuggccuccacccuauguaugaaggaaaaccaguucccgugggugggguacuacugguuucuccaggcagcuguaagagcccuggggaaaaccccagcugagagagcauuagaaucacucagccagcccuggccaggugcgagggccaacuccgccccccccccuggcccuauuguccuuagagaugaggcgauggauggguuccuaaagucccauuuaaggugaucugggucacacacaacccuguccucccacugugugcugccaagcacuuaguggggcagauggugcaauuuccugcccagcugccaagcccaagcugcccgggaagcaggcacucuaguggaggcuuuccagugcacccaccucggaauaccucugaugcaguuuugauuuccaagagugugucgucauggagacguacuuagggggaugcacagaacaggucacugccagaaaagagaaaauauguguuauugugggguccaagaugagguuugggucugagagccuucuagaaaaccaggcuaucgccauggguacguggacuugaccucaugacuucacagaaaggcugauggaagaaggaaggggugucuuuggucuuuagccuauuguagggugcacuugcuuucucuuuuauguccguucauccaucaggcuaccccugguuguuaaggucaaugagaaugcauucaggagaccuggccagcccuccugacucuccucccuuaccggagacucagccuuucauggggcaggaguaguuguuuuggaugacaauuuccaaacaccagcuauaguccagguaggucuggguggaaacagccaacuccaggauauggcuggaggcauggcacaucaucuucuagauuuuuaaagaaguuagggagauaugacaagccuggugucugaggagauggccccucuccugcaggcucagcucucaaucccaucucuuagucaggguuucaauuccugcacaaacaucacgaccaaaaagcaaguuggggaggaaaggguuuauucagcuuacacuuccacacugcuguucaucaccaaggaagucaggacugcaacucaagcaggucaggaagcaggagcugaugcagaggccauggagggauguuucuuacuggcuugcuuccccugccuugcucagcuugcuuucuuauagaacccaagacuaccagcccagggguggcaccacccaccaugggcccuccucccuugaucacuaauugagaaaaugucccacagcuggaucucauggaggcauuuccucaacugaagcuccuuucucugugguaacuguagccugugucaaguugacacacaaaaccagccaguacaccagcuaaggacagauggugccaccuccacuaccgggggugacaucauaagucucagcagcucuugggucucaaggaucagcaaggagcugguccugcucauggaaggagguaacaggaggcugagaggagguuggaaccaggaguccuggaguuacaacacuggcuuuccuucccucacuugugagagugaauguguaaauguguccugugcccaccauggagcagaaauggccuagagauccccaggaaaggggaguugggaagaugggcagggccagaaccuugauggggguaacauugcuauaaguggggugggaaggaagagggguaagaaggggagagaagaagggaggguaaaggggagggagagaaaggauuaacaugggacaagcuuacucaagacucaggaaagggagagaaggaagagagagauggggggaggaguaucccugguugcuaugguaguagcccuuggucacuaacccagaaggugaagacacagagcaucuuugggcaggagaaaggggguaggugaagguuaccauggagaaaggcaugacuucaagccacucagauggauagauccuacaggucagaagcucugaagaguaugggucccuuguggcaggcagagucaagaugugccuggauccuggggccacaugagacccacuuggccccguccaccuccuggcucuucgugcccuaucacuuccuugacccuaacuguccuccccugcuccaucccagggcuccuccacuugucaccuccagggguccuccugaccauagcuauagugcuuuugguccugccagucacucacugucacccucuucuggacucugugcagcagcuuaccugagcucucucuuuaggagccuggggccagguauaguucuccugccaccaacuggguuagguagauagaugguguucuaauuucuuuucuguugcugaaaugagagagagagagagagagagagagg

SEQ ID NO: 8518 - RNA, 11559 nt, Mus musculus
ugaaccaaggguaagucaagauuuccccccaaauauuuuauuuaaauauuaaauuaaaaaaaauacaucaacuaaucauuuggcauacgucucucacauuaacaugagaaaugaaacgauuccaucauaguaaaaaaaaaaaaaaaaaaaacgaaaacaaaacaaaaccauuauauacaucugagaucacguagugucuuuaaauaggcgauuccauuacaguccaguccagggccgugaggaucuacaaaaacauagcacacacaccaaaaaaaaaaaaaaaaaaaaaaaaacaaaacccaaaaaacaaaaccccaaaacccaagaacuaaaaaccaugauguuacugucccccagaggguugauagcaacuagaagacacaaaaacugccagaaaguaaagugcuugucgauucugacacacagcagugcacaggccuuugaucugugguauccagacaggaacuaugggagaugagggcuggcugccuuaggauacugagugcuugcuucccugaugcacacaucaggugagucggcaggagggacacuuuuugguuuguucuguggagggcaccaguuccaacccagaagacuggucgguccuucgccugucuggagaguaagcgguauaggaugggccacggggcccacggaggaccacgcugggacaucagguuucggcgcugccucuuccuggccucagguaacucggucaaucuuuggcuuuugaagugucuccuuuccucucccuuaaugaccucagguuaauacugcugcggugagauuuggugguggaagucgcccgggaggcagagagacagacgcgagucagaaggguugacaucccugguuccuuccagagguguuuggauggcacggcuguugccugggccuucccugcccagguagaccugucagguggggccacuucuucccugacaccucuacucuguacaggagguggguagccuacaggccuuucaccacaaacauggggacaacuuccuaaugugaccaagggagguuuuuuuaagccagaaacacaaaaauguauacaaaauagaaaaaaauaaguagugucuguuuccuauuuauauacacauacaguauuugcuuuaaaaagaaacuuuacaaacacugaccuauacuuaugauccuccuggaaagcaagccagacagagcccaggccuuggggggggggccaggcuuuuaccaggaaaggucccaggccaagggcaagguagucauaaccaagaugccgacagccccuugguauugcacaauucccccaagucagguguucuagcgggacccugauaaugaaaugcauaaaaaucugauaauuagcagcagagucgagguacaaggccggaaggaacuuccucccuuccaggccucugaauaagccuggcgcacugacuugagcagcuacaaaaacccccaagcugaaccacgacaaggcggucuucuggcugacgggagaccccgagaaugcaugccguuugucuuccccugggcugagccuuggcuacucugaaacccacacagaaagcagcgaguucacaguuucugucuaaagcaugcgcguuucagaaguggagagcugugaacccaagccugaaacaacgccaaccacuacacaggcaugagcaacaguacgagcugcccccacuucagggaugccccagcucaucacgccucggaggccgcucuccccccacugcccuucccucccguccgcccgcccacgugacauacucucaauuauuauuuuucuucagaaaguuucccuacuuaucauugaggucacucagugcaaggagaaaacaaaacaaaaaacaacaacaacaaaaauccuaaaaagcccauacaccaaacguauugcuuguuucacgucuagaaaguucuuggcuuuugaguccggaaaccaucuucacauacuccgaaauuauugcuuggaagagucaaucggccacgguuggggggggguggugaagguggcgagguuggggggaugugggccagagccacccucacuguaccaggacgaaugucccccgcuggccagaggucagguccuccaucucacagucccccuguggcagcccagcuggaucacagccuggggacagccuggugaggcacuguggcaggggcccaguggggagggccacugggccagcacugaugugcaaguggguauccaggagaugcgcagcagacgccacaggggacaugccagccuggagaagggguguuggcagcaguggaauuccagacacgaggaggcugucacagggagcaagcacauaggggaccggggacagcugggggcccugcuggcagccagaugaggcggcggcgguagaagaguggugcuguaacuggagcagccugaagaacagagaggcggagagggaggaggucggucacccuuguuggcucugcccaguuuccacacugcccaggugggccccacccaccucaaagcugcagaugggauuucacauagcucugugugugacgugacacaucccugagccauccugccccacauccuggcuguuguggcaacucagagaugucaggcucaacaggagagucuuggucaccauugcucucaagguuacugaaccuacccagugucccuccuugcucuaucccugacauaaaggucccuaaggaaccacauggcaggacacaucuaagcauacagggaaugcuuguuucauaggcuccuuaaaagaaagggccaagagcccgggaaugugugucgggccuaccucugcuggugcaggaccucuucaaguaggcuccugcccucccgauugcuggucgugcagccuugcaggccggagcuuggggcugggguguggaagguacucaucccuccccggggaguucggacggaggacuggcacaccuggcgagccaacccuuugaucuuguucagucccaggaaccccuugguccucgcauuuuuccucagcugcugccggaaggccuucagcccuauggagacaagagcaggcagggguuuagcaggcucuuagguuauggccgacagcuuucagccugcuggaguuuccaggcccugaggaggagggaccgggaagaauaacugggcagcuauggccaagguucccuacagggcucguuuggcaguugcuagcuccugaguccaacaucuacaccuccuccgugaucagucaucuuccuaggucuggggcugugggcccucccacuggugugucuggggaugcuguggaggagaauaugcagugcaccagacgccggaggcuaccuggacugacacagacauagagggccucguagguagccugacccugagugacauagaaaagccugaagcaggcaugggacuguuuuggaaaggccaccuccuugacccugggccuccugcuuguuguucagaacgguugucccuugcacucagggccaggucugaguccacccuggaagccaagcugccuagaacugagguugcaccugaggagccuggauggcccugcacaggcugggaugagauauccacaacucccaucaaggacagagauggcccacuaggagaguagcacccccacccccuggggcaggagggaugagcacagaaccggaccuuacccugagugagagagguaucagacgcucuccgucccuccuggaagcugacgggagguaagacggcugugcccagaccugccugagucuggagcacagggguggcugacugugaucccaggaagggcgaggccaaucugacuggagagcuggugcccagcagcccugggguggccaggccacugccaagcccugcaggaccuucacuugcagagaaggggaggcagcugucggagcuggucccuuccgagggacucgccguggcagaggaggagacaauuaugccuguggggagaucggguacuugagcaggagaccucacaccccagcgugcagcccgagggaugagguacuuggccuguuaaagugaggggaagcugggguaugguauuccccaacuuaaacuuaaucuaggccaccagagccuagagcccuggcuaugagccccuaagugcaugggcagauggcaagcuaaccagcaagguucagaccccaggacaggaagagaaccaaggcaaaacaccuguccuucaaugccugggauagccaagggguggcccgccagugagaugaguacacgcgcgccuaacuaugaaccaugggucaugaaaaacaaaacaaaacaaaacaaaacaaaacacacacacacacacaaacccuaacugagggaaggcggcaggccaagggcacauuucaaguggucuuggcccucacccuggaugcugggucucuggacuuacaaggaggguugagcggggagaaauggguggagacuucagccaaugugugccuccggccugugcuuccgggcagggguuccuggaccuccuguuccuccucuaggcugggacccugccuggccuccucgcugauagcuguguccagcagacugcugggggagauggaucggugccggaacacuccacugcaguugguauccagggggaauaauaagggcugcaagggagggacagaagcccgucacuuccggggcucucccuacagauggauccuggugguccaucaggagagaacagggaacccacagaagacuagcacccacacaccugaagugagcuguggagaucacagucuaucucagccugcaggacagacugagccaaggccuggggcugugggcacagcagagagggccggaaagggucacacgggagaauuucuugaggaaccuggggccagaaaggagggauggguuguuagggaguacuuccagcgucaggcaccgguggcagcuggcugguccuacagguaaaacugacaagaggccagccagauacuagcuaaugaugcuaggggcccagucuuuaucugugaggucacacacaugugcaggugacuggugugugugugugugcacaugcaugcaugcaagaacaacagccggcagggccuggcccagaguaaagcagccauagcuccgcccauacuccacuccccacagccccuccauuucccacagcuuguggcugaagcacaaguuagcuugcagugagguccggguaccgcccugacaaucagugccauguuuaagcacaggucuaugagcuccaagggacaucucacagggccgggagaacuugggcuuugagagggagcucagccuuaccuccagacugcugaggucugagcuucggagcuggggcugucuggugggugcaggggugggccgggaugagggcugggcgcuucgaugcuccuugaggcgcucgaguaggagguaguaaauggcggcaaagugguuguagcugcuguucugcagagacuagggagcagggaugguagggucaggacgagcccgcucggccucacuaaccacuaggcuucccugugagacuccuccaggugacucccgggcagucaagaauauccuuagacaagcuggcgcuuaaacuagacuguagcucuguuuuaacuccacagcaagggcccugcuuuucccaaguaacccgaucccaccagcaucucaggauaugagggcuaggcacagccagccggccaccacacagcuugcucaccucuauaguccgcugccggucgaugccgagggccugcaugaucccuagcaccuguucguuguagucgcccagguuggagguguagccuugcaugucgaaggcagggucauccugcugcaggagaguggggucggccugcauccaccggugcuggcggaucugggcuauggugaugcgcuuagcgggguccacgaccagcaugcgucugaucagcgucucacagucuguggacgggaagggcucacacugaggaugcggaacugggccugggggcucauuccuacacccacaguagagcuggucacacaggcaaaaaccacccacaugacagucaagaagucugaagcugccauuuuagauuccccugcuacagaggaaagccaccauguuggggaccagacgcagagaaagacgcucuaucucucuaaguaccuccuguugugguacacgugaggcuaggcauaguuaugaaacagaaagccuuguguguaagaggggcuggcaucuuagcuuugcaaucgacaaugggggaguugcaaagaugaaggggcaauggcugguggggggacugcagaggcaggcuuauaggaaggagacggacugcagggagagguuccugucugaguuguaaguaggccacuggaaagcaccuguggcuuggguuucuguugccgccugaucacccagucccaacucgacugcagauuugcuaaacagcugagcaggcacugccaagacccacccaccaccucuugccuaaagccaccgccaggcuuacccaaggcuccucgcacccaccuugagacaugaagaaggggaugcggaagcggcccuccaguacccgcugucucagcguaggcagguugggcccgucgaaggggagggagccacagaccaggacguacagcaccacaccgaggcucugugaaugaccagacagcucagguugggacccugcuugccagcuccggggacugugcuggcaggcagcaggguccacaaagggcuccuacccagacguccagcuggggacccucguacuccuuccccucgaagacuucaggggcugcauacggggggcucccacaccacguggacagaggcucgccuggcuuguagaaauucccaaauccaaaaucugugaggcaaagggagagaggcacccgcaucagcuugggacgcgcacgcacucgcguccccacagggccaccccucgcccgccaggcgcuggcaucaguuugggacucguaugcacucgaguccccacagggccaccccucgcccgcccgccgggcacacacucuugccugcuagcuugauauccauguugcuguccaggagcagguucuccgucuugaggucccgguggacaauguggugguuguggcaguacuccacggcugacagaaucugccagaacuucugccuagccucguuuucacucaagugcccguuggaagucagauaaucugagggaaacaacaaaacagucacaccagaagacaccgagccgggguggggguggggguggggggguccugggggggggaggcauacaagagaaggcgggcuucaccuaaauuagcuaugacgaauucaacucaccaaacauuucuccauuuuuugcaaauucugugacaauguagagcauauccuuugucuccauaaccugaaauaacaaaaaggaaaaacuuaagugguagagaaaggcgcacaaagaagccgugauagucgcacuugaaucccaaacaaccuuugaccucucuccaagaaacagccuccaucguuuaaggaaggagagagggaaggggaaaaaaaaucccacaacccagagaagcaacuuuaaacaccuugggagaagccccucuggcccaccauccucacaaccccuccucuuaaaggggacagagccacuaacaagacugcacagggcaagcacuuggcgugccugccuccugggagcucagggggccaugagugcuagaauccugggaagguccuuuuagaagccccauggacaaaaaccauagcagacugagugaucaauacaaguaccccacccccacucccucuacugacaagacauuaggccuuaagaacaccuuaagagcaagacauuaaagccuugccagguaagcuacaggggauugcucuuuguacagugcagcgccuggcaugugucaacagaaauggucaaugucaacauacaccuucagaguucauuuauugaucggcaacuuuguuacuuuaaaaaaaaaauuaaaccauaacuaagcaacaaagauucaggguuuuggguuuuuuuuuuuuuuuuuuuuugguucugaaacaaaucaaaauuacacuuaugcauacgcauagguuaaauauuccaggggagccagguaugguggcauacaccaguaaucccagcacucuggaggcagaggcaaaauuaccggaaguucaaggccagccuggucuacauagcaaguccuagcccagucagucuacguagugaaacugucccaauacaacaaauaaaggaagaaaacaucucagggagagaaagagacuguauugcaauagaaagaaagauuucuuuggguuuaagacaugcuguuauuccuuuagaagauacuuuaaagacgcuuuuugagucauaaauuuuacuaagaaauguguuauuaaaaaccguagcaauucagcuaaaauuucagccauugucccccuccccacagugcagcagaagaccucugcuuaggccuuuucuacacagaagaaagggagaaggaaaacaaacuuagcgucuauaucuuuuaacguuucaagacccaaaauaaaccaacuguguugauauacaucugucaucagagacuacagcaggagacugccccaagucuaaggccaucaggacacagagagcaccagggccagcuagagcagcuagcuacauugcaagacccuaucucaacagccgcaaccagacaaacacuccccacccccacccaaaggagagaacgggaugccucagcaggacucuggggucagaggucaggugaaugaaugcuagacaccaguaucaagaccagaguaccaguuggcuucagcagcccacucaaucgugaaagcugagucacugaagacaggagcuaaaauauccacucugacauccaucgcccggguaacauuuccucagugguaagagccuaccuaacccggugggcaaguggaaggcaggaagagggugcuaagacagcauagacuggcguccacaaacagacaggagcauaggagucuacccuucccagcccccucucucaagcacuggccccggaggaaaccugucuucgaguacaacuuagagaugaagauugaaauaauggacaaccccugagugcacagcccuaggcucugugcuuaagagauuccgagggagccgucaccacaggccaaacacaaacuccggagacuugucugccuuuguucugagaaggacuggccaggguaauuuuaaauuacaguucuuuccccuccugaaccauaaacacagcuuuuccaacugucccuuggagucaccucaggcucaugaggauccugagagucacugacaggacuuacacaccaacacaagcagauacaacaauaacaacaccacgagggcuggcuccucuauacauugagcuauuucacggcagcagaaguggccaguuaucacaaggcagauugaggaagaccgucaggaaacaaaagacagaaacgggugcggcauguccucagcccagcuuaaauggcaaguucauagggcugaaguaucucccuugcuucccccagcacuccgggcuacacucgggagacgagggcuacugcaccccaagacacuuuaaggagaccugggaaagaacagcugcuuuuuaaacguuuagcaauccucugcaaaggcggaaguuuccaguuucgcucaaguuuguccuucacucaagccugaccguacauacauauggcuauccucacagugacaggacuucaacaacggacuucaacaugugcaaaacuggaacacauuacaauacuagauaaaauuggaacgaggcaaaaaucaaguagaacccagagcaagagacuaacagucaauaaagcugcagagcccagugaaggucaaccuaguuacuuuguacucuguguucaguucccacacagccuuagaaacgcugacuaccuucagggacccaagaaggcucagggugugacauguggaaggauggaugugcucacggugcggcgaggguccuucggcucaccugauaaagcuugaugauauuugggugguucaaaaguuucaugagcuggaccucccgguagaucuucuccagauugcuagaaucuaaccgugucuugucaauuauuuuuauugcaaccuacagauuuuaaaaagaaaaaaagggggggaaaaacuucaaguaaccucauuacuucauuuguacuuuuuuuuuggacaaaugaauuucucaaacauuugaugucuucaagaggucacaagaaguugggggaaaaaauuaaaagaagccacuaacauuuuuuaaagggauagaaguuaaauuaaagccucuguauuuuucagcuagcuuuauuacaaggagcugcucacuucuguuguguuccccccucucuauuucucucucucucucccucucucucucucucucucucucucucucucucucucucucucucucucucucucucucucucggaagggggcgguugcuggucauuauuaucuuugcucuucccuaguaauuguacaaauuauguagaagcauaauacaaagcuuuuuucccccuuuaccagacuaaacaaugucaucguuuacaauugugacaaucaacuccacaggacugaaucagcacagggggccacccccuggcuggauccacccccugguuuagucccccccccacacacacacacaacacgcgcgcgcaccugcguuuuggugacucggugccgcgccagcuuaaccacugcaaaauugccuuugcccaggguccguuccacgucguaaaagcccacccggaggggcuucugcuggcccuggccagugccugaggggaccgcacugaacuccgacaugaucaccauggcuucgggccgcaccugcgggucagcgaggagugcgcucagcaccgaccgacuccggcucggucccgaucccauuccccgccaaacccggccacugaaacuguguccgccaggccaccacgcgugcguccucaacccucuguuccuccagccccaggcuccuaguguggccccgacccagguucgcagcucacacccccacucgcucauuccuugauacaguaucuccucggcuaaaguccccacgcacacacuccucuaucccgaacccccagccugcgcccccacgcgcgcgcccccucgaucccagguucccucagugcgagcccccacgcacgcgccccccgaccuccggucccggccgggcgcgcgcgccagcaguccacccgcagucgaccccaagccagcuccuggacacccuacggucccggguuuucaccgcgcucccguccaccagugccaacgcucggcuccucaggacaggcuccacaaccgggcgcucgcagacccgccuccgggcgccgacccgcaacaauagggagcccgccgggcuggaguccugcccgcgaccccaggcgcgcaccugcggguuucggagacccgaacccgcgccauugcucaccuccgccgcccuccgugagcccgacccgggaugccacccgcucggcugcuagcucugcuccggugcccgccguucgcgccgccgccgccaacgcugccgccaccgcccgggccucgccgcaugucagcgccccg

SEQ ID NO: 8519 - RNA, 1153 nt, Mus musculus
gcagucaagaugggugagccuggggcucagguuucuuuauuugugaugauggaaaauugauucucuuuggaagugucaucaaaugcuacagagaagcucccuuguguaggccaggacuuaucuugggacccagaggagccagcuugacuccagccccaaagcacccaugacaaagugaagaucucuguugaagguccccuaccaaaccagaaggaaggucaccuccauagugccacaagccuucaaccagccccugugguggccauuuccauucacccuacagagacugucccauagccuuuacuuucagaguagagccuucaucucaggaaggaugcauagaaacaaggaagguugacaucacccaggcccagaccagagaugccaugaggauccagggggaugcagacaggccagcaugguggggacagaugugacacuugugcugacaggagauguagcagcugaggcaaggugguucuucaaguucucuugccugaacuucaaggcuucacagacgaguuguucggggaugguaaacugagggacggaaggaguagagaggaggcuggggccauagggcucaaaguggcuguuguccaaugaccucucccugcccacacaggcuuuggcccacaggagaaccugcuuugagcagaagauggugucuuccuguguccucccaugguaaggggcuacgugugcccugaugucucuccuacaagagcucuaaccucacgggcgugggcuccauccuuaugaccuugccauaccccaugcccaccuccgaccaccuuuaacuuggggugagggcuuauuucaaauacauggauuugggggguacaugggcauucagaccuguagcucugugccuaccgauccccacagcaaacccugugucccagccugauuacucacagggagcuggaaggaagcucagcucacagguccagcuuagcucuucaaaucccgugggccagucgggagcaggcauuguucacuaaacggccaacagcaacgaguguuaacccccgguaaaccccaaucccgacauaacucggugccugucuggcauucggugcccauugcuaauccaucucugcaccugccacaggcauauguagagccccaucuggccccauccucuggagug

SEQ ID NO: 8520 - RNA, 5782 nt, Mus musculus
gcaaccuccgaaaccagguccucgcaggcuccacccccaacccccucauccuuaagugucucguucugcccagguacuuuagcugccacuuuagagugagucaugagagguggcaguaucuguccgagccgcgcaucuguuuccucgaccgguccaguggacuccgauagcacgguggaaucccaaaacaaagguggugggcugcuggcgccagcaccccuggcucagucucccgaccacggcggcucuguagucgucccagagcgcaaggauaugccggaguuuguggugacagcgcuacucgcacccucacgccucucgcugaagcugcugcgagcgcuggugaugagccugguguacuuggcugccuugguggccgcguuugucuacagcugcaucgcgcucacccaugugaugugccguccucgcaggggcugcugcggccgccagagguugucucccccagagugccugagagaccccacgcugggcgagcauugcuuucuaacccucagggugaguguuccucccgugaagguagguuucagggggcggaugcggauugaagaaaggagguugaaaugucggaucuggaacauccuuggguguucaagucucgggaggaagcucccauauuuccuuacccuucagcucuuacuuagauuggguccuucugcagaguuccggccugcgucugcacuaugucucugcuggucauggcaaugggccacucaugcuauuucugcauggcuucccagagaacugguaugucugggccccuggauccugaugcucacuggacuagggaaagguagaguucugacuaugagguacuugggaaaugggaaccgguaggguugaguaauccugggauuccacuauuuccuuccuaagaaguccagagcagaaaggugggauggcccaaagcuggguauaggaggugcauucugcugacuaaacucccaacucccuuacccaacagguucagcuggcgcuaccagcugcgagaguuucagagccauuuccaugucguggcuguagacaugcgugguuauagucccucugaugcuccaaaggaaguggauuguuacaccauugacuuguuguuggaugacaucaaggauaccauccuaggccuggguaugacucaucuucucauuuuugcuccuuuugggaccuacuccuacacgucuaccucaucccuacuguaucuuauaccauugugucucucucuucccaccaccaggguacuccaagugcauccucgugagccacgacuggggggccucccuugccugggaguucuccaucuacuacccaucccuaguggagcguaugguuguggccaaugguccucccaugucagugauccaagguguguuggacuaugccuaaagcccguguauucaccugugaccuggcacggggauccagauaaaugcuaguacacuuaggaguaauguaaauugucuugagcacuuucagguuggaggugauggaguauaguuaagugguugcacauuuguuuacuauauuagcgggaaaaggugugcucuccagcauugagagagagagagagagagagagagagagagagagagagagagagagggagagggagagagagagagagagagagagagagagagagagagagagggagagggagagagagagagagaggggaaggagggaaaagccugggucaggaguguuucugauuuuugcauuuucuuuuauuuuuagaguguuuacacacaucaucagaucaucuuguugcuagagccuagcucugagcaugacauuaauuuaugcuuccuauauacuuccuguaccuagacuugaguagacugaaagaaauucauacaauaaucuuagugacuuuguacgugaaggaaaguucguggagcugacuauacuagcauauaccuacuacuaucagcacuugaggggcaggggcuggagggaugacucaacagaggagggcacuuguuauucaaagaacccaaguuggauucccaguguccagaugguaucccacuguacuccaguuccaaggcucuaaauguccuaaacugaccucuguggauaccaggcacacaugugguacaaauacauacauguaaauaauaacaaacauuaauaaaaacaauuaagucuaaaaagaagccagauacaugccuuuaaacuugagaggcagaggcagguggauuuccaugaguuuuccauagugagacccugcuucaauaaaacugaaccaaaaccaaacgaaaacaugaauuaagucuaaaaauaaguaaauagauaaaugcuuaggaagcugaggcaggaggaucgugaguuagagagcagccugggcuauguuguuuccugucugaaacaaacaucacacacacgcgcgcccacacagacacauaacuguacauugaaccauuagaugucagucagcugguguauagcuggcauauacuuuggauuccagcacuugggaggcagaggcagauggaucucugugaauucaaggccagucugguguauauggugaguuccaaguuagccaaggcaauacagugucuccaaaaaaaaauaaaaccacucagauuuuggggcauuuaaauuuuuuuggaugaggguggucaaccugugccugccagucgccuauaauagacuugcauacaaagucaccaugcagggcucuugggcugaugaaagcguugcuagcuucauguucuaguugagggaaacugaggcaaaggagaugaugucugucuuugauuucuuuuucuucucucuuccauuuguuuguuuguuucuuuauugagaggagucucacuauguuggccuaagcuggcauggggcuuguugaaucuaccaggcuggccucaggcuauagagauacaucugcuucugccuucugaacacugggaucaaaggcaugugccucuguacucagcauugacagcaaagacacaaacaacuaauaaaccacgccacaaugggaucagacgcuccuuccuucuggcucucuaauguuuuuggaccuuuuuuaguugguaugaguguaggagaugauggaaucuagaaccccaagauugcuaaucacauauccucauugagcuacaccccauaccugaccugggaaguacuguaaucuucacuguguucaaaauccauuucauccuacccuuuucugcaggagccugguacacaguagguguucaauaaauguuuauuaccuaaagcagagggaauaugacuaggccuaaacaggagaagccugcuggugccuccugaggguacccaggagcuuuagagggagaaacucccguuuuguuuuguuuuuuuuuuaggggguuucucuguguagcuguggcuguccugaaacuuacucuguagaccaggcuggccuuaaacucagagaucugccugccucugacuucugagugcugagauuaaagacauauggcaccaccacccaguaagaguuauuuguuuuauguuuauauguauauaucugugcugugugugucauggaggucagaagagagcauuagaaccuauggacuaagccaggcgugguggcacaaaccuuuaaucccagcacuugggaggcagaggcaggcggauuucugaauucgaggccaaccuggucuacagagugaguuccaggacagccagagcuacacagagaaacccugucucaaaaaaaagaagaaaaaaaaaaaaaaaaaaaaacaaacccaugaacccauggacuaguguaacaaucauuuagugccacccgacagaggugcugggaagcaaacuuaaggugucuggaaaagcagcaugcacuuuuaaacccugagccaucuaucucaucucuccagcuuugccuggucuguaucugugaagacaauaugggagggcagcacccagccagagugggggcauugucuucacagacaggcaggcagcagugguggucuaacccauacucacauccuuucuccucuucccagaauacucaauccaccacaucggccagauauuccgaucaaacuacauguuccuguuccagcuucccuggcugccagagaagcuguugucuaugucugacuuccaggugcagugaggguugaagucuaggacuaggggauggcagaguggggcugagcgaccugggcacugaaaccagcacauuauuguguacacgcagauucucaaagacacauucacucaccgcaagaacggcaucccaggacugacuccuucugaacuugaagcauuccuuuaucacuucucacaaccuggaugccucacugggcccaucaacuacuacaggaacguguucagguaagguuguagccaggagagaagcugaggagagugucgggcagagggaaugagaguagucauucuuccaucuacuugucugucuuggucgcaggaacuucccccuggagcccaagaaacugucaacacccacgcuguugcuguggggggaaaaagacuucgccuuccagcaggggcugguggaagccauuggaagacacuuugugcccggccgguuggaaagccacauuuugccaggcagugggcacuggauuccacagagccauccucaggagaugcaucaguacaugugggccuucuugcaagaccugcugggcuagaagcucuuguuugccagccuaacauugauauguuggagcacauauccccuguccuuguguaccugggaguccaugcagugugugcauaagggugcacucccagaacuccgaguuacacacagaagcaucugugggcaucuugccucaccugcguggaugucuuacuacuuaucaaaaccucccugcccccaagggcuacacaaaccauaaauucuaaccuuucugucuuguuuuccacccccggucugauguuuaagucuuccuuaauauugcauccaauauauuucuaacacacaggaauacuucaauuuaaauguuaaugagcuaaaacgaaccacuaugaaaaauacaaugucucugaagccaggaagaccgacagcugagugacuaaaagcauuuggugcucuuguagaggauaugaguucuauucucagcacucacauggaguuucacagccauccauaaauccauguucaggggacaggacacucuuuccugcugucccugagcaaugggcaugcauacagcauacacacagacaugcaagucagacauuccuacauacagaaaagucaauaaggaaugugugugugugugugugugugugugugugugugucccugagcaauaggcaugcaugcagcauacacacagacaugcaagucagacauuccuacauacagaaaagucaauaaggaaugugugugugucucccugagcaauaggcaugcaugcagcauacacacagacaugcaagucagacauuccuacauacagaaaagucaauaaggaaugugugugugugucucccugagcaauaggcaugcaugcagcauacacacagacaugcaagucagacauuccuacauacagaaaagucaauaaggaaugugugugugugugugugugugugaguguguguguguguguguguguguguguguuucaagauaggguuucucuguguagcccuggccauucaggaacucacucuguagaccaggcugaccuugaacuuggagaucugccugcuucugccucucaaaugcuggaauuaaaggcgugcgccgccaccacccuguaagaaguaaaucuucuuuaaaaaauacagugucuuggucaccaca

SEQ ID NO: 8521 - RNA, 88457 nt, Mus musculus
caucagugcgcuggcggcggcggcagggcuguuuguucugcucucccgcagccgaggaaccgaagcaguggcggcggcugcggcggaggcugccagcagugcccgcgggcgagcggggccugugagcgcagcggcgcggcgggcgcggcggacgggccccggcuuggcgucccggacagcgugcggcggcgugcggccuagcgucucaggugaggggaccgguguccuucgcggccgcgaggcgggcugccggggccccacggcgcggcccgcguaaccugcauugcguaauggggcuggugcgccaccaccuacgccaucggcgcggggguggggaggccgcaguuucgugggcccggagccuggugcuucucgcgcccugccggggcagcccgcgccguuggggcggcggcggccgagugggcucgcggacuuuguaccggggcaguugcgcccgccgcugucccccuuggcgcgggcggcggcagggaacgggaccgggaccgggaccgggggcgcgggcgcgcugggcggccgggggcgggcggggggcgggccaagcucccggcacuuccugccgccgccauuuugucaagugaggaggaggaggaggaggaggaggaggaagcgacugccucuggaucugcggugcgcgccgggccgcguaaguccgggccggggaugcugaccgcggguaccgcccgcucucucugguugcaguucccccuuggggcgggucgcucuugcgcgucgugccccggcgcgcucuccuuccgucagcuggguacuccugccagugcugggauagcgaguucccgcuucauagucucaccuuuccggcuguccccggagcucugccuagaaagagguagaagauuuuguucacagggagagagcuuccauugcacgccugcuccaggcuggacccaggggacaggaagggugacgaaggaccaggagucccucucgacccacccacucccaaccuggaagccuacucuuugggugcuuuguuuugaugggucucugcuugcugccgucccuugcaauggcuucuuacuugcaggagugugucgguuuaggguggggauguuggagaguugugauucagcaaaaugaccccccccccccuuacacacaaacacggaaauagcacuuaaacaagaagcccccaaggccgagcuggguuggagaugggaaaucccacguuaguguaguggacagugugaauacuuuugcucaggccggugggugagucaugugccucugcugauuggcugaccucccuguuacucaagacaaggguuuuuuuguuuguuuuuuuaaaaguguuuuuagccugcuuguuuacuuguuuaugcuuuucgaaaucuggugagauuaucuccuguguguguauauauguuggaugccaguugcagcagcccucuugagaaugucuuuacuuaucaucaaaggugauauuaauagccccugguuacuaaaauccaacucucaguguacuucuaagccaaugugcucuucagugcuauaauaaaaaauuggaaaauuuuuaugaauggagaugucaacuucccuuggaauugguagagcuuggguguuguaaagaaugucacccacagggcuagacagauggcucagcgguuaagagcacugauugcucuuccaaagguccugaguucaaaucccagcaaccacaugguggcucauaaccaucuguaaugagaucugaugcccucuucugggguuuaugaagacagcuauaaauuaaaaaaaaaaaaaagaaaaaaaaagaaugucacccacaaaaaugcaaaggaauuaugaauguguuuucaauuucaagaagucuucagcuagccgggcguggugucgaacgccuuuaaucccagcacucgggaggcagaggcagguggauuucuuaguucgaggcaagccuagucuacaaagugaguuccaggacugccaggguauacagacaaacccuguuuagaagucuucagcuggggcucaguuuuaugggcuuuacaauaauuuacaagaacauuauuuuauucacuuuaauuuggauggagaaugaucuuuccauagagggcauuuauagguaaccaacuccuuccuucucaaagcuucaacuaggaagguuggaaaagguaacacugucaaagacugaauugaauugaucaaaucuagaaggaaaagcccagaauuauaaaauauauuguugcugauuuguacauccuaucuuugguagccaauaaaguauuuaaggacucaagguaaaguaagucuuuuuaagugguauuaguuggucuuaacuggaaauaaaccucuuuuuaucuuguuagcauucugcacaugcaaauugcuaaagauaagggauuuugcuuauugaugaaagcuaggauacaaaagugacugggacauuuuggauguucugaaugcccguguguuucauuuggagggcugcaagagggaacuuuuaucuaaggauugcuggagaaccuuagaccacuuaguaaaauuuccacuaaauuauugaauuauuuaaaggaauuuagacuuugucuccagaguuaaucuuuuuugagccaguuuugugaucuuuguaccaaauuacacuuucacuuuuggagagauacagaaggcggcaguauuuucaaguuacacaauucaggcuguugaaugacuugagaguuagagauucuauagaguggagaguauguuuauuaauauuugugcacacaugcauucuccccuggagagcagaagagggccucggguccucaugaacuagaguuauagaagguugugaggagccgugagaaugcugggaccagagccugaggccucagcaagaguggcaguuacagacuugccuucucuaggcacuggaggcaggguuuugauacaggguugaguccaggcuguccucaaacuuggcaguucuccugucucagccuccuaagugcugggagucacaacaaccugcuugggguuguuuuuaaagaaaagccauucugggcagucuauguggcuguaaaguguuugaauguuuagaguuugggaagaugguacagugaauggccuguaacuucagcucuugggggacugacacugccuucugacuuccuuccacccaugcaugcacagcgugcgcacacacacacacacacacacacucucacacacacacucacacacacacacacacacacacacaguuaaaaauuguaaugucuaaguuugaaagaaccugugagauuaacugagguuggaaagaagaagggcgugguaucacacacagcccuguaaucucaguacucaacaagcagagaggcaggagguucuccaguucuuggauagcuugggccaccuacugauucuguguucuagaaggaaaguuugucauugaaauuuacuaauggagcuggguguggugccacaggccuuuaauccuaaguacccuggaggcagagcgcuuuugagguugaggccagcauggucuacagacccuaucuugaaaaccaaccauccaaaaccccccuugcuaauaguaucuaauaagucuugugauuuuuauuguuuuaguaagaaaacaccagacauuugcaaagugagaauugugagaaaauccuugcugcugcuauuucacuuaauacauaugguaugcacauguagcagauuuuuagguacuuucauuuucuuauaauuccacaagagaggguuuuguuuggcuuuucuuuucuuauucuguauuguguacuugguaccuagaagagcaucuuaacgauugaauaggaauuugccauacauaauacuaaaugcaaguucauuaaaacaauacugugauuuauaagacgugugaguuuuaacuaagaauaccacugaagucucuaguaauugugguaagcuuacugagugguauacaguugcuuaaguguacugcuuugacuucccuauuuagcaguuugcaauguggucaguagguguaggcuguuucaacccugaccugcagaaaauauuuuaaaagggagaagugggcaaauaaauaaauaaauguguaugggcagcauguuuuucuuuucuuuucuuuucuuuuuuuuuuucgagacaggguuucucuguauagcccuggcuguccuggaaacucauuuuguagaccaggcuggccuugaacucagaaauccgccugccucugcuucccgagugcugggauuaaaggcgugagccaacacgccugguuuauucagucuuaauggauaaaauggugggcuugaauaguuuuuacuuuugggaaagauagaauagugcugccuauaauaacuccuucuguauaaggucaagagugguggcucuggggaucagugacaggauagagaguuggugaccagccucaccuauauuuugaggcccuguuuaucaggaaaaagguuuguguauaaguauuuauauggacauggauuaauuuuaugggccagauaucuaggagugauuugauaggccagaugguaauuuuuuuaaaaucauuuuugaagauguacagagacuauuuugguggguuuuuucuuuugauuuuguuuuucaguggaguggguuguuugagacugacugggucucacauagccaacguugaccuugaacguuggaauuacaagugugccccaccaucauuuauacagugcuggggaucauauacugggcuuugugcauguuaggcaggcaccuguaccaucugagcuauguuccccagcccugcagggaccaacugcauugccuuucuagugcuuaugucguagugucaaaacaaaggaacauuugaucuuuagaaguccaagucauagaucaguuugauacaaguguauaggcgaaagucuggaagaaguagccaaaguuuagguaguucugguuguccuagagcuuuccauuuagaccagacuggccucaagucacggaucugccugccucucccccccccccuccccccgacaggguuucucuguauagcccuggcuguccuggaaacucacuuuuuagaccaggcuggccucagaaauccgccugccucugccuccccgagugcugggauuaaaggcaugcgccaccaggcccaacugccugccucuuuuuugaguguugggauuaaaguugaguaucacuacuuccagcccuaaauuuuauauuuuuaaaaaauuuauuugggcauauugcgugucugucuacaugugugaaguauguauagaguauacuuuuuaaaauaaaaaaaagacuuauuuuauguguauguauguuuuaccuguauaugucuguguacugcauucagaccuggaguuaaauaaggaugcuuguguggguacugggagccaaaccuggguucuguguaagaucagcaagugcucuuaacugcugagcugguuuucuuuccuuguacagguaaggguuuuguuuuguuuuggcuuuucuuuuuucuuugcuguucuuuugguuuuucgagacaggguuucucuauauaggccuggcuguccuggaacugagcuccauagaugagacuggccucacacagagagcuucugccuuugcugcccaaguguuggaauaauaccugugccacuacugucuagccauucauucauucauucauucauucauucauucauauguuucucuuuguagcccuggcuguucugguuuccuuuuguagaccaggcuggccuugaggucuugcgucugccuccugagugcugggauuagagguguauggcaccauaccuggcagcuuuuauuuuugaggauauuuuuuuuuucucccagucuaaauagcaugccaaucuuaauaaaaaacuguauguacaucucccaggguaaaucauagggcauaucuuauucugaauaaauugaugaaagaaugucuagugucagguuuagaacaguguagacauauuccucucuucaacucucacaugcccaagagacuauggaacucagggcaagagacuauggaacucagggcuuuacagaaccuaggcagaagcuuauucugggcuacaacugcuacaguuuugacauccuuucuuuuacuuuuuugugacacuugucucacuguguaggucccacuagccucuuaaauagcaaucuacuugccucugacuucuuuuucuuuuuuuuuuuuuuugguuuuuuguuuuuuuuuuguuuuuuuuuuuguuuuuuuuuucgagacaggguuucucuguagcccuggcuguccuggaacucacuuuguagaccaggcuggccucgaacucagaaauccgccuuucucugccucccaagugcugaguuaaaggcgugccccaccacacccagcugccucugacaucuaaguguuguaauuaaauguaugcaccacuauaccacaucguuuuuuuuuauuuuaucugaacaauaguaauauguggucauuuaaagaauuugggccaggcagugguggugcaugccuuuaaucccagcacuugggaggcagagguaggcggauuucugaguucgaggccagccuggucuacaaagugaguuccaggacagccagggcuacauagaaaaauccugucucagaaaaaaagaaaaaaaaaaaaaaaagaauuuggaaaguuuaggauguauuuuaaaguugcagguucuuuugcuggguggugguagugcacucacggccuuagucuuaguacuugggaggcagaguuaggcggaccucugaguuucagcacagggcuauacagcuuugaaaaaaacuaaaaccagccacucugcccccuccauuuuucuuuuaaucuuauuuuuauuucuuuuuucuuuuuuccuuuuuuuuuuuuucuuuugguuuuucgagacaggguuucucuguguagcccuggcuguccuggaacucacucuguagaccaggcuggccucgaacucagaaauccgccugccucugccuuccaagugcugggauuuaaaggugugugccaccacgcccggcuguuauuuuuauuucuuuucaguuuucucccuauacuuucauagcaaaauugaauuggacccucaauuaaggguggguuuuaagagccuugcacauacuaggcagguacucuaccauauaucccucacuauauggaguuuuuauuuauaauugugagagaauaugugacuguuggugcacaaguggaagucagaggacuacuuuuuuagacuugguucuucauucucuuuuauguaggcucuggcaaucucuugucuagucuaaagcucuuugaucugcugaacacuggcucugguugcauuuuuguuuuugagacaaaugaccugaguaacccuggaugcuuuugaaaucccuggucagcccugcuuuugccucccaauuauugggauuacuguugugcaccagccuggcuaguuucuuuuguuuugccaaauuacuauacaggugaaccuuugguaaaguuaaguacuuaaagcaccguguaagucuaccauaauuucuaguuguggaugugguuuucagauuuuucucuuucaucucuaggaauaagaccacuagaucaaaaaguguguauuugaaauccuuccauuguuacucuucuagaaagacuacauacauuuccauuuuugucugaauuuagcagugucuuauuuauacuagugagguuuuaacauuuucuuuuauaucauaaaugacaguugugugacuacaaaaugucuuuucuuagauggguucucagggcuauuucuaugagaaaauagaauguucuuggcacuugaucuugccagaguaagccccauccaccccccacucuccuaccccuaauccagucuccuggucuugagaucagaggcccugcuaucugaaugcuuuaagaauggugacucuagggcuggugagauggcucauuuugcauuaaaauaagugucuuccuggcacagaucuuaucaauccagugcccucuuuuuuuuuuuuuuuuucuuuuuuucuuuuuaauuuauuugcuuuauaugaguaaacugugucuucagacaccagaagagggcaucaaaucccauuacagaugguugugagcuaccaugugguugcugggaacugaacucagaaccucuggaagagcaguccgugcucuuaacugcugaaccuucucuccaguacccucuuaagguauuugcugucuucuugcauucuauaggauaaagaaagguaggaagaagaugggguauguccacaacuagaaauaagcacucugaugaguaggucuugguuuucuaggcaggucccagagaauagauaccaccauccagguucuuuuugucuccauucuagcaaauuucaguagagacuaauguaggagaugauauaaagguggcagaggcagacagucugcaggccaaucaaggcuauauaguugagacccugucuuaaaacaaaaacaaaacaacugaccacuugaggaauugaguaaauuugcaucuccugagugcuaugauuaauaguguacuaucuaaaugguguuaucgccucccccuucuguaaagaaaaucauguuagcccuuccaguguacaaaggcucuggaacuuugcugcaggaagcaauggucuuaguuggguagcauucuagauagcuguggagcucacugucaggguucagaccugugccuguccaaauuguguucucucuguaagccacaguucugacuuauaaaaugggaucaguauuccuaagccuugauguggaacaggguggcacucuuauguauggcugaguuugagagugccucuuacuguauuuauuuguauuacuaugcuguacugcucuccguuggguuuggaagguggaaaccaguaguauuuguuuuggaaaggacugggacuauugucggggucuuugcaguggccacucuacuuuucuugguuuccauucaaggucgagauugcuuguuucuagcugcuguuacaucaagagacuuguguaucuugugaagauagugccaggggagagguauuguugggcuugguauuaugcaauuuccagaaauacuaauuaguaauuccuguguccuugaauaugguuaauauccccaguuguccuuccucaggcaauaagacacaugacuucaaguguuaaaaaaaaaaaaaaaaaccaggaagaagacuaguuaaaauaggacuuaaauuugaggacuuuuaucugaaauaguuggcauacacuuugaggaagaguguauuuuaugggagccgauuauuauacuguguggcugaaaugagaaccacguggaauauagagccugccaaugugguugggugguggagucauacaggguagcugcucuugggcuacucugaucucccaggacuccguuucuuguguauaaaauagaguaaaaguuagguuguauagacuggagauugagggaaagagaguugaagagaguugcuuuuuguuuaagguaugaucucuauaacccagguuggcaucuaaacucagcaaugcuucaauagcuuucugagugcagggacaaauguugucaccucacccaacaguaauucuuuguuuguuuguucauauauauaugaauaauuauauuguuguauauuuguacuccugagcauguuagugugccacauauauaacccuaguccuuguaauucagaagagagcauuguaguaauuacagacuaguagugaaacccucuuuuugacugcugagccauuugucuaaucauauccacuuaauguaacuucuguuaagaaagucuuggccaguuguaguggcauacuugguaggcagaggcaugcagaucucuugaguuccaggccagccuggucuauaaagugaauccaggauagcagcaagagcucuuaacacagacaaacccugucuugaaaaaccaaaaccaaacagacaaaaacagucuuuuguuagguuucuuugaaauauaaguaacuugggaugggcuuacguuuauaguucagugguaggagacugaugugacaugggugagacccaaguuucaguccccaauaucauaaaaacauaugaaaaaaacuaguugcagcaaaaggaaauuuguuacucauuagccagaugugguaguacaugccuguauuuccaauacuagagaguguaaggcagggggauuaaaaaguucacucugagcuacauaugagauuugguccauaaaagcgggggggggggggcagagggggaagagggagaggccuuugguggugccaaagguucaaacgaugacuucagagcuuguuuuacauuucucauauucugaccucaaggucaagaagugguuucuuccaguagagaacccuuuuugauagcagacuuuaacagcaacucucuggguuggaucauuguccauuugucaggcacaagggggcaaauguuuaaauuaccuuaccucuagguaccuuuagguguuuuguuuuucuguccuccaugcaucccaaguaacaguucuuuuuuuuuuuuuuuuuuggagacagguagcccuggcuguccuggaacucacuuuauagaccaggcuggccucgaacaccugccucugccucccgagugcugggauuuaaaggcgugcgccaccacgcccagucuccaaguaacaguucuuaacagugcuuugcuauuugaguaagauaaacuguguuggguaguuauugaacagacucuuaaauuggauggagaacguacuaauaaggugaauagaauuuggaugucuaaauaaaggaaagguuagccgggcagugguggcccaugccuuuaaucccagcacuugggcucucaguuuggcuggaauuaacccccaggaaauaaggaugagaagcuuauuacuacacugucaagggguuaaggaagucuuuguugagaaggcagauagguaaguuucaguauuuuacuuacaguaauaacacugugcuaaaagauguuuaccucugucuuccaugcuuguagaagcaacuguaguuucaugauuggcuaaacuuuucuauaaccaagcuucuguuuaccauucuuuuaguuuuacaauucagauuuccuaaucaaaauuaagcuccacuagaauagccauuuuccugugguucuugcuguugaaagauuugugaaaaucgaaaaaccauuggccaagaauuagaccagucauacuguauuuuugcuaaagcaucagcuuuaaagcagcucuaggcaggguuggagagccuuuagaauuugaagaauguucuggcucaaaaauaaaauaaaaguaugcauacauagucuuugaaccuuaaagacagagacccacauucaggauagauguaccggguuuacuucugcauugauaaauucuaugauggagacuuggacauacauccugcucuuguagagagucacauacuuuugacacuaaaucauucugagcacucauuaguaguuguccuuuuaaacauccaugggaggguuuucuagaguccucaaguuaccucugugucaucagaguagcugcagcggugugucccaugccucccucacguuauuaccuguguucuuuaauggggauagagaauuucaggguggaguaauauaauuuauagaugaagaaaguuuuccagaacucugcccuaacuugugauuuuucacaucccucacuccugggauuugguguugucauggagccuuugcuguagaagguaacccaauggguuuuagccaaccuguugauuuauuuggugguguuggauauauagguagguuuagaagacaugaaugcuauggucucuuaugugucuuagugccugcucuuaaguucuuggacagugguuauguccuugaacauacaagguaaaggagacauuuugugggaaagcacagcacuugagguacauagacacauuauaccagacugucacucuacuuuucuuucauacauccuuugggaugucacucuacuauccuuccacacaucacuaccuaguggaaggaauaggaaauacaauaccauaaacuuaaauaauucauacuucuagaauuggggcagaauggaaaagaacucacuacuaagaacaguacaguauccauuaaacuccuuccuccuucccuaauuucuaagcuuugaaacuguguauauacacuaguggcuauuuuccugccaucauuuacuagcuuuuaauuacuugcauuucuuagcuuaauuccacuuaguguaaaggcauaacuuuuauuaacuuaagcaguuuuacuuuucuauucuguaagagaaauaagauuaccuacugggauuuuuuuuuuuuuuuuuuuuuuuuugaaaugggugcaugggauuggagauauggcucaguuaacaacauguauuguucuuccagaggaccugguuucacuuauucauguuuuugaguggccaagugguggucacucacaaaugaucuguaacuccaguuccagaggaucugacaaccuuuucugaauuccuugggcagcagacuugcauauggugcacaaacauacauguagguaaaacacccauacacauuuuuuuuuaaagugcuaucuuuguguagggugcuuucauuuauaauccucacuuuguucugaagugcuuuccuuuaagggguguguguaccaguuugugacuuuguuuccuuuuugaagcugggaaaccacugagucaacaauugccuggaaauaaauaguaucuuagaauuaauauauuucaagauuauaacuuaacauuuuuguaaucccaagaaugaaugaaguuuugaauuaccaguguucucucguaggcccuuuugaauuaugccacauauugcuuguggcuuguaucuuguaucucuuuggugucaucucacaggacuucugccuuacaagucuguuuguucuagccacucauguccuuccuuuguaaguuugagagcugcuccuucauaggcgccuucccaggcuguuagcuugagcacagcacugcuggguaugccauucuagugaauauauuuguguaacuugugcuuucaugcuguauuuggaaauuguguauuccucauguccucagagaauaauuuuaagaacuaaguauuuaauacugucauccccauuuugugauaaggcugugaugcauagagagcucagucacuuagguagguuugaaggucauagagccgguuaguggcagcaccuagcuccgcagcucacacucuggaaugaaucugcuguucugcucugugugaggagagaacccaccccaggcagcuuugcuuuagggaucucaguugguuugaauacuacacaauauguauauguacaaaguagacuccagaaaggauuuuggaaaaggagaucuuccaacuuugcuuagagggagagacagggucuucaguacccaguaggaugggcagucagaagagagaugagaaacucuacagcacauuuuuuuaauucuuucaucuauguggucaaggaaaaaaaaaacacacacagugccaacaugcugaagaauugcucaaaauacuaauuuaacuucaucuugagaaauguucccacuagagcaccagcugccuugacuggauucacuuccauguuuucuuuugauagucuaguggguuugagugaaaugaaggaggcuuuuuuguuuguuuauuuugcuuuuuaaaacaggguuucucuguguaaccuuaguuguccuggaucuugauuuauagaccaggcuggccucgaacucagacuugccuuucuuugcuuccugcugggauuaaaggcaugugccaguaaaaugaaggccuugugggagugggaauaagucaauacaguggagcaagaguagagcuuuagcucacuugccaagucuugucagaaucaguuguauggauuagauggucaggauuauggugagccuucagucuuuuaacauuacuuuuggugguacaaauugaauuaaguuuguaggugaucccugcccccaacauuauucaaaggaauuuuccuuuuugaggaccccuguucaaugcauauacuggauuuaguggguaauuagccauagugcuguauauugcacauauagcaagaauuugagggugagcaaaggugcuuuccaugucuauauuguagauguaguguaugccaguaaucccaauacucaggaagcagaggcugggagaucaugaguucaaggcuagcauugguuacaugagaccauaucaagagaaaaugaccagaagaacugaagcagauaguuaguugaagauuccuaaccucuuuggagaggcagaugugauucuuagcaggugugcccuaugggauaauuuuuugaaguuauauuuuguuuuuaguuauguguauaugugugucuauaugggaauaugugcuuguuaagggcagguaccuagagcugaaaauacaggacagguggcagugagcugccagauuugcuaagaauugaacucuuguccaccauaaaaguaguauaguuauaguuucucucuuucucucuuucugucuguuuuucucucagacuuauuuauaugaguaugcuguaacuguauuaagacaccagcagaggacaucagaucccauuacagaugguugugaacuaccacaugguugccaggaauugaacucaggaccucuggcacagcagucaguacucugagucaccacuccagucccccaguauaguuucuuuuuuuuuuuuuuuuguuuuguuuuuguuuuuucgagacaguuucucuguguagcccuggccuggcuguccuggaacucacuuuguagaccaggcuggccucaaacucagaaauccgcuugccucugccuccugagugcugggauuaaaggcaugcgccacaacgcccggcucccaguauaguuucuuaaugaugaaguccugagucaucccuggcugcccacugccccagucccagcuggauucccaccccgcuuugggugcuguugguacuguuggagauugaguccaggacuuugcaugugauaggcagauacuauauucaagcuguauggagauagagcaguuuucauuguacuuauuuuuuccuugcuuuguuuguguuuuuguuuguuuguuugguugguuuuuuguuuguuuguuuuguuuuuuuguagucagguguggcagugcagaccuuuauuccuagcacuugggagguagagggaggcagauauccuugaguuggcuuuguauccugguuuauaugguaaguuccuggucagccagagcuagagagccucuauauggguauuugucugcaugcauuucuguguugucaugcccauugaagccagaugagaguaucaggccuccuggaauuagauacagguggcuauugacccccauguagauacuggaaaucaacuccaaguccucuacaaagagcaagugcucuuaacugcugaacagucacuucugcuuuuucucacuuuacguuuauuuauuuguguucuuucgagacaggguuucucuguguagcccuggcuguccuggaacuuacucuguagaucuggcuggccucgaucucagaaauccgccugccucugccucccgagugcuggaaaaggcaugcgucaccacuucccggaccuauuuuacuuuuuuuuaaaaaaaaacugacuauaaauaaaaugacagcuguaaucuacucaaguaaaaguuugguucaagaguaugucuuaguucgaagaaaacgguagaagugguuaaguaagcuccauguaaaacuugcucuuaaacuaacucaugaucaaaauauaauuuacugcaacauaguuacuucuccacuuccaaagucacacucccuucuuagaggauccugguuucugugccaggcuacugucaugcuucauuucuguguugucucacuuccuccagucauacaccccauucuuccugagccaguuuggaugucacaaugcacuugcucaaaucacuuauucaguaaaucauucauucauuucuccagcuuuuucucacuuugucuguauuguauugugaaauggggaagauuuuuguauccuuugcuggcgcgaaacuccuuauauagaccagccuggccuuggccugcugugauccuuuuggcucugacuuaggagugcugaaauuacaggcgugugccaacauagcugguaacucuccaaauuucuagaacaguucuguccaguguucaguggguuauucagccugguagauacuacccugugcauaagugagccuuugaaauagucuggagaauucagucagugcuguugucaacugcuuugacaggcuuuaggaaaaguggccucacuuuauagucuuaugaccauuuucuuguggacauggcccugaaggcaggagaggcauacugcuaaugcaaggggaaaucuaagcuagaccugguaucacucaauauuguucucagaaguuaguaagaggugccgagguucuggggagagagaagagaaggccagauaauaauaauauuaaguaagcaugggugcauccuuucucuuccucuaaaguuagaaaugagaaccuagcuugagaaagccagacucaaaguggguugagaacacuggugguagauucagcuucguugggagggcuucucuugccuuuaccccaucuauucauccuguuaucauacaaguuauuuaguacuuagaguauucucacccugaaccccauuuugugaguggagcuuugagcaagacugcccauuuuggcaccuuguuuuguauauggagagaaugugaacaauggagagaaacugaacuaugcuacuagaaauacuguuagaaguucuccuuggagucagugggagucaagaugaggagaaagaguuaccugaugguucaggauggcucccaaguuguagaauuggaccuugugcacuuuuggauaguuuucugguauuuaaauguaugcuuauugagcacuuuucugucccaagcaccaagcaggugcuggcugccagcacugagcaguagauaagggccgaguuuaugugcagugaaaugaggaacauagaguguuuccugccuucaauugaguauaugcuuaugaaacaaucauuuauuuccaaguaaugauacucauuuuauuaguuugcuguuuauuugagcaauuauuuuguguaggucuuuggggggggcgggcggcuuuuugggacaggguuuuucugugcagcccuggcuguccuggaacucacuuuuuagaucaggcuggccuugaacucagaaauccaccugccucugccuccugagugcugggauuaaaggcgugcgcuaccaccgccgggcuuuguaggucuuuaaauacugacagccugguagugguggugguugagaggugguggugguuuuuuccaaucuucacuuacagcuuaaaaguguggaguaaaguuauugcuuacuuuuuuuuuuuuggcagagggagucauuaaaaauacauaaaauucaucaccagaauaauguuaguugcaugcauaucauugugugaagauauguaccuuuguuuuacauuuuauuuauuugagugcaugagugccacaguguggaaguaagaggacaguucuuuugggaauagcugcuuucuuauaccauguggauuccugggauugaacucaagucagcaggccuagcagcaaaguacauuuaccugcugagucauauugguggcucuuccagaaugucuuuguuguccuauuaccacaucaugacaauuauacuccuacuuacuguuucuaugaauuuaagccauauauuauuauauaaacauuaucagugguuuuuaaauuuuuuuugugacuagcuuacacuuaggauaauguuuuacuagguguauccauguaauagauuaauaauaccucauugacuaaaaaugucccaccaugugccacacuugauuuuauuuauuuuaugugucuggguguuuugccugcauguaucuuguguaucacuugcaugccuggugccuucagaggccaguaaaggggguccucugaaacugagcuucaggugguugggagccagcaugggugcugagaguugaaccuccugagucuucuggaagagcagccaguuuucuuaacuugcugagcuaucgcucuagucauaacacuugcuggccuagagcucacuguguagaucaaacugaccucaaacucacagagauucauucaacugguuuuauuuguuuguuuuguuuuuuguuuuuguuuuucccuugaugcuaggaucaaagacgugugccuccauagguugccaccugccugccugcuuucugaacacaggcuaaaaaacucuuuaauguagaagccaacugauagcuacaauucuuguacccugccuguacacuaacagugccuugcaguugggagcugagguagguguacucaagggcauauaacuauguaaauaguucaaacagucaggugucuuucacaguagucuuaaaaucagcaaccagcaucagguaugauggcauccuuucaucccagcaguugaggcugaggcaugaggagcucaaauuugaggcuagucuuagguucauagugaaaccauuucugaaaaacaaagucaggggcugaguagugggucagcuacaaaaggcuuugucuggcaugcuuaaagccuuggguucccaucucaauucacagaauaaaagucaacugguuaaauggauuagacccauaucuucacuuuccuaaggucucauccuaucaguuauucuggaaccccaguauugucacuuugacauguuuuguacaauguacaagaauaugccugaauaguuuugauaucuaucuaucuaucuaucuaucuaucuaucuaucuaucucuugguucagcaggucucauucugagaaaacucacuaaauacucacuaaauaaagguaauacuuuucuuuguguuguuucaguguggccagagaagguuaauuuuuuuuuuaaagagguuucuaaagucugagguuucuaucauuuugagcaguuguaauaggaaauagcauugauucuuggguacugaauauccgauaaucauaauaaaagaucaacuuuuaaucaauugaugaauacuugauuggauuguuucauuuuucugucauuaaugcuguuaauuuuuauacaugagguguucugguuuuguauaaaugugcuucuuuucucuuuuagauguauacauguaaggauagauagaaccauggauuuuguaguacugguauuuuaaguaguuuccagggaacugccagacaguuguccaaaaaguguuauguagccaagacuggcuuugaucuccuuauauaacucaagcuagucucaaagucacuauccuaugguuuucugguugcuagaauuagugguuugugucaucacacccagcuaguaguuguguugaugguggauacugucucucaguguugucaugugacacaccaguuucugugcgccuugagugcaugccugaaugcaugguguggucaaaauauauguugaacuuuauauuuucugugcgaguuuacucguuuuccucuuuuaauuuugugcacaugugugugcuuauucaauuuuuuauuuuguagacauuugugccaucagaauuguuuuuauugaggguacagaacaggcacauuaagagaguaguguuuaaaagggggaaaaaaaagccaggcaguggcggugcucgccuuuaaugccagcacucaggaaggggaggcagaggcaggcagauuucugaguucgaggccagccugaucuacagagugaguuccaggacagccagggcuacacagaaacccuguagagaggggagggggagagggagggagagaggggggggggagagggaggcagguagguagguagguggguggguguugucaugagcauuuuaaauguaagaugggcgugggucaguggggaugcuguuguaaaaugaccaaguauuuucaaaacaauuguuagcaguuugacuuuccaaguuuaucaauagaguaauagauuuauuuacuuuuuauuuuauuuuauuuuauuuuucgagacaggguuucucuguauaguccuggcuguccuggaacucaguuuguagaccaggcuggccucgaacucagaaauccgccugccucugccuccuaagugcuggcauuaaaggcgugcgccaccaccacccagcucagauuuaauuuugauggaugugaaaugucacugugacuuuaauuauaaugaucuugagcacugcaucuuuguggguaaaguuuggugcccuucucuaugucacuuagaguaucuuuugauugucagaggaucuuaauuuuaacguaugugaauuuauuaacuucuccuuuguguuuggcaagagcacugcucuggugccagcuauauucuuuguugaaaaaguuauaaagggcaaguuauaaaggugcuuuuacauaagccagaugaccugaguuugauucuaggacccacuuaguaggagagaauagacacccaaaauaguuguccucugaccucugcagguaugcagcauauguaucccccucaccaaacacaucuuauuggauacugcauaguucuuuuuaaaaaguuguaaguuuugccuuuccaguuugugccaauuugagguauagguaaaggggucacauagauuuuaaauagacugguuuuuguuguugaagccaaugagcuuggugguuauaaacccaagguucuguacucuuuuuguguucaagauccucaugagauugaaauacaucugugagcucuaagucuuaguguagucaguaauugcuucucggucuggguacagcuucauucuuuaagcauguggauauucagugaaaguuggcacuuaacugggaaaauugcuacuagugcauugccugccaauaaacaguuaccacagcuuggcucaguaaaucuccuuguggggcacuguuggcuugcagguacaagggcuuauaacccagucuuauaguugugucauagcuaugcagccuagaagggaaagcacacuaccuucuaggaagcuagggagauaaaucacuaaagcgcuugauugcaauugugggaacugagaacccaugucaauuuauuuuuuauuuuuuuuuauuuuuauuuuuuuuauuuuuuuuuuuaaagauuuauuuauuuauuauauguaaguacacuguaguugucuucagacacaccagaagagggagucagaucucguuauggaugguugugagccaccaugugguugcugggauuugaacuccugaccuucagaagagcagucgggugcucuuacccacugagccaucucaccagcccucaauuuauuuuuuaaaaagucuagaugagguggcauauacguguaauuuuaguauuggacagauggauucucuggaacuugcuggacagccagcuuagcccacuuggcaagccuuaggcuagugagagaucaugucaaaaaagcccaaccaaaagguggguugaucccaaagaaagacauaacaguuauccucuggccaccaugcugugugugcgcgcgcgcacacacacacacacacacacacagacagacagagacuauaaauauaugguaaccguuuccuguauuccugcuugggucacaaagcuguguucaaggccuacuuauuccccacauaacugugauaggaagcuggcagcauugagccugagcuaagccuucuggugcaaaaaugguuguuuagaaacuguugaggaccacaugugcccaaacacacucuguguuccugugggcaaacagacagcaggggaucugguggcuuuuggcauuugugcuacaacauacuucucugaaugauuuuuaaagagauaaaauggauuggaauugugguagguuuaaagaugugggcagggaggaagguagggaagccaccccccccuuuuguuuuuuguuuguuuguuuuuugauuucaagacagaguuucuugguguaacagccuugacuguccuggaauuugauuuguagaccaggcuggccucgagcucauggcgauccaccugccucugucucccuaguguugguauuaaaggcaugcaugcaccaccauugccuggccaguggacauuuuuuuuuuaaagauuuauuuauuuauuauauguaaguacacuguaguugucuucagacacuccagaagagggcgucagaucucguuacggaugguugugagccaccaugugguugcugggauuugaacucuggaccuuugaaagagcagucgggugcucuuacccacugagccaucucaccagcacccauuuuuuuuuuuaaguuguucucuuuaaguagucagaugucagaaugagggcaucagacauugagaggucauugaaucucucugccuggcuugcuaaggggucucuuguguuugauuguuuuggagggcagaguccuguuauauugcccaaguuggucuuaaaaugauaguucuaccucagccuucugaauagugagaacuauaggugccuaccacucuaugcauggccuuguugcacguugauuagggccuuuuguccugugucuuucacaggguacaguauaauaauuagccauuggaugcuuauugaucacuuucuucacucuaaugaccauacuugaaaaacuggaaacauccagauaauaggagggaaguaguuaauaacguaagacuggccuauagugacagaaaagcagcuaucuguucauaccauacauaguuaaaagugacaacuaagguguggguggguacaguuguuacccuacuuaccccacucccccagagaggaacucagagguccccaugccccugccucccaagugccgggauugaaagcauggguagccaccagagccuagcauggguacaguuuugaaucugaauacuacuauggcuuaccuuggacauauagaaauaggugcuauaugacaaguggccuuuucauuagcuuuuuucacuugucaugacaguuguauguuuuagggguuguuuuuuguuuguuuuuguuuuuguuuuucaagacaggguuucucugcaguccuagcuguccuggaacucacucuguagaccaggcuggccuugaacucagaaauccaccugccucugccuuccaagugcugagauuaaaaggcaugcaccaccuccgcccgacugacaguuguauguuuuuuuuuuuuuuuuuuuuaagauuuauuuauuuauuauuauauguaaguacacuguagcugucuucagacacuccagaagagggagucagaucuuguuacggaugguugugagccaccaugugguugcugggauuugaacucuggaccuucggaagagcagucgggugcucuuacccacugagccaucucaccagccccauguauguuuuaaccuuagucccagagacagauuuguccuuuuuaguacugcuuuuuccucugaacaugaagauguucuguaggggccacuuccccugccuguuccuaagaauuuucaaccccaguaagcccacauuaaaaaaacauaugauccaguuauuauaagauauaucuagauugggcagaucuuaacacuauacuaacuuauuccccagcuaugagacccuuuauuauuugcgguuucuccuggccacgugguucugguccaucaugacuuacuugauccucuucugccucucuaacuacccccacucucaaaccuucagucccaucuuucuccucuacugcacaaucacagucuuuagcuuuuauugcccagcuaaaauggggagaagauucacauccuuuauccuugguccaauuuuaaaguguucauuaaaucuccggcaaagauacuuguguguuggccugaugcuuuuuguauucucauguuaauucugcuuccugaagcgauguuucacuuuuuuaaaacgauuuauuauuauacauaaguacacuguagcugucuucagaugcacuaaaagggggcaucagaucucauuaugggugguuuuaugggugguugugagccaccaugugguugcugggauuuaacugaggaccuuuggaagagcagucagugcuccuaccugcugugccuucucuccagcccgauguuucacuucuguuuuagagaaaauucuagccugagcugaguaaauaagucuacuuuuuuugaguuuuguuuuuauugauguucuuuuagucucugugguugaacaugugaugcauuguuuuaaguuuuaagcuugaaaauuauuuucuguuucugaaugugugcaucuuuuaaaaauauguauauaaauguuaaggacagguauucuuguuccuaaacauuuauagauguaaaugccuggugcucucagauaggaaaugggcacaggauccuuggaaauuguagccuguugugagccaccauaucaugauguauugguaacugaacccaaguccuuuauaagagcagucagugcucuuaaucacugaaccuucuccccaguccucgugugcaucuuuuagucuacagguaauaacuucucuuucccacauuuggguguguuuguuuugugucugagacagggucuuagauauucucagcuggccucaauuuuacuauguagauggucuggaacuuguuucauuugccuaggugcuaaaauuuuaucacacccaagguguauauguguguauguguaggaaaaugggguuaaguuuguguuagacaaguucucuauccacugagcuccauugcuagucccacaaacuuuuuucuaaacuauuuauuuucauuuucuguauaugaagguuuugccuucaugucuguaugugcacuaagcaugcuuggugccaguggaggccagaaacaggcuuuggauccccuagaacuggagcugugugacaugaaugcuaggaauugaacucaagacuucuggaagaacaaccaguacucuuuuaacuacugagccauuucuccaccuccaacuuuuuucuucuuuugagacagguucucucuguuauguaacccuggcuguucuuggacucacaauauagaucaugcuggccuggaacucaaaaaaaaaauaugccugacucugucucuugagugcuaggauuaaagguguaugcugccauuuccagaauucccgcauucuuuuaaauuuuauuuuuauguauauggguguuuugccugcauguaucucugcacaauuauuaugcaggaccuuaggaagucagaagagggucagauacccugacacuagaguuauagacaguugugagugccauguggaugcugagaaucaaguacagguucucuggaaagcagccaguucuccuaaccagagacaucucuucagcuccaacaaauguccuccguuccccccagacaggguuucucuguguagcccuggcugcccuggaacucacuuuguagaccaggauggcuucgaacucagaaaucugccugccucugccucccgagugcugggauuaaaacaaaugguuuuuuaaaauaaucuuucaagccauucauugaaccuagaggcaccacuuugcaaggguuuuuuucccccccacagcacugauauuuuuagucauauuuuuacuuuuuuucaaagauuuauuucuuaauuaugcaucuauguauggauaugauuauaugcaugugaaugcagugcccuuggaaaccagaagaggggagcagaucuccugucugugaagucaguuguaagcuaccuggcuguccuccaacucaaagauccucuugccucugccucccaagugcugggauuaaagauaugugccacccuauugcgcacucuuuuugugugugugggugugggugggugggggguuugguuuuucgagacaggguuucucuguguagccuuggcuguccuggaacucacuuuguagaccaggcuggccucggacucccgagugcugggauuaaaggcgugugacaccacgcccggcccuauugagcacucuuaaaugcugagccauuucucuagaacguagaugggugagugcauugcagaagcagguggccauuuucuauaagcuagcacuagaaugccauuucaugcucuccugagugauggggauugaccgacuacuccagcucuguaagaaggagggaggaggaagcauggacaucaugucccagaaucuacucguguuguuaccaaaaaaccauggaaaugugucacuguuauuugacagcucugccugagguuggagaauugugcgaaugagcugcaggugggaguaguagcugacauuuggguacccaaggucuugcccacaugcccuuucauucugaguucuugucaagaaacuacaauugauuacuauucugacuagggacccuuauuaucaaaaaggaauugggugacuuuuguggauacggcagaacuugggagcugaaauggcucagguguugaacauucauuucucaugauccauguuugugggugugggggugugugggaaggaggggagagguagagagcccauguccugccagagugccugugcucugggcaggcugacgugggaggacugcaggaggcuuuccacuggaccccgagugggcaucugggcugugugaacucuaguggggguuggggguguguggacaaggggcagcccccaauaccaggggccccggggugacacucucggccccagagauaagggagagagggcaggggagaagguucccaugcaggcgagaguccuuagucuggucuguggcuggagcacaggaaggccuucugaugggagauuaggcacgguuuguuaggagaaagccuaucccauuguccaagcacagcuggccuugaugaacagagacagucugugguuuuagagcuucauuguagaaaggcagggggaaagagagaagguagaaagagggagagaccggccauggccaagaggagagaaaggggaaaggagagagagaagaaaggcuagagaguaagauggagagaguaagagguuagagagaguaagaaguuagaauaagggagugaagagagaggaugaggagaguguguaagagagcaaggagaggccaagcagcccucuuauaguggccuguguuaucuuguuguugcuagguagcugggagaagucuagccugaaggucagaagcuuaggacauugucuaugugacuacuagccaggcacaugcuucuccugugagggcuaugggggcgauaacuuugacaggagccagggguccaggagacaugagggaacaccuucugucccauguaaguaggaaugaauuaccaccacuggguuucuccgggguucacaaccucagcucuacuggagaccagacagucugugcauagcccauugccccacacauucuauuuccagaaugcacauggcagcuuaaaacuuuuuauuacuccaguuucaggagggcaaugcuccaggcauaaaguagcaagucaaacacuugcccacauuaagucaaaauaaaauuaauuaaaaugaaaagaguuguugacuuucuauagaaguggcagaaguugggcuaaagagauggcucaguaagaaugcuugcugcuuuuacacaguacccagguaugguuccuagcaccuacaaggaagcucauaaccaucuguaauuaauggcucagggacucugaccccucuauugaaaucuucauuuguaccaggcacacacaugguacacacacgugcaggcaggcagaacacucagaaaagauuggaggacgggcuagaucuuuagugaguauuagacuaaaauagaauuuuuuuuuaaauguggagaguaugcuguauccauucauugcauagugaucaucuuacuaauagaaugacagggccuucuaccuuaagacaaaugauuggucacaaauagcacucuaucagaaggggccuuuccugccuaaaaugggaaggccauacuaucucuaugaaguggaugucugacauuuuggcuaacaagucaccauaucaaguguguuuuuuuccucagauguucauuucugcacguaccaugguauuucuguaaacugggaaaggacucaacagaaaguagaacagaauauuuuaaaggguauagacaaugagacauaggauguaccaacaauuacccaaauguugggaucuuagaaaguugguuuuuuuguuuuuuuuuuuaaauaaagaccuauuugucuuuuuugaguaugaguauuuugcacccauguguaugucuguguacuccauguauguauguaugugugaaccuggugccugcagagguaagagggugcuggauucucuuaaacaggaguuauagauaugggcugucauguaggugcugggacccuggucuucugaaagagcugccuguguucuuaaccucugagccaucuugagcccaucugugauaaauggugaucucuucauguugugcuugcuugcuauuugcuuguugacuuuugggagcaggguuguggggagugacaugaucuuauguagccggaucuuccugccuccacaucucuaguguugagaucacagcuacauuaccaagcccaucucugcuuguguguguguguguguguguguguguguguguguguguguguuggauuuuguguguguguggggggggcagguuugagacaguauuucucuuguguguauuccuggcuguccuggaacucagucuauagaccaggcuggccaccuggaacucauagauaucuaucugccuuugccuuucaaacucuaggauuaaagguguuggcuaccaccucugggcuguuuccuuucuuugagccucagguggcuguuggguuauuuucaacggauaaaauuuucaauggauaaaugauugucauuuuucccauggagcugauuuccuaguauguaaugacauugguuuaguuaaaucguuagagaaacugcuuuaaguuuguaauuauagaucuucuuucccucaccuaucugaaagacgggaugcaauucaguccugugcuugcucagccagagguuuuauuuauuuauuuauuuauuuauuuauucauuauauguaaguacacuguagcugucuucagacacuccagaagagggagucagaucuuguuauggaugguugugagccaccaugugguugcugggauuugaacuccagaccuuuggaagagcaguugggugcucuuaaccacugagccaucucaccagcccuaagauuuauuuauuauuauaucuaaauacacuguagcugucuucauaugcaccagaagagggcgucagaucucauuacagaugguugugagccaccauguaguuucugggauuugaacuuaggaccuuccgaagagcagucagugcucuuaaccacugagccaucucaccagccccucaacuagaguuuuucucuaugaaccaucucucuacaaucccuucuugacauuugaggguguaauaaaggagaacaaaguacacaauaccaugcuguuuucuugccaaaaugguaaaaaaauguaaguugagggcucuuggaaguuucacaauuauagaacuacauauauauguaucugagagaaggaaagaagaaagccuuucugauaacaguuuuacauuacuaugcuggauaguuuaacacauguuuuugguuuaauucuuauauaagcuuaauggucugagaagguggcugaauaaaagaguacuuguucuugccaaggaucuggcuucaguucugagcacucagaaccaucaguagcucuaauucuagggggaucugguguccucuugggaccuucauaggcaucgaacacauauguccaugcccacaagcaaaacacauaacauuuuuuaaauauuagaaaaaaaaaaucuaagguugaugauagaaaauccucuuuuugggcuaaaauaaaugcucaggaccacaaaaggucauggucuauaggaaggucuuggugguuuagaagaauuuugugaggagcagccucugucaagaguacacaggugcaacuaugauuauucacuagucaaccagagaaacagguggcucuuagaauggugcaaucuuuuuugucauuagcuuuucagaguuagagaaaauguuaugccccacuaaccucauagucagguggaaggugcuguagagacugagugggaggugagggagacuguacauuagguguguuuacacacaccugcauuguuucucucagggcuccacuugaaucagcuaugcagccugcuuuugcugucuuaaaaacacgucucuggacauccuauuccaacauguauggauuaauuuugugauuaauuuaagcuucaaacacauuggggccuuccagccugccaggccccucacuuacuuacuaugauauuacuuguaauuucaaauuucaguuuguuguugguauauaagaaagcaguuaaauuucacauuuuuguaucugcauccuugcuuuuaguguagaacuuucuguugauucuuugguauuuucuaggggaggcaaucaugcaucugcaaagaaaaguuuucaguuauucccucccaauugugucucucuuguuuccuuuuguuauuggauuaguuaggacuuuaacacaaguuagaggacacccuugcuuguuccagaucauaaaggacaaagccucuaguuccucaguauuaaggaauuuuugugaaugccauacaacagccuauccacuucagaacauuuuggaagaucacuugaggagggcagauacgggguuauggaaaauggaguaagcuaguauauuugaagaaaucuuagguuuacuaucucacucagcaaagagauagggaaacuuagugccccuggguccuacaauauacugcagacacuacacuuacgcuggcaucucuggacugcgguagaauguuguacaucuuuuuuagcaaguugguucucugagauugacaaguaugauccccccccuggcccccgcccccagacaggguuucucuguguaacccuggcugucuuggaacuggcuuuguagaccaggcuggucucaaacucagauagauauucgccuguguccgaaaccucucuuggaauuucucauuauuucuagaguaggaaauaaacaacagaaguaaaaguaugauguugaauguuuuuggaguuagacaugcuaguuuguuuucugaauggucuuucuggcauggaaccugcuuguacaccuuucucuaucuuugacugccaugccauuucaucggugcccaggguuccacagucccacaguuccucagccuaccaaggagcuugaaugucagccagggccuagaacccuaggcucugagggaaucagugguuuuguuuuuguuuuugaauuaguccuggcauccagucaucauuuacagugucccugggaaccuggcagagaagccucaaaaauuggcucaaucugcccuuggaaacacaagccugcccuaaauuguuagucgucucucauauauugagaaggcuucugaaaaauaguagaaagagagggugggggugauuaucaguagauuuccaggccaguucugucauucugccccucuucuauucuccuuguuuucuagccaacaagauagcuguguuccaguuuuguucaaaacuacuagugaagaaguccuccucuccucucauucccauaucugcuuuccgucuggacacaacauugggucuaagaaaaucagcucaccaggcugugaccacugaaucacauuggaguucucuguagugaguaagaauucuggaauuaaaaaaaaacagaaaaauuauggguaugguuuuuuguuuguuuguuuguuuuuuguuuuucaagacaggguuucucuguguagcccuggcuguccuggaacucacucuguagaccagacuggccucgaacucagaaauccgccugccucugccucccgagugcugggauuaaaggcauacgccaccacgcccaguuuauguuuuuguuuuaaucccauggauuaauccaugggauauaggacugcuucagauuguccacagcagcugacuuugauuugccacaugcucuaguagggaugugauuuugacagcugcagauaauuucugagagugugugacauuuggaauuuuggacuuuucagaggguauauaaauacuggggcccccaagaaauaugguggcuuguuguugguuggucucuauuggucaagauuugucuaaguaguugcauguaaagaacaagaagacaaaauuagauaucuggcagcagcauugcccccuuuccuacuccugacuuuauucagggaucgcuauccuuuuuuuuuuuuuuuuuucuaguguuggggggguugaaggaaagggguggaagaaaguagcaaaagacagcuucaguucagcagucuagagacuuucuccaagcuuuuauuacagcaucagaaauguggggaaagagaacauuauacuuagucauguccacuuauguuuagguuaugaggacauugaugccaaacauauuacauuauaaauacucaacagauuucuggugugucuggcaugacucuguuucuuuauucuugguugugcagugacucaagaguuaugacuugaagguuagagucauccccggagaucucaaaauauaaauaacacuugguacuuacuguagagagagaggagcccaaacaucaaagacuauaaagguuucuguccuagauguugcuggcucuguaguucugcacauuguugcucuugggucaggaacugagucauaaauucaaacccagucugugaggcaagauacauacugggccaaugguacuucuggauuugcuugaccucccucuccccccaccccucccuagcuuccucccucccuccuucccucccuccuucccucccuccuuuccuuccuucauuuuuuugauaucugcugguagauaucgcuuguggaacaucucuuuguuaguuugaagguagagauaaugauaguaguuugguuucuuauggcccaguugacugcucuuuggcuggugaaaucaauguugaagcuauuucuguuggucauuugguaugggaaguuuucagugaaugaauuggcacuuuuuuuuuuuaacauugaguaaaagugguugugccuuugccacugugacaguacuauucacagaaguccuggagggagguucaaaaguuguaggcuucauagagagagccuguuagcagaauaaaacaguagaaacaacuguuccaucuuuaggaaaagugaagaaauaugcaaaauauaguuauccuuauaaaguacaguauccuucagacuuaaaaggaaacugucacauguuuuauaacauggguggauccugagcacaucguaccaaauggaaacauacaaguacaaggagacaaauaaugaugguuuuccacucagagaagauauuuguauaaucauagacaagaauagagcagugguuucagggacaggaaagagaaguuaauauuuugugagcagacuuugugauggaugaaagacaaguuuugaauaaggaucugaaugaugaguguguuaacauuguaaauguacuuagcccuacugagucauaugcucucaguguauagccuaggcuggcccauacauaccugccuaccugugucuuagugcuucuguggacuaugugcaguguucugaauuggccagugacuggauuugucaaggauuauaggcuuuugucaaaguuguggcuggauuuuuguuuugugaaaucgcauggcuacuacugaccuguugcuuauuguuaccgugccuuugacguucuccacgguuauugggcuguguuuauacucugcuguccuggggacugagauagugugccuucucuguucuuggacauuguaguauuuuaccaaguaucaccuuccuguggcuuuuuauuugggguaguguugugaaauagaguugaucagagaaucuuuuuuucuuuuuuuuuuuguuuguuuuucuuucgagacaggguuucucuguauauuccuggcuguccuggaacucacucuguagaccaggcuggccucgagagaucccugcccaucgaucaggaauucugguauaauuaauaaguuaaacuuuuuucaggccugauuuuuguuuguuuguuuuuuguuuuggagacaggguaucucuguaaccuuagcuguccugaccaggcuagccuugauugaacucauagauccaccugccucugcacccaccccagccccggccccgccacccgaagugcuggauuagaggugugcuaccacugcccagccucaggccugcuuuauaggucuuguucucccguggguacccaaacuuuguuuugaggugaagguauguuuuauuugagaccaggcccaggcugguucuuagaaacuucccaaggagcaggaagaaacggguauuaggacugcagacacacaucacuguauacagcuugucuuuuugguugggugugucauuacuuugagcaguacugccaguagccuccuugaguuguuggcauuggcaguggacagcugcuggucucagguucuuagguguucauguaguaauaugaccuugguuagauccaccauuucaaguccaaaggaaaaauguuuuuauuugcccauaugccuuccuugagcaagcuauuuucucaguaguacacuaaauaguuuaaauaacaacuggcuucuuaaagagaucuuucaggguauagauaacaucuaagccccagaugguugugaaaugaaacucuuuuggguuuucgagacaggguuucucuguguagcccucgcuguccuggaacucacuuuguagaccaggcuggccuggaacacagaaauccgccugccucugccuccugagugcuggaauuaaaggcgugcgccaccgugcccagcugaaaugaaacucuugauuuuguuucuagauauuuguuuccuugaguacugccuaggugaucuagcugaauuuuuauccuuucuugaucuguuuuguuacuuguuuuguuugugagaccuguaguucaagaccccuaguggggagagaauuacccuuccacaggucucauaucuaucagaaauuuauacauaauucauaaaauuaguaaaauuccaguuaggaacuaguaacaauaauuaggggucaccacaacaugaaagacuguauuaaaaggccacagcauuauuaaggaugagaaccacuggccuuaaucuuauauuugugggacagggugucuauaguuuagaaaucuuuauuagguucuagcugaaaauagacuuggaaaugacuuucacuaaggcuagagagauagcucauugguuaagagcacaggcuguacuuccagaggaccugggugcaguuccugacaccccacaugacagcucaaaacuguaacuccaguuuggggagaucaaguaccuucacauagacauauacacagguaaaacaccaauauacauaaaaauacgucauuaauauggcugugagaaugacugccagauuguaaaggacuggcuuccuuaaaauuccauuuguaugaaguuguacccuaccccaggugucaugacaguggauaaaugccaugaccucucuugagauggaagaaagugacggcaccugaauuccuaaagcuuuuaccagaagauguggauauucuuuucccucuguuaaccuaccccaccucauugauguuacucuccauauguaccucccauugcuugagugugagaaugacuaggaggugaauuucucccuucugcuguuggcugaggagaagucuccacuguucaguuugugcuuggucuuguuacugguuccguaguuuauaaagugcaaauagaaagaguaaacuagguaagaucaauuuaugcauaguggcgucuuuuucuucucucucuugcuugcuugcuugcuugcuugcuuuccucauuaaagauagaauauaacuaaugagguagguucugacuuugguuagcuaacuuucuaauuaaagauagaacauacugguggauaaaaauucugacugguaguuuaguaccucucauucagcagugcuuaagugaacuguuuauuuuggaggguaccacucuucgcagaaggaguugcauauaucugaaaauguagcaguuuaagccucugguuucaguaacuguaaccugcuuaagagguugggauucaggaucacacuugauucuuggcauaagaaucaguagguaaauuagcaaaagcaugaacaaccaaccaccagaguuguauguagguuuggcuuauacaaagucauagauugacuacuuuuucuuuagcuuuccaggugguagugcaacuguugaagacuggaagcuguagcuaagguuucuucuuagucuuaucauaaagcuggcaaaucagcuuuagauuaaucagcacaugaaugggauguucuauuuagugagggaaguuucuucccuuugguggacuguguuguguuaaaagauaaaccccacagaaccucagcuguggaagucccaucucaccggcucuggcucucuccuuccuuuguuccuucuccucuuccuucucucucucucucucucucucucucucucucucucucucucucucucucucucucuuuugguuauucgagacaggguuucucuguguagcccuggcuguccuggaacucacucuguagaccaggcuggccucgaacucagaaauccgccugccucugccucccgagugcuaggauuaaaggcgugcgccaccacgcccggcucuuuuuuuuaaaagauuuauuuauuauauguaaguacacuguagcugucuucagacacuccagaagagggagucagaucuuguugugagcuaccauguggaugcugggauuugaacucuggaccuucggaagagcuguugggugcucuuacccacugagccaucucuccagcccccucacuuccucuuuucuuagcaucugcuuuauucccaguugucugaguccaugaggacaaauguuuuggaaucagaucuuaaaacucuguagaucaacaaaauacauaauuauuuguuaaaugagugagugagaaguccaguaaugcacauuucacacaacagaaaugaggugacugaagucaugcucaggcugacugugaccacccuuaacaagccuuaauuugcaguuuguucuuuacuuuucaaacaaauuuauuuauuuauuuauucauuuauuuauuuauuuauuuauuuauuuauuuauaugcaguaaacucagaagcaguccuuauaacuguuagugggcagguagcuauaaacaguguuggaggaacaguuugcauccuuacuguaacccuuuggugguauuauaucauggugcuuuugucccaucuagguccugcuggaguagucacauucuuuuuccucuguaacucaagauuuccuccccucuuuuggcaguacugggaguggaacccucaaacucagaagucugccugccucuugagugcugggauuaaaggugugcaugugccaccauuaccuggcccaagaacacuuuuuaaagccucacauuggucuuugacuugaaaacaagucuuuaguagauauaucucuaacaggacccaguaaagaaagugagccagcaccagguuggaauucguguguagaguguuggguguuacauauuaaaaaaauaugucuuaaaaggaaaaaggaacaauagaaacaugaaaaguauugcauuggauagagcaggagauguguagguucugugaauucaggcuuucuaggguagaacuagaaccuggaggcacagaauaugguggccuguccguggaggagagggcaguccaauuugccuagguucuuccauggcuugguguucuguguuaaaaugauggaaaagucuucucucaggcuuaggacauuuauuugggugguguuuuggguuguucuuguaccacuuuuuaucacuaaaaggguguaaguuuauacuggauuuaauaagguuuuucuuuuucaacacccuugguauguuucuuuaccugaaagucuagugcauuuugaugccauuucuguggcagcuagugaaauccaagggagcagauugcauuuuugugaucauaggauuaguugaaagcacaucuaaaauucuguuguaagucucggcugcuuuuuugaagagaauugagcuuauccaguacaauuugggcgggcgggggggggggggcguucaagacaggguuucucuguguagcccuggcuguccuggaacuaauucacucuggcccugaacucagacauccccugccucugccucuauaaaguacuggaguuaaacgcaugucuucaggccuggcuagcacaaauuuuuguuauugacuacuguauauccuuuuugugauugaaaaugugacuacuuaacuuucaccgacugccucaggaagcuccccucccccccuuccgccucuccuuuucaaagauguauuuauuuauuuuaugcauacgaguacacuguacauacccgaaggaggggauuagaucucauuacagaugguugugagucaccaugugguugcugggaauugaauucaggaccucuggaaaagcaguuagugcucuuaacugcugagccaucuuuccagucucaggaagcuuuucuugacccaagccucuuacugcugagguaccugugucaccuugugagguugccaucuggccagacccagguacaaguggugcuucagucuccuagcuuauguucucuuagcuuguuagauugguuacaugggacaguucagggucagaaaaaauuauuccuuacuuucgggugggggcaugaaaacaaauucauacaaaccauggaguucauguuuugacaaagguucucaugcagccauggcuguccauaaacuccauagucuucuugcuucagcaggugugcaacaguagcuaaaaaccaaguuuucuacuggaauuauuuggagauaacaccuccugguuggcuuuuggcuuaagcaucaguuacuugaauguagaauguaaauaacaaauaguagagugugguaagagagagcuagauaauaaagacaaguugagguagaacacuggaaccaaccaacuucccucccucccucccaugugcauuggcauuuuaccugcauccaugucugugugaggauaucgaaucuccuggaaguuacaggaguuacaggcauuaugugggcugccauguaggugcuaggaacugaacuuggguccucaggaagaaaagcuguugagccauccaucacuccugcuccacacaggaaacauuucauuucaucuauuugggcuguuuucuuuuugauuguucuggacagaggggcuuauugggggugcaugccuguuggaggaguuguuugauaaagauggguauucauucucacgguccuucuuuggaggacugaggagucuauuccuaugaccuuucuguucuuuaagcagaugauucaguaagcguguuuuccagcaauaaaagaacgcauucaugccauucacagaccaguaugcucagaggucugacuuuuucugucugcuggagaagaugccuuaacuuccuugcccuugguacuacuauggggguucugacacuuaggacagaggacugguguauguagcacaagcugcucagcuauuguggcgugaacaggggaugcuagaaagcucacacauuuuugugcccuccuggaaaaaaaucauguaagggaaugaaaagccuauuauaaauaaauuuauuuguuaagacucugaaaacuuuuauugguuaucucuuuuacuuuaguguauuugggagaugguagcguauuaaaagcacugcauguccuuguuggcuccauuuuucaucaugguagccuccauguucagugcugcagcccacauuguaaggccugauuucccuguauggagauaaacaucagugucaggcucaugucagguucuccauuacagaaaaggcagaaauguguagaaaauggacugucaggggcuggagagaugguuaagagcacugacugcucugccagaagucuuguguucaauucccagcauccacaugguggcucacagccaucuguaaugggaucugauacccucuucuggucugaagacagugacaguguauucacauaaaagaauccacgggggcgggggggggggguguuggaugauuuuuccuucagucucagcuauguguggaagccuuucauguacgacacuuuaauauuucuagagagguuucugcuuuucccuuuacauguacuguuggacuuuuggagcacaaacuuguuuuccccccauuugucuaauuaaauugacaauagccuaagaccacauaaccccucucugccagcucuaaccuguugugcuguguugccuuggucaugagguaugagaaaccaguccuuuuaggcucuugaauuauuuuugagucuuacucaauguuuucccauuggaaagucuuggaaggugugugcacuagcgaucagaauaaggccuuauaugagauaaacucugcacugauuuaugccuuuagcaccuccuuaccuuaugugguuuuguuuuguucuuuuaggaaccucuauguuaaacuuguuuuccuuccucucaacaagaaucuuaaaggauuuguauaaugccuacccuaaauaagauaacuaacuggagaaauugucaucccagugggagcagggucuuuucuuuuugcugcccaaacccuaggaacagaauugguaucccagaaccuuugugaaaaccauggagguguaguugccaucuguuaucuaucguaacauuaaggagucaaagucaggaucaccaggauaaguugggcaguuagacuaggugaucaucaagcucugccuucaauagagagccuaucuuaauaaaguagauuucaaagaaggugcccaguaucaacuucaggucuauaggucugauuccuucacccccacuccccaccccaaacacacacacacacacacacacacacacacacacacacacacacacacacacacacucacacacacacacacacagagagagagagagagagagagagagagagagagagagagagagagagagagagagagcaggaugaucaugaauucaaggacuaccugggcaacguugucucagaagauaaacaggaggacaaugcuuugucagggauauaaaugucaauuuauaucccuaacaccuauacuuaugcagcagcaugguucacauuaaccauacuaacuguaaaaauaaggcauugggguggggcuagggagauggccagaugguuaagagcacugggugcucuaacugaagacuccuguuugguucccaggaccuauacauggccacuuauauccaucugugauuccaguuccaugggacuagauucuuuuuucugaccucuucuguuaccaagcaugcaugcaguaacauacauaaauacauguaaccaaagcauuccucauacacauuaaaaagaaagaaaaaaaaaagaaauccaaguguucagaaacugaugaauguguaaguaaauuguguuucauguguagucauuuuuaaaacuaggaaggcacuucuguuguaauguggaucuuguuaaaugaaauaagccaugguguuccccucaagugaggccucuagagacggaauguaguugggacugaaaucagggaaguacagggaguuagagcuauguggugugguuaauacaguaacaugaauguaccuaaaguuuugaggcuaaggcaggaggaucaugauuuagagaccagauuaggccuacugugugucaguaacaucucugaaaggguaaggagagcuggcuuguggcucauaccuuuaaucucaaugcugaguaucuauugcguuugaggcuagccaggaauacaaagggaaacccugacucaaaccaagcaugagauuuggugccuuaucaucauaauaccacaacaguuuuacaaaaggaaaaucaauuuuuaaaaaucacuuauugagaucuccuguacuguuuucaaaagggucuucucucauuuacacuuauuacaugguuuuguuuuaaggaagcauucugaauuauagacauguacugauagcauuaaaugugugcaaugcugggaaaguuucauacaucugauuacuacuaaggccuacaugccuaaggcucaaucauauguuuuugaaugaaaaauuuacccccaaauugaaauguacaguguggagugcuaagauuagguaugcaauauuuaaaaguugcauauuuauuuugcuuuaugacucugugcuuauaccuucaacacuuucacaaggauuuucugcuccucgauaaggaaggcccacuugaucccgucacagacagacaagcuugccacacauggacccaccauaggcccugcugacgugcuucuuggucuuagacagucucagaaggacaucgggccucacagcacgaaccccucgcagucugccugggcgcaggccacaugcggauuuaggugcuuucccaaccuucuugguauaaagguaaacaguucuguuguuagccuaguuuuguuagaggcuguauuguaggaaagccuacgacaguaugucaagugcuguaccauccugagugccucuaagcacugucccuggaagagcauuaaaugucuuuuaaaauuauuuuuuggguuuguaaaagaaugcagaugcuuaggugaaaaucagaggauaacuuuugggagcugguucuccuccaguagguuauggggagcagucaaacacagguugucagacuuaugcaguaaaaaccccuuuacccaccaagcuaugucacuuuccccaacucugccucucuuguuguuucugaagaccuggcuggccuuaaaacuugcccuagccaauaauucauguuguuaaaaaaagugaucauauauuaaaaaauuugggcacaggagguuuaucaagcaaauuguuaacuuuaaucuccccuuuaaaaaaaaaaaagauuuauuuauuauuauaucuaaguacauuguagcugucuucagacacuccagaagagggugucagaucuuauuacggaugguugugagccaccauguguuugcugggauuugaacucaggaccuucggaagagcagucggugcucuuaaccacugagccucucuccagccccuaaucucccuuuuuauguuaauaugccacaugacuuaucacauuucuacuggauauauagagauacaaugucacugaugcaauuucuauuuuugggacacuccaccagacccuuuccuuucuauaugaugcugaagucucuggaccuuugucuuuuggugaauucuuggcugguauuucauuugucccaaugagaucucagccugugaauacccaauaucugcuuuggcauagcacuguguugacucuaucaaguguuaaacucauaaaaggcagcaguucugccaagucucuuaccucauggcagagaggguagguaacuuugauuagaaugccuuccugcccucaggcauccggagagcuggaaaucugggaaagcuguaguguguggauucccuuuucucugugcaucuuuuucauaccaagguggauuggaugugguuugaauaugcuuggcccuugggaaguggcacuguuaggagguguugccuuguaagaggaagugcgucaguauggggguggacuuugaagcuucaccuaguggggaagagucaguuucuccuggcugcaguugggucaacaugcagaacucucaguucuucucuagcaccacaucugccuguaugcuaccuugcuuccugccaugauguuaauagacugaaccucuaaaaaugcaagccaaccccaaauauuguuccuuggucauggugucuguucacagcaguggaaacccuaaaacaguggacuucauuuuuacuacuucuguuguuccuacucaaaccuggcuauuucagaucuuuuaacuuuuuuuuuuuucuuuuucucuuauuuuuguuuuuuugagacagaguuucucuguguagccuuggcugugcuggaacuguagaccaggcuggccucgaacucagccaccugccucugccucccaagugcugggauuaaaggcaugcgccaccaagcccagcaucuuuuaacauuuuuuucuuuuuucuauacuggaaacuauuuuaucagccaggagaugggaaacaaaaucaaauagagaauaaaaaugaaacaaggguaguuuucuauuucuucuccuggaguauucaagggccccuauguguuucaucccccccccccuuacauccuaaucacagcccccuccccaucucccaguauuccuucucauauugaucccuuccccucucaucaccucugagaaagggggggcgggcaguccucuacugcugccuuggcuccucaagaggccaggcaaggcagcccaguuaggggaacagguccacaggcagucaacagagucaggauaagcugcaucugcuauacauauauggggagugucugggucuagccucuuugguuggugauucagucucugagaaccccaaagguccagguuaguugacucuguuggucuuuuuguggacucccuguccccuccagguuccucaguucaucucccaauucuuccacaagcccuaacucuuccacaagacuuccggaguuggucugucuuagucaggguuucuauuccugcacaaacaucaugaccaggaagcaagcuggggaggaaaggguuuauucagcuuauaauuccacauugcuguuccaucaccaaggaagucaggacuggaacucaagcaggacaggaagcaggagcugaugcagaggccauggagggauguuccuuacuggcuugcuuccccuggcuugcucagccugcucucuuauagaaccaagacuaccagcccagagauggucccacccauaaggggccuuucccccuugaucacuaauugagaacaugccuuacaguuggaucuuguagaggcauuuccucaauugaaacuccuuucucugugauaacuccagcugugucaaguugacacaaaacuagccaguacauggucuaauguuuggcuaugggucucuguauuucuuucagucagcugcuggguggagccuuucaggauaguuacgcuaggcuccugucugcaagcacaacagaguaucauuaagugucaggaauugauucuugcucaugggaugggucccaaguugggccccagucauagguuggccauuuauuuccucugucucugcuccauuuuuguuccuguacuucuuguaggcaggacauauuuuggguggaagguuuugugggugggugggaguccugccuggcuauaggaaguggccacuucaggcuccauauaccaccucacuacuagaagucucagcuggagucacccuuagagacaaauucuaccgggagccucccucagccaguuucccuuuacuuucccggcccucucugaacauuaguuccauucuuuacuuuuuuuuccucugccugcaaguuuucaauacagaagcaacaagaaauuccauggaagguucaucuggggugugauaugugugauagucuguacccagauuuugguuugcuuuggucugaaagaucccuaucaaugaaaguuaguuuccccuuaguguuuaguuuugguuauuuuggguuuuuagaguaggaguuaguauauuccaaguaggccuuaaacuaugugaugaccuugaacuucugauuuucuuaauucuacccacccccugucuuggaguuauagguagaggcaugugcuaccaugugauggugugacucuggcacccgaucuauuucucuagccuaacucuucauaauuagauccagaagacaaacagucugcagaggcauacacuuaggccucuagauaccuaggaugcacucuggaggggcugguuaucauugcccucucccugggacaagaggaaggcagauuagauuaagaaagccucaagagaaaacaagacaagucuuaucuuaacuugauuuuuuuuuuccuguacuacuuccaucuucucucuuacuaguggguccuugauuuuuguggguuacuauguggaagguagguaguauuaguauuaaguagcaacauuauuucuagcagucauagcucuuaguaaagugauuuuuguuugcuacuguuuucugcuuuuaacaguugucauuuaaaaugguauaggguuuauuucaacccuuacucaugcaggaaguuaccaagaagguaucaguuuaaguccaagcacccccucccccccaacugacuugauuagauugucugcacaguaaaaacaggcauuggcugaggacucccugaaggugcuugacuggguggcuuuuggcuuuuuuuuuuuuuuuuuggauuuuugagauuggguuuuucuguguagcucuagcuguccuggaacucacuuuguagaccaggcugaccucgaacucagaaaucugccaaccucugcugggauuaaagguguguaccaccacgcccggcuagcuggguggcuuuuaaguggugucuggaagccaagacucuacugaggagcuucauugacuugaaaggcaucugugaaggacuggcccucuguguuuguguugaaugugagcauuucauucuagacacuaucagcuguuacugacggcucuucuggcucuggauuacuagucacacccaccuuuguaaacugagaccuauagucuuuguaagucugacauuaauuuuguguuacuucccucuccauccuguauaguuggaguucaugaugagaaguaaggcaaggagaggagagagauugccuuucuuggagucacuuaagagaccaggggcaggaggcuaagcuggucaagguucaguucccagcacccacauugggauucacagccauuuauggcucuaguuucagaggaucugaugcccuuguuggggccuuugaagguaccaggcacacaugugauaccuagaugcagacaaaaauauucauauacauaaaugaaauauuuuuaagagccuaaaaauuaacccauauaacauguucuaaaauucagcuucacacugccuuuaaucucagcacuugugagggagaggcaaauaucucugaguuuggggccagccuagucuacauagucucauuauagauagauagucagagcuacauaaugagaccuugucucaacccugacuucucccgcaaaaaaauagcuucauaacaaagagcuuggcauuaguguugauagacaggcuccagcagaaucuagugggugcuugugaaagaugggaggugccagaaacuugacagguuuuauguaugugguggguagaugagaggugguagguuuuuuuuucuccuuuucuuuuuuuccucuuuuuguuuuuguuuuuguuuuuuuucaaggcaggguuucucugaguaccuuauuuguccuggaacucacuuuguagaccaggcuggccucgaacucagaaaucugccugccucugccucccaagugcugggauuaaaggcgugggccaccauguccggcuccacaucugccucuuuuuuuuuuuuuuugugccuguuguuccaugugucuguucauuuaaaccuaacaucaucugaaaaaaaauuuuuuuaaagauuuauuuuuauuuauauaagcacacuguagcuguguugagauagaccagaagagggcaucgggcaucagaucccauuacagauaguugugaguuaccaugugguugcugggaauugaacucaggaccuucggaggagcagacagugcucucaacugcugagccaucucuccagcccggagaugugugugcguguguguguguauguauguauguauguauguauguauguauguauguauguauguguauguguguguguguguauguauguguguguguguguguguguguguguguguguauguguauguauguauguauaugaacuguguuaucagcuaggagugguaaugcaugcuuuaacuccaacacucaggacaggguagguggaucucugaguucaaggccagccaggucuacagagggaguuugaggauagccagggcuacauugagaaacccaucuagaaaaaucaaaucauuuuuaauauacaauauuuuccuuuucccuucucuucagaaagucuagaaaucuguggaacaggaccucuaaaacuggcccucaggauaauuggaguuuuauucgacuauagcugggcuuaccuguuuucuugugugugguuguuucacauugagguaacauaauaaugaauuauuuugagauauuauuugugguccuuuauaggaaaaguuaucccagcagucuugacuguguccauaccaaccaguguuugguuugauuugauuuccacuguauguuauuuaaacguuuuaaauuucugacucuuucugggcauauuuagcaguugugauguaaccuguauguacacuaucuguacauuugcuggcauccuuuacagagaagaggaaagcaguucugcuuucucauacucccaguguagcuggcccgccuagugcuuucugaaggaaaagcacuggaauucuaguugauggggcuguaacuagacccagcugggcuacaagaccuuugauggcccaugcugccuccagggaggaagacagaacuugaguguuacuucagacucccuucacucaucagagcaugcaguacugcagagucugaggugcaauggaguccaacuuguccuguguguguguguggcggggcugggguggggaguuauauacaaaccaagaaaggauuaauccaauaaaggauuaaggcuucuaagagagcugccuuggcacacaagccacuggccuggcuccaggcagugcagucuggcucaaguuauaagugcuguucucaccagcugcaagagccagucagauagaaaagugaucccauuugugcuuccccacugacacagaugcacaauuaagcagugcugucgucguaaaugugaaguagccacugcucuaggacuaggagagggaugggcccucucauacucauguuguagaaccacuauuucagcagagauguuccuagggcaggguaagaugcugcaacuagauuuuaaugacagaauauagguuuaauuuuuuucuuuccuuuuugauauuguauuacgauuacaucauuucuccuuugucuuucucccucuaguuccccccacguaccucuccuuguucucuuucacaguaauggccuuuuaaaaauugauuguuuagauacauauauuuaauauacacacauauauauauucuacucaauauguguaaaguuacuuuuaugguuuuuuuuuuuuuuugguagaccuguauagaagucauuaagaauagccacaccacagauuaaauaguguaccgucuuuuuuuuuuuuuaagauuuauuuauuaauuuauuauauguaaguacacuguagcuguccucagacacuccagaagagggagucagaucucguuauggaugguugugagccaccaugugguugcugggauuugaacuccugaccuucggaagagcagucgggugcucuuacccacugagccaucucaccagcccuacuuuuauguuuuuaaggugaccaauugguguccuuuucccuggagaagauuauuucuuaguuaccuguaguucuuugcguagguuugaggcuucacuguccuccucucccccauccccauuagcaugucuuuuguucuacuugagcucauguuuaggcugucauguuggugagacuuuauagguaucacuucugacauuaccaggagagucuaauggcaagcucccugguccucuagcucuuagaaucucuuugccaccuuuuccacaauguuccaugagcuuuaaguacagaagaaguguuuuguagauauaucucauugggagugggcuccaaaagucugcauuucaguugguugguauuuuuaguuuugaaaauggucuguguugcaaagagaaguuuccuugaugaggauugaggacugcacucauugguagggauaaaacaauguuuagaauguagugagggauuaggcucuuuuagucagcuucuccuccuaaucuaugacuucaccuagcucugaguaguuggcuaguucucuuaauaccaagcaugauuucccuccuguugagcacgauuauagagcuauugauuuuuaccaagauaugugugcugugccugucagucauguguuucauagaguuguagcuggauaggacuguugguugcuucccuccuuuggaagcucacgaggugccuucugggaccaggaaaagcuaguucucaauaaggaggcguucaaguccguuccaguucagccgccucugagcccuguaucugaagugcuugauaucuucagaaauagggauuuaccuucuaccucuaggcauagcaauaacaugcaugcauguuugggagucucuuaaacaacccuaaugaacagcucagaagaguuacaugguguuggaguuuuuguuaggcagucuuugucuccaggagggaugagaaaauuucuuuuaaaguauguauguauguauguauguuuauagguuuuaaaaaaaacccgauuccuuacuacuuuuuuagacauucuuacuguugccauccuugccuguauuuuucucugccuucccucccuaaguuugccccauccccggcaugcacaccccgaucagaucacuuauacuuugcuucucaccacucuguuuccucaaacccugguaaggaucccccuuuuccuguuuucugcaguuaacuccaguauauguacucacagcugaagaucuggaguuaggaaccuccagugaaacaaaagauaagacguuagucuuucuggaucuggguuacuccacucaguaugaucuuuuguaguuuuauucaaaucuuuguuuaauuuuucucaauuuauuuugccaguuaucagugucucuuacuucuuucuuuuuguuccuggggagauugugucacugcuuuauucaaguacuuucacuuguagaaaggguuauucuaccucucucucucugugugugucugucugucugucugucugucuuccaugucuuaaggauauauguaaauuugaauguauuuuuuccuauggaccuggggcuagccacauuggccagaaggaaacaaguuuaagcuaugcuuguucaggucucuucuuauaucccaagcuuaaaaugugaauugugcuucagauuuugccuauaaugauguccaagucucccugagaacagauggccaauuaccacaaauugucucaguucugauuuauuuggagugaaaauauuuggagauagcacuacuagaaaucuggcuggagccuuagugcaugagccauaugugauauuuagguccauguguacugagggcaggccuguugaaggauggaguaguguacugucagccaaggcaaaagaagcagcucacagucauugcuccugggcuugaggaggccacucuggaucagaacauaccaaguccauaccacucuacaccaucucuaguguugucauggugaagaugaugaugccgcugucugaccugugagguugcugugaaguauaggccaagucuauaaugcagagcauaaagcaucaucaacccuagaagugaagacuucuacgcucuagggguaauuaauuuaaccagcuaaccagcacucauaacuguuccuuaccucugacauuuugcugccuauguguuguaauaucaagaaagcuguaagucugaaggaauagagcagaaauugaggagucacugggcuccagggggacuaaggcuggaaccugauuggaauaaaaugggguuggucucaaccuacuaaacuuguuggcaguggucauaauggacaacuauuguacccauugcaauaugcacaucagcuguuucuaaaauaaucuuaaagcaauguuaaggagcaaggugguaucaaggauguccuugagaagauggcauacuuaaucagaaguugaugaacuuugggaaauacguguguacaugugcaaguauguuuauuguaauaguacauauauauuccuacuaauucucagguuaaguacuugccacucaggcauaaggacuagaguuuauuuagaucuucagaaacugaaugucugaugggcacaguggccacacgggcaaguuggcuagcaaaacuugccuaaugagugagcucuaggcuugagcgagagaguuuugugggguguuuuuuugguuuuuuuuugucucaaagaaguuagauggaaccauaauugaugguaauuuucaaguuagccaaugaucuccacgugcaggcaaauguauacacuuccccacacacaucgaaacauacguacccaguacaaacacuccugugugugaaaauggggaaacccuuuucacauggacucaggccaaaggaagcacucauuaauuuugugaaacugcuaaugccucaagagcuguugcuguuaaaaugcuuuuuuuuuuuugaaaggagaacuacuuuauuaucuguauguuauuauauaguuacuucuuaaugaccaucugucucaaaacuauacgauaaguguaaccucucagauugagaaccauuggaggcaccaccuacuucccccguuauagugacuucuugugauauuugcuuuuuauuacaguaacaacaagguguuaagcuuuagaaauuacugcaccacugaaaggaauauauuagagccuaacaaaagaccaauugcuuuguuuuaauaguguuugcagugacccucuugcaugauguccuugggacaccuugguauuagcaccacacuguccauccuugcuucaucuuucccucuauuucuauaaacucaaaacagguuauuacaggauuucuucuggaacagauuuagaaucaggguauucauuggggucaugagcauuuaaaguugaaaacauuauguggaauuuucuaacaguccaauuucuaauuuuuuaucuuaguaaacgggggcuucuggcccuugcuaacaggucagaaaugaaaguggaagggggguaacuuuuuuuuugacccccuaaguuggcuuuaacaguugccuuaacugucagauucuuagcuaccauucuguuuguuccucauaaaugcugcugucucucuugccuagaucagugccuccauugucacuguacugaugagaccugucucugcuuaccucaccauaggagcacauccuuguuaucaguauaguaucuccucuccuguccauggcuggagcagcagccccccccccccaauuuuuuuuuucaaaaaaaauauuuuaaugauauugauuaaaggguugcuuagucaacuuagaauaucuugucaauugcuaaaugcugcaggcugccauguaguuccagugagacacagauagguaccacauuguccuuaugagugcugcuuuuucaaagcugugagacugaucccuacaguaaaagaaugagaaugugaaagagugagaaugacugcuucaagauucaaguuguuaugugugcacaggugauggguaggagauuugcagcugucucugucacucugugugugugcuuuuagcagauauagcaaguaaaaagucugaagguaacaaggauggcaguagugauauuguggaccauagauaguugaggccuaguaaggaugacauuaaagggagaauucaccaagggacuaaauagguuacccccauacuuauaagggaaaucacuaagacucauuuccuugcuucaggggcagcaaggaaaugagucuuguucauuuuccuauugacugauugauugauugauugauugacguuuuuguuuuguuucuguuugagggugggaggucacugcaaugggaguggacaauccuuaucccacuuacucuuuuugaauuggggaucagagugagaaagguuacuacuccuucagcuaugguuuauuuauaaaccuuaguuuguuucaaugggauaauuggguagacaaguaugaauuuuauuuaguuuuuuguuuuguuuuguuuguuuguuuuuguuuuucgagacaggguuucucuguguagcccuggcuguccuggaacucacuuuguagaccaggcuggccucgaacucagaaauccgccugccucugccuccugagugcugggauuaaauaaaggugugcgccaccacgcccagcuaugaauauuuuuuuaaugagugcaauaccuuuucaugagauuucuuuuagcaguaaacauguauuguuugaauauuuacuuugaaaauguuuguaguuaaugugaagcuguuuaaaagcaaugugcauaggccuuaucuuaaugcucuuucuuguguagcccuggccuaaauagaaguauugguuuguuuuuguguuguauaagcaagagcuuacauuaucuuaucccaucacacaaccaccauucucuaaaggucuguagggaaaagggccaugcaaguuuaugaaacauagcuuuauuauaccuucucccuugugacucuguaguuuccaguggguaugcuugcuccugaucagcucuuaacuuugugcucugacccugguuguugacagguauaccuaucuucuguacuagauggucacuuuuuuugguggucuccugagauuguauauacuaggcaugcacucuaccacugagguauauccacucaguccccuucuuauuuuauuuugaaacacaaucugacugagcuguucauauaggucuuaaaccugauaaaaccaccuuucucagccuccagaguaacuggguuuacugccccucaucaccaagcccagauagauggcuagucuuagaagagauaaugacuagggcucuuuuaguuggagaguggaauaguaacucuccuagccauccugaccaguuaauaccaguggagcccaaucuuuggaaucugcagccaggguuacucauuucuaguuuggcuuaugugcuaucuggucuuugaugggacuuuuuucuuucuguuuagagugccuggugaagaaugugaugggaucacuagcaugucuacggagagcggcccugggacaagauugagaaaucugccaguaaugggggauggacuagaaaccucccaaaugucuacaacgcaggcccaggcccaaccccagccagcaaaugcagccagcaccaauccuccacccccagagaccuccaacccuaacaagcccaagagacagacaaaccaacugcaauaucugcucagaguggugcucaagacacuauggaaacaccaguuugcguggccuuuccagcagcccguggaugccgucaagcugaaccucccugugaguagccaucuggacagggccucuggcuucuacuacccucagucucuccugguaaaggcagauucugcagaaggguaaaguuggguuuggagucauugaacucuuaaccaccaguguccacaguggccuuucaauauauuguuguuauagacuugaaaauuaaacaggagggcuggugagaugguucaguggguaagagcucccgacugcucuuccgaagguccggaguucaaaucccagcaaccacaugguggcucacaaccauccaaucacgagaucugacucccucuucuggagggucugaagacagcuacaguguacuuacauauaauaaauaaauuaauuaauaaaucuuuaaaaaaaaaaaagaaaaaagaaaauuaaacaggaaagaaagagccgggcggugguggcacacgccuuuaaucccagcacuugggaggcagaggcagguggauuucugaguucaaggccagccuggucuacagagugaguuccaggaccaaaaaacaggaaagaaagagaagaagcuaacuggcuuagacauuaacuuauuucuuaguuaauugguaccccagguaaaauuguauagaaaaaguuuaaaacaggaugagcugaugucagaaccccaacuaguauuucaaaccuuuccguagcugugguuggucagccuguacagagauuacugcagcagcagucacuugaagcaccaccaaagcacuccaaagcuugaaagacucucuccucgggagcaagugcacacaggcucuggggcuugaaggggacugcuacuguccccuggggaucuccccuccaauauacuugcucaucuucucgcuuucuuggggacugucccauuuguacauaucccuagcagacagcucuacaaucugaaccccagugaaugguuaggacaagugcuuuuauaguucccuucaaaagccaaggcuuaguuucuaaguuacucucugguauguauuaaguuccaugcccuuuuggcaaauguguuauguggugguagccguuauccagguuuggucugugagggcuagaacucuuucguguguacuuaguugguggccuagcuucuaauagguguucauguucuucaaaaugugauaacccacucuggccugucuugaaaauuauugaccacuaaauauaugucuuuuggucuuagaagaagagacaagacaucuaggucgugaacuugauagaaaaagaugugugugugaggguagugcccacuauuaacuaagauaagcaauauaagcagcugccagugggggccugcaggucacuugggaggccugcuugagauuaauggcaauagucuauagcaucuaauucuacagaugaaaagguaacuuuuuuuuucuuuuugcuaugaagagacaccauggccaaggcagcuuauaaaauaaaguauuuaauugggggacuugcuuacaguuucggaguauuguguuaguccaugcacauccuaacgggggcagggggguauguuggcaagcagguauggcguuggaacaguggcuaagaguuuauauucugaucaacagagagaaugaaacuccccaggccugguguauauacuuuugaaaccucaaagcccuucccuauugacacuuuuucuaacaaggccacacuuucuaauccuuccuaaacagucuaccaacuagggaccagacauuucaguauaugagccuauggcagcuauucucauuagacagcagcacucuuuaggucaaauaggauauauaaggaguugggaguggaaggcagguuuccaaacuuuuaugagaagaggggcaagaagagcucuuauugaagagaccaaauaaucaccagcaaacaguaguccccagguuuguacgucagagaacaugaaaucaaaaugaugagaguuacacacuaucugucauccugcuggcuguuagaagaccaagaaacuuggcuuugagggaaaaguauguccaggcuagaauagaggaauaguuguuauaaaaaagauuuaauaggugcagaggcacagaggcauuaaggggcagagaccaaccaaugcaggagauuacuaggggacucaggugaggccacaggaacauacuagaauuccuaagggauucaagugagguuauuggaauaugcuggugaguaaguauaugguaggugaugcaugucugucaagugcagaggcugcaacuccugaaggaauuucccucuuuuggaugauaugaauccaaccuuucuucuaauuuuaucacauuuagcagccuuuuaaaaauaaagggagacaggcggugguggcauaugccuuuaaauauggaggcagaggcaggcggauuucuugaguuugaggccagccuggucuacaaggugaguuccaggacagccagggcuacacagagaaacccugucuugggggaaaaaauaaaaaauaaaaauaaagggacagguccuaggcugcccuugaucuuguuucauagccaggucugguccuuuuacuguauacccuccuaacuuuugaauugcagguguguaccuccacugauguuuucaaagaaagguugcugaacaagagugaucugaaagcccuuaauuugaauagacccgggggcuaaucagcuagugcuguaagagcucauacuuuucaggaacuauuagaaagccaccuuccaggucucccuuuugcauucucuggggccuuauaugucuuuacaugcaguuuggccucuuguccuaccuuaaacccauugccuuagcucccaacagucuuuuaucccacugcucuucagcuugcccuuuaauguuguccuucuguuuuugagccacuugaaacacuagacaaugcaggucuaaacacuguucucagaguuuugucuacagaauaaaaauauuuggauuuccauaggucuucauuugcuuuuaguucucuuaggaggggaggagacagcaugaaauaaguuagaaagugugguuuucaguugccuuuuggccugggugcacaggugcagccuuuaccagagcaagacgccuggauguuccuucucuugcauagacaguaguagcccuuucuuucugggugucagcacaucuuaaaaccucauuucccaccuuaauuucggaacauaucuucaugcucuccucugccccucuauucgcaagaacugcuuuuuuauaugcugugugccuucccugauacuuacaaggaagggauguuuuaacgcccccgaagagaaggggagauuauaaggcuccaccccuacuugaggagauagugauaauuggcugcugagaaaaaggagagucaguuuucuuuggggauaugucuacugggaagcugcggaugcuccuaacagucucacccaugcgcguacaggcaucacuaauuugacucagugggguguuuaaaaaaggaagacaaggaggccuagaugaggggauugggggaugagggcagauuuugaucaaaauacauugugcauacaauaaauuauccuuuuuuuuuuguuuuauuuaaaaagaaaauauuuauuuuucccccuugugaauacaaccuguuagcaugugaauuuccaucuagcacuuaggaaucuguccuuucuuuacuuacuuuacagucaguuccucacugacaccacgggaacgucuuuggcuguggaguuaaguaacaguggccuuugauuucuuugcuccucaggauuacuauaagauuauuaaaacacccauggauaugggaacaauaaagaagcgcuuggaaaacaacuauuacuggaaugcucaggaauguauccaggacuucaacacuauguuuacaaauuguuacaucuauaacaaggugagauguuggggggcagagguccaguuucccugcuugggaaggagggggaguaaaaauagggauacuucuaaggagcccaaggacaggguugcugggauagcugggcuguguaaggaugauagcaagagacucccagaaguaggauaaugggaccuauaauugugcauaggauuggguguuucuuuuguggggaggagggcauuguuauccuuguuagccugaagcaucugccucgaguacccuugggguuuuuauuuuaguucuugagcaugucuaguacagaacauaugaggacagaugacaccaggugguccuuugggaugguguaaauuuucagguaaaagagccugcacaacuuagaguuuugcagaggugugcucaggcacaaaccuugaugugagaggguacaguggggcuagcugcagaccccagcuguucugugggucacagucuccuggaacuguggacauggccauaaaauccaguguccuccuggucuuacauauagacccacgggccacuuccuaaccccguagccaaaccuuucggcucggcugugccaugaagccagaucauuuguuuacaguucagaccacagaugugauuaaaaccaacccuuucaaauagaacgacucuggagggagacacuauacagaacucagcuuuugaccucugcucguguaguggguaaaauugcccagaagagauggguaggugaguuucuugaaguuuacuguguuuuguaaagccuuaguucucaccacuuagguggaaauuaaaauguacagacuaggcccucaguuuagagcugaacggggacagcauguucuggacauggugacagaguggggauucauaaggcaaugugauaagggcuuuguucaaaccucacugagcugccauugggguacauuagggagcacuguuggaacccuaaaaaauauucaucaccagaaaaaaugcuguguaauuugaguaguucuagugaauucauuugaguuguaucugaagaaaucccaaaguaaaggagggccucccguuaggaaauuaagcugguagguacauaaggcacaaggaugguuucuuggagcuuaaaacugaaaggagauucagguggauaggucuucuuaggaauaccaaauagcauaaccauuauggccccuggaguccagaucuuguuuaggaauaccugguagcauaaagauuguagcccccuggaguccauaaaucaugaaaggagccuggguacaaugcuccauguauuggagcauggggguggcccuggugucccguccacagagaugggaagaaaaggccuuccagcucuaccccaccuguuuccucauccagccuggagaugacaucgucuuaauggcagaagcucuggagaagcucuucuugcaaaaaaucaaugaacugccuacagaagaaacugagaucaugauaguccaggcaaaaggaagaggacgagggaggaaagaaacagguaguuguguuucucccucaucguugccuauuuuccaaguuuaucagagugcuagggauuacagggaguuagguggugacagcaaauauuucauugcugauauuugaacagaguggacuuuaauaucaucuaugcuccuaggaagucccauggaucugaaguuucuccuuggcaaaagucacugggcccugaguaguugauaaacuuagauauaaaagaaagcauggcuuugacauuugauucuucaccuuuggugcuguagcuguuucucgcuuuucucucaauuuuauuauuuauuauuuguuuuauggugcuaaaccucaaauccagcaaguauuucaccauugagcuucaugcccugguccugcuuuuccauuuuagaauaaagaaauuauucugacagaagccguuguaacuaguuucccaaucuuuaagguuuaucaucuaaauucccuuaaugccagucauguuugccucuggugcucacucaucuaaagccaauuacuaacuucuuccugccucccaguuuccaacuguaccacuacuaacaaaacucaagcagccaucuggcaaaguugcuauuaacagguacuauguccuguacuuuacaguucugagcugcaaaagggugacaauuuucagguugcuucugguuguuaguuauuugcuucuuuuaagacaugcuuuuagccuggccucccaccuugcucuaaaguggcaaaggcacaggggcccgcuaaauccagaguagcuuuuggaauuaccaaagaaagacagucauucacauguauguucccacuccuuucuccucuuccucucccucucccuuccacucucuucucucccuccuuccuucuuuuuccuucccucuccuucccuuuguuaauucagacucaaagucuucaugcuucuugagucuuguuauuacauauauucacuacuacucaaaacuuuuggcagguacauggauuaaaucacauuccuuauccauaacaugcagagccuacuccucacuuucugggacuaacaguuuugaugauuugacugcagcaggcacgggaaucucaggcuagaaagaaaauugggaaacucaguagaaccucccccuuccuccucauaugauuccuggaaagcgcucuaggacagccuacagauagauaaugcuuuugcuuuccugucugucugucugucugucuccuuccugagguagaauuuuuuauugacauagcccaagcuggcccuaaaaccuuaauccuugcaacuuggccuccucacugcugagaucgcaggcuuuaaagacuugcugucauuccaucugaaugcaaaucauaguacaggauacggucccugguucaccugcucacguuugggcuguaguuauaauccuuuguuuuuaauuucugauuuggugugccaugugacuacuuuguguuggaaguuagaaugcagcuacagggaaacaagcugaguagucacagauggcuacaauuguccacuagucccuaguggcucugagaguugagaccauccuacuuuucagaaagcuugcaaggucgacugcugccagaucugucaaaagcacucggaaggaagugagggcagcugucugcauuccccaaggaacauuuuucugauuuccaugugcagcacuggugauaacacaguguauagguuucccacucuuuuagccugggcuucccuucuuaucucagucuguaucugagugaggaguugccaccaggacaccucaggaaaugauaccacuucccuggggacacaggaauaaguuuggugcacagugauaccugaaguguuccagauggucuuaacacuaaacaaauguaguacacaaguauauguggguguuuugucagggugugcuaacauagcuuuuaaauuuacuauuuuuuaugauugguaggggcagcaaagccugguguauccacgguaccaaacacaacucaagcaucaacuucuccgcagacccagacgccucagcagaacccuccuccaccugugcaggccacaacucaccccuuuccugcugucaccccagaccucauugcccagccuccugucaugacaauggugcccccucagccacuucagacuccuucaccgguacccccccagccaccacccccaccugcuccaguuccacagccugugcagagucacccgcccaucauugcgaccaccccccagccugugaaggugagcauccugggcccugguggauugcugccaccagagacggacuugcaggcucucuuaguuguuucuucuaugggcuguguagcucaaggcccagguaguaagcaguaaaccucuucagcagguucuguggccucuaagggaguaaauacucuauugaguuuugugcuuuucuccuguugcuggcugguucuaguccagcuguggaaaacaguggugugacagggucucagugcaguuauaccuuugggcuuguccugaguauugggaucccggucagggcuugguuucagaggugauccugaagggcagcuguaccagccagagccucugauugagacuuuugugucugugcucauggcagacaaagaaaggggugaagaggaaagcagauaccaccaccccuaccaccaucgaccccauucaugagccacccucacuggccccagagcccaagaccgccaagcuggguccucggcgggagagcagcagaccugugaagccuccaaagaaggauguaccggacucacagcagcacccagggccagagaagagcagcaagaucucugagcagcuaaagugcugcaguggcauccucaaggagauguuugccaagaaacaugcugccuaugccuggccuuucuacaagccuguggauguggaggcacugggucugcacgacuacugugacaucaucaaacaucccauggacaugagcacaaucaagguuagcuaccaggucccugggaugauggucagagacaggauuucuccuagacuaauccaacaacguucugggugcccccugcagguucauuguugaaauaagugaacacuaaccuaguauacuugguuucaggugaugacucugccuauuuccuugguguaaggagauguaagaugcauacucgagcucucucaaugccccuguacuucuuugcaccugccagauggucuaggagacuggguccucugggcucagugugauuggcaagaaaggcuuugcuguuugaucuguagaagacacagcacuaucuaccaacaucaucaccaaaguauuuuauuuaaggacuuuuauaauuuuccuccuggaaguagaauaacauugcucaaacaggagauuccuuucuguaccuucaguacaagcacaugcaagaugagaacuuguuuuauuuucucaucaguucuggcauaaucucuucugggauucugugcguucaguuucccuuuagacuuuucacugaccucaguaggguaagccugggucuaaaaucauuucuaagccccaagacuuggcagcuauaucuccguaucugucucaugccgagaaccggagugauggccuguuguucuucuuuguccccauaauccauauucuagucuggauuaaacugagagccacuaagaagcuaccuuguuucccaucaauaauguauuacacacacacacacacacacacacagagagagagagagagagagagagagagagagagagagagagagagagagagagagagagagagagagagagacagacagacacaggaacagaaaugucuaaggccuacuuuguauuugcagucuaaacuagagucccgagaguacagagaugcccaggaauuuggugcugauguccgauugauguucuccaacugcuacaaguacaaccccccugaccaugaagugguagccauggcucgaaaacuccagguaaggcuccaaggucaggccagaucuugccuugucagguauuuauucugucacuucacucauaauaaugcagugaggcuuggaggaaauuuuguuuuuguuuguuuguuuguuuguuuguuuguuuuugaacagggucucucuuauguaggccuggcuguucuggaacucuuaacauagaucaggcugagcauauguaacuuaccuaaugcauacauacauuuuaaguuagggucauuaacuuaaaugugaguggcugguucugucugucugccuguucguaucccccaaccccuacuccccacccugccccuucaacaaccuggaggagacuuuuauuuuuuuuaagacuuauuuauuacuuauuuuauauguaaguacacucuagcugucuuuagacacaccagaagaaggugccagaucucauuagagaugguugugagcuaccacguaguuacugggauuugaacucaagucggugcucuuacuuccugagccaucuuaccagccuagcuuuuauuuuaaagaaaaguacauaccaaaauuuacagagaccuauaagguacaagugcucuuaaccauugagccaucucuauaaugcccagaccugccuuuaaaggaaacauaagaucuuaauucccagccauuucuucauuaguucauagguugcuaccgcucucaggucaguggucugcugagcaaccugcuacuaagaagcacagguauauuaguugugggucgcaaggcuuccuugggucugcuuauauagcagucucuaggguuuccagggcagagauuugcagagcuguuggugacccguuggucuuugucauuagaacuuuggugauucccugccuccauacuauuuuguuaguuuugcuaaugugucacaugauagcaucuuuucuccuucaguucagagaacaugucagauucaaggguagcuugauaggauugacuacugcucuuugauaguguugaccuggcucuuaaaauucaaaugcacgaucagacuauugggaauuuuucacuugauugguugauuuuguuuguuuuacauuuauuuguaugggugguuugacugagaugucuggugguuauggagucuuaaaagaugguagcagauccucuagacuggaguuguaagcuuccagcuuccuuaauggugcucgggacagaaccugaaucuccugcaagaccaucuaguaccauugguuugguuugguugguuugguuugguuuuugugugugauuguugguuuuuguguuuuuguuuuuuuuuuucuuuugguuuuuugagacaggguuucucuguguagcccuggcuguccuggaacucacucuguagacaaggcuggccucgaacucagaaauccgccugccucuaccucccaaguguugggauuaaaggcaugcaccaucacgcccggggugguuuuuuuguuuguuuguuuguuaguuuuuguguuuuuaaaucuuccuuaguuuuguuuuuuuuuuucugacuuguacuugucacuuagcauucccucuucaguuugguguuaucuguccuucagcuucauaagaaaggcagccccuucgccauuuauguuugcuuucacuagucuuuauguggaauuaaggcuuuuaaauuuugcuacaauuuuuuaagauacauuuuauuuauuaguuaauguauuugaacuauacucuuguugucuaucucuggcuaguucuaccucuacauucugaauacuggaauuaaagauagucuacaucauacucagcugacugcacuuuuuaaacaggaccaucaaguggcagcgugccuucagacuuuggucugaggacccccuccuuuugcucacaguuuuuuagaaccuaggguaguguuuggccauuuuugucccugguuuagaaacuguaaaguucaauucaguuuccugccagcaaggaaaaauacuaucuugaggaauuaauauuaaagaagggaaagaaaaaccacugugucuggugcgcccccccccccccccccccaugccuugccacuacuucuuccucuguacagucuggacucugaaggggaaggguuugcuuuuauauuuuggugucuuguuuaaaaguuuucuuuuguauaccuuucuccucuuagugggugaaucuguucaagcauaccauuuuuauuaggaugaucaccaagcuaucugcugcuuagcagccuacagagaugaguucuucauaggcauugacuaacaagcuugacuuagaugagaugccuguucucaaggagagucccugugaggcaggcagggguggaagguucuuagcauuaucuuuugccaggcagaucucuauucugaaaggcaguuaucuuugaagcaucuugggguuuuguauucuuuuucuacaaauguccccuaucagaaaucuguaagaagccagaaaggggaacacaaagcuuuuaccuuguuuaccucuuuaagaaguaugggggaggggacacacugaagaaaugaguaaaugguuaaaagugcauucugugcaccaugaggucuagaauuuggaucucagaaccuaccucaaagaaggacaccggaugcccucuucaggucucuaugcauacagguaugcagaccuacucucucuccauaggcauauucucacauagauacauacacaaaauaaguuuuuuuaaaaagauucauuucaggccagauagugguggcgcacgccuuuugaucccagcacuugggagacagaggcuggcggauuucugaguucaaggccagccuggucuacagagugaguuucaggacagccagggcuauacagagaaaccuugucuccaaaaaagaaaacaaaauucauuccuuuguuuguuuguuuguuuguuuauuauauguauaauguccugccugcauguaugccugccugcagguuagaagaggacaccacaucucaguaauagauggguaugagccacugugugguugcugggaacugaaaucaggaccuguugacgagaagccagugaucucaaccucuugagcuaucucuccaacccugaacacaauuuaaauuuaaaccaacuuaaguuucuuuucuuuuucuuuuucuuuuuuuuuuacauuuuucgagacaggguuucucuguguaguccuggcuguccuggaacucacucuguaaaccacgcuggccucgaacucagaaaucugccucucaagugcugggcgugcgccaccacacccugcccaacuuagguuucuuaauuaggcuauguugcaggaauagaauuuacuuggaaaaguuauauagaaaaggaaaacuuccuuuccaccuucauucuagaagauuuguaguaacugcagcccaugugcuuacaggacuuuaauuuguugaggaggugggcacaaguuccuugugguuguaauuguuuaauagggaaaaagaaacuggaaagacauuuggcgccuauuuuaggucccagagguaggcagguuuuacuaugggccuugguuuguucaagcuuccucccaagcacguggcaccgccuacugaacuuucaauuuuuguaucccaaaauuuuaaauggguuucuacuuccaacuuuggcuucuggacuguuucaucugagauaacuuagacacugugacccccccagcaccugaauuuguauugaaagggcuuuuaccuaccuaccuuccuuccuuccuuccuuccuuccuuccuuccuuccuuccuuccuuccuuccuuccuucccauuuugguuuuucaagacaggguuucucuguguagcccuggcaguccuggaacuuacuuuguagaccaggcuggcuucaaacucagaaauccaccugccucugccucccaagugcugggauuaaaggcgugugucaccacacccgaccuuaugauuucuuuaucacauacagccugcuuaguauucuaauacacacacacacacacacacacagaguuuaccuacaugagcugaccuaggcccucugcauauauguucggugacaccaucaauguuggauccucauuggaacuccugguuauucucucguugcccgugucauggagauccugcagcuuuggaucagcaggacuggcccaaguguuugcaaauuauacuaaguuugggaugagcauacucagugcccuggaucugggcaugggagguagcugagcuggucagcacacuggcuaucccuuauuugcaccaccagggugaguucucuagcacuucuccagguaggccucccaaaaugacuccaucagcaggaaagucagggucagcuuucaugcccucaggugcuuucuugcacccaauaucuccagagccagcuccaaucugcugcccagucaaggcuacuccuaacugcugcaaguacacuguagcuaucuucagacacuccagaagagggcgccagaucuuguuacagaugguugugagccaccaugugguugcugggauuugaacuucagaccuucggaagagcagucgggugcucuuacccacugagccaucucaccagcccgguuauuccauucuuaaagcaggucuuuaaaaaaaaucuuucugggaagccaaccuuauuccuuauaugucuauucugugaguuguuguuggauugacuguggccuccccaacauaggcgggaggaguacagauugccaguugguugccugugugugauuugauuccuaggagcacaggcagggacuacugcucuaugaguucuguaacuccauguaacugucagcuggucucagagucuguguguguguguguguguguguguguguguguguguguguguguguguguguuccucugcccagaaucccaguggcuucuguggcuucugcucugguugguuauacuucacaagguaccccuuauugccauaagcacuguacaccgcuagccagcauuccuagagaugcaugauccauaggcuuauucaguuacauggacuacuccgaguaauaggaaggcagauguagacacauacacaugugcauucuacugggaauauucaacucagccuuugccagcauucuuuucucuauguaggaggccagcaaaaaccucaugucagagagcuccagaccuguaaggagguuugggcaucuucucugggggucuugcucauggccuaacacuuacuaagaacccucaaacuaaaguucucagaagacuaguuuuuuuuuuguuuguuuguuuuuuguuuuuuuuuaacuuuggucacuguuuccuccaaggaacaaaucuggucccaggcauuccgagggcugaacacccacauaagcguggcuuucucuccccaggauguguuugaaaugcgcuuugccaagaugccugaugagccugaagagccaguuguuacaguguccucuccugcagugccacccccuacaaaggugguagccccacccucaucuagugacagcagcagcgacaguucuuccgacagcgacaguuccacugacgacucugaggaagagcgagcccagcggcuggcugaacuccaggaacaggugagagaaucugguuuuaugugcagaagccaggauaguaguuaguuucucacgggauucuaagagauguucucaacucuaccuuuuuaaaaagcuccuuguggcauuuccucuuucucagcagcauguuauuccuacagauagauaugcuguguguuuugaguaaaggugagauacagacauuuucugugagaauagacuuuaggauccuggggcuguuuguuugucuacaauaaucuuaccuuugaguuagucaccaagcccuaguguuucaguuuacucuuuaccuaacccuuagaaaccuuccuccguccuuccucccucuucucugcccuucuacccacuucacugcuccucuaccucugcacaauaaaccucucccacguggaaccaccaaaaaaaaaaaaagaagccuuuaucccggaaacauccugggacuaagauagccaggagauuuagcaucugucaggcuauucaacuucucuguuguggaggacgguagcaguccuuggagaucaaggaguggguaagcacaccuuagggaucucauuaauguggcaggaagccagcgugcccucugcuucuaccauacccacaacucaacacucagguauacaguuuuacaugauacagagcuauccuccaggguuuagguagugagaagaacauuuaguccugguaguggguguguuaguuugcaucugaggcagguucccacuaaaaguuuggcuaguaacucaaagagauccaccuaccucugccucucagauguaggaagggauugauuguagaccuguaccaucaugcccagccugguuguaauuaauuaauuaguuaauuucucucuuucuccucuuuucucucccucucccucucuuccucucuccuccgcucuuuuccacagcucaaggccgugcaugagcagcuugcagcccucucacagccccagcagaacaaaccaaagaaaaaggagaaggacaagaaggaaaagaaaaaggaaaagcacaaaaagaaagaagaaguggaggaaaauaaaaaaagcaaaaccaaggaacuuccucccaaaaagacaaagaaaaauaacagcagcaacagcaaugugaggucuguguuucccaguuuuuccaucuuugggaguggugaucccaaaaaaugauuuguagggaggaagacaacccuguuggcuucagucaccagucuggguuggugcccuaucauacgcacuuagcuguuccuucccccucaguuuuuuucccuuaacgugcuuugguaacucagugcuugaccagagaggguacaguaggcagccauuaugcaguuacagcuucuguagccugcccaaguucacucuggucuuucuggucguucccuguugagagugggaagucaaacaacacccaccccgcaugcuuacacuuaaccacauacauucugagggaugugugaaguuuuugucagggaacccauucuuaacuguauaucucaucccuucauagcaagaaggaaccaguacccacgaagaccaagccgccucccacauaugaaucagaagaggaggauaaguguaagcccaugucuuaugaggagaagcggcagcuaagucuagauaucaacaaacuuccuggugagaagcuaggccguguaguacacauaauucagucaagggaaccaucacuuaaaaacuccaaccccgaugagauugagauugacuuugagacccugaagccaucuacacuacgagaguuggagcgauaugucaccuccuguuugcggaagaaaaggaaaccucaagguauaguugagaacucuugguauagggguccuucccauggaaaggacacacacacacacacacacacacaagagagacagacagagacagagacagggggggucggggaggagggagcuggagagaggaaguuaugaauucuaugcguuuaccauagaaacccuaagaaugacacugcaccagacccuggauugucaugccuuucuaggccucuuugguggccuagaaaccuaccugaaucagcuguuuuuugagacuugcucugaguagaagcuguuuucaucucuaguuguuagccauacaguuuucuccaaaaaugaucucucaccucuguugaggugaggccaggaggaaagaggugucuggauguccuauuaucugguguucguucaguacugagccccaccuugcuagcagaggugaugcccaccccaucccugccaucaaccuuccagacaccucuuccaucuuaugccucacauuggcauguaacuuuccccuuaguacuagaggauuuaguuagcuuaggaugugugucaaaauauuuuuuauauacugcuuucuuggccugugcuaaguccucagaacuuugcucugaauccccugaaucucauauucggugacaucauaugggcuuuacucucgcaacuuaacaggaaagcuuugagaacccuggaacucuuuuugcuuguuuugcugugcucugggcacagcagauaaccuguaugaaaaaauuacugcucacugcucugccuggucuucugagucuaugagaaaccauucagagaguauuauaaaagagcuugaugaggccuugaaauugcaacacaaugcuauguuucagcuaguguggaguggacuaccaaugagaaccuuggaacuacucagaaucuggguugguaguuguugucaggagcagucuuuaagccuacagggcucagacuucucacuggcccuuccucuggguaggugggaauacacuguggcgagcagcagcugucuggguugguaguugggaauacacuguggcgaguagcagcugucuggguugguaguugggaauacacuguggcgagcagcagcugucuggguugguaguugggaauacacuguggcgagcagcagcugcauggguugguaguugggaauacacuguggcgagcagcagcugccuggguugguaguugggaauacacuguggcgagcagcagcugccuggguugguaguugggaauacacuguggcagcaauugccuggguugguaguugggaauacacuguggcaagcagcagcugccuggguugguaguugggaauacacuguggcgagcagcagcugucuggguugguaguugggaauacacuguggcgagcagcagcugucuggguugguaggugggaauacacuguggcgagcagcagcugucuggguugguaguugggaauacacuguggcgagcagcagcugucuggguugguaggugggaauacacuguggcgagcagcagcugccuggguugguauccucucugaugcagcucugucuguuauuggguuacagcugaaaaaguugacgugauugcugguucuuccaagaugaagggauucucauccucugagucggagagcaccagcgaauccagcuccucugacagugaagacucugaaacagguuagcugauuccuguuuaaacaucuuaucaaacuaccccacucauccccgguacuaucucaguccuuuguccagcccagaguugauggccacugagaacugccugggcucuucuguccacccauucgucauguuaacuucucccugcagaguggcaagaugcccaguguagcagcacucuauucucuccaucuggguaguggguagaccuugaggacugcagguguuggggucccaucaaccuuggguugcaauauccccaguccccuucuaguauucuggccuuguaguugucauggaacuacauuuuagcaaaguagagccaagccaccuauaucugacagccugcaugaucagucuguuuugagcucuguugucuguagccugagcuuacacuauggaaaaugccauuuuuuuuccuuuccacaauguguuuacugcuguuuuguguugucuguucccugaucuguuuuaacuacauguauguccugcucuucuacuuauaccuguucucugugggccuauauaaugguguucaguuccuuuauucugagcaccaguuacagagcucuggaggugagggcaggugguaaugaugggaacagauugcuuuaccagaaguguacuuuucuuuauuguucucagaggagcaggugcucacauugaccucaagggaaagauagggaagaaggcaugguguacuuagguugccugauacaugguucacaugagugguauuaccccugggcaggucagguuccauuugcugagaagauaaaguccaccuaugagcuagcccuggggucucaaugugugaggucuauagugggccuguggaggaaaaggcuccuggcagucuuccauggaucuuugacuuguggaucaugucaaggaaagucaaggcucccuuaaaacagcaaggaugagcuuuguugucucagacuguacacagaaacugggaguuagagggaggaaacauuuuugugggccauggaguaggcuugggccuucccuggacaguucucuguucugccuuguauuugaugaggaauguauuuacaaagaaaauguaauccacuaaaugguuuguucugcauuuguuccgcagcauguggaaauuagauggucucacaaccuccccuauuuauuauuuucccuguucauucuaaaguaccuugccucacauucccaugaaccagcagggggagcugcauccuaggccugcuggucagggcuggcccugagccauuccuugaacgggggccaccgccuugagcagggugaauggggugaauagauguauucuuagggcuccauuagcauucuugguggccacugacuuuucacuuuuauugccagucaagcuuuacauuugccuuuccucuguuuucucucuuucuuuuuuggggagguguguguggggggguauuuucuagauugucccuccuaagauuuugcagccuucuuuucuaagaauccaaguguucaaaugacaaucccagagacugacccuaaccugaugcuaaacaucuuggcuuaccuuuaggaucuuagaggacccugaccccacacacaaguauuuuugagccacugcccccauaucccucuucuuugagugguaguccuccuauggucccacaugagugcccuccaucugucuuuccuugauggcugucaugauggcauuuccagcagcuuuuugcuacuguuacagaaagaagacuuuuuuccccuaacccgccuccucacuuaaguagaaagcuugugcaacaaguaacccgagagcccugggaacggcuguccuggcgggaaggagggugggauuuaaagucauggagcugcugaucgcagacuuuuaggccuuggcuauggacccugaccauuuuggcuccugggcugagccucuccuucauuccagaugauauccuucccauuuuuggcuggccuccacuugucuucguucagaccacuaguuuuuauuuccuacuauguacagagugcugucuugugaagcuguuaacaugagauuuuguuuuagaaccccacauaagacacaaaaagacauggucauccauggacacaugcauauacuagcaaaacaucuucugucuccucauaccacacagguacugcuguuugugauauuuggagugcagaggugggugaauacucuaguagcugaucuccuggguccaggaagcccagccaccuuagcuagccucuguaacaaguaguacuaccaugucaggaggccaagguagagaugguguagacacggaaguuguuucacuuuggucuuugggucuaguuuauguuuuucauguucuuauuuuucuacuugaauuaaagcuaaaauuucucauggaaccuauuuuuguuauuuguacuaagggucaauuguacuaccauggccccggugauacagaccaucuaaagcaacugaagagaagcauucaguaggggcuagaagguauacaagaaugcauaggguuagaccacacugacgaugagugggugggaugcuuuacuggcuggauuccagccacugugugauccuccauguguagcaacugcaccaguggcccuucgugacauuugucuugaacccaguuauuuguaguugggcuguucuguuuuucauugagcuuugacucuagcuugagucuggaacugcuuacugguuccauguuagaauaaacagaauaaggcccagguguaacucccuucaacuuuaggaagucuucaaacuugggcggggaaagucaggguguaagacacuguggcucuccuuucccagaacucucucagucaccaguauagaaucagaucauccuucauaugggguaaaguucuuucauuauauugcuaauaucugguucuccucauauauuuuccacaggucuuugugaguauagguagcuacauagcuaauuaugugcauccacucuggagucaccccuauaguguaccucagcugccuggccuagagugggauuggagccauacagugagaaagcucuggaagcgcagucuguucaugcaagagcacgguccagcuauuuuagucuuacuuccuuuucccaggauuggaacauguggguguuccuuaauagcuccaggguaaagaggaaugcgugguguuuuggaaaggcuggagcugggaagugcagacaggggcaaugagacacacucuagagacucugaucagggagccagcuucagcucccuggccccaggaucuuugagacuucccuucagggguauagugauccugcuaucagaaugugacaguuacuucagaaaggguuaaggccucuugagaguaggaaauguacugagccagguggcaccuccagaagcucaggaguuugaagggauugauugggcuuccccagagugagggccagcuuuguggaauguggcugagugggcgggguuuucccaggcauguucugggacuagggauuguaacauuuauaauuccagcaguggcgccacucugcuacaugugggaaccaguccagaccccucucuggaccagaauccauauuggauguccugaaaaaggauggaaaggauaaggccucuuugaccucuuccuucccucaacaauuguuaugucaccaauuugcuuuuaauagagauguggaaauagacagaaauggcucugcucuaugccuuccucagugggaaguuuuuuuuuuuaauugggggcuuuucuucucugaccacucuaugagaaaggguugguaguuugcuuuucugaagcugguuccuggugacuuugacacaccuggcuggugagauagcuugggggcagugggcaccucucacauguaagagggacuucaggaguaaagaaaauaccagaauacauagucagggcacauggaacucauuagcagaaucaguuuuguuuagaagugcagacaagcuucaaacaauuuuagagacuuguacauacacuguggccuuucugugguguagauuuauccaucccugccaaggcaggccagucaaggauggggcucuugguuuccaacaaggucuucuugagcccuuucagucacuagggcacagaaccuggcccagucugcaauucuucuguucuuguaacuugaacgguacauuccacaccauucucucacacugguuucuuucucccucuauuagguccugccuaaucauuggacacggacucuuaauaaaacggucuucaguuccagauuccuucccagcgagcuauagcuuaagucccauuuucuucugugaaagggacaggacuccaucaaguuauggaauugcucagagcccugggccuauccccugggguggauuagucauguccagcagcacacaccuaguuucaccuucaggaaggcugccugccuggccugcugccugggccucucuguacaaagacugccuggcuauccugcccagccucccuggucaucugggguccucuggguggguggcaucuccuagagggugauaauaauccuccucuaugcauacauguggugcugcucugugugcaaagccugaucacaguguguuuccucucuucgucccuuccaucuuuuucugagacuccagaccuugcagugacuuuagcccaggaaagcuaauucaccgggaggaugaacauugugaccucccauguggggccacccugguuggcuugaucagauggaagcugugaccagcuuuaccuggcacguagccuccugaauucuccuucagucucuguuguucccguagaguacuaaaaguucaaguaacccagugaacacuuccccaaguucuuuggucuucucuccucaucacauaagaaaaauaaauaaauaccuuucaagguugcuggggagggacaugcagccccacugccaaaccaggucaggaucugggaagugggcaagaaaaauuacauggcuacuugugaacugccuacagugccucaacaaguuccguugccaucacggccauccucaucuuuagcuuccaauaaugacagcagcuguugaggcaagaauagaccauaucauccaaaccuuuccagaaacaaaccaaaguagguuggggcguuuguuuguuuguuugggguuuguuuuguuuuucuucccugaaaucuggcccuggcccuuuuuuuuuuuuuuuuuuuuuuuuuuuuaaucacagaucuagcaccccaccagaaaacugccugacauaaaaagccccauuuaguggguucuuucugucuuuuuucuuuuuuuccuuaauguacuucugagagaacugucucagacaccuuggagcuugucuuccccuggggcuaaaaugagacugugguggugccaaguaccuucccagauuccagaguuuccauauucaaggguugcuugcugcccucuaucugauaugaccuuugggucucagacucccuagaacauccagugaccccccccccccaagaugcugcugcugaguucuuaggccauuccaaguccucugugugugucucuaucuucaagauagcuccuuuugccaaauguacuauuuugagcugcccuuuggccugugccugacguauucccaaugaacuuggcuuggcuggaauuggggggaaaggagacuucuugcccagagauucccacaggacaguugggaaaacuguuggcauuaucuuucugggaagcuuuugcuaucuuggaccaaaugguggccuauauucccaccguaucuuggcuaugugccucccuugccccucccaacacccugucuacacacgugcauacauacagggcaacuuucccuguagaguacucuuugcuaucaugaaucccaucccuggcuaugugugccuacugugauaggaacacucaggaccuguugaacuugaaagaucuuuaggcuuaaagguuguacuugguacccuggaaacacaggcagaaaggacagugucccaccuguucuuccuuguugguaguuuucuguucccgggcaaugggagguccccuuggaaagccuuaguauaccagcugggauccuguuggggagccagcaaggauaguggagggcuucucuccuuaauugcccugcccuuaaaccugucuccuucauucaaguggggccgggcugggguugaaaucaguguuuuaauccaaguuuacaaaaaucauuuuacuuuguacaauaccauccuauguaaagaugaaauuuguguuggagucuaagauuguuauggaauaaagaugacacaguguuugaggccaucuccauggaacccuuucuagagaguuuuguguggggugucugggcuggugugucaugaagcacuuacuguccugucuucuuacugguaacccaacccaaggauugggcuauaggagcuacauagggcugccucacaacacauuucagcuccacuagucucaccugggcccagagggcgcauccauuucuacucugaagaugagucccagaagacuccugcgaccuuugcaguuccgcugagauuuccuagaaccccuuuguccgcugcucuugguccuacgccuagucuuguagaccguaacuugaggcagguggugagaggcaggaaguauuuuucccucuguguaaguaagaaaacaauguucaauguuauuagacacuaggaaggaagcaagccucgcuccuacccagacaucuccccacucaguucagccucuggugccaccuccaaagcuucacaugugauagagcagagugguucagcuucaucuccucaagagcacacucagcauuuuuguagggcagcucuccccaaaucccugccuuaucacccugcccacuccacccuucuuacaaugucaccgaaaaugcuaauagagaagccugucuaagguuguucagcaaccccccccaccccccaauccugaaucauuggucuuuagcuguuguguguccccugucauacaaguccuucuggugaguucugcagcuggugcuguuucuacauuuuaaauagucaaaugcccagcccugaugagacagaucuuuccaaccguccccuuucuuccuuguaauaagcucucucgccaaauuucuucuacugacccccaaggaguuguuaagaacucugcuuucuggcauccaaauuugggcucagccuugggucucaugagcuagguguccucauuugugugaggacauguuuguggcugcugaggucugugccuguguuuugucagugcugcauggaguggugcgcucuugcaggguacaaggugccaucauucuguugaaugcugcaccucagggacugugcacuucacagcacuucaacacagcuaugagcaagaacugguguucugacaaggugcuuggggaaggccaaaacagacacaaaagugacuccuauugacaguuaccugaaaggcucaguaccaugggcagagucuccaacccgguugauugguauuuguauuguuugucagcccaagaguacuggccaagguguuaucccucuccuggaguauccaguugccaaaauuuccuuauaaacucuuaagauggaggcagagguaugaacuuagguuuuuaaccagcuuaacagagaaaggcacccuugcacacauacagcauuggccuucagccucuuaaggagccaggauacacauugccuucuuucuguucacguugacuguccagagaagagucacugacaucugucuuguccaaggaagagaaagggggccagugccauguuuuuggcagugagcaccugccguguuuguucguggucauucuggggaggacauccugcucccuuaaccauaaccaaaagguauccccuucuguggucucauucagggucccucuccuuucccacucuauggcucuggucagaguuaggcuccaugccaggaccacugaucucucgcagucccagccucaucuccuuacucugaggcaaggaccaccuggcacacaagucuaccagagacccuagauugcugacucagcuuugugguccugcuugguuguccucaguuuuuggaugaagccuuguucucagcuugucucaacuggggucguugcaaauauccagaguuauuccagaacguggcagguuauaacacagagugugcugacacucucagccaagguaugacucaugaaauggggagaugguaaagucucuaaagcuuaaauucuggcaugccagggccuugcccuuuacuuaugccuguggucuggagcuuguuaaggcauuuucagucacaguuccuuggaaaagcuacagguagauggauaggugacacgccacacaucuuuuucucccuaugauggcccaauucagaugcauuuucaguguuaccaauccuuguccuaaaugccccauguccaugucuucuucguccaaggccaauucaugaucucuuccccagagucucacuaccuuuucuuuucucugcagagauggcucccaagucaaaaaagaaggggcacacugggagggaccagaaaaagguaugugcuucacugguaucuccuccuucagugauagcugccugagagggugcugugggucugaugcaggcugauuucuccugucugacaucagcccgggugccucucugucugccugcagcaucaucaccaucaccauccacagaugcagccagccccagcuccugugccccagcagccgcccccaccuccacagcagccuccuccacccccaccuccgcagcagcagcagcagcaaccuccacccccaccaccuccgcccuccaugccacagcagacugccccagcgaugaaguccucgcccccacccuucaucacugcccagguccccguccuggaaccacagcugccaggcagugucuuugacccuauuggccacuucacccagcccaucuugcaccugccgcagccggagcugccuccucaccugccccagccaccugagcacagcacuccaccccaucucaaccagcaugcuguggucucuccuccaggugagccauggcucucucuccuuuugccaccuugguucuacugcaucaucaucagugacuuugagcauccuuagcuucagggaugagucgguugcuucucugggauacgacugaugugccagaagauuguaguuaauucuuuggggccaggcauucuguuagaucagcagaaauuggaccugucugcagcccuggguuagggcaugggagagacauccucauccucaucauuaauccugugggguuuggagaacauggauggaggggaagagacggagaaguggggauguuuacucucuuggcaagcugauggaagucugugagcagauaucacaggccugaaggucugugcagaaaaaaggagggaaggucagggacacagaauauagggcaggauggcuaaggaaggccugcaggccuucucagagcugucuucuuguacugucuguagaagcuugcgaaccagaagaacagaagguggacaugaugucaggacaaggucaggguagacagaaacgccaauccagaaccaaaggaacuaaagccucaugucuauuuuguuuguuuguuguuuauuucagcuuugcacaaugcgcugccccaacagccaucucggcccaguaaccgagcugcugcucugcccccaaagccuacccgacccccagcuguguccccugcccuggcccagcccccccugcucccacaaccaccaauggcucagcccccccaagugcugcuggaggaugaagagccaccugccccaccccucaccuccaugcagaugcaguuguaccuacagcagcugcagaaggugcagccucccacaccacuacucccuuccgugaaggugcagucccaacccccaccgccuuugccgccuccaccccacccuucugugcagcagcagcagcuccagccacagccaccgccacccccaccuccucagccacagccaccaccccagcaacaacaccagccuccaccacgaccaguucacuugccauccaugcccuuuucugcucauauucagcagcccccaccacccccaggacagcaaccuacucacccacccccaggacagcagcccccaccaccacagccugccaagccccagcaagucauccagcaucacccuuccccccggcaccacaagucagaccccuacucagcugguaagcaggccccucgcuuguacuggggugggggugugugugucuuacucucacaaugcacuguuaguuugugguucaggcuucagugaguucagagccaaacccugguaggcacuguguaauuggaguaucgugccccuguuccguauuuaucaggcuguuugucuuguucacaagcagaaauacuucagaaagaaaccuuccuugaccuuaacucauaaauggaaggcaggagccagucaaggcaccauaucuaaacauucaggaucagggaaaguuuccuagaggugacccugaguuaagcaggagauaauuugguaaacaaguugggaguuagagaauaguuuggggaauagccaaucucugcacugaacccugcaagacccagguggcauugauuggcccauguaggugaauaugacugggacucauaagcagaaucuacucaggaacccugacuaucugccuagugcagacuucaacaguguuguuugggccauacccuuugguuuuuauggcacauuugacuuugaguuguugauaaccaaaaugcucugcccaucccugacuagaaaauguuccagucaaagcuuacagcaacaucuuaccuuugcgggucagguuccugggcucaggacuguauauacaccauguuguuugccuagggguugaauuaaacuaagugcugccugcaaauugagcaucaaaguagggcuguaacugcuccuauacuuaacacacgcuaccaaagggcaaacaaauuguugcauccccugagcugggugcagcuguugguucucucugggccuggccacccaucuggcugugcugaucucauccuuuggaaggaagguagagaaccagcuuugggcauccuaggccaacaacuuacaaccucccucuacuuugucuuagggccccaccuaagaucccuaaggaguccuaugaguuggaaccuagcuaacagcuugggggccaaaaaccaaguugucagagacacagaugggcacccagccaauucccagcaccauccuugaacugcuaggccagcucuccaaagcuaccagcaaaccauagaccagagagucuucuguuguucagaucagccuuaacaggugcacuugauagcacuaacacagccaacacacugucacagacauuuaccugugaaugacagucgaguggaaccagggugguaacuucgaaggaaguccugauaagcuggguuguaagaaaagaaaaaaucugacagaaugcagccuacuggucuuugcugcuggcccaacaguggagccaagggucugcccgcauaagauauuauggucuucuuugggucugccaaaauagguauauuaaacuggaggagaggggauauugucagaguaagaguuccuauacuaguaugguggcuuagaaguggaaccuggaggacuacucuggacuguagcuagcagagcuaugacaggugacacagccccuuucuagcugggauucaaguagagaacaaacuacaugggaauguacgagacucagcuucuccaguccccaggaaggaaggccacgccacauccuuaccccaguuauaguagauacuguagguuuucauccuuucagcuuguuuggaccacaugacauuccuuuuauuauucucuucucaagauccagguggcccagggcuaguggccuguaucuacaccagcucucugacacaguucuugccuggucuccuaggucaucuucgugaggcucccucuccgcuuaugauacauuccccucagaugccacaguuccagagccugacccaucagucuccuccccagcaaaacguccagccuaagaagcagguaaagggcagggcugagccacagccaccagggccagucaugggccaaggccagggaugcccaccugccucaccggcugccgugccuaugcugucccaggagcugcgaccaccuucagucguccagccccagccccuggugguaguaaaggaggagaagauucacucaccaaucauucgcagcgagccuuucagcaccucacuucgaccagagccccccaagcacccagagaacaucaaggccccaguccaccugccccagcgugaguguccucccugccugcaucuugcuaaccugcgcaucuuccaggugacccagacucacauacuguuucucaauucuagggccugagaugaagccuguagacauagggaggccugugauccggccuccagagcagagugcacccccaccaggggccccugacaaggacaaacagaagcaggagccaaaaacaccaguggcacccaaaaagguaaggguaguaggugcuucagugcucucaucucauugcgauuacucggguugggcauaagcuucuugacauacccugugcagcaggcccucaccugccucuugaccuuugccuauauaggaccugaaaauuaagaacaugggcuccugggccagccugguacagaagcauccgaccaccccauccuccacagccaaguccucaagugacagcuuugagcauuuccgccgugcugcucgggagaaggaggagagggaaaaggcccugaaggcucaggcugagcaugcagagaaggagaaggagcggcugaggcaggagcgcaugaggugggcugggguccaugcagggcacuggggcucccagggccauacugggcuccaggcugaccuggggccccgcucugcccaggagccgagaggaugaagaugcgcuggaacaggcacgucgagcccaugaggaggcacgacggcgccaggagcagcagcagcagcagcagcagcagagacaggagcagcagcagcagcagcagcaggcagcugcuguggccgcugccucugccccccaggcccagagcucccagccccagucuaugcuggaccagcagagggaguuggcccggaaacgagagcaggagcggaggcgcagggaggcagugaguagggggaccuggugggaacuuuugggcgggagucuaccguggagauucugggaauaaagguccuaggacccagggagagagagagagaggcagugagcccaggauggguguaagggaacagcacuggagcuaugcacaugcaguauggggagcagguggagcaggguaccccaaacucaguucuuccuccuucuuccccuccagauggcagcuacaauugacaugaauuuccagagugaucuuuugucaauauuugaagaaaaucuuuuuugagagcacccaggugacuucugacuuuuucuggcaaaaauguugacucuccauccauaguguuaggggcagccguggaagcagcagcagccagggaugucucugggccuggcucuccugcaugcugugcccggggcaggccugacgggcgggcagcugaggaucgcagagcccaucugccuuacagccagccggacagacguccuacuacaugccacccccucagaggacgucaguucagggcacgucucaauaugagucaagugccagcuggaccugaggccugcuuccccgcgugcggggcagaggcccuucucugcgccaaaugucugacuacacaguauacacaggacauuguugcugccgccaccgagacugguuuucugucccugagaacaugacguuugugacguccuacccauugggaguccuucacaccccagccaucgcugcccacucccaggaggccagggcaagccuguguggacuggagcagcaaggcacuggcccaccccuugcuggcacugacuuugccuugaacagacccucuccccucccccacaagccuuuaauugagagccgcucuuuauaaguguucgcuugugcaaaagggaauagugccguggaaguguguguccauggcaguuuggacaggggugacuguucacacguauggacaggccucgccuggggaguaaggccaccaaccaaagucaguuccuucccaccuguguuucugauuuuguuuuguuuuauuuuuuuccuauauauauauuuuuuuuuguuguuguugaauucuauuuuauuuuuaacucucuucuccucagacacaguggcacugcuuaucuccaaauggugugaucgucuccucagugagcggcggcucccacugcgcuguggguagugugugacuguggcuguacuguauagugaacauaguuggcauaucuuuguuugaaguuuguuggugauuccaccaaacugguguaaaaaacaaaaacaaaaaaacccacaaaccacccaaaacucacaaaaaaaauccugcuuguauucaguuucaaacuuuauuagucucacuuuuaauuauaaaaccagaaagcugcaauuucuuuucccucuaccccuuauuuguuggcuucuuuguuuuuuuaaugucaaaucuguuuguuuuuaccaagaaagggagagccugaggaggucugcaggcuuuggugggcugcgaaccgaggcggaggcccccacccaguaccuggugagaccagugugcugcgccuuccuuccuauuaguauuuuuguuucguuuuguuuuuaaauuggagccccuggugagguuacaugugccaugagaacccacucuacaccauagugcuggugccucaguguuggccaaacucuggagucacugacugguuugacuuucaugugguaaauaugcauuuggucuguacugaucauggaauaaacacaucucucuuuuuuaaugcu

SEQ ID NO: 8522 - RNA, 46938 nt, Mus musculus
gucuucguggcaucaguuuauugcuuguuucgaggauauucccaaagugcaucuccuacccccuaguaaugcuccuucacagagugcugauuuaaucccugcaauauuuuauugccucuuuuauaauucuucacugguugauauuuccaagaugugaucuguguacaguuaauggacacaguauuguaacuucaaaagggaggaaaacccaucauacugacccuauaaaaccuaguacaugcuacuuuacagacaugcugagccucccuuucucagacucagaacugccaaaggaauacuauuugcuuaaaaugaaacaucuuuacguaacugugugagcuuuuuacagauagaucccaucuacggaaguuuacauuuguuuuucaucaaugaguaauuucagguuuuuuuccuaaguacuuuuagguggaaauaacaaaauuaagagaaaacaaaacaaaaacccauaauccugcacaaauagagguggaacacaaacaucaaacugauuagcaagcacugaacagagagaacgaaugccuucggcagugucuucacucuagaggcccagguaggcaugcuuccuauggaacagcucugacaaucuuauacacaggccaaggucaccaucuuguuaugccuuuaguuaacaggaugcugccacaucaggugaggaacauagaauacaguguauuauaaaaccaaagcccagcugagcuuggcuguacacacaugguccuaguacuccagagacugagauaggaggauugaauucaaaggcaagcuugguccaagcaagaugcuaucucaaugccaaagcuaaaauaaaggccuuaaaaaaaggucugaugagccgggcaugguggcgcaugccuuuaaucccagcacuugggaggcagaggcagguagauuucugaguuugaggccugccuggucuacagagugaguuccaggacagucagggcuacagagagaaacccugucucgaaaaaccaaccaaccaaaaacaaaacaaacaaaaaauuggucugauguuuauugaaacaggcaggacuguuauugguagggggcacaaucugagcucucgcacacauggaugguugaaucgugugugucccacaucaaccaugcauaauuuaugaauaaauucauaugugaauaagggaauuccccuaaauaauuaauuuuuucccccucaaacaaguuauauuuguaacaaauugcuuuccaggagaaaaagcaaauaaaacgaaacaaagaccaaccaaacaaaaacauaacacacacacaaaaaaauccucacauucuguccguuuuaggacuuaacaauuaccaggaagaucuacuuuuauuauucuaacugcagugcacagauagccaucaaaggccacuugggaaaaugguuuaccucuuuuuguauucuaacagagguaggaagccaucuacuguauagcaucaauccuugagguacauugggaaggaaauggcccaaucuuuccaccaaauaauacacacccuaguacaucuuauaaaauaaaaagaacacaugauauauaacauaucccuugaaacagggaagaaaaaaaucauucggugggaauaucuuuggccucugcaccaguuuguuccagcucaucuuccaugauucccgggauugcuaugacagguaacgugcuuccugcgucugcuguuggcauagcugcuucguuucuggccucagcagccucaccucuggucuugucuucgaugcuccugguuucagaugcugcuucacaggucugcucuucuaguagcuuuucagugugggggucacugcuggccucugcuguguccacaggcccuuccacuucaguuaggacgucacuaugcgcugcagcagguucuccuucccccucuacagccuucacugcugcugugaucaccucugcuaagacuucggcagcuaccuccucuggugucuccuccuucuccucuccuacauuuucaucuccuucugucucaaggucagcaguuucauugacaaaaggauccucacccuggacaaacaggaaacacaaaucagcgcacagccagacaggcccaguuuaugagcucucguuuuuuaggaagagucugcgaagcagcacacuacacuguagacugcagccuuugaagcuucagguucaagugugguaaauuuacuuagaauaaguaaguauucuacucaugacauuuguuccuccaauucuucccauguuccccuuccucaaauucagucuccuaccuguuaacuauuacccauauugggggugcuggggauuaaauccaaguacacacacgcuaagugcugcagcacuagugacacccacagacccuaucggcucuuaaucucugagccaucucucuaguccuguuucauuggagaccauguauugcuacguugccaugcuaaccucaauuuccugggcggaacugaugcuccuauggcuccagaguaguugggcaugugucgcucacuacacucagccuggaugcuuucuaacaagcauuauccccaacaucugcucagcacuuuacagccaaauaaccaucaauguguguugacuaugaguaguguaauacagugauccaccaaagagcaccccacccacggucacagcuaaacaccaagucucuggaaacccccaaccuccaaaccucugaucgccgccuucaauuuaaaaaaaaaaaaaaaaccaacaacaaaccaaaacucagaaaugcucaacacugcacgcugucuacauacacaccuuccauccccauggcuuuucugguccacuagauuccgaaauacaaaccuugagguauuuuuccagcaucuucacuauauguuuguuguucaaaacacucuuagccacauggagacuuguuuucuugaacugcucagcagccaacugcaaaggcaaccaaaaacaaaacaaaacaacuuuuuaaaauaucagagaaaucagaaaacuagccagagugugugacauuuaguuuaacugucaauuugacacaaaccaaccacagacaagucugcacuguuuagaucaggcuagcccggaucacuggaguggcacaaaucccuggacuucauaagagagagacccagcauuaagcaugcaugcauucauucucucugcucuugauuguggcugugacaguugcuccagauuucagccuugauuuacuuccucaaaaugaugugguauacaacccgaauucacuagacacuuuacuaaguugcuuuuggucaggguauuuugucacccacaguaagaaauaaaaccaggagggcuacacagagaaacccugucucaaaaaacaaacaacuauuuuggaggaaaaucucaaaugccaaauaggaaagaaaaguuccuuuacauaaaggcugugcaagugcaaagguuucaucacaggguaaagccagguuugauaccuaagcuccaugugcacggcaaggcuaaagugagcacuuaggggcaugguggcgcucaccuuuaacccucugaguuccaggccagucugauauagauggcuaguuucacacuagccacagcuauuuugugagacaguaucucaaaacaaacaacacacacacacacacuacaaaaaaguaaguuacguggacuaaacagggaaaaagggcaaaccuuuuuacuuuuggggguuauauugcuuucauaguaaauaccagcagcaucaaccaaaacuuuagauugggcaaguccagugguacaaggcuuugggcccugccuccauagggugagauccugucucaaagaagcaguuuaucaacuacuugacugcuuugaggcuuaucuuaugucacugacuccuggcuuguuacuacuacuacuguccugcagaucucugccaaguccuagaggaacugaagagauggugguucaguggcuaacacuuuuugcucuuguagaggauccaggauucauucccagcauccacacggcagcuccaaauuagagucucuuaacuccaguuaaaaggggucuggagcuuuucugacauccauaggcaccagacacucacaugguacacagguauacaaacaggcaaaacaaucagucauacacguuaaauaaaaacaaaacaaaaagccgggccuuuaaucccaguacuugggagguagaggcaggcggauuucugaguucaaggccagccuggucuacaaagugaguuccaggacagccaggacuauacagagaaacccugucuugaaaaaccaaaaaccaaaccaaaccaaaccaaaaacaaaaaaagcaaguacuaagagaugugauguagccaggugauggugugugccuuuaauccuagcaccgaggaaauagaggcagaugaaucucuaaguuccaggacaaccaggaccacacagaaaaacccuauccccaaaccgcaaaauaaauauagagauggguugacagcaacugguauucuaucuugagaugggccagcaauguagcccacacccacuuuaucaucugcauaucuacaacaguuguaccacacaacaacgaucaaaagcucugggcccacagaaccauccuaauugcagggaacugacuucaugguccuuucagauuacaaaguccaaggacacucaagucuccuauaaaauggacuggcguuugcauauccuuccuauauuuuagaugacuuaacaaaacuaguugugcaaaauaguuauaauguauuuguuggggaacauuuagaaagaauugcagugcauucaguaauguugcaauucuuacaccaaaaguuuuuaaucuccaguugguucaaccugugacuguaggaucacagauaaaagccaauuauaucuaagaucacacuuaaaaaaaaaagauuuauuuauuuuauguaucugaguacacuauagauguacagaugguugugagccaccagcuacaagcccuaagaucacacuucuuaugaaaacaaacaacucccacaaaccuagcaacaaaaccuuguuaaucccaaguuaaacaucuucagccucagccucaucaucaauggaagaccaaaccaauacuaaaacacaggucaggggcuggagagauggcucagcagucaagagcacugacugcucuuccaggggucaugagcucaaaucccaucaacuacauggugguggcucacaaccacccauaacgagaaacaugaaaaaccuuugggccagagcaagaggaaaaagggaagggggguggggguggggggaaccaggucaguuccccaggccacggaguucugaacgguccuggccucaccauacugaaauccaauuuuucagcaacuggaaacuuaacucugauuuauagaaaacaguuucaauucagaauuuuagcuacuacacaccaaauuucuguguguuuuucuucccuucuuuuuaagagagagagggccaggcugugugucaaggcauauaccuuuaguacuugggaggcagagggagaggccagcuagggcuacaugcggagaaccuguuugagaccacggagagagaaaagagaggaugaaagccugucucucaacucagccucuagguaggugggaauuaagagaugcauuccaccaaacacaaccccauuuuaaaggacucugaagugaagguuacgguaagaugacagacucacugcgaggccugauggaaugugagcauuccugacccagcauacaagggucugaggucaccccaggagcagccugcauuaaaagaagccuuacccuucgauuaugguuaugguccacggaaugcagaugccgcuggagaagcugaugcugcgcaggaaucagcaugucacaggcuaggcaaugugcggcuucaaucuuuuugaagaaaugcuccuggccaaugccuggaauggaaaccaaacaauuagcuuucucccuccucuccagcaagguccacacucucccuguucuacccucuaggauaucuuuaggacagaaggugagaagguggagaucagcuccacugugagaaauguuguuuuggccuuucucauccuuccagcuguggcuauaccaggagagaaccauuaggcugcuucacaucccugaugggccaucaacgcagcugugcucucauuucagcacaagcagggcuucuuuccacuaauguuguuacacagcacgcggcuucacauuuuugguagcccuuaacuagcacugcacuguuguucuuguuuaguuuuugaagacagggucucacuaugcaguccuagguauccugagacuugcucgguagaagagguuguccuugaacucaccugcuuuccccucccuagugcugggaauuaaaggugcggacugccaucauuuggcuguuuaauuaaaaaaaaaguaguuugcuugcacauaugucugcucaccacaugcgcccagcgcccaaggaggccagaaacagggcauccucaccacaugcgcccagugcccaaggaggccagaaacagggcaucguagcccuuaaaacugggguuacagacaguugugagcugcuauguuggagcucaaaaaccguaggauaccagucaguguuccuaaguucugagggacuucuuuaggcccugggcuguuuuuucaugguauggagauuaaacaaacucugaccucauacaugcuaaguacugcaauauauagaacuauauaaaccuuugcauucugucuucuuuuuuaaucuauuuauuuuagguguguugguauuuugucuguauucaugucuaugugaacagaagccaagagagggcauuggauucccugggacuggagccacagaugacugugagcugccgugugguaauaacaaucaaaccccgaguccucuggaagagcagccagcuuacaggagucauguucuguaccuggauacuggaucacaacuuaccuuugaauggaucugguuuggguuuagggcucuccuucuccaacaacuccugacgccguuucucaauuuucuuauuccuguuuaugauguacuccuagaaggauugagacauaccaccaaauuaaaugacaacacacuacucugggcacuuuucaaguauagagugggauaagguucuacuguggcagcuccaugcugccacaugcagaaccugcuguggucagagcuguugucacucugugacacaggaacauguauaguaguuucaauuugggaaaagaaauucuaucauguuuaggucucuccuuccuuuuaacccccuaaagaguccuuauacuuucagaaccgauccucaaacacaguagcauacuuuaccuggaggaauucuacugucuugucgggcaguuugguacuuauaaaucgcaaagucucuuugugaaauuuacuuugcagaugcuuuugaauuucuucaucuucaaagcuacgaaacuugcauacagaacaggcaaacugaauccuagagagaacacaggaaaagugguaauacagagauuaccagcucaucuuuggauacagaaacgcaaagaaccaggauuagucuuguucucaaaagagccaaacaugccgggcguggaggcgcacaccuuuaaucccagcacuugggaggcagaggcaggcggauuucugaguucaaggccagccuggucuacaaagugaguuccaggacagccagggcuacacagagaaacccugucuugacccacccuccccccuccaaaaaaagaaagagccaaauggagccucuuccaguuccagucucccagguguugagccauuuagccgggcuaggaaacagcacgagagggcagcaccugagcccuaagagcaggguauguuauagaaugggaaacuugcucagcaacugacaucaagcuuaaagaccugcaccaaucugcagguggaaaaagacaacaaauuccuucaaacuuuguuuugaccuucaugagcaugcagcggcagauguguacucauucacauaaaaacacauggcccaacccucaacaaaugaaaauuuuaggucauuugguccugggagauggcuccauagguaagaggacuuguuauguaaggacaaugccaaaaagcaacagauucucauauaggcaguaggugcuuaaucaugagggacagucccaugauggaguaaaagagacacuguaugggccuggcauuuuagcauucuuguuugauacaaaaucuggccagcagaaucaccuacacaugcauucucacucugcugaaucccagagauugucuagauuuggacagggaaucaaaacaccuccuagcagcuauccugaaugaagaucacuuucugggaggcuaaaugucaagugcugacaguuuuggccaccccuugggccugcugaggagucaagagagcucucagcucuggcauucgggcucuaauuccaaaagugaggaaagaugguagucucagagguggauucuccaagcaaaaacaaaguuaacuaauuacauccaucuuccacacacuucucuaaauuguaucuuccacuaaccuggcuaagguugacagcuagaguuauaaaaccaaacuccugugcauuacaaaggaaggacaugugacuaggagagcccgacagugcccagauccaacagccuuuaguggggaucugucccuuaccugucagcugcucggucccgcauccugucucuccuccuuuguuucucccgucucuucuucacauccucauccucguccuccuuuucuccuguaacagaaaaguccccucgagacacugaggagccugcaggaaagcucagcuccaggggccaaguuggaugcugcagccuggcagccacacccugugcccagcuuccauuacauuugugguggggcuaggauaccccaaggcaccgaggagcuguuagagguuccugguguaccaggaugagaacccagaggaguugccucacuccucccauggccugaugggcagaggcccaucccacucauggccaccuacucuguucugucccaggcuguuguccaauauaucacuuuguuguuggcucuucucccacaucacucaaagagcugcaaauauccccaacagaggcagcagcuagaaagucucaggaaauauaacaagcugcagugccacccuccaucccaugucuagguggguuguggugacugucuugcuggcuucaucugaacuagggacucagcaggucugacaguccuugcuggcccaaucucuaguuuccacucacaaaaccaacauccuuggacuuucccaaggccaggugggaaacaauccuagaaacaaaaaugggaagagaccgacugguccucccaucuacuccuuggggcuggcauagcucccaggagaggccuguggccagcaucucagcaugagaccacaccagagccccaggcugagggucaaggcuggaugcugaaaaaagguuggauaagcaucugaacuguaaccccuaccccuggugccagucccgagacugucccacgaagauggcgaccggcgugcgcugcucagaagccucucaaaaggacgugugggacuuuuggcaagaggucacugccugaaacuaugacugcuguuuaauagcaaagucaucccgguuggguagcaggaccugugcgcaacaaacaugucaccuuugcuuuagcauuuacccggcugcaugaacugcugaaugcuggggggugaucccgcgcuguggacaaaacuuuaauguguaggauaggggacaucugagggcuaguuaaccugaggagcugaaggagccaaaggccuucugauuauaagggacaaggguuagccugugauccuugagaguaaccagcuaagacagguccacacagcagggagaaagacaaggcugggugagccuaaggccuugccacucaggcugacucucacccuugggguguucagaucuuaggucucuugcccuagaacuuacaagaccuguucagugauaaaacggccuuuagauacggcccugaguacaccuuauaggcuaucuucccacgaccucaagaucaaccauaguagguauuugcucucuguccacagguacugaagcugccaggauuucuugcagaggccaggguacaaacugaggcucacaacugaaaaaaagagggggaaaccccccaacaaaacaacaauaacaaaaauaccccugguaggaauaaagaagacgggaauagaaaagggaccucuuucuucagauuucuaaaacccgcuuuccuaccuccuacaacuuguaucuauugaggcaaaggaacuccuuucaagcgaaccuugccucaaacacuggacccaagcuuugaggcuaguuccuaguguggguccacugugcagcugcagcaccucugccaugagccaugucuguuuugcucagaagcuggcugggagcugggcaucgagugugggucagauaaagaaaggcuacaaaagauacugggugacgccuaccucucugcuuccuggagucacacaagucauccuccugaaaaagggcaaacccaacguuaggcagugaggcggagcuuccagaagucuaaccagcccaggacuaauaccuaggauguggccugcuauggugcugggaaaugaggcagcaccaagaaacuggagucauaaagaagagcccagguguccagcucuaacucauggcuauuagaagaccauaaagguaauucuuuuuuuuuacagugaccaaccggguucucuccaaagugacagaaugugcccaguggcaaaggcagccaauauaguuuuguaccacagaaaaagagcuuauccacuggcaggggaagcugcuccacccugggauauucuaauucuagcacugaccagaaacaggcucccccaaauuucuaaguauuuguuuagcauucuaacuaauuaguauaaauacagacccuaggauuaucuaggcagucagagaucugcagagacuuccagccuuaagagcuacuucaacugaauggggagcaagaaagauuguuaguaaagccucaacgugguuggugguagguugguagaacacuuggauucuaccaccugcugcccaaaagaacaaaacuagucaagauucugucaggccacccucaccuggcuuucuaccugaccauuagaaguacccagaggaagcuuucuggugccuugugcauuccucaggaaugugguguggcccaagccugccuucccugacacuccccagugacuggguaucaggacaagagccccacaauuagaaggcggaugguuaaacucagcacuguggggcaagggaaaugguuugggagcuuuaagaaagagccaggcaugguggcacaagccuuuaaucccagcacuugggaggcagaggcaggcggauuucugaguucgaggccagccuggucuacagaguuccaggucagccagggcuacacagagaaacccugucucaagaaaccaaaaagaauaaaaaagaaagagaacaguggauaauauauaccccugggagaucuguucuuuucagaagggaaugggaggaaucgaucugaggaagaggagaggaggcuggggaggacugagaggaaagagaaacuuccuuugggauguaauguaugaagaaagaauuaaaaacaagcaaacacaagaacaaaaugguuguuacaggaugcacaccaaagguauaugguucauucaagccaaacagccauuuucaccucuggugagggggaaaaaaaaagaaaagaaaaagaaagacagaaaaaagcaagcccagagagacagagacucugugaaggugaacuuaccccccugaauucuucaucuccugaucuuaagucaccagcuccaucaucugccagauacagggaacagaaguguuagcccuuaagcggaugguucccagagcauugccacauucccacacucagugaccugacugaccaaacaaugccacuucaacccagagcaggcaccugccucccaucacacccagcuggcucagugaucccagagcauaccguuuucagacagaucuccgucacugucagcacgggccaguuuggcaucagguucuucauacaauggaaacugcuuccgcuuccugcccauguugucugguccaaagcguucaaacccccuccuucuaggcuacagacacaaacacaugucauguacugcuaaccugggccuguaagaugccccccaaacaaaauaaagaucagcacuuguaaggacagaaaacaaaggcaggaaaaagccuucaaaaaagugagacuauaauaagaguccaaaagcccaugucaugcuugagggagccagacacacaaagccacaugugugacucuauugcugugaaauaucuacaacaggucaacccagagcuaggacuagagaacagaugauggacacaucuaaagcaagugguguaaacguacuaaaaguaaacuggacacugggaaaugagggcaucuuacaguaugcaaacuuuuagcucaacaaaggugucaggaagaaaaggcaguaaggccugacagaacuuggcgaacuuacccaaucccguauccgcgucugggaccggccacauccguaaggcaugguaccaccaaaaccgcccacccccugcaugcccaucaugcuguagucaggggccauggacugggagaagagggaaggagguggccugcugguggagggcccaccgagaccacggccacccauguaguucagcucauuccacguaguggauaagggcuccgaggcugaggguggcaugaaagggucacuacguaugaaggugcuggaguugcuccggucuuggaagcggcccuggccccggccccucaagaaaccaucaagggagccccgcucuggggcugggucccgacagucguugaaugucccaccaaagcuaccauugcggucaguucccaagucaaagucauaaucauaaccguagccggggcgguagggauuaugcucagguauacagggccuggcgucguaggacucguauggcuggaagcggaaggagcugcaaaggaaguauacagcccauuaggagcagccuaagccauccaggcuacccaauaaucugcccucagccuaacuuuacacuaaguuggaccucuuacauucagaacaagaaaccaacccacccagucaguaucuaccuaaaugcccagaaggcaaacuagccuaagaacacucauucaaacacugcuaacaaagaaagagcaugaagcccuugccagaacaaagaaucuuaggcucauuggccagcaguuuaggaaaccuucagugaagcccaccccacaggguccaacuccagccuaaaggaggaacaggaaagagggcuuucuaaaagagcugguacccacucccgugauuccagaaagggauuccaugagcaaagguugaaggccauaaucaccugucucgguccugcacgcccuccccaccgcugcugaucccaccccugccuccuuccuuagacaacauguccaaacguugauugaucuuggcaaugagcgagucugaguugucgguacauggcucuggggcaaaagacgccacaugcauggcagggcucccagcugccaggccaccaucauuggucuugguggccucccaugaggcugggccguaacuauaggguguuccugcagggacacugguguucugggcauuguaguaguuguaguuuucauaaccuaucaggagaaagaagaaccauguuaggccugagcacaugaggcuagccaugacauucuugucugcaggagcacucucugcccaccaagaaggaaaaaguuauggaacuaagcauuaccaacaucauaccacaauacacaugugaucaagaccagagagacagguggccacagauuguaguagcagguuuucuuuaagagacagaaggacuuguuuccuaaucaaagauggccaagaaccucagaauagcaauuccagguacuaacaaagacauuugaaaaguguuccugcacuauauccacaaucccucucaaacaaguucaaacuccccuucaggucagccuagcucugauacgccucagggcccagcagccuuauucuccgggcuaucgacagagccaugugcacagccaggaugggggaguggggaccuguaccucuggauggcuguuuaaagacucacuugcccaccucaaggucccuuucagaaggucuuaccuugccagcuggucauaccacuuccauauguaccuuaggaaaaacaaaaacacauaagcacuucaauaccaguuauuaccuaaggacagcugccaccucauugcaccacaagguggggugugacugguugugucagugguccuuagcaugcucacguuuuacagaacagguacaaagcaccaauaauauuucucucccaggcaggccugacuucucccaugaaagcuuagaaaagaaagguacacagcaauccccaagaugguggucuacacuacaguacuaacugagaggacaggcugcacuggaccuuagaaaauccccugcauaaauaagcucaguucucaccaaaccuaguuauucccaaccauaccuaaggcaucagugggagugggaggaaaucacauucucaacugaauaagaacauauuauguggcagaggugucuggaagaccuuuucacggggcacacaaaaaaguggcuugccuccaauggugcuagggacuuggccugggacagguucuagacucagaaaauaagggugaacaaaagccuaggccacaucuagccuacugucuguuuuuguacucuugacuuaaaaacagguuuuaucucucuaaauggucacaagaaaagcaccccaagacaaacguuccacaauaugcuaaacauaauaggaacgcacaguuuguguauacagacuaacaggggugcaugggugcuacugaggccugugguggcagguagcagagugacacaaggagcauucuucuuacuaaucagccuccgcucccauguaguacuguuuuuccuuaaaaagaaaaaaaaggcaaaauguccccuagggaagacagaugcugggcucuacuacaagggggcaugcaguggagaaacccacaagccaacccauuaaucaggaaccacuuacccuggguguuggcagguccagcacuccaugccccauagccugugaaaagaucaugugucaagauucuguccuaccucaaggaaauaagaguucugauaacacccaaagagucuaaagaagugucagcuuacaacgagggaacguaaaugugauccagcgcaccuccuccagccuuuaagaacuaucuccacccacaaaugcaagcaaaccaucauaccuuaccuggcugagcugacaucaaagcaaaaaaaaaaaaaaaaaaaaaaaaaaaaaggggggggggguggcgggagggagggaaccaaguuuagaggacacaaaacacagcauuaggucacagugcccacuguacuggccuagccgccacauaagcgggaaagcucagagugcugccaguuaugccacgaaacugggaaacaagcuagaaauucggugacauaaacguuaggcuuugcuuccauguaacuaaacacucaacaccccagcuuucaagccucccucugaccuucuaagucacccccuacaacacuccuuugaacagaaagggaauacauucucuucauuuguguuuuuggagccuagcauauaguccgauacaguggcacagucccaggcugucgaaugacuucacuuugacaguguuaaugguuaguucccuuuccagaauaucccaaaagccccacuguaacacagucccuuaaaugugcugacaggcacucaguacggccauaccuaacugcuacuuagaaaccagggaggggcuggccagaugguucagugguuaaucgcgcugacugcucuuccgaaggucccgaguucaaaucccagcaaccacaugguggcucacaaccaucccuaacgaaaucugaugcccucuucuggaaugucugaaaacagcuacaguguacuuacauauaauaaauaaaucuuaaaaaaaaaagauucuuuuucuucuucuucuucuucuucuuuuuuuuuuuuuuuuuuuugguuuuuugagacaggguuucucuguagcccuagcuguccuggaacucacuuuguagaccaggcuggccucaaacucagaaaucugccugcuucugccucccaagugcuuggauuaaaggcauucgccaccacgcccggcuaaaaaaauucuuaguuaaaaaaacaaaaaaaccaggaaggcugcaaauacccuaacuguaucuguaaaauuauuggcugguagaaagugggagucaccaugaaguucccuagaccaaagaaguauagcaggguugugacagguaucuaucugguggaaaggcuaagaauggaagacauagaucuaggaucccaaaggcaaagagcacuaggcugauacccaagcacacguguucaucacaccucaggccucucuggcaaguccaauucuagggaucuuguuacucugcugccucucaagaucccuuccuuagccgccagaagccacuaaccacucccugugcccacuuccaaccccauuccacauguuccaacuaucuccugcggguaaaucuccguacagagucaaggccucccaggagauuaaaagcagauagcucgagaaccgacgccuaauuacgaaaaguugcugacauuuagguuaggaaaggcaacguucccgcuuccgcagacccccguaauguuacaguccagaaucccagccccucaggcagcacaccucccacgagcaccucacgccgcguacacugcagagacccagccagguuuucccaaaaagcugcaccggguguagccgcagugcacagcugggccgaucgcgcgcugcccguaagccuucagaaaagcgagcccggggacacgagcucucaaggacgaccugcggaggaugagcugagacucucuccucgcuacggccgccgcaacccagccggaccucaacccccuccaccccccgcuuccucagcguucgcuuuagccccgccccuggagccgccauuuuguggcgucuucggaagagaaggcgggacugagaccgcucggguccuggggucccgcagcgaugagagccacucggcuugcacagugaaagcgguccagaacgcauccagaaaccggccacagcgucggccuucgcgccucauccgcaccccccgccccgaguccuaccggccaauccacgcgcggcgcuucgggaacgauugcgcagaggcccaauaagggaagcgcgcgcguccgggacaacuccacacagaaccgggcugcggcaagugcguuccggcugcaggcuaagcccgaauaccacaugcgccagggucucccguggugaagaagagcccacacuaaccuccguagccuugcuccaugucugcgacgcgacccgccagcagauccuugucuuagauucgcucagaacgcaugcguucaacgugcugucugcuacuggaagacgaagagcguacgucucuuucugggcgcuaccauugguugcucaaaugggcccgcccccgccgauccgcccagccuuccggguugcaaaucuacagcaucucgggaguugugccucaaggguaagcuagugcgcaagagcguccagguccgcgcacgcgugagcgguucuagcgcguuuacccgcgcgcaggcgcacuucuaggggcccgcccucaccacagcacaaacgaagaccucagaugggaaagcacuuuauuaggcuggacuuccagccucggccacgggagcccugccggguaaggguuauggacccccaccgcccuccucgucgucuuccaugucgaggcccgggaucccgcggaucugacacugcagcgcuccgcccagcaaggguacagggcucuccuccucuucuggugguggcggagguggcgguguuguagucccuggggcgggcuccaggggcacggggggcugugccggcacgcccucugugagcucugucgcuucgcuuggugccccuucauccagagcgccagccuccaccucgucuuguuccuuuuccuccucuggguugucagugaaaggauucucgcccuguagagauggauagagacuuuaaugggagguaggaaucacugggauagaauggggaccaggcucacacaaaggucaggacuaggacagugcuuucgccuuugccucaccuucagauaucgcuccagcuucuugcuaaugagcuuguuguugagaauacugcgggccaccauaagcgaggacuucuuggacugcuccaucauaagcuaugggcagggcagacagggcuggugaggcugcucuaggaauccaacaaacccagcugagguucagauucaccaauaacuaguccuagugucuguaagugaccuugggcguaauuccagucagucuggacaggcaugcaaggaacuaggauucgaucugaucacccacaccuuauuugcuguuugaaaccugaucugcuuacauagaaacuauaguaaguacuggacuuaguggcacaggccauguaacuccaggacauuaaaguggaaggccuaccuggacuacagaguuuaacgguuuacaugguuugacuaugucucagaaaauaaaagacggcugggagcuagagagauggcucagcguaaaggacuuguuaguauuucaaagacucagguucauuuucugccaccuacaagguggcugacaacaaucucuaaucuaguucccaggaauaugaagcccucuucugguuaccacaggcaccaggcaugugaauagugagcauaugugcaggcaaaacauacaagaaaauaaaaaauaaaaaaauaaaacguaaaaagggggagggggccagcuggagauaauauaauaauuugaugauagagugcuuucuuaguauucuuaaagccuuaguuagguucaauccccauauauauacacacacaccagauguaauaaaacuuauuaaaaguaaaacguagggcugggcuugguggcccauaucguuaaucccagcacuugggcggcugagguaggagggcagaucuuccugaguucaaagccagccuggucucagagcaaguuccaggacacagaaaaaccuucacugccaccccccuccccucaauuccagugacaacaaaaaaaguaaaauguaaaaacaauaaagggucuggcaagaugacucuggguaaaagcacagcuuggcaaauugaacccaauucuaaggucacauacaauaaaggagagaaccaacuccugcaaguuguccucugacuucuacacacaugcuaccucccgcccucccacagauacacagacauacacaugcagucaccuaggagcaaauuguuuagaaccaguaaagaggguauaaaaacagcccuagcaaugcacaccuguaagcccaucacuuaagaggaagagaggacugcugcaaauucaaggccacucugaccuauagagugaauuccaggacagcuuggacuacauaagacugccaaaacaaaaugagaauauagaugaaacuauauuuaaauauugugcaucauuuuaacucacaggauuuggauaugaagaaauaaugguaaaacugaaaagagacacuucucuacugguggagcaacugguuauagacuugaaaagcuauuugauggaauacacaagaaauacaaauuugccucaguaauuccuaucccaaaguuuuuuuuuuuaguuuuuuuguuuguuuuucuucuuucgagacaggguuucucuguguagccuuggcuguccuggaacucacaggcuggccuugaacucagaaauccgccugccucugacucccaagugcugggauuaaaggcgugcgccaccacccccgggcuccuaucccaaaguuuaagaacuagaaauagaccggcuccgcggaucagggccucuggcagaauagaagacauuuauucgauucagugggaagccugggccuuuuguuuuguuuuguugagacaaggucuugcuaugguagcguaggagguucugggacuuguuugguuguuuuggaauuauuuuuuguuugagauauuuuguaggcaaggcuggccugaucucacuauguaguccaugcuggucucucagauuuguggcaauuuuccugccucagccuuccaggaacauuagacuaugccugguuuauaaacuggcucugaacuugggauccucuugaucuccuaaugcuggaauuguagaucuguacuaucauaucugagucauucugucuggaaucaacaugcucggucauuucuucagucauaggaguacagacaugauuaugaaaccaaagaaagaaugaaagggaauugguucucucucuccagcaugagugucccagagcucaaacaggcugccaggcuuagcaacaaguaacuuuacccacugagcaccucacuagaccucacaguuuuccuuauauauuuuuuucuauuacuaggcugaguauacucaaguagcagauuaagguaaagaauuagaacacuacuacaguuccucaguaauuuucacuggccgacacuguccuuucuuaccccucuguguguccagaaguggaauauaaacagcuguuuccaguuuuggucauaaugaccaaacaugagaaauaauuaaaaacaaaacccaguguuccuacuuucagguuggugucauugcuuaauuauccagugcuuccuugaccuugauccaauagugacuuacacuauggugccaacauuaaaacaaccaacuauacagcacucaggcagaaaauagagagccugaccuggucaguuagcauacauauauaguaauagcuacuacagaagcagaggcagaaagaucaggugaagccaaagguuccaggucaggauaggcaaaacagauuccccuuaccugccucuucucagcaccaguuguuauauuuuugcuguuagauaaaaagaauguuugcucuucucgugccacuguccuggcuguuagcaacccugaggacucugaugugcacacuggaaauaaaugccuagcauuguugaagccaagcccccuuggcuucuagacugccuggacugcucaggaagauuucuuuucuuucuuucuuuuuuucccuugguuuuuuugagacaggguuucucuguguagcccuggcuguccuggaacucacuuuguagaccaggcugaccucgaacucagaaauccgccugccucugccucccgagugcugggacuaaaggcgugcgccaccaugcccggcacgaagauuucuuuuaaugaucaagguaaaucuaauuuucuuccuggacuucuaauuguuuuuguuuuuuuuuuacauuuaaaauuccuagaauuuaauacaugguauguagcaaauuuauaaaauguuucagggcugcagagauggcucagcgguuaagagcacugacugcuauuccaaagauccugaguucaaaucccagcaaccacaugguggcucacaaccauccguaaugagaucugaugcccucuucuagggugccugucugaaaacagccacaguguacuuacauauaauaaauaaauaaaucauuuuaaaaaguuucaauauuuuucuacuaaacuaaaauauagggcuauaauucuguuuuuuuguuauuuugguuugguuuuggauuuuagagacauuucucugaauagcacugguuggucuagaacucccucugcagaccaggcugaucucaaacucaagagauuugccugccucuaucuucugaguauugggauuaaaggcuugggccaucauuaccuagcaauccauuuuuuuuuuuaaaauaaauuuaaaauaaaacccaagacaaagauguaacuugguggaauaauggcacgugcaagacccuggacuugauaucaaaacacacauacucacgcccccauaagaacucuagagaacaaguuuucuucuccgucauuuggugguggcuaaauguaagccaacauuaggucuuuuuguuuuuguuuuuuuuuguuuuuuuuucgagacaggguuucucuguguagcccuggcugaacuggaacucacuuuguagaccaggcuggucucgaacucagaaaucugccugccucugccuccugagugcugggauuaaaggcgugcaccaccaccaggcuuguuuuauuacuggccaacaucagcuuuuuuuuuuuguauuaaauuguauuggcuuugcaguaaguuucaaauaucugauaagcaaguuccugaacucacaacugccccuuguacaguauuuuggccacuguuagagcugccacuuuuuuguguaucuugccucccauccuccuuacuacgcucacuaacuuugaggucauuuugccaugaucauucagcuucucuaaggauggugcgacagggcuggcaagauggcuucaauggguaaaguacucacuaccugccaaauagagggacuucaguucuaucucugcaacccacaugauggaggaagaaagccuaacucccaagaaaguuguccucagacuuugacauguaugggacacaugcaugccagaacauauaaauaaacaaaagaauaaauguaaccuugaaaaagacugucaaccgagcagugguagugcacgccauuaaucccagcacuugggaggcagaggcaggcggauuucugaguuccaggcuagccuggucuacacagugaguuccaggucagccagggcuacacagagaaacccugucucggaaaaaaaaaaagaaaaaagauuguuacuuuucuucccaauauuuuaugcuaagaauguugcuagguucuucuuuucugagacaggguuucucuguggcuaagaaaagauaggugacuuaaaaccacuccaggugcuucauagaaucucagggucacaguaauaugccaaaggguuccuugcucaaaaggacagcaucagacucucacuacagggaugaaagagacuucacuaguagauacaucucuaaagaauuuggcucauccuaggaauguguaucuuagugguugagugcuugucuagaauguacaagucuuggagucuaauucacaacacccauagaaaggagaaaaacaacaacaacaacaacagaauuuggcuagucauuaaucacccaaguaagcaaauagguuaauaaguugcuacuuauguggagggugaggaucagugcccagaagggucagucaugaugugauuucucagacaucuagauuaugagauagucaaaggaaacggacccaucuuaaagauaacaaaacaaaguuaaaaacaguaaagaggaagcaguccuauuugacagcgacuggacaucaguuucuucucugugcagcccuggcuguccuagaacucagagacucaucuaccucugccuccaaaaugcugggauuaaaacagcauucaccaccacugcccuaaguagcucuucugacaguuauuugauccaaguguuuuccuuacguaacugauugauaauuugaguacucauucaccaaaaugggcauaaguaccaccuggcagugccaucauacuucaaaguggcaauuaaaaacacauuuaaucugggcuuggagguagaggcaggcaguucucggugaguuuggggcaucuuaguuuauaauaacaaauuccaggguagccaaagcuacaugugagacacuaucuucgaaagccaaaguaaaccaaaccaaacaaaaaagcaaacaaagccaccacauuuaaagaacauagacuaucaacagagauguaguaauaucuuuauaaaaguacagcuaaaucucagaaaaaagaaguguaacagaaacaaaacauucagcagggggcuucaacagcagaugcagacugaacaagcauggaggucaagaguaucacaguauaggguccuacuucaucucuccaaggacauggacuguggggaucugaauuaacauuuguuuguuuguuuaguggagagcugaggacaaauuccacaaguggguuagucccuuccaccaugugagccccagauaucaagaauggagccaagucaacccauguugcuggcucagcagcaaggauuuaagaagcagacacugaccaaggaauucccacuuuguuuuucccucuuguucuguuucuuucugaauuacuuggagucuuuuuccuuacaguuauuggaucagaguuaagacagugaaccaaacagccccuaaacaagacacuuucuuggcaccaccaugguagacccuaaggaaacggcuggucacggucagaucaagacgaugauauggacugauaaaguucuuagugcuugcuucuguucaucuuuccuguuagaaacuaagaccacggggcuggugagauggcucaguggguaagagcacugacugcuuuuccaaagguccugaguucaaaucccagcaaccacaugguggcucacaaccauccguaaugagaucugacauccucuucuggugugucugaaguacagcuacaguguacuuauauauaauaauaaauaaaucuuugggccagagcgagcagagguccuaaaauucaauucccaacaaccacauaaaggcuuacaaccaucuguacagcuacagugugcucauauucauaaaauaaauaaaucuuuaaaaaaaaaaaaagaaaaagaaacuaagaccacuguaagcaguguuugucuacagcaggguaaucagacuguuaauaauaaaacuccuuuucugcuuucgccacuguuugguucuuugauuggcuuucuaggacaaauggcugagccuaguccauugggagucucugugcuuaggauuuuguuuuguuuuguuuuuuuuuuuucuuuugguuuuucaagacaggguuucucuguauagcccuggcuguccugggacucaguuuguaaaccaggcuggccuugaacucagaaauccgccugccucugccucccgagugcugggauuaaaggcgugcgccaccacaccuggccggauuuuguucuaacucaagcaacaauuauaccaucuaaagaacagagagaaaaaaucaugaagaaaaagccgggcgugguggcauacaccuuuaaucccagcccucaggaggcagagguaggcggauuucugaguacacagagaaacccagucucaaacccccccucucccucccaaaaaagugaagaaaaaugaauugucucagacagcauuaaguuacucaauauaaugacagaguaagaaaaaggaauagaaaaauaggcuaaaggcuucccgagacugaugaaagcuuuacucuacacaacagagaagccccaugaacuccacaaagagugaacacagauaccuacaaaaugaugcaucauuacuuacagcaccagaagcccaagauaaaaagaaaagcuugaaagcaaacaaaaccucacuugcaaauaggugucucaucagacaggugaauccaaaagacagaacaacacacacacacaaagaaaugcuuuaagaaaacaacuguugggccaaagagaccgcucagugguuaagagcacugacuguucuuccaaagguccugaguucaaaucccagcaaccacaugguggcucacaaccaccuguaaugagaucuggugcucucuucuggugcgucugaagacagcuacaguguacuuagauauaauaauaaauaaaucuuugggccggagugaagguuguaauaaauaucuacuuaaaaagacaaugaaacaacugucaacuuggcccagauuggucuggaacucacucaguagaccaagcuggccuuaaacuuacagagcucuaccugccugugccuuccaaggccuuagguuaagggacuaugcuaccauaccaggcauaaucauauucugaaaaauacuggugaaaggaaagauuaaaaauaaacaagagggcuggcgagguggcucagcgguuaagagcacugacugcucuuccagagguccugaguucaauucccagcaaccacaugguggcucacaaccauccguaaugagaucugaugcccucuucugguguaucugaagauagcaacaguguucccacguauaugaaauaaauaaaucuuaaaacaaaacaaaacaaaaaaaccccaagaaauccaaaguaaaagaaaaagacucauaaccauaaauuagaagacaguacucacucacucuaaccauugcaccaagaagcaacaaauacaauauuguaagauaauaggacuuccccaaaucaucuaaaaacacaacauaauuuuaucagaauaccagcuuuuuuuuuuucucaaagaaaaugacaauacuaaaaccaaacagcacacaauaacagaaucaauacugaaaacuauguugggcacaucacacauucugaauuuaucaugaggcuacaguacaaauuccagcacauaggcagagacacaagaauaauuucaauucaagacuaguccaaguuauagagugcgcacucucaacaacaacaaauaagucccuugucccucccuccucaaaaaagaaccagaaaucuugcaggccaagcaaguuucaggccagccugaccuacacugcgagaucaugccucauaacacaacagcugagaacguugcucagugguuaaaugcuugcuuauauguacaagguuguagguuuguuucaauuccagcaacuucaaaaaaaacaacaacaacaaaacaacaacaacaaaaaacccagagauguaagcaagcaaacaaacauuugugaggggcuggagagauggcucaggaguuaagggcaaacacugcuuuuucagaggaccugauccuacuauucauaucagguaguuuacaacuaccuguagcccucuuuuggcuuccaggaacaccugcauucacauguacacacacacacacacacacacacacacacacacacacacacacacacacuuuaaauauuugaaaacaacauuaacaaauccuuuugugaaguaaaagauacaucaagaaggugaaaaaaaaaaaaaaagccaggcauagugguguaugccuuuaaaucuaguacuugguaacaugaggcagguggguuugggcagacuugucuacauggcaaauucaggaauagccagagcuauauaaugagacccucucuggaaaaaaaugaaguggaaaacuccacagaguaggaaaaauacuugcaaaucugagaccugugucucaaaucuaaaagaauuauaagaugggagauauagcuuaguagagugcuagcuuagcauggacaagguccuaaguucagcccucagcaauguaaauugaggguugaaguuaagacccucaguuuaaaaauauuaaaaagcaauaugaaaaacuuuaauaauuuuagaagacaacacaauuuuuuaaauacuccaggaaucugaauagacuuucccccaagaauagcacuuuuuacucaguaggacagcuagacuaagcguucgauaguuaaacauagcuaaagggcugggguagagcuaggcuggcgugcuugcagagcacgcagaaggccgugacucugucucuaacauaaacugggcaggaagagcagggguucaggugcacagagaagucaucaggcuggagaaauggcucagccauugaaggcuaggcucauagccauauauaguauauguaguguguguauguuuguauacuugacugugaaugugcacauaugcauaagagcuaagauuuugguaucuguccucaucauuccccaccuauuauuuugacccaggaucucucacugaaacugaagcucaucaauuuagcuagaauggcucaucaaagagguuuaggaaucuaccugucucugugucccugagacccgagaugguuauagguguaagaaacaaagacuggcuguuuccacaguguuaugcaaugugacuagcugucucaaacucuuacuaccaugguucuucaccaugauggacuguaccuuugaauuguaaccuaaaauaaaauguaccuucuuuaaguugcuuaagcggucagguauauugucauggcaauggggaaaguaucuaguuaauuaccuagauaguuccuaaauucagugacaaguguccuuauaaaagcuacacagaagaaucuauagaaaagaaagcuuugcaaaugcccagaaagcauggccucaaggcaaguaagccaaggaaugucuacagagagugaucugaacccaugucugcauccuuguacaccaggcaacuuaucaacugaguugccuuugccuucccagucucccucccuucccuccauuuuuuucucucugacacugucaauauaguggcacuauauuauuugaaccugcacucuuucccaagucuccucagcacuaggggucucacuauguaguccucaauagccuugaacuuacagagacccaccagucucugccucccaagugcugagauaaaaggugugcaccagcugggcagugguggcgcacgccuuuaauucccagcacuugggaggcagaggcaggcagauuucugaguucgaggccugaauaccuccaaugacagaagcaagccuuaugucuaauucccuucucucuuccagccauaccaggucuguuuguuggccucugauuucugaaacuaauauagcuguugauucuuaaaaguccagcucaaucucacgacuaucaaacaggcugcauauguaucccuggccuuccuuccugccccugccguccucacagccccacguggacaagcagaggcucaaauuccaggcaagcagccccgggcccagcucacccugcgguuucgguugugauccaucgucuugagaugcuuuuggaugauuccaaacugcauggggaugaaaaggucacaggcugcacagugggccgccucuaccuucuucacaaaaugcuccauagcaaucucuguugggggcagaagaaagcagucaucacagucucaggugccaaaggcaucaggccaguuccugaacuuucccugacacuucuacacgagccugagacuggugaacagcggaacaucaagccacuacaccgagaagcagaaaagagcaggcuaggggccuacccgguggcagccauccuggugggauggaaccuccucaccuugggucagaucuuggucucuguagauuuguuggaucagaccaucaagguccuccacaguuuuucggagcuccuccgucuucuuggucuuguuggugacauauuccuaucaaagacacagauguuugugucagcugccuggccguccggagcuuagagaaagcagcagcaaugugccacucaguagcuuaccugcaggaagucagcaguuugcuuuggaagcuuggugccuacauauuugaaguguuccuuguggaacuugcugucaagguggcuacccaucucauccucauagaagguccgguauuugcagagagaacacacaaacuggauccugccacaggagggaaacgaggcugaggccgcaaggcucccaggaaaggucacugcuaccccaacccacgugcaggccuugaaacaggccucgcucugaagugcagucccggcugaaggguaggcuggggcugguaggguugggagcagaaggggauagauagucuguaggcugcaguuacagcaacguagggguuaggggaagaacucuuccuucccacaggcaggaggcugagaccugaagcagcuacuacugcaacaggcaaagagucgcuggaagguugucggaaggccucucuaccaaggcuaggcaggagcuugugcauuuggcccagcuggggaccggaaggaaggaugcccuggcgagagccaggagggccugaggugcagaguggaguacgcagucccgaggcagugccugaaaaggugcugcaucuuccuucucaggucugggggacucaauggcccagcccauccucugcucagaaugccugggggguggugucaggagggaugggagguggcaggccugggcaccugcugccucaucuuccucuuccaagaagagaccagucugagcuggaaggagggcgcccgccuggccugccagagggcagccuggaaucacugggcgaggugcucucugucuaggccucguguccacagcagaagccuggggucuagggccugggcuggaacaggccgccguggcaaggggcggaggaggccagccgccaccgaggccucggggcgggucccuaccucugccgggacguccuuaucugggccacggggucagcuuugucugaagagcccaggggccgggcgccggcgaggcugaguggaagguccagcaagagcaagagucugaggcggaggaggcaagcgccagugcgggagcccugagggcagacagacccgaccaaggggcgugaagggcucagccacagacaggcccggccugagagagccggugggcagggccaacagcagacccagaggcugccauagcccacaggugcugucaucucuccugggcacgguggcggccucuuggcagcuagcugggguggcacaggcgccuuggaccuugagucucugaugagcuggcccccucccucaggggcaucgggcccccugcgcaccucagggcucgugugcugagugaccuagugcuggaacuucuggguaguggugcugagcaguggcaggucucaggccacagauggcagcggucgccagguggccacagaggggcaggggaugagucaggacuugggagcugggccuggcgggaagcaggguccaugcacagcagagcaggugguggcucccaagggaggucagagggcggcgagauggcagagcuaugacccugcucuccuggugguagccccagagcagggcagaugcagaggcagagggauggagggaagacaguuaccuuuccaccauacggucucgcugccgcuuuuucuguuugucuuggcucuucuugcuugccugcaacuugcgcuuggccuggcugcucucauccugggcggucagggccccugugguaacagaaaagcagaguuaccaacaggacucuaacagaauagacccuguggccuguggcugagucacccgcuguccacuccagaggguccaucugagagcagcuguacacauagacccucaggccaugagcagggcugggugcccugggcugagcaggaaguagauuuggcuuaggcaccgggagagggggaacacgugcugaccccucucuuuucuggaacaccaacacucucugcagagugggugcagagaagcuggaaggcaaagacaggcugucuuggugggaacacaagcguguuccgagggacugggugguggauauagggaggccguucacauggcccugcccacccccccaccgggcaccgcggcaacagugggcugaggcuggauuuacuguuagguaccugcuggcgcucaucacucagguggggggacacggacucccaacaagggcuggagaggcgcuaagggagaggacacgcaaaccagagccguaaaaacugcaccaagggucccagcucggacaccagccacugaggacuuggaacugucuauuacugaggaacugagggggggggugccugggcuccccacacuuuugcuugcugcccccaccugaaggcaaaaccaaagugcuagacuggaggccacaccauccauaaccucugccuaggaaaaacggaggcaggcugggagggcacagaguaagaagaggccuugcuaacauauauccagucccauaaggaaggucccagccagccaucuuuccgcuacaacccugcccucagcugguuuccucccacuacaagcaccuggaagagcuuucccaguaccuagguaaccauggaagacuuaccuuucuccgaaucuucuuugccuucucucccauccucuuuucccuccucgucuucuccuuccuaauauacaauuuuuagaauucaauuuuaaaaagggcacagcuacuuauaccugcucuaaaggauuaagggagcgucagaccuucccacucacuaccugcugcacagaggccugcaucgccccauuucucccaaggaaacacacuguuagugaaguggucuguacuuuucccuagauacccagccuccuugugcuggccacucacuagccaugcauacagguaagaccacauugccugugacccuuguagcaaggcugugugucuuuaagccagcucuggaguccuaugccccaccugcagagagcaagagccugaggucuaggguuacuuacugcucgggagccuuucuccauagccucagcacuuucaguacccucugcagcuucccccucagugccuucaucugcaaggagaggacagucaaguucaauccaggggccccacggggacagggagcaggacaccacauuccccaacuuaccauugucugagucacuguugucugagcagucuguucugguagcuuugcugucuggcucaucaggacugccacccugcuuucucuucuucuuuuuggucuggaagugaaaggaggagugaacucagagauuguagccauauuccagcauggaucaggagggguaggucagcuuauucacccggaagucggcugugguccaggucuuccagguacgccucaucugcuucaugccauugccaaauccaaagccaaaucgggagccaccagagaaggcacccccaccacgcaugcccuggaacaugccauacucggguaugauguucugggagaagagggagggcagccgggaggcaccaggcaugcacuggccccgggcccccaugggaucuucccacaugcgcccauagcccgaggccauuggccguccacuccgggcaucccgggcccagcccugagcccuuggaccaaauguaucuccuccacgcauucgaaacuggucacgguaggcaucauauuggcccucauaggccauuuccaucucagggucaagcucgccauagucauagcuugaccgguagaggucucguucacucaggauggcccuugagucacaggccucauaggagucauaucuguggagacacauggcaaaccucagacagagcccuuuggagucucuugacuccagcuugccuagccuacugcuccugcccuaugcucugucacuccuagucucacaaaaaaccucaacacaauaccuaggaaggaggccagaccaccuggcuaagacagagacauguuuaggcuuauuuccccccauaauucacaaguacagggcucucucuguacccccuucuccaagccucacuggaaagcaacaacagaugcacaagcaauagcacccgcuguucguucaccccaagcauugcuuccaaagcuccaugcuagagcaaacugcccugaagcagugugagccaagucucucucucucuuucucucucuuucuuucuuuuccuuccuuccuuccuuccuuccuuccuuccuuccuuccuuccuuccuuccuuccuuccuucucucgcucucucucuuucucucucucucucucucucucucucucucuuuggguuuuuucaagacaggguuucucuguguagcccuggcuguccuggaacucacuuuguagaccaggcuggccucaaacucagaaauucaccugccucugccucccaagugcugggauuaaaggugugcgccaccacgcccggccaagucucuugcucuuccccagaaucccugggcuuuaccuggucuucccuccucacugccuguucuccaucaccuaucaguggaagcuauccagcuacuuuuaagguaugcuagcaauugucugccgaugauagcacucaugggcgauuuucugcaguaggacagaccugagggugaggcucagcccaaccagcccuaucauucaggcaaagggugcucugcuuuccuuuaguagccuaucuaagcuaggacaaggguccccagaaguauacauuuacaaggcaccagcaaggggccauuaaguacucuugugcuuuuuuuuuaaaggcacauuaguguauugauugcauguauguuuaugugaaguugucagaucuugcaguuacaagacaguugugagccaccaugugggugcugggauuugaacccugguccucuggaagagcuaucagugcuuuuaacugcuaagccaucucucuagccccaaguacucuuaucuaccuaaccacuuugauggagaugaccuggcuaccagugguuagucccagaggauuaucccacacuauucacuaaaugcaguuugcccugccuuggcacugcaggauccucccuugucaggaaggggggagacauuagacacuacuccugagaagccauucuguggauacagucaagacagcacuccaggggucugcucuucccuugcacacaggaugaguuggccaucaggggcuagcaagggggacgacagguuuuaacaaagggaagcacagugaccuaauuaggagcucagcauugggaagcacagagcaaggagagggaaguagauaccaagaaacauucaggaaagagucuggcacacaggacccuaaggcccucggcagcaccccaacucaccucucuccaccaccugagccguacacaccuccuuguaucaugucugucuccaagugcggcaucauaucuaagcgcugguuaauucuggauaaaacggaaucggcacuggcgcuacccgaggcacuaggguuugcauuugugucagagcuagccauuucccaagagugugaaguggccauaccauacccauaguuggugguguuauccuggccauagccauagccauaaccauaguucucguagccugcaguuagggagacagagggacagaaauagaggggguggggaaaagggaggaaguagcagacagagacaaacacagaaaaaaaaaaagguguuucggucaaaaauaagcugggggaacucuuagccccucgaggcuggguaggcccuucucacucuaaggaggauauccugugccagccccagaaacacccaucuaaguccugcuuggccacacaggcaacuaggaaacauuacugguacaguccugagaagaggaauauggcuagauacuugccucuauuugucccagaguuccaaguuccauauccuacaaaaagcaaagagggcuauuauuauuucuacaguaacuucuaguacagcaugaacuuaagcuuacuacaguugaauucaaaaguacaguuuuucucaguaccugacucaacuuuccaagguacuauacacuggacucuacacaagcaccuggccacccucuccccaacuguuacucagcuuucugagacucuggguucauagauuuaaagccuccuauuucuaacacgucuaucuaguaagcuugguuccuacacuucuucacuacagagauuggacuuaaaaguuggcuuucccucuccuggcuaggagauuguaggcuacagugucugccuagcauauguaaggccuuauauagaaacauaccaaaacacagcuauuauguuuuagcaaaacuuuaucucugagauagaguuuuauccuguaguacaaaauaacaacugacugaaggaaaugaagaauacacacacugcuacauaagcagugcauccucacacucaaaucaucacucugcuguggaacucuguccucucuauggccacugcugucuuagaucaggugucacuacccucaugauccugacaagacugagucuaccugaauucccuuaugaaaugggggaccagcacacaagacuccuuccuacccaaggacauaugaaucgugaaugguuuaaggugugauuugaacaugaucuuucuucugagauuagauacucagaagauguaugugcuccuagaaacaguccuucccccgugcuccuguaaguaagcccaauucaacuagagcggauuggauuuuauguuuuggugccauaccuaggguauagauuagacauuuguucauagugcuccaggaaaagucaugcaacauacucuuucacccaacgggaacagagaaacagaugguccagaaaccaugccuuaacagagagggcuacaaaguccuugaugcaucaucuaggaguacgaugcauuagggaagggcaaucagcaaccccccagaaucaagcauggugauguacaucugcaauucuggaacuucagagguggaggcagaaggaccuguacaaucaagacaaguauuggcuacauaguaagucccagaccacccugggauacagagugagaccuuacuuuaaaaacccgaggggucagaggcaggcagaacucugugaguucaaggccauuaugguucauacagaaguuucaggcuagaagacuguuacagauuuuugagacugucucaaaaaacagagcaaacaacaaaacacuuuuuuggaaaaaaaaaaaaggucuuugaaagaaccaccuggaucauaaacuaaauauacucuagguuugaugauauguaguaaaaauugauuccuucaggagaguaaaguccaaagugcaaaaagcacaugagaaucaagagucaaugggaguccccagagggacaggcagggcaccuccuagugugaccccagucacuuccuaguccaugguaucucugcucuauugacagccaaaccacacuuaucuuugggcaggaaaccaaccacagugagaagacagcagaaugaaugacagagaaacagggaaacuaaauaaaccgaauggguaccaucugcauuugacuguauaaaacaaaccagggagaugauggaaaccaccuaagaaauucuagaagacugcuacauuuaauaaacugugacaugagaguucacaaagcaaacacccucucaggaugggaaaaacuaaaccaugugucuaugcaacaagucucuuagauaaaaugaucccagcaugcugggaugcugcuugauguuucaagaagaugugacagagaaagauauuauaaaggaacaaugauauagcagccauuuccacaggccagaaagaaagucaacagagucacaagaagagucagaagcuguucagaagguugguugcuagcaucacaaacaguggacacacacaggacugggaagcaagcacaaacgcgcuaggacucugcuuguggggcaggcucuaagugucguucaggcuuuuugguaucaaggagcuaccagaagcaaguaaggaagaacaaguucccuuggugggagugagccaguggacaacuuuauaguucaaggguaggcaaauggccuccgaugaccagaccggauaaccgccaucuauuaagcauaggccuguaaucccauuuacuugaaagaucacagguucaaugccuuccugggcuacaggagucccuuuggacaagcauucacuauaugcuacuugcuauaccuggaaugacugagacucucucauggacucucaggagauaggaaugggggcugucccuucagcagaaagcuacaccuaagaauguguguccaugagaccugccucaucagaagaggcaccucuacuggcuguccacagaggaaaugaguucaugguuggcaaaggaaaauuuacuuuguuuuucucccccuccccucuuguagcucuggcuacccugcugacuucaaagcucacaaagaacuuccugccucuccuugagugcugauuaaaggccugugcugcuauaccuggcuaacagugaacauuuugaaagaaauaaaaguugaguaugggccuuuacuccuguaauaccagcacugaggaaggaaaguccagaggacuggcgacaguucuaggccauccaaggauacauagcaagaagcugccuuaaaaagagaaggagaugaccacaguaaggaacauccacagaccaagugaacauguucuaauaguucaauauuagaauucagaauuacaaucagggauggagagaugguucagcaauuaagagcacuaugguggccuuugacuaucuauaauggaccuucaagcaugcagguauacaugcagauagaacacucauauauuaaaucaaucaaucuaucuaucuaucuaucuaucuaucuaucuaucuaucuaucuaucuaucuaucuaucuuuuugggcuggagagauagugguuaagagcacugaaugcuuuucuagagguccugaguucaauucccagccaccacaugguggcucacaaccaucuguaaugggauccgaugcccucuucuggugugucugaagacagcuaaagaguacucauauaaauaaaaaauaagucaaucuuuacaaaaagaaagaaagaaaagaaggaagagagagagagagagagagagagagagaaagagagagaaagagagagaaagaaggaaagaaaggagagaaagaaugaauuauaaucuacaugcugggugagauaccagguugugaugguaaauguugguugucaccuggaugugacaucuggaaucaacuaaaacgucucgacugagucaccugaggucagaacccauccuaagucugagccccauuucgugcugucaucccacgugaaaggucacagaagacagaagcuuuugcuuucugccugcuuguccucgcucgugcuggcaagcucaucuauuuuauggcugaggcaccccuucucuggucugagaaccuucuugaugauugcaaugcagacugaagacagccugaagcaguucucuagucccuucaggacucagcaucagaucaggacagcugagacacccagucuguggacauuaccagauucuuggccuaucugucaggagacaggcacuauuggacuaccuggaccacaguguagaaaucacuagaauauguuuuuaauauauucacacacagacaaggagagacgcucaugcgugcacacacaugugcuuauauacugagucaguuucaguuaguccugcuccuuuagagaacccuaauacagaauuuacgauauaacgccaauggagaaucaauguccucuccuggcuucugagaguaaaagguacguacaaaaugcacagacaaaauguucauauaaaugaaauuuuuaaaaugaaaaaaaaaaauuaaacaucaauguacggcuaaauaugguguuacaaagugcuuuuaauuuuaccaggcagaagcaggcaaaucugugaguuuaaggccaaccucaucuacauagcaaguuccaagccagauaggguuacauagucagaccuugucucaaaacaaaacaagaaucucuucaggauuuauuuugauaaaaaaugaugcacugauuuuaagauuguauguucaaaaacaagcaaauuauaaucaaggcaauuuuuuguuuuaagaaaggguuucuuuguguugccuuggcuguccuggaacucacaguauagaucucaaacucaacuauuucuaccuccugaguucugggauuaaaagcagugugccaucacugccuagcugcaagacaauuuuaaaaaagagacagagagagaaaaaaaaagccagguauggugguacaaagcuuuaauuucagcccuuaggaggcaaaggcagguggaucucugugaguugaggccagccugaucuaauagugaguuucaggacaaccagagcuauauagugggacucuaucucaagaacaaaacaaaaagcuggccacugguggugcaugccuuuaaucccaacacucuggaggcagaggcagguggaucucugaguucaaggccagccuaguuuacaaagggaguuccaggauagccagggcuacaaagagaaacucugucuugaaaaaaaccccaaaacaaaacaaaacauuaaaaauaaaacagaugcaugguggcacauaccuuuaaucuuagcacucaggaggcagagggaggcagaucuuuaugaguuccaccacagccaaggcuacauggugagauaccuccagagagagacagacagacagagacagagagagacagagagagggagacagagagggagggacagagagagagagggacagagagagggagacaaagggagggacagagagagagagagagaaaaaaagagagggggagggagggacagagagagacagagagaauaaagaauaaauccaggggcugaagugauagcucagcuguuaagaauauuuauugcucuugcauaugaccuucucagcacucgcaugacaacuaauaaccaucuguccauuucuacaggauccgaugucgucuucuuuccaugggcacugcacacacauggugcauagagacacauggugcauagagacacguguaggcaaaauacccauacacauaaaauaaacacagauaaauuugaaaaagaaaacugcucaaaaguuaaaauaaucgagagaugguggugguaugugccuuuaauucuagcacuugggagucacaggcagauggaucucugugaguucaaggucagccugcucuacagagugaguuccaagacagcuaagacuacacagagaaacccugucuggaaaaacaaaaacaaaauguuaaaagaucaaauccaggugacucauguuaacagacuucaaaaccuauaauauccaauaauuaacauagaauaguaccggagaaaauucagacaaauagcuacugaaagagaacaaagacuucagauaacugauuuucaauagcuacaauggcaauuaaacagccuaacucuugaguuucauucuggaagccacauaaaggaauaggagagccuauuccuauaaguugucuccucugacauccacaugcugcagugacauauauacauacauacauacauacauacacacacacggaaaaaaggugagacggagggaaggaaacagaccagugaguugucucuguaggacccaagugguggacagagaggacaggcaaggaauacugcgaucagccuucuuagacuggguagcacugaaaacagacuggcggcaccuguagaucucucaucagguguggacuccuguuucuucacaauugauuuuaucaacuggaaauuuccuucaguguguguucauuggccugagauaaccuagcuacaaucucugaaaauccagcuggauaguguggcccuccaggcucuucugcugcagacuacuugccaagaccaugggagugcugaauucauaguguggucucaccuggcucaaucuuuucucguuacauucaguagaagauagcucugaauguacucaauacaaagaucaucaacuuucuuaauacacuauugucaauuguauugcucucuagaggaaacuuugaagacaacagugucaucuguuccaaugccgaaagguugaacauggcugguggacuucaacuucuuucccagaugcucaggggagauuuacugagucuauaucuuuggucaagaaccauauuauuuccacaaacugugaaaaggucaaaggccucaacauuuuauagcccagcuugcucaguaacucaagcucucauuuacagauugccucaaagaagcacaagcuggccaaacaggccacagugccacauaucagguuggguugaauuaggcaagacagggugacaggaaagcuaaaagcaaccaagcagaaacaaggcagaacacucugguugucacuaggagccacacucaccauaaucacaggugggcugggcacuggugucacaguacguagacugcaaagugguuucggauccuuggacaaaaccuaaacauaugcacaaggugguuaauuuucccaaagcagccauaagaaagugagcaacugaaauagcauuuuaauacagauuagcagacaagucucccuucaguucagaaaccucuaaaaccuauagauuccauacuuuaauuagaccucugaacacauuaaucaguacagacaggucaugcuuaacuuguuacaaugacuaugaaaaaacguguaaacauuuaagcuacuagucuauuuuggugcauaaaaugaauccaaaauaucauucaguuacauaaggaaucaaaucauuauuauaaauaaagcuacuucugaccaggcagugguggugcaccuugggaggaagaggcagauggauuucucugaguucaaggcuaaccuggucuacagagugaguucuaggacagccagggcuacacagagaaacccugucucgaaaauuucuuuuaaagagagagagagggaggggccggggagaaaagcuacuuccauuucaaacaaacauuggguuaguuuugaaauuauguuaauacuaaucuuugcaccuccuugccuggcuguuucuguauuuugauagagugucucacuugagaccaaggcuggugucaaauucacaguaucucuccuguuucaguguccuggguauuauaaacauaagccaccugacuuacaauuuuaguuuccccauaugaagaaguauguacugauggguaagaauuccaucuucaaguuuuauccuuagaccucauugcugaaacauauuaccuauguuucacauguuuauauggaaauaaguauacuaaauauagugugagcaucucuacccuaaaaucugguuuuuaguuuucuuguuuguuuuuugagacaggacuucucuugaguagccuggaugcccuggacguccuucugccacccgagugccuggauuaaagguguguagcaccacaccuggcucuaaccuaaaaucuuuuuuuguuuuucaagauaagaguuucucugugcagcccuggcuguccugcaacuugcuauguagaccaggcuggcuucaaacucagagauccaccugcauuccgagugauggaauugaaagcaugaaccuaaauucucucuuucucuuuuuaaauaaaagauaugugccuaaauucucucuuuaugaaauuauuuauauuuaucuggugcuuuccuugcauguauuucuguaugacgguguauaucccuuggaacaggaguuacagaccauugugaacugccauguggauacuuggaauugaaccuggguccucuggaagaacagccagugcucuuaacugcugagccaucuucccagccccuaaccuaaaaauuuaaagccuuacuuaaaaagcaaaacuuuuuguuucguauaguuuaucuguauagcccuggcuguccuggaacucacucugcagaccaggcuggccucgaaaucagucccccugcuucugcugggauuauaggacagccacacuuggcaccgaagucuaaaucuuucuaauuaccaacuugaggcuacaaaggaauauuccacacuggaccugacuuuccuuaugugacagguugcaauccaaaugcaaguaaacaaaaucacauaauuuauuuuauauaaauuacuaucaggcaacugggcacgaugguacacacauguaaucccagcacucaggaggcagagguuaggggaucuuuuugugaguucaaagccagccagggcuacauaguaagauccuguuucaaaacaaaaccaaccagccagacagugguacugcacgccuuuaaucccagcacuugggaugcagaggcaggcggauuucugaguucgaggccagccuggucuacagagugaguuccaggacagccagggcgacacagagaaacccugucucaaaaaacaaaaaaacaaaaaaacaaaacccaaaccaaaaccagucaaaauaaaaaccuucaggcuauguauacagaugcauaugaaauguaaaugauuuacuguuuagucuugggucugacccaagacaucacuagggguaguccaaaauccaaaaaauaucucaaaguccuuuuggucugaagcauuuagauaagggacacucauugcucaguggucacuaugaagccagacacaguacaccuuuaauccuauucucugggaaggcagaagcaggaggauugugaguuuuaggaaggccuugucuaacauauguaucuuguacaucuuuucacuuagugcugaaaugauuaaaacacuaagcccuugacucaaaaaucaaugacagcauuuccaauaaaaauaaguuacaaccgaagcauaucaaacaccaaucauguggguacagauucccauacugcugcugcucagugaagguuacagccuacaugccagcacucacgaggcugaggcacaaguucugccauggguucaaggugcugaaacagggugagacaccccugaaacacacacacacacaaaaccacagcaaccauagucaauauugcacacugaauaaaugcuucccugcugggugcuuuagcugcaggucucaguucauccucauuaagacccuguucccuguccaaaauucuuugaaaagucaguacuuuuuaaguccaaaaaaaaaaaaaaaaaaaaaacaaaacaaaacaaaacacuacaaaucgaggacucucagaacugggaaggaggcuggauaccuccaggcuuccaaccauagcaguucauaagcagaguaagugcccucugcaaacgugaacaauuuuacaccgaggccacagggacccgggagaaugaauaccguuuauguauguggugcaaaaucaauacgguuucugcuuugagguccuugaguugaguuaaucucaaggccuuggcaagcuaggccaacacuacaucacuaagcugucccuaguguauucaguuacaggguaccaccuugaccccaggugaagagaccauacuucuucaggguagaauugcaaauacauccagcuacaaggacuccaaaaaagaaagcuguggacucaacuucagcuuuacuuuccaaggagaggaacugagcccaggucuuggggaaagagaaaacacaaauauagagaccgagucuuugccauccuuccuaaagagauuguguccaauuagauuuuucccaccccuggggguccagggccuucucaagaugcuuaaauuuuaaguacuaaugauuuaauagcugucuauaaaaaccacugggguggggagugcaacuggagagaugguucaguggucaagaguacugcucuuccagugggccaggaccccaaucccagaagccauggggguggcucauaaucaucuuuacccuuaguuuuauagaguuacaggcgcucacauggcagugcacagacacacacauucaggaaaaacacucauaugaacaaaauuaaauaaacaaauuuauuaaaaaaaaaaaacacugaaggguuggaaauaugcugcucaauugugaggacgagagucagauccuagaacccaugucaggcggcucacucacaacccuccguuaacuccaguuucaagggacccauguucucuucuggucccaaggggcaccuucauacauggcugacacacucacacaaacacauacauguagaugcagacagauacauguaaauaaaguaaaguauguugugguggaagccauacuaugcgcuucaggcugcagaguugcagcccuacccuuuauccacuagaugucaguagcacugcauaccagucccccaccuccacccccccccugcccauacacacauuauauagauaagacaaaacaggacuccagauauugccaaauguaccccugggaggugugaggcaggcaaaaucacccugguugagaaccacuggccuagaggaugguuguuaaaaaucccaagguucuuggcaagcauuugacccaggggcuuaggaggacuggcauaaagcucagguuccauugaaagccuuaaacauuccaaacagaauguggguuauccagcaaccacuuaaguucaagccugaaauaccuccaguaaagugggaggcacugucuguggcacugacugauaaguuucauuggcaaacccagggagccuuggcaacuaacucacucaagaaugauucuacagucacucaagcauauuccacaccccucaccaugcuccucacccaccuuccucuuugcucaaauaucacugaucuaaguagguaggcgguuccagcccaguauguuuuacagcgacagcuaucuuuacucuuuccuauuuugcuuacaucucuucuuaaacgucacccuucccagaggcuucaaagcucuccguguaauggcugaaucucuucaggauacccaagacccaaaauaauauauuuauuguauuuugucuguccucgccuauaagaugcuuaagaaauucuugucagcauucagugucuauucagcaccugauucgguaaguugaguggaaaguagucauucgucaccaggguucaagcuugcucucuaaagcucccugcaacgguucagagccuucauauagauuuacagauucucaccgcccccugggggagugagguaggggagguuggcucucccccccucccgcuuuauaccagaugaaguggggggagugccaugaguaagggucugcgacguuuugcacagaaacugcucaagggaggcaauggcgacagcagccgccccaacggacugaucucagaagcucaggccugagaagcgacgucuuagacguggguguccguggggcacuagccagggaaugacgaacggaggugcgggaagccugaaccuaacguugaggcccaagaccuacggucacagaagacacaagcaaauccuugaguagccaggagaguccaagaugcccggcugaggucagugagagccgaagcuugagggaugcgaccccgaagggaagagccuaagacgccauuuugugaccacagagggcaaugaccacgacacuacaagaggagauccuagcaugacucagcccguccugacgccccggcccagagcgcugccuucacccuguugggccuaccuguguagcucauggccgcagagaacacccgagccguggacacagaccgcuacucugcgcgucugacgccacaacaaucccugggguccuuccacacacgcuccagccccgccuccuuaucu

SEQ ID NO: 8523 - RNA, 1139 nt, Mus musculus
cacuucuaggggcccgcccucaccacagcacaaacgaagaccucagaugggaaagcacuuuauuaggcuggacuuccagccucggccacgggagcccugccggguaaggguuauggacccccaccgcccuccucgucgucuuccaugucgaggcccgggaucccgcggaucugacacugcagcgcuccgcccagcaaggguacagggcucuccuccucuucuggugguggcggagguggcgguguuguagucccuggggcgggcuccaggggcacggggggcugugccggcacgcccucugugagcucugucgcuucgcuuggugccccuucauccagagcgccagccuccaccucgucuuguuccuuuuccuccucuggguugucagugaaaggauucucgcccuguagagauggauagagacuuuaaugggagguaggaaucacugggauagaauggggaccaggcucacacaaaggucaggacuaggacagugcuuucgccuuugccucaccuucagauaucgcuccagcuucuugcuaaugagcuuguuguugagaauacugcgggccaccauaagcgaggacuucuuggacugcuccaucauaagcuaugggcagggcagacagggcuggugaggcugcucuaggaauccaacaaacccagcugagguucagauucaccaauaacuaguccuagugucuguaagugaccuugggcguaauuccagucagucuggacaggcaugcaaggaacuaggauucgaucugaucacccacaccuuauuugcuguuugaaaccugaucugcuuacauagaaacuauaguaaguacuggacuuaguggcacaggccauguaacuccaggacauuaaaguggaaggccuaccuggacuacagaguuuaacgguuuacaugguuugacuaugucucagaaaauaaaagacggcugggagcuagagagauggcucagcguaaaggacuuguuaguauuucaaagacucagguucauuuucugccaccuacaagguggcugacaacaaucucuaaucuaguucccaggaauaugaagcccucuucugguuaccacaggcaccaggcaugugaauagugagcauaugugcaggcaaaacauacaaga

SEQ ID NO: 8524 - RNA, 1139 nt, Mus musculus
ucuuguauguuuugccugcacauaugcucacuauucacaugccuggugccugugguaaccagaagagggcuucauauuccugggaacuagauuagagauuguugucagccaccuuguagguggcagaaaaugaaccugagucuuugaaauacuaacaaguccuuuacgcugagccaucucucuagcucccagccgucuuuuauuuucugagacauagucaaaccauguaaaccguuaaacucuguaguccagguaggccuuccacuuuaauguccuggaguuacauggccugugccacuaaguccaguacuuacuauaguuucuauguaagcagaucagguuucaaacagcaaauaaggugugggugaucagaucgaauccuaguuccuugcaugccuguccagacugacuggaauuacgcccaaggucacuuacagacacuaggacuaguuauuggugaaucugaaccucagcuggguuuguuggauuccuagagcagccucaccagcccugucugcccugcccauagcuuaugauggagcaguccaagaaguccucgcuuaugguggcccgcaguauucucaacaacaagcucauuagcaagaagcuggagcgauaucugaaggugaggcaaaggcgaaagcacuguccuaguccugaccuuugugugagccugguccccauucuaucccagugauuccuaccucccauuaaagucucuauccaucucuacagggcgagaauccuuucacugacaacccagaggaggaaaaggaacaagacgagguggaggcuggcgcucuggaugaaggggcaccaagcgaagcgacagagcucacagagggcgugccggcacagccccccgugccccuggagcccgccccagggacuacaacaccgccaccuccgccaccaccagaagaggaggagagcccuguacccuugcugggcggagcgcugcagugucagauccgcgggaucccgggccucgacauggaagacgacgaggagggcgguggggguccauaacccuuacccggcagggcucccguggccgaggcuggaaguccagccuaauaaagugcuuucccaucugaggucuucguuugugcuguggugagggcgggccccuagaagug

SEQ ID NO: 8525 - RNA, 15779 nt, Mus musculus
gugcaccagacauuagacaacacaaagagggcagagaacugcuguagagcuagagagaauaaagcagggcaucccccaaauucucucugucucugggagaguucaaaauccacuuuccucccgccugauguaguuuccaacugcggccauccaccuguuccauugauuuacacccuuuuauuucucucgccuacaaagcagcuucugaaagcugcggcugacugccugcugcuuuccuagauccugauaucacugcugaaccuaagcgaauccagcaagcaugucagcacgcuguuccagcuuggacaguacagcacccuuagcaacgggccccaguacaaauauccuaucugcagagcucaaugccagcaguguuuccuccaaugucuucugcaauucccagguccugcguugguacacuaaauuguugcaagccagccagcggcucacauguccagguucgagccugggaggcaaccgggagcugaaagaaaagagggaaccuaggcaaguugagaaauaauggaaccaagacaugcuagucuguucaagguucaaauguuuaauggagaaugcgcuuauaaaaaggaggggaagcccauucccaccaauucaauuuggagccuggagccagcugcaggcauagucuccugaauagcucuggggccucucagcaccguagcaguaucuugaagaggaacagggaaaauggcugaacacuagaguaaucuagggaggaaggcuacacccuagguaaucuccuuagugucagcaaagucaaggucuggcucagccugcuucagacuugugggagguuacaugccaguaaaccuuguaacucuccugcucaaacaucuauggugccucccuaucgcuaaaagaauaaaggccguucuugagcuggggugcaugcaacucuucaucagucugcaggcccugugggcuacccagaaaggcccuuggacucagaaagcagccccagacuuuucucagccaggcuuccagacagucucuguuauccugcagcgcccucugauggcucugggugaaacuccgcuuauucugggauuggcaaaggaaagugacugagacaguaguagaccuggucacugagcgcccuugcucagaggcuccacccgcagccacaacccgcccuccgcccgcaggauuaucucuggcuuccggcgcggcuccuugucaucaggcaggaugcggaagcgcagcagagucagcgccagugccaccuucaucucgcucauggcgaaagucuguccuaugcaguuccugcagaggggcaggauggggacucugugcagugccuagacaggagcuccuggacccaaccugauccaguccuggccgcaccuggucagcccuucaacuuccaacccuggguucugcagacuuuugugcauacucugagcagagggugguaaggagaacuagaacccaaccaucccagcuccacccuauucccacugucagccccagaaucuacccaucaccacaagccaucuggucucaccugggcccggcagaaaagggaauaaaagccagaggggaccucuucuguggguuuucugggucaaagcggaaggggucauagaccugaggggaggggcaagaugaggcuucuaguuugcuucuuugcccauacccagccagccccccaaaaaguagacaugaagacaggggugacagcuucuuguuuccagguuggggcuacauccccuucccaugucccucccagcaaugccuggaggagcccccaccucagggucuggccagacugauggauugugaugaauaccaaagaugcugaugacacagauguucccuguuggguaggaggauccagucaguacuagccagguccaagcugccccuagggaccgucacccuacucagaugcuucccaucugcuccucccuucgcccuugacuuucaggacaccuuuagggaugacccggccaucagguagcacaaugucccgggugcagcggcggaggaggucuaugacuggggaauguagccgcagacucuccuugaugcacauggucaggaaggguagcugggccaggucgucccuaaggaacacagcgcacaauuauucaggagcaaaacaaagucuaagcucagccucaucagccucugguuggauuaaccacucgccucucaugcuuagucauggaacaaauuauauucuagaugaaucaaggaugcuugccaguucuuuuguguguuugugucuacuacuaagaauaaccuugaauuccuguauuuaucauucuacuucccaaguuuugaagccacaggggucaacuaagaucuagggccuuggaucuaagauuaacacuacucucccccgaaaucucaaaaacaugggaagggggaagcuuaaccugaaauauuucuacuuaaagccuacagcuccaaaaauauccuaaacuugauaauuuuucugugcacaagcuuaaaaauguuuaugcaaugagcuggauguagugguacucaggaaaauggaggguggaaauuccacauuaaauagccaagcuaggcuacaggagacauuucaucaaaacucaaucauguaacgaagguuuucuuuuaaaguaagaaauaaaaauccuuaaagaccuauacaguuauuuaaaugaauauauguacucaguagcagaguggcaggcaaugaggaauggcccaucauuacaggggugucaguucuauccuguucuguccuguaauguguuguuuguuuguuuguuuguuuguuuguuuguuuguuuguuuugacacaagguuucucaguggagucauagaugucauagaauuuacucuauugaugaggcuagccuugaacucugaaaucugccugcuucugccuccagagugcuguaauuaaaggcgugcaccuacaccaccuggcuaguccuuucuauaguaacaauuuucaauacuaucaaauaaacuuuuagcugaguuuucuuaucgauuuaaaaugcauuuuuuauauuuccauacaugcauguaauguauacuaauuauacucaaccuauauuacuuaucucucauuccucuccuacaccagcugaaaccccuuuguccuccuauaccaucucccuucccuucuacugugaugucuuaacuuuucuguuucugacgugaugaaguuaaauaauguugccugaauaagcaugagugguaugugugugugugugugugugugugugugugugugugugugugugugaugaguggcaugugugaguguguguguguguggccaugaaaggcagccuguguuuugguugagcgaagcuuacuucagagauccaauggaaaacucuacaagguacagaacagagagucacauucccagacauagacgccugacacccuggagcccccaacuccauaauauuguggcuaucagucacacaaugucccaagcuccuggcauucuggcuagacuccacccucacaguuaccugacaauagccagguauguuccucccaacaguuuccuugcaacagcaagauagcccagcccacuauaaaggggcugcuuggccccuccucucucucucuuaaacacuuaccucucauucucaucucucgcucuccuaauccuccucccuugcucucucucuccacauggccauggccagccucucuuuuucuaccuucucucuuucucucugccuuucuaccauaaagcucuagaaccauggacaaucucugcucaucaagacccacagugcuugaaugauggaauaggccuuccccuaaggagcugcaucuaaugucccaccagaaggccuuucagcauuuccagccuccaggcugggccagaccaaagacucucacgcaugugggaaccacccagcaccucuucccccgacccccuacucccuucagcucuggugcuggcugaacugcccccggggcccucacuuuguucucagcugguacugagaacuuguugucacuggccucugugagguccagagaccccccggacuacuagccccgaggacuaggguuccauggcuucccacagccagacacacaccuggguggcagagcucauggcagucccucacgucugcucacccagaacaccugagcucuggcaggaugcaggcucucuccuacccccuuuauuucccugugcccaaugcccaacgugugugugugugugugugucugugugucugugugucugugucuguguguccauguguguacaaucugugcuugacaaugcuuuuccaggucugauuuucacagggccuugcauaauaagcaaauguccccauucaacaacuuuauucuauuuagaagaaugaauauccaacaaaguugaagcuaaaguccaggcaguggaaagugauuuucaaaauaaaagauggaaccaauuuaccacucacuaaaaccuauuacaaaacuauaguaauaaaaaugaaaacauuuucuuaaauacuaaaugucucaugaagccugcagaaaacagacaugagaagacauuuagagaagacaauccacacaaugcuaggaaacagacaggaagaugguaacaauacuagcaauuagcaacaaaaauaauuaaaugcagccagcaaaagaaucccaggacuggagaaguggaugcaggaggauugaggucaaagucaucucagcuaaagaguaaaagcuggagggugucauggcccaaacaagcagcugucucaaaaacuagacacagaaaacaaauguuugcacaucuucaaacccagcacuugggaagcagaggcaggcaaaucucuaugaguuugagaccaaccugaucugcacauuguguccaggucagucaggguuaccuaauuuaacccgaucuaaaaacaaaacaaaacaaaaaauucuuggccacuccaaauauaagguagauuuucucaauauaucagaaacacugaaacuauaaguuaaugaaauuaucuauucauuucuucauugugagacugucaaaauauuuucuuuccccuugguacuuuguuuuaagauagauauauuuacuuauuuacuuacuuauuuauuuuuuuguuuguuuguuuguuuaauguauaugaagaugcuguugcugacacaccagaagaaggcagaucucacuacagaggguugugagccaccaugugguuucucagaauugauaucaggaccucuggaagagcagcccugguaucuugaaauguacaaaauguugcuaaaaaguagaaaagacuauaaggugggauuacaaaggauuaaaaaagaugugucuauaaacuauaaaaaagaaaaucaagcaaaagccagaaggaaauucacaagauggaaggaggagaaucaagaaucaaauucgguuugaaaacuccauaacaaaaccuaacuagcuaugugagacauaauuaucuaaaggaagauuuccaaacuggguauauaaucccuaaaagcaugggguuaagacucuguaauccagccugagcuacacagacacacccuguaagaaaugcagcaacgaauguggugaccagaagcuccaagagcagagacuaucaugcucaccauucaaucuccucaggcucucggucccucagcagcuccugaaccuccugccggcagcgcuccugguauucggggugccucgccagguuguacaggauccaggagagugcacuggcuguggugucauggccugaaggguagagagacaagcaggguugugucccuggccuguuucagcaaaauggggcacuuguauccagacagaaugacuacaaaaaggaaugaauggaaagaaagaagggagggagucuaggucucuccaaaauacuuacuugagacuggcacaccucuaccuccucuguagcccuacacagggacucucaccuccaaacauaaaggugucagccucugcccggauguccucaucugacagcuccuuuccauguucauccugaagacaaaacaagacccucgauucacaccguguaugugcagaccacccacauguuugaaugcuugaccacagagaagagguguggccuugcuggaggaacugugucacuguguaggugggcuuugagguaucacuuuuuuuuaauuagauauuuucuuuauuuacacuucaaauguuauccccuuuucuaguuuccccuccaaaaauccccuauccucuccucaacccucccacuucugcuuccugucccaggcauuacccuauacuggggcacagagccuucacaggaccgagggcaucuccucccaaugaggaacgacuaggccauucucagcuacauaugcaguuagagccaugagucucucuguguguuuucuuuaauuggugguuuacucccagggaguucuaggguuacugguuaguucauauugaaguuccucuuauggggcugcaaaccccuucugcuccuuggguacuuucucuagcuccuuaauuggggacccugugcugucuaauggauguuugugagcauccacuucuuuauuagucagacauuggcagagccucucaggagacagcuauaucacucuccugucagcaagcucuuguugacaucugcaauagugucucgguuuguugguuguuuaugggauggauccccagguggggaaguuucuggauugucaugccuucagucuuugaggucucuuuaugcucagucucuacgauacagaagacagacucuuccuggcugccuucagaagacuuacaacucucagcuccugcuccagcacuaugucugccuccacacugccaugcuucccuccauggugauaauggacugaaacucugaaacuguaagccugccccaauuaaguguuguccuuuauaaggguuaccuuggucauguugucccuucacagcaaugaaacccuaagacaggugauaggacacagagucugagaccuguugugcauacaaggugccuccucugucuucuccacagccugauuccauuucucccuugguuuccugcccacuguuugcucuuuuagcagagccuucaaagagucacauauaaaaugaaucccuguguggugucuaguuuucauaaacacagucuguaacuccccaagacuuccuggucaaguccagcuucugucuaagacugaccaugaauguuccuguaacccagaucccacaugagcacaccuuggccaacaagagaacaucaaugaaauccagagucuuagacuuagucuuggacuucaagaacucaucaugguuuuggcuggagagagugugccgucucucccuaaugacagcaucugugaaguugugcaccaggucacaggccuugcggaagcgccgcccaucagcagugugguaauacaggaagucaacgaacaagaagagcugaagugaccuuuuuauuaugagggaacugaguuccaagauggcagaaauguauucacugggagaccugcaguacaagacagagagaggaggcaaguuaacacacaggaaaacuccagccagaguuccaggauuaggaucuacccagcaaaggugucuaugacacacaaauucuguuucuugcuccucacaaguagccuucugagccagguccuaggguacaaauggacuucauuucauccccucauucacucagcaccuguuuccgcucgucccgcaauuuccugugacucugcccaggaucagacccuccucuccaggcuccuuaccuccuguaacucuaugaagcuccucuauugacucgauugcccaagcucacugugacuaggaaccccuaccccuuauacagacaucuucucuuaugcucugggauacacaggauggaguacacauccuucuggcuugguauucaacaucuuuaagaucuggccacuugcuggaaaugguggcuccugacugugaucccaaaaucaggagguggaugcaggaagaucagaagcucaaggccaaucuaaucuacauagugaguuccaggccagacuaacuacagacugagacccugucaagaaggaaaaaaggaaguugauggaagggcagaagaagagaaaaacuacaugggcugucuuaagguucugcuucaaggcugagacagggacucacuccugacaguugcugucaaagccaaagaggcauuucugcagacuguccaaggucaugaggcugaugugcucaaacauuuccagacgugcacugccuuccgaggauaggugcuuccacuuggccugaacagagaagggacagagauggggaugaccguugauccuugagcuccuucucaaugcuaaacaccacaaaaggcccugauacuaaggaaaucccaacucuggugggagcagaagaugcuaugaucgcagaugaagacauuaguuaggagacgaagccgaguuuaauccuaucucugugugcccuugguaagcuugcugccugcuagguuggugaagucuuccagcacaauugaauugacaugacuaaauuaacuguaaaauacacuucagugcucucucuaccuuucaugcucucuucuagacugaccuuucaauuuaaucauccauaauaugacagucauauucaucucugcaacacagcaauauggaaacuacaucaaccaauguagaugauggaacuggcauaauauuuuguauguauaaggugcucaauaguguuugugaugguuaucauuguauuuggcucuagaaauggcuucaguuucuuguaaguccuccauucucagucuuuacagugaguccauguaaaguuucugcuuuuccccuuuugaaaccaggauuuauccauacuugacaaccagagugaacucagcucuauacaagaccuuagguuugguuugauuuucaaacaaguuuugaccauauucacccauuccccaacaaacuucuuagaucauguugauguagcuuggacuggccuaugauuuagucuuucuucuugagucuccccaggcagguaguaaggagugggucaccaugaccagcuuuagagcaaugaaguuuaaacaagaaucacacagagaaagagcuucuucuguagugaacaucaacuguugguugacguuucagggcuucugagaagaagaguagacacuaucugcuaugaacucaucuacauacuagagcaugacuccaggguaccauccugaucaccuuuggguagauuauuauucucacuuuaaagauggggaaacugaaacaugagaagaaaacugaugucccugaguccuagaacagaaccgcaccuuuagccugcaucuuucugaagauaugaccuuuucuacaaaauuguauaugggacccugguuugaggaacuuacgugcaugauguucacacucugguuaaaaaucuucacauagggcuucaggauaucaaaguggaaggcaggugucagcagucgacgauggcggcuccacuugucaccugaacucaggaagagcccauccccugggagggcaguaaugucaguggacaaagguggaaaauuccucugacccuaggaguccucugagacucacuucaagguacucacccagccagggcuucaggaagcguaaaaaugucauguccuuuggggccaccaaagcugucauggaggaagcaaaucaggugccaugaagaagacagauuaacuaugggaguguagagaacucccagccccaaggcuuuccacuucccugucaaguucaggauggcaggaaguggacagggacaaaggaaccagaaaaaaggaauuaggugaggcaggaccagaccaggcugcagcaucagggggagaaaaggucgccuggcagggcacaacaugccucaguacacuuagacaagacugcuacaugguccgccauguuuuccacaucugagaauaguagaaacagucuacaggccuuugcaaagacuuaggacacaccauccauguggcucucugacauguccuggcauguccucguauacaagaaggggcacguguuucaugaccuaucauaaagaauacacacaguauucccugacaugccacaacacaguguuuaacagucugaugucaccuguuugugcucuucagauaaucccagauuggcauuucaaugugguuccuuucgaguuucaaauaugaccuacauaugccagagauaccucuaucucucuccgcuauaccauauuaagcauuaaguguucagaauuaaggguuucucuauucuaagagccaugugcccaccaugaagaguugcuucugcccucuccagccaucaggcaucuccagagcccaccgaacaugguucacccuucuggacucuggugcaucuuucccuucaguucuuugcauuccagcucugucccaaauuuucuccaucuuggguccuuucuauccaagggggcuguggcaccugagauuuacugaacuggggaggugggcaagaguucgcccuauguuacaugccucccacaacaucaacuguucacccaugagauacacaucuugcaagaaugcuguugaaugucauugaggacaaauaguaaaaaauaaaaagcacuauuuuguucuauucuacauaggacuauucagacccauuuguuuggauagaaucuguauguacauacugucaauaucagaggaugcacacauugcuaacaguuugcuagugugaguuaacuauucccaaucaggggaguaccaaaaagaauguaauacccacaccacagagccuuaucaaacucagcaucuuuagucuuaaccuaacagcaaaguugguuguuaaugaggcauaaaugaaggacaugauaaggaaagaaaucuugaaucucagaggcaagacugacuaugugaccaaacggcuggaagugagcucugguaaaucuauccacuauugcuggcugcagaagagauacaagguaauuuuucaggugguggacucacuuucucucuucucagaucauuucugaauaaagcauaacuuagagauuccaucucuguggauggagagaugggucaguagaagauaguucuugcagaagaccuagguuuauuucaaaacacccacauggcaacucacaaccaccuguaacucugguuccaaaggaucugccacucucuuauggccacuggggguccugcauacaugggguacccauucauccauacaggcaaacauucauaaauuaaagauaaauguuggacaugguagaacaugccuuuaauaucaacacucaggaggcagacaaaggugggucucugugaguucuagaucagccuugucuauaaaguggacuccacgucaccuagagcuacaaaauaucucaaaauaauaaauaauggccucaaaaauaaauaucuuuaaauguuuguaugcuguugcuacuggugggaagguagagauaggagaaucccuggggcuuacuggccagacagaccagauggaugggugagcuccagagaagagagaggucugguaucaaaaaagauaagaguuccaaggauagcaacucauguugucuacuauccuccacauguaugcacacacacaugaauauggaccaacacacaugcaaccacagccauaagcauacacauguacguuucaucuaagacauagguuauuauucccaguucucaaauggaaccugguacuuuguucaugguaggcaaguguucuaccacaaaguagaucccauccaauacauuucuucccugccuuagaucagacuggguuaaguuucuaucacucacagcucagauuguagcagcaagagagacucaggaccuuauccaaagucacucaacagguuagccacagagacauggccacugucagauucagccccaucugcugcucagccuggucaauccggggauagagugagcugagauaagggacagagaagaagccaaugguugggauccuagaauggauaccuggggccuggagcaggggggcaacaaaugcagggucaacaauccucagcacagggaucacuggucccagccaaaagagauggacaucuuggaaagucuggcccauuucgguaaccagcugcaugccuuccucauugcucuggaucuggagauggagaagguugaggccaguacaugcauggugucauaggugcuccuguuuucugcccaacaugcucauccugcuuggaugacucauuccaaucucuugaugagucacugaaucccuuccuggacacaugagucuauccacaucccucucugacacauccuucugcucaucccuuuguuuugugauguagauauaaauaagugaaggaucaauguauggacggaaggauggauggauggauggacagacagauagauuuacacccagagucugaaguaggugacuuacuacuugauagagggauugauugggaagaggaggaugguagacagauggaugauaggcuacugagggauauauagaauauauagagacagauacaugauagacaacaaagguagauuacauugaaagaugugauagguaacuaacagcagaagaaggugauuagagugguagaucucagugugguguguguguguguguguguguguguguguguguguguguguguguguggugugugugugugugugugugugugugugugugugugugugucugugugucugugugucugugugugugugugguguguguguguguguguguauuucuuuaucauuauucugauucuucuccauuucaucugaucgcucccucuccccuuucuccugaauguaucuuuuucucuaugagauuuuuuucuacagcuaaaucaucuaucucaccucuucccccuuuccuuccucacuccuccauccuccccucccguuagguguaaauuagaguuaauuucaucccauccaauucucucacuugucccuaauucaccacagccuaucaagaccaguuuucugcaggaauuuccaaagaauugcagcaaacaaucacaaaguucuccaaauauugaucccaaguuccagagaagugugaacuuggaagucaucuaaggaggaaacugaugaaugacuuaggaguugugucccuaggguaaggagaaagcuucaaaaaagacaacagagggaaaaugggagaaggugacagaggagucauguggaaaggucagagggaaggggaucuagcaguggacagagaaggaccucagggagcaaagaggagaccaagaaggauuuaauucuggagccaaauaggagcuaccaggaaagguggaaaaaccaucagagagcugugaggaaaugaaggagacagagccaggacucggggacauggcaaucaaggguaagagaaaugagaaacaagcagggaagggaacaaacaaugacaaugauccugugucuauaaucagauggcagaaaccugauggaguuggcacaagcacauaaucccuugggaaacagaugcaggucucugugaguuuuagguaggucauccugguguacagaacaaguuccaagagagccaaagcuacacagaaaagcaaaguacaaguagaauaugaaaaauaaaaacaagaagaaaaacaaaaagaagaacaagaaggacaaaaacaaguagaagaaguacaaguagaagaagaaguagaagaaguaggagaaggaagaagaggggaagaggagaaggagaaagagacgaacaaaaagaagaacaaggaaaauaagaacaagaacaggaagaacaagaaguagaggaaaaagaggaugaggaggagaaggaagaagaggaggaggcggaggagaaagaaagaggagaaggagaaggaggaggagaaggaggaggaggaggaggaggagaagagaagaagaagaagaagaagaagaagaagaagaagaagaagaagaagaagaagaagaagaagaagaagaagaagaagaaauaguaguaguaguaguaguggggaggaagaggaagaggaggagcaacagacaggagauuuagugcaccaagaccacauaggagguauaagaaugggaagaaacaugucaccugacucuacaguaucacugugcauaacaaaacacaacauaugggaguuugggggcaucaaaagcaacacuuuuccaaaugcuuaaaggaaaaaugaauugucaagaaccucacacuugaaaucuugauaggaauuugaacucauggggagaugaaagggaacuguaaggaagcugauagguuaguaugcauaaaggauggugaugcugagaagacauuggauaacaaugguuacaugagaauguugguaggaaagaggauucuguugagagaagcaguacuugaauguauggcauuggugaugauaucucuauuaugagugaucuaaucccaagaugugguucugcaacauggagcagcauggagcaaggggaccuggugaccagggaaggguacugaguaggaaguguagucauuaugaugagaccagagagaaaauggucaugcugugaugugccuuuggaauaaagucauugcuuagcaugcacaaacccuaagcacuucagauaaucacuaccaauguuaaaaaguguucauccuugaccuacauugcauaauggagcccacuaaugcaucuucaggacagagggcaaaaugaggaaggacaguggccaagaaguggaagggaaaaaaacuacaaucucucuucugcacccaaacaguagguggagguaagaaaucgcagcugaauccuacagggcaaauagcaacccagagagauacagucacugaucugaaaccaagagagaugagccaggcaggaggcaagaccuuggacauacugaaggaagaucucaaauccagcagugaaacagaauauaccagggaugccacuacucugugcuauucgccaugggauccacugacuaugacacauauccaggaacuugaggaauccucaguccugcugagaguauggcccacaguaggcuggugccagguaagagagaaaggcugaugagcacaacuuggaaagaaagauaaaugaaugugggguugugaugagaauaggggcccaaauaacuuucuuugcuucucccugcuacaggcuccagaccuuuccugaugccuagggaacacauacaccccgguacccccagccuaucugccgccauacucaccaugcccaagugaccugaaaaccaguuuuuuuuaggaggcugagggaaacaacugaggcgggagcaguucucauagaaugaguaaguccaggcaaggauucuggccaaaauccaggaagccacuccaagcagcagaagaugccaugacgaggucaccacagagcccagguccagcccagacacacuuagccgcagcauccugcugagcagacagacacaggaggagauucugagguuuggaagaggaaccuggaaaacuucagaauuuugagcaugggcagaaacuggagaguagagcagggaguagagcagggaaggggauggagauacaggaagagacagaaugagagagagagaaggaggcagggaacacacagacaagagcuguugaagucugggauggcucugccugaagcacaaacgguuauccaggaacccaggcucacuugugccaauugucuccauggagccaccccaacacugauaaacucauccugaucagagucaggacccugucuugccucagagcccaagucgguaccuuaucucaggagcugcugguccucuaagaccuucuccccaguccugugaaaagcauuuauccccugcuuccuaacuucaggaagcuguguggga

SEQ ID NO: 8526 - RNA, 442 nt, Mus musculus
aggccuccucuggcuuuuauucccuuuucugccgggcccaggugagaccagauggcuuguggugauggguggauucuggggcugacagugggaauaggguggagcugggaugguuggguucuaguucuccuuaccacccucugcucagagaaugugcaaaagucugcagaacccaggguuggaaguugaagggcugaccaggacugggucagguuggguccaggagcuccuuucuaggcagagcucagucagaguccccauccugucacuccgcaggaacugcauaggacagacuuucgcuaugaaugagaugaugguggcacuggcguugacucugcugcgcuuccgcauccugccggaugacaaggagccgcgccggaagccagagauaauccugcgggcggagggcggguuguggcugcggguggagccgcugagcaca

SEQ ID NO: 8527 - RNA, 22797 nt, Mus musculus
aagcggaggaugccacuucccguccagccauuuuaggcguuugugucuucuguggagagagacccgcagguuguuuuccccagugucuguguuccauccacuuacugcaagagcugccggagaacagcaggacacccggugauuggaaaugguacgugcggccaggcgucccggcugcggggagggcgccgcuagaagcggaggcggcaguggggacgcggccuuccagggcagcugagucugcaucucaucugcucugcugggccgcgcugcccgggucccucuggguggagcugggccaucaggcagagcugcgguccuguccuuugcuaagagcucagugcugcggccauggccucccuaggcauccgggcacccgcagcgacgcggcuccgcagccugggcgguggcggcagcgucgcggugagacacgggacccuggaauucguguguguguguguguguguguguguguguuggggggcagggaagccgcaggguguggugaccuuguguccugggcguguugucauaaacaggggggacaaguuuguguguuuccaaugccagaauuuaucgaauaauuaauaauucacaagucauguguauuucguuaauaauuaauccaguagucccgauuuugcuaaccagccauuggcaaucaacgcguuuuuauauaacaaucuaauugcuaacguuaacuggaagaucacacaugaacauuucacacaaaaacauacaaaaugugcagaucacagaaugacuaagagccaaagugguugaguuuagagucuguccugaaguaggaggcauugagcugaggcgggugcaaagaagaaucugaaaggggaccaaugaugauguccuagcaguguagacacagagaugucaaguauacgcgcaccgaacguugaaguaagucaauuugaaguuggcugaauguccugggcaggagaaaccgcacuggagauggaguccaaaggacugacucaguucuucccuguggguaagugugacaguugccugccauccuuugggcuuggggaugcuccuucguagugccaggugaggggauuauauguuguauacuuugugugguguuucuaauacaauuugguauauuuuuaguuguugauauugucaguuugucccuccuaguuuucuaggagauagugggccuuuuuuuuuuuuuuuuuuuuuugcuugcguaaacaaguuguacugcccuuccuuuuucgggggaggggcuuugaguaacuaguccagguuguuauuuaauaaaauggagucauucuaggcuugacguuguuggaaagcagauauucccuacgguaucacugaguggucugcccuggcuuccucacucuugucacucacagauucaaggggaagcugucuuuaaauuccaugaccugugccuguaagucagugaaucuuagcauuucuaccuucuucugcucuuccuaaacucacuggauaggcguagccauacacaugcgugcggcuggagucuggcucugucauaacggcugcugccuucagaucuuucuacacauugacuuuuguuuuuauauuuuauuuuuuaguuguuguguauaugugugguguguguguguguguguguguguguguguguuuccugcaugcuccagcuugcauguuuagaggucagagaaagaagaaugcagugacuaaucucuccuuuacauggguucccaggauugaacucaggacauuauacuucugcagccaaaugucuucaccugcugagucauuuuuccguucccuacacauuauuuuaaaaggcagagcccugauagagguaggccuuacuggaugugagcgcaaucuuggguuagaaaacccuaaauguuagguuauaaagugcccaaugguuacccugaacagggccuuccuaacucuuagggaagacaggaguacgcaaguauacacaguaguuaccagaaggcccuagagccuggagugguuuauuaagguggcauacacucucaguuuuuuccuuauauaagcuggcugcuuugucuaggccaucaccagcuccuggcauccaccuggaauauacauuauauauauacauuacacacauacacacauauauacauuauauauauauauauauauauauauacacacacauuuuauuuuauauggacucaguggggugguaccccacucaucuuguuacugugaguggcugcagagagaauagaauguuagaauccagcaaacgcuuaggaaguaacaugucuagcgccuucccccucacagauacugacaaccaccuuacuaagagauugucagaauugcuagcuaauagacuuccaggugccaggauuuuccacccagagaagucaguuuacauuaguggguacuaguggccacacccccuucuccccacccucuucacuccccugccuccugccagguaaccugagagccugcuccuagucuggcuccugcucugaaacuaauuccauccccaggaagcuguaagagcaccucuuccaggcagauccacauucauuccguucuuuagaacuaaggccacugcugccugccugccugcuucacagaaucucagucucagaacauuucagacaucuuacagaauaagggccgagauaaugaucaccugggaaacagaccaagacucuuucugugugcaucuuguguuuugucuuaauccuuucucguuucuauuauuacugggguguuuuguuuuguuguuuuuuaaaauugaaguaugugccagauccccaaagucagaucugguaugaucagacccuuccauuuguucucugaaaaagcuagguugauuuauagaacugcuguuccuuugcucucauuaccgugucucuaaucggcaguuugugauugcuggucaaucugucacgauugccagaaucaggauauuggguuuuacauuuuugaguuacuuaugaacuaggaaauauuuggacuaauucaacuggcuuaauuuaugugagcacuuauucaucuccucagccaauuuguugucauacaacaauaugaaaaugcaagcauguguagacacuauccucaucuagccauauacagcuuuaaauagaaaauguuauagcacuuauuucuaguuaucauuugucagucauaagcuaaacuguuaauuacuguuuuauuuguauuugugugugugugucugucugucuacuaaacaugucugaaugcccaagaaggccagaaggggugucagauuuuucuggagcugaaguaacaggugguugugagcugccugacucgggucuuugggaagagcgugaagaacucuugacaacucuuaagcuccuguguaucuuuucuuuuuucuuuuuguaucuuuucuaucauuaaauaauuucccccacaucuguacuuuuauaaauaugacuuuaaacauaaacaacacacaaacuuuaagaccuuuuuuuuaaaaagauuuauugauuauuauauguaaguacacuguagcugucuucagacacuccagaagagggcgucagaucucauugaggaugguugugagccaccauguguuugcugggauuugaacucacgaccuucggaagaacagucagugcucuuaaccacugagccaucucuccagcccuuuaaggccuuuuaaaauuguauauuuguuuuuucuuugaaaaugucucaccauacauucaguguauuuggauuaaauugauccuguaaucccacccucccagucuccucccagcccuacugcacuauaucugccucccaacuucauguacucuuucgugaacccaccaagucuaauuaguguuuccaguauguuuguggguguugggucauccacugaagcaucagcaaccuggcaggagcagcauuucuaaagaacacugauucucccuccucugacgucaucaguugccaauaaguccucuguugggaguugugcuuuguuaguguuucccauugauucugaaauuuugacugguuucaucuugugcuguuuuuaagcaagccaccacagcugcucugaguugguggaugcagcagcccuguugugugugcgcggaaaacaugacuuccuguagucuccccugaccucucacuccugcaguguuuucucuccuucuuucguaaugauucuagagccuuguggggaacaggaucucauuuagagcugagcucuccacagucaguaucucugcauuuugaucaauugugggucucuguauuaacuucacgaagagucaggcuucuuugauuaggguagaaaguuacacuaaucuauuuauugguguuacuguaaguauuuagaagaaguuuuagcagaauaauagcauuaaauucuccccuaaggccuaugaccuagccagcugucggcuuuugguccaguuaacagugcuagcuauggaauccaucuuguggagcaggcugugaauucagucagagagugguugguuguuaccauuacauuggugccacacuugggccagcaggugugucuugccaggcaagucauuauauuauagguuggaguguucaaagcuauguaagacuaugcccuagcaaccugcacagcaccuuugguauugugaaagcuagccgacagggaugaggauuccguguaaguaccaaugucuugucuugugacucaagugugagguguguucagcaauagggucuuaucaucaaguucugguggguagccaagagcaguggugguacccuguguuguaaaacuaaagucuugacaacacagagccuccccucaucucuaagcaggcaacaacauauggguuuuaaaauaaauuuucugguuuuauucuccuacacuggccgaggcaagaaacuuggggaaaacugcugguuuuguuuguaucacagaggagagaaaacaaauaugcaagugauugugagcuuaagcaauuauauguuagaauuuaucugaaagaaaaugcaagauaugcuauuuaauucuucacuaagacaugguccauucugagauuacauagagaguacauuuagcuaucugcuggagguuacggguuguuguggcugcaucuuccgaaaaggcaauuaaacuugaaccuauuagacacauuuugggucaaaccaguauaaaggcaauauaucaagcaauauaaaggaagugcaccaagagacauuuuaaaacuuagacauuagcgcaaagauuauuggaaaaagagauauuuagggaauaaaguauuaggguuuuuauucucugccauaaguuuaaugucauauguauggaugcuuuuuuggcuuguaugugcauguaccacauguguguaguauucacagaaaaggacauucaguccccuugaccuggaguuauggaguugucagccacugugggggugcugggaaucaaaccaggauccucucaaagagcagccagaguucuuaacugcugcgcaccccccuccuaauuuuuuuaaaacauuacucaaagaauauucuuuacagguuaaaaauacaaagaacuuucuuuuguaaacaaaacuauacacuggauuuauaagggagcuuguuuaaauugguaauaagagggcauuauuguuagacccuauuaggaugucuuagcuuugucaucggugucuggucuuuuccugacuccgugaacaggaauggcaaaccaguggccuagugucuuccucaugcuuucucuccugggucccaauaauuuccuguuuguuucauuuaccuuuuccuuuuuuuuaaauaaaaauaaaaaaaaaaauagaacaauacaguaaaauauucacaauuuaaaauccuuucucauuaaaagccuuuacauuuguacuacacuuuuuacuaaaaauauauccuuaggaccugugaguugacuugguugguaaugguauucgccaccaagcuugacuaagaccugauaguggaaggagaggaccaacuccuggaagcuguccuuucaaugccacaggugaaccaugggcuggaggccucucccagcccucuucaccauccguccccugccagacauuuuauauauguauauauauguauguauauauauguauauguaauuuaaagcagcaagaaaaaaaauucucauuuauaucuguuuugacauaugcuuaacauuuauauccauuuuuuuuucuuccuuacuggauucuauuuguugauuuuucuucaguaucauaagacauagggacaaaacaaacugacuuguuuuuaaauaaagaguuaaaaaucaauuuauaguggagcaaaucaagauuuucuuuuuauguaucauuaaacuaaggcuuugcugcugagcuuggacagacuuugucauuuggguuuuguuguuguuuuuuuuuuuuuuaauuuauuuauuuuccucuuugaguauauauguuauguuuugugacauguguggaacucagaaaauaacgucaguucucuucuucugccauauggacucuggagcucagauucaagcugccugauauguagacgacaccuuuacccacugauccacccauuuggcaggccuacucuaguuuugggguucuuguuuguuuuuuggggaagcaguuguuuuguguaugucccgaaagucuugcuucaggcuuauuuguaacauauauaacccagaguagucaugaaccuuaaauuuuccugccucaguuucccaaaugcugggauaauuuuuguccauuauuuuaguuaggcugacugacuuuuaagacuucauauuugauuauuggcuauggaguagaagaaaauauacugcauauucccaaauuugugccaguuuaucuuugccuuaggugguuuuugucucugauauggaaucuauucaacagucaacuguucuguuucaaaauugcugaguaaagccugauugucugcguguaguguguuugucuguguugauaccuuagugcugugacucuuagugcugugacuauuguagcauuagucuuuuguuuauguuaggcaagcuuuuauuuucuuaaauaagaaauaacugguugauauuuuuuucaacuacuauguuugguaaaauagauuuucuuauauucauugguuauuuuuuccucaacacuauaggaaaaauaacuagugacuaagaaaaucuauuuuaccaaacauagauucugauaaguuuagggagaaagaguuuguuguggcuuacauauuagcuuacagucuaccauaguagggaagucagggcaagaagcagaugaagugcaugcucauaucaucuacagacaggaagagaacacugucuucauuuuauacaguccauauccucuaccuagggaaugacccucccacagucacagugacugugccuacaccgguuaaugugaucaguaugaucucucagagacauucuccaaggcuaaccucagucuagaccccucauaagugcacgcggaccugugucucuuaggugacuacagagucugucaaguugauaauuaauauuaagcaucauuucaauuuuugucaacuugauguccagacucuuaaucaccacuuuuaagucauaacuuuccacucaucuccauagacuuguguccaucuuauaguguaauaugcauuuaucccaacaccagaaacaucccauugccauuaagcuuguuuaaacaauuggaaauuucaaagugucuuaacugugagcuccuguaaaaugaaaaacaaguugcauacuuccaauauauacauuuauuuauuuauauuuuaugugcauugauauuuugcuugcauguacgccuguuugaggguguaggauccccccgggaacuagaguuacagacugagugagcugccguguggguggugagaauugguccccuggaagaacagccagugcuuuuaacugcugagccaacucuccagccucacauacuuccgauauccaguggcccagagcagacacuccaauuguaaaauggaagaauuggggccuagccaauuaugauugagucaaggcaagauacaaacccagugaggcaaacacccaauccgacaucuuugugcccaaucucuaacucuaaugaaaccacccgacuccugaggguagguaaccccacagcuccagcucugccaccugcagcgcguauagucugucucuuggacuggcuccucucagugccuguagcuguucguggcagacaucucaaagucuuggcaucuccauagccuguggucuccaagaucacuuaggcuucaucuucagaacuccacacagugacuucugagggucaaucaaucuacaggaacucagacucucaaauggugccuggccccagcucuucuguauggccucccuuucuugcauccuucauuccuucaaaacuaucaccauugugauaacaguaccaagauuuacuaccaccucagauuggagccucuggcuuugcccucaggccacuuuucuuauuguucuacugugccccagcaaguuuuccuccagucacacugauauuuuaucaauuccagcuguucucagcauuguugguuuuaagcuuccacaaacauggcucauuaagcccugcuuuucuaacccaaauaccaauguuuuuccauguucuucccacaaacaaugccuaagguggccauguauauuacauaaacagccaguguaagguaccaguuuucugucuuaguuucuugccugguugcugugauaaaauacccugaugaaaauaacuggaaaagggauucaguccaaguuacacacuauuaggagucuggaucuacugccuugauuaucuacaacaggaaguagaaagaaaugaauaaauacuggugcuuagcucccuuccuucauguuauacaguucaagauccccugcucagggacugcuacuacccacacuugagagguuuguucccauaucaaguaaugugaucuagagcuagauaaucauucacgggugugcccgaggcuuguguccugggugacuuuuguuuuuguuuuuguuuuuuuuuagaauuauuuauuuauuuaaugaauauugaguccacuguagcugucuucagacacaccagaaggcgguaucagauccuauuacagaugguugugagccaccaugugguugcugggauuugaacucaggaccucuggaagagcagucagugcucuuaacagcugagccaccuuuccagcccuuuuuauuuuguuuuguuuuuaagauuuauuucggugugugugugugugugugugugugugugugugugugugugagagagagagagagagagagagagagagagagagagagauugagaaaagaagagaggagaggagaggagagggagaagaauaugcgcauggaugccagaagaggagaucagauccuuguggcacuugaggcacagguggcugugggucacgugaugugauuagaguuucuccugcugugguaaacaaccaaaaacaaccugggaaggaaaggauuuauuucagaguucagugccacaucacagucugucacugagggaaguuagaucaggaacuaacuaaguaggacagggaccuggaagcaggaauugauggcagaggccauggaggagugcugcuuacugucuugcuccccaaggcuugcacagccuguuuuguuagagcuuccaggaccaacugcucaggaguagcaccauccaaagugaucugggcccuuccauaucaaucaagaaaauguauggcacauuuguccacaggccaaucaguugggggcauuucccaucccuuuuuuuuccuuuuucuuuuuuucccaagacagggucacacuauauaauauagcuggccugaaacucucuauguagacaaggcuggccucacacuuacagagauccacucaccuuugccucccaagugcugggauuaagggugugugucgcuaugucuggcacuuagggcauuuuuucuguugaguuuuuuaguucuucgaaaaugacugacuggugucaaguugauguaaaacagcuaaaauauuggucuucccaagagcagcaaguguucuucauucgugagccaucucuacaguccgccuaagaagacaucuugagggagucuaggcuucagauuagggaugcagacuaucaugacaagaaaggcacugcaggaggagcuugagguagcugguuacguugggugucuucaucgggaacugaggauacgugcugguucucuaauggcucuguucucugaauauguaguguucuaacacguaucugaugagcacuuaaaacauuccaagaauucugagagaaaagugacauuauaaaaguagcaugugauugacaucaguuguugggaaagcuacuuccuucuuuacaguugaggugggggaggacuccaucugaagagcaguugcagaugccaggagaauuagaauuguuuucuucuacaucuguaagccuaugcaguguuaggacagcugguguugacuguguuuuggugcguucgauaaucagaauuagcuguaaaugcugcagugaacgaauguacaaggagagcuuaacacaauacauuggaacagagaugguccuauccugcuggugcuuuaccagauggcuccaaucugcugugagaacuauugugugaaagacucuuagugugugugaaagcuaaggguaugauggccaggacaugacugacacaaagagcauuguauccuauuaacuucuuaggaguuaagauuagaucuccaguucugugagacucacauuuccuuguggaaauguguaugggcucuuucaggagucaguggccuuugaggauguggcugugaacuucucccuggaggagugggcuauguugaauccaucccagaagaaccucuacaaagaugugaugcaggaaaccuugaggaaccuggcuucuauagguaaguaugccaucaucccuuuaaucggugaaagaaagcaugcuucuagaugaguuuaaauaugguaaagagguuugaaugacuacuugagauccaccuuauacugcaaauuuugcuauaaucuauuaauguauuuacuaugaugucauaauuuauaaugauucgacuuuaauuguauuuuagggagcaguuuggagcaccauaucauugaaaauauauaccgaaacuccuggaaaaaacuaagguaauacggaccucaagagacagccauacucuuuauaaaguaguaaaaaacacaggcauauccaguuucaaacucaacuacccucagggaauuuucuucaacacuagaaacauuaaacauccugaaaauguuauaaggauuccaauacuggaaauaacgugagcaucauugugcccaaagugauuuuugucauacuuaauauguaccaacuuuguuccauacaauauucuuaaauuuuaaauauugacuuagucacucacuuuauguauaaaauauaugugacacaaaaaucagggguccuuuuaggcuuggacuaaauaucaaaaucucauuguggcccuucgagugguuuagaaugucaugugagugugauuaugauuauccaccauuauuuauuuguuuuaguuuaguucugaggguuauagcaucacauggauucuguguucaguaaccuuccuuucccuuuuuuuuuuuauuuuuuuauuuugagauaguauucgccuaguuuagacuagucuggccucgaacucagaaccugccucugccucccaagcauuaagguuaaaggcaugcgcuaccaugccugacguccaguagccuuuguagcaaguuuucuucagaauucaacaugaagcaugcuacuguuucauggacuugaguuaccucuucccagauuauucuuuuuuuuuccccuccaagagucacuuuugguuugguuugguugcuuuauacgcagaagcacaucucuugucuaaggagaauuuguuuccaucuuagacuuaaacuucuuaaguuuuaagaaaaccuauaugccuccuuugguucuaaagaccuugcuaauuauagccagcaaaaauggccuugcacagcagccucugagacaaaacuugcugauagacguccuguuuuuuaagcaggccuccccaggugccaagauggcauugagaauugaaauagauauuuuaauguuauguaagacauguuugcuagaccuguguaggugauauaacagccacccgugaauacuacuguuuuugguauaguuguccucagaguugcugaguguguuaaaaaacuucugacagcauagagccaacauuucugcugguagguaaaauauuagugauguacauuugcuuucuucgcaguggucaagugguggagggacucuaugacuguaaagaugaccaucaaugugcagaaaucuucgacuucacuacacacaguauuguaaaccagaacuccuugccaggaguguauauaugugaaaacagcggaugugcaacgguagucauuggccauuuaucucuaaguguacuucuuaaaccugacccaaagcaugaaucgugcgaagaucaggaauaugggaaggaauuauacaauauggaauauggggcccccuccaguucucucacaucauuugagaacuaugaaaguacuuacacuguagagagaaucuauaaaacugagcguugugacgaagacuauagauauggccaaaauguugaaaagacuuucacugaagaaaagcccuuugaguguaagcagugugggaaguguuucaguuccuccagguauuuucgaaggcacgaacgacgucaucgggccaagaaaugcuauaucuguaagcagugugggaaagccuuugcuuuucccacuuaccuacaaacacacgaaagaauucacacgggggagaaaccguacgugugcuugcagugugggaaaaccuucgcucauucucguucccuuaaaacacauaaaagaacucacucgguuagggaccucuuugugugcaauuacugugggaaaaccuuacgucauuacagcucucuucaaauucauacaagaauucacacgggagagaaaccuuauguguguaaaccgugugguaaagccuucauuacuuaccgcuccuuucgaauacaugaaagaauucacacuggagaaacaccuuaugaauguaagcaguguggcaacaccuucaugcguuggauucaguugcgaaagcaugaaauaauucacaguggggugaagcccuaugcuuguaagcuguguggaaaaagcuucacuuguucuggguccuugagaacacaugaaaggauucacacuggggagagacccuaugugugugaccaguguggauauagcuuuacucgguuaaauucgcuuuuaaggcauaaaauaacccacaccggugagaagcccuacguguguaaucauugugggaagacuuucccucgaucugcgucucuucaaagacaugucaaaauucacaccgaggagaaacccuauguaugcaaacaguguggcguugccuucccuaguucugcugaccucuuagaacacgagcaaacccauauugacgagaaaccguacauaugugagcagugcggcaacgccuucgugcuguggagucaguuucagaagcauaaagcccuucacgccgucccaguguccuacguguguaagcagugugggaagagcuucacuuccucgaggucccugaaaacccacgagagaauccacacgggugagaagccuuacgagugcaagcagugugggaagaccuuccugugguccuacucccuacagagacaugaaaagacucacacggacgggaagguccacguguguaagcagugcggggaaacuuucccuuacgacagucaucuccaggugcaugagaaacugcacuuugacgaugagccuuuuaauuguaaguacugugggaagcccuucuucacucugaaccauuugcauagacaugaauuacuucacacuacccuggauuccaguguuuuuuagucaugggaggauuuuuuucccccgcuuugugguuuucauagaaauaagagaaaucauacuggaaaaagacuggauuugugcuagcaauguggaaaaccuuuugauuuguuucauugaaacaaacgugcgaugucacaaugaggagaaaccuuuuuuuaaaacgaaaaucaauguacaaaugguuuucugagcuuaaagcuccuuggaaugcaucaaagagaaacgggccugugacugcgagcaguguggucgagucaucugcaguccuggaucuuggaggagacaggagaaaacucaagcuguagagaaacuuuuauguguauaugugguguuguauuaaaaaaaagcccuuucugcuuccccauucccucugaauauguggaaggagucacuggagagaaacccuucauagcuaggcaaucuuggauagucuugaguuaucacauccucuuacagacaugaaagaaccuacuguagagaaaucuuaaaaacgggauuugugaacucuucauuaucagcuucauagaacuaacaagaauguacguggggagaauuccuauuaguggaaaccucuaugaacaccauuugguucaaugaacagacaaggaaagaacuugauccggagugcuaaucuucucaaaagagauguucaagguuucauuuggcacagaugguaacacauaucggaugaaaacuuuugcuguugaaaaacauuggaaaaucuagagcaaaguccuuugaaauuuuuuucauguuuaaucugauaaaugucaguauuaugaaggacuggacauauuuuauuuuauuauuuuuuuuuuguagcaugcuccaggaaaugcacacucuggugagaauguuaucaguacaguauuuuguauuuauugaaauguuucaggggcugauagggaugaguuagccuuuaagagcaucuucugcuccuuccaaaggacauugaguuggccuuuaagagcauuugcuuuuuagcaccacgucacagggcucacaacugcaugugacucuaguuacaggagacacacuuguacacauaaaaauaaagcuuaaauauuuuucuagucuuuuuuuuuccaaaaaaaaaaaaacuuuuguuguauaucauguuuacccagaacuguuaaucuuccagcuuccagcuuuugaauguuuaaaaugaaaugucucugcuuccacauucaccgucauuagcuccugcuugagaguccaucucuuggcuuguuuuuaaauuuuacucuacaaaagcaagcagugagcagagcauugagcaauguggaauggcggccuaauuacaugaacugcagaccagugagaccuacauaugaaaaaugcucacaggaauagaaagugcauuuuauuacauuugugacacuucuuaaagcaaucauguauuaguuuaauaggugauaucuuuuuguauuuaauaaguagaugcuucucauuguaaauuauguuagauucauugguaaauugauauuugaaguaugccaguccacauaaaugucuuuaaaugcauuuuaguauuuaugugugagcaugugaggguauguagacauaugcccauggaggcuagagugcuuuggagauaguauuacaggaauugugacauguuugaugugugucaugggaucaaaauccuagucuucaugauagaacaguaaguacucuuaacugcugagcccccucaaacccugcauaaguguauuguuuuucaaucauguuuaauggguaguuuaaaaaauggcuuugugaguauugggauaguccuauugguuuuauuuggcuaauuauaagcauuuuguguauaugcuuauuuuucacgaaaaauguguguguguguguguguguguguguguguguguguguguguguguguguacguacguagacgaguguguuuggagggcauuguuuauguguugcugguaugguuggugguguucacaaagugagcaaaguaauauauugggugucuugcucuaucuaucacuguuauucccccuaagacagagucucacugagccuggagcugggcagcaggagcauuucuugugucuguccccccagugcugaguauagagacacucuagaaguuggcucugguucuuccucccagcaucauguucccagaaauaagacucagacucaaaauauauuuacaaaugccuuagccauauugcuaagcucuuuucuggcuagaucauaacuaaagauaacccauuuauuuuaaccuccauucugccaugugggugcuuaccugugcugagguaccaagcaccugucuaguuacaucuuccugggcaaaucuccuaccucuggcucuauuccagaauccuuucugccuccuggaugucccuccuugcauuuccugccuaagucacggcccaugagcuuuuugauugaucgguacaauacagaagguaucuucucuauagauaacucagucauucccagcuucuuauuaauagggaaugaaacuugaguccuuaugacugcacagcaaguggcuccccacguagccaccuccucaggccuaaaccagucuuaaauugauuguuucuuuuauguugcucucucguguguucucacaauccugaguaucuguucuuuuugacuuugaaguauuuucaaaauauuuuuuagaauagcaaauguuaggguugauuuuguuuugguuuuccuauucagaagguaggaauaaguauauuguaaucaugggucagccugucuuuccaaguugacuuauuucuuuugagaauuucauacacauauacaagaaaagagaaucaugcauauccacuguuucuccuuccaagccuuccuauuucuccccaacacccccucuuaacuuugucuuuaaaaauaaccugcuagucuaguuagugucguucauacaugcaugagucuggggccaucuacuggaggaugggggaccuaccaguaguuacaucuucacuagucauucuccaccccccagcagcuauucacuaccuguagcuucucaguaagggagaugcugggaucugggcugacuuaaucuuacaauguaggccuugugcaugcagucacauuugcuaugaguucaugauuauaguaaccaugucaaaagaaaaaaaaaaaagaacccagcauuucacagcacuucucccucccucuggcuucuguauucuuguugcuuuuucuuugauugucccugagccuugcugaugguggagacuaauauagcugucucauuuagagguacccauucagucucuauagcccuuugaccaguugugcaucacuccauugacagcuguccacugggaaaagcagcuucucugaccaaaguggagagcagucaaggucuguuggugucaagagcugaauggauggcagguacucaguguuuagaguguuuuucuuugucuuuuuucagauggugucauguuacauggccuuggcuagccuggaacuuucuauguaggcaagacuguugucaacuugugcuuaaucuuuauuuuuaagucacgaacuauuaguguguguguguguguuuauguaaauauacuguguaaauuuugcuuuucauguauauuucauuuucauuguaauuucucuagcuauuacacuaagagauuuauugguguuacugccuuaguaaaaccacguguucaauacauuuacuaacucgguauacguggugagugaguggcucaucuauaaaaggauucuccacauuacuucuggcagagcugguguuuggauuuaggaggucucaaagggauuaguucuguaguucgguguccccuguguuggaugcacugagggguaacugaaguucugcucuuguaaccauaacaguugcuacccaggagacugagugcuggauuuaagggagugcgauucaugagguaugcugugugauuaguccaccagugaguuggagguacuuuccuauuucaugaaucaaaauguuucacaguuuuucaacuuaagaaugccuuguagucauucaggaacauuguucacugguuggaggcuuggaacauguccuugaguggcagaagaugugucuagcugugugaggugaacaacaguguucuggaucauuuuugcauuucuuaguuucuuuuuaaacacuaauauuuacuauaagaugauggaugcaguuguccgcauauauaggugugccuagaguuuccauaacguuacauuaugauaaguaaagugcgaggucaagaaaagcgcuuuacacucaaccuaguggucggcacaccuuagccuagucuacagcaacaguuuuggccgcacuuacguuuucuuuauguuggaaaaaggggcuuuuucuuuguacauaauuuuuuuauuucaauguuuuuuuaaauuauuagcucguauguuggcaaaguuauagguuuucaaaugacauuguaacccagguuuccauguacuuuaaccauaaccacuaacuguuuuuucugguuccguuucuucuucccagugggucuguucucccaaguagacucccuuaguucaucucucuaguuuguuuacauuuugauucuguucgauauagaagggacaccauuuggaacugaguugacaacuuacuaucaaucuccaguuccauccagauuccugccaauaacaauucuuggugaccaagaauagucuauguuucuuauauagcacauuaaaaauugaaaaauuuuaguuuaucuauugaugggcacuuaggcugagaugggcacuugggcugauccuauaauugagagcagucagcaguuguguaggaacaggagcacaaguguuucuaguauuaucugacuuagauuccuuuuguugcauacuaagcaguaguacagcaggaucauaagguaguaguauauuuugauuuuugaugaaacuucuguuuuccagagugaccgugcuaauacacauugccaggagcagccguacauucucaccaguuuguguuauaguuugguuucuugauagcuauucacacugggguaaaguuaauuguauugagaauuuucauguauuuauuggcuauucguacauuguuugagaauggauuguuucuacuuguguugauucaguuacuuguuuauuuguaauauaauuuuuguugccuuguacugguuuucucauuguguguuucguguaccuaaaauugcuuuuaagcuugcugugugugugugugugugugugugugugugugcguguguguguguguguguguguguguguguacuuuuugucuguauguuaaucucuugucagaugaaugagaguccaaagauauucccccacccccaacucuguggcgcgcucucucucucucucucucucucucucucucucucucucucuuaauaaagaauuguuuccuuuuucuuuauaaaagcucuuuaacuucuugcagugauuaacucccauuuauacuuugggggauuuuguuuguuuuuguuuuuaauauggguucuugcuuuguaggccugucuggacuggaauuugcugcauacaugaggguaacaucuaauuuacagcucucuuccuuccucugcuuucuggguguuaacauuauaguccugagccucuaauguccauucccaauuugucauacuuccuguaaacuauuagauugagaaugccauuguccacgccuauagcuucauguauucuguagauuucccucugaguuucaaguuuuguagaccuuauguuaagcucuuugguucacuuuguguugcuuuuauacagaauaauagagggauuuagggcuacucuuguacauacaaugcugauuuccuauugaggccacuucuuauccuuagcgugauuugggugccuuugcugaaaccagaaggaguggcuccaugguuguucugggacccuuccauugcuccgugugucgguuuuuaaguuauacuauuucacucugcuuuuagagcauaauuuaaauugguguaguaagaacucuagcuagcauuacucuuuuugcucaguguugcuuugaccauuuggaguguuuggguuuucuuacaguuacaggaguguguucucuauuucuggaaauaaugacauuggaacuuugaggggcaugugugaagucugaacagcuuagacuuuuucauauuacuaugguggugauuugugagcauaggaaugguuucccuuuucuagagcauucagucuucaguguuuuuagauugucacgaugaccucagcuugacuaaguuauucauagguauauuugacuuuuugucuggucgcuuguuucuugggcuuuuggaagacaauuuuaaaaauuauuuuaucaccauuuucauuauauaaauggcuacuugguuuuucuagacugacuuuauuguacuacuuuggugaaguaaugauuggauguaagagucuuggugcggcacuuugggucuuuuaagacuaugaacauaggagcagucaagagcacuggcucuuuuccuagaggacugaggcuugauucccagcaccuguguggcaccucacaccuguaacuccaguuccaaggaauccaacacccuccucugaucucugggcaucagacaugcgcauggugcacagauagacaggcagguaaaacacccuuaccagguaauaauaauaauuuuaauaagaugaucauauuaucuauaaauagagauuuggcuucauuuugcuuccauuuuucuuuccuccaugcucaggguugaaccaaggagcuuguaugugguaggcaagagguguaccacugaacugcagccgcacaauuggaucucuuuccuuucucuuuuuaaauguucuagcuaaggaugcaggagauguguacagcaguguagagaagguguguaacuucuucuuguguaacuccugauaguugaagagaugcuuuuaguuuuccuauuugguauaaucuuggcucuaguuuugcuguguguaacauuucuuacagugaggugucuuccucuuccuaauuucaggauauuuucaucagggaacauagagcuuugaaguccacuucuccauguauugaggugaucaguggauccuugaauaucuauauuuucuacaauuagugauugauaucuguggaaagaugcuuauaugcaaagaaugaaauucaccugauuauaguuugugguguuuuuaauauguuggcuugcuuugagaguauaauauugauuuuuuuuucuauuuucaucaaggaaauuguguuauaguuuucuuuguuguugagcccuuccugguuuuggcaucaugguaauacuacuaccuuuuaugaauaaauuaguauuucuucccuuuauauuuagugaaauaguuugggaagcuugguagaauucaacagugaauuugucaaguccugugcuuuccuuguggagacaauucauuucuagcuugaagauguuucccuuuuucacuguucacauucccuugacuuuucaucuguuuuguuguugagaauuuuaugcaugcacauaaugcauuuugaucaagcccacacacuccccauuccuucuaauuuuuccaucccucaccacuuuuguucucaauuucauuuguucucuuccauguuuaaccuacagucuccuuaaugcuuccaguauauacaugggugcagugccaucuucuuuggcaugacuagccucucccuuacccagcaggcaucaguugccaauagcuacucaggagugggccuuucugcacaccucccaccuccaugcugucauuuuugucucgcuuguauuuccagucacagcuguugucaguuaguaggugcaacuguccuguuguaucuagcacacacuguuuggcuguaauaauucacucuggcucucacauucuuucggcucccucaucuguaaugaucccugguccucugagagaagaaaugugauguguguagaugcuccauuuagaacugagcccuccagaaucacuuauuuucuacauguugaccaguugugaaucuauucauuauaaucuacugcaaaaacaguaauaaaacccaucuucugugaugaagauacauuuuucuauggguauaaagauacccuuuaacagaauaauaguagguuaguagaaaguucuccacauuaaugcugccagacuuggguuuuaucuuguggguugugugaaauaggccugaaauccagucacagugguugguuauucuugccguacucauggcugugucuugucagacugaucuguaauuguagcucagaggcuucucagcuggguaaacacagcaucaucuagcacuaugaaagcuagccaguaggcugaacucucuaggucaguauaagcuaugauuucuuaauacucugugacucaauguguggugucuucaguaauaaggucuuacugucaaguucugugugguaaccaaggacaaucgcaauagccuauaauauuuggagggggaggucuaugaaaccuccaacuuuuggccuaauuuugauauuucauauaugucuugaaauucuccuugauuucuuaguuuauuguaauauaaguuuucaaaguguccucaaaucauucucuggauuucauuuucuguguauuguaaucucucuuuucagcucuaacuuuauucauaugaauaaauguauaaaagaaagcauaagauaauaaacaaugaaguacuuaauuaaaguuuguaacuauuaugacugccugaaaguuguauauggagcagcuacaggguugaaguuuuuugaguggucaccccuucucaguguacuuuuuggugaugcaacugacuuugagucacccuuauuccuguaaguaaucccuuauugauacuccuguaaguaaaucucaauaaaaucaugguucuccaaauugg

SEQ ID NO: 8528 - RNA, 1200 nt, Mus musculus
ucaguaaauauuaaauauuuuuuauaaaugugaagaagagagaacugggugggagucugaagaguugggggcuggaacgcuggcuucgugguuuagagugcauauuguuuuuguaaaguacccaaauucuguaccaggacccacguucugcaguuuauaaguccaucuccgcggauucagugcccucuucuggccuccaugggcaucuguucuugcgugacaugcacacagacacacaaacauauuuuuaaaaaaauaauaaauucuuaaacaaaaucuguaaaugccaucuagucaucuugcuggcugcgccucaagucuuuuuagcuuuccuauuuucgcuccugucuucuaaaauaucacuuaaaauaccugucugcagguucccugacauuguuccaagcuugcaccuucuucaccuucuucacagcaggaaucuauuaucugucuacugcuucccacccccacccccccacccccggccucuuauaacgcuuucagcacccagagcaggcuuacaauuccaaucuucucucuucaaggcuuccuuucugauuucuaccauuccucugugaacuuaguucuaccuccgcagucaggcugguucuccugauugcaggaaugucugcccuggaagucaucuguggaguauuccagguuuauguguucagaguccuggagcuccgcugcgaccugcgcaaacuuccacuuacugaagaaucuuuggaaugcuucgaaucuuaagaaugguucuguguccuuccauucccaaaauguuuugcucuagaagugacuuugugagggcaauaguggcgagguggguucaagagagaauuugaaaagaguaagcagaauggguaaauccccagccacagagaccuuggugacaaccaucgaucacaaaaugagagagaauauuagaagcgcagccaaauaggcauaauucacaucauucuuuucaaugccauuucucacucacgcaaauagaauuuagccgacaucuuugcuuuguuaaagaauagacuucuacguauguuuaaauccauguaaaauauaaaguauucauccccuucacacguaacgccagaaguagaguuugggaaucccaccuccaguuuagaccccaaguaucaagccuuacguucggauuagagguuuggcgccacaguacacucgagaggaugcuuuuucugucauuua

SEQ ID NO: 8529 - RNA, 1212 nt, Mus musculus
gagaaggaggaggaggaggagaagaagaagaagaagaagaagaagaagaagaagaagaagaagaagaaguaguaguuuuuauauuaaaaguuuucuuuaauuacaugaguaaacucacacuggugaaaagcuguaugaguacaagugaugcuuaaacuuuuuguggucccaaaucaugggaaaggcauggcauugauuagauuguagaggaaccuggugcauguuugcaauguagaaagucuucacuucucugcuuccuccaaauauguauaagaagucaacuagagggugcuggagagaugccucagugguuaagagcacugacuguucuuagagaggauccagguuugauucccaacacccacauggaaagccacaacugucccaacuccaguucuaagagacccaguguccucuucugagcucaguggggccuucaugugcauggcacacagacauauaugcaggcaaauuaaccacacacacaauaaaaaauaagucauagcagagagaaccccuuuguguguagguaauauugaaaagccucucauuagcacaguuaauuucacagacaugaaagaaccuacccuagaguaaccuuaaauauggggucuacuuaaaaaaucuuucuagacuauuuauuucauguguguaaguguuuugccugcaugugugaaugugugucacauaugugcacugccugccccacccugaagagugccuggaguuacagauggcugugagcagccuuguaggugcugggaucugaacaaacgcccuuuguaaacacagggagugcucuuaaaaacugagccaucucuccagcccaguaguucauucuggacuccuauuucuaaauuuuguuuuacaaaauaagcuuaagccaacuaugugagauaggaugacagcuuauacccuugggauggagacuaguaaucagcacaugugaaggaaacaagacaaaacaaaaaacagcgguaaaaagaaaaguaaacuauugugaaaugauucuguaagguuucuuaaagcagaaaucuagaguuuaaugggugaucucuucucgaaucaaaucuggcacguuucuguuugcauugugaauuguguuagauucauuguugaacugacauuuaauuguaacaugccaauauucauaaaugccuuuuuucaagcaauugugguuaauuaaaaauuacuuuuugagaauauuggaau

SEQ ID NO: 8530 - RNA, 12945 nt, Mus musculus
cuuuugguccccgccuuauuuggggaucuggauuguuagcaucuguacagggaaucuccaggucucucucucucucuacuccauuucugccucaccuccacugacugcaggaacuacaagaggacacuaggacaucaugucucuggaaaugguucgugcgggcgauuguggcagugggguacagcucucgucugcagaggggucucucugacucugaugagccucagagcgggauccuccggguggagcugguccaggcugcccugucucuugcugagcgcucacugaagcagacacaucuggucucucgcagugccaggucuaggcagaguggguggugguggcagagggugguggagacuagguacucggguuggggguucugcaccagaggagguaagagguguguugacccccggaucuugugcauguuauucugaaacauacagagacauggaucuuuuuuacacugucacgauuuauuaaauagccaauaaauucuuuuuccuugacuacaguuuuccaaguaagcccgauuuugccuucuuucuggccgugggcagccacugcucuuuuauuccaaucuuaaucacuaacauuaaaccacauauuaacauuucacacaauaaugaaccaaaacacagguugcagaaugguuaagaaaguguuagaaaggcuugaaagcacacaaagcuuuacuggaguccaggcauuggagcuaauacggggacaaagagggcuguugaggaucgaauaauucucaucgaucaacuaagccggagaaacugcgaggacaaaggcgggagggaguccuugcccacgguuauuccccuucucuugacagcugacccugugaucacugccugugugccacacucugguuuuggggugcuccuuguagaaauucaggugagggguugcauauauugugguugauaagcucaugcgucuaguguuuuugauaaaauuugguacauuuucaggaguuguuuacugaugucacuuugugccuucuggagugcuggcaaauaguagcucuuuuuccucuaugagaucuuaugcuuaaaacucgagcaaaucagauuaacguuguugcugaacacaauggagccauucuagguuuggcauaaccugcaacaugaacuaacuacaagcagcccgcccccacgccccccuccacccccccccaccccccccacccccccccaccccccgccgucuuuuccuugucucauuucaguggcaccugcuuuuccaaugagccuugcagguugcucuagucucauccugucgcugcaguaacauacugacugaaggcagcauggcucgugaggaaaggguucuuuuggcuuauuauuuucaggucacaguucaucauugaaggaauucagagggaaagcucaggcaagcacuugaagcagacaccauggaggaaugcuggcuggcuuauaaacucaugcuaaaauagcuuucuuauacagcccaggacccccugccuagggaagguucuuuucaucauagacugggccuucccacaucaauuaacuauccacaugcuaaucugauccagacaauuucucaauugagaugcucuucucagauaacuauagacugugccauguugacaguugaagcuaaccaggaugcagauucaagggacucuuccuccaaauucccugaccuguacucuuagacuaaggauucuuaggacuggcauugaaucccugacuuuccaaguccuccuaacauuguccgacucauagaaagggagagccauauauaccugggauggacaggguuggccucugucaaaauuguaauugaugugguuuguuucuaaauauuguuugaaaacggaaguccugauggagguaagccaugacaguguugugaauguacugugaaaggggaaagcccuccguguuggcucacaagcuucucauaggguugggcuaaagaaagcugugcuuaaaccagaauaaaaaggaacggacaaaagauaagagagccugaugugaucaagaugccacaguuagcgcccagauuagagcaguuugcucugaggucaucugugcuuaggacuacaggaaggacugguaugugcuggcucaggcugggaaugaaucaaucagugcucacacgccuagaggaaagacacaaacuugaggaaaaucugccuagaaaaauauuuuaugucucgaccaaguguuaaggcaacaaaucugaguuguccugaguagcaaguauuaaucuguccaaauuauuucccagagcugaggaugucagccagguuuauuccuguguguauaaauacucccggcaauuguuacacggucuuuuaaggacuccagaauuuggaguguauagauucucagugucuuuguuuucagauuuucuucaugugugauggagauugguuggcgacauaagcaucucguuauugccaacuuuaucacauaccccacauacaaguuuuaucuccuacagagauuuucaauuacucacuuugacucuuugugacagguuuaagcuuucuagcuuugcccucacagcuuuguuuguuuggagacaggguuucucuguguagcccuggccauccuagaacuagcucuguagaccagccuggccucaaccugccugccugccucuaucuccugaguacuggaauuaaggaugugugugugacacgacaccuggcuacacucacagcuuaggaaagguuuuccuuguuguuauguacaugccucggucucccaguggaggccagaggccaacuguuugcagucaguucuuuccuuccacacuucugugaguuccaggguucaaacugaggacgccacugggccauauuugcugacccacuuucucuuacuucuguuuuaaaaguuuguuuuuauguaugugaaaaaaauuuguuuguuuuauguaugugagugcacuguagcugucuucagacacaccagaagagagcaucagauccuauuacagauguuugugagucaccaugggguugcugagaauugaacucaggaccucuggaagagguaugcucucagccagugcucucaaccacuaagccaucucuccagcccccacuuacuucuuuuuuaugccuacuuuagagcaguucuuaacaucagaacaaugcuaccugaaccuccuuucuccuuuaaaagcaguucccuuuuugcuuuaauauucuuguucuaaaauuauaucauauugcuauaauuuuaaauaucuucuuuuuuuaaguuggucauuccuuuuugucuuauuuuuuuuuacagaauuuagaaaacauuucuuaauaaaguggcuccauguuuauagagauguauuuuauuuuuaauuauuagaguaagugugcauaugugagaagaugccccuggacuccagaagagggccccagggcccuggaucuggagcuccaggcgguuauuguuggaacacuaagaauggagucaguuagacuucugagugcuugugagaaaacuccaagaaaacaagacaagaauaguaucugaccccaguuuccucaaaacugcgaaauugauauuggaguguguuuuugugccccucccagguauaacagagugaguuuauuucagauuauucauuacaacugucuacuguuauuuguuuaugugucuacagaaaaaaaccauuuuugccaugaguggcuuguccaccaaauacggcuuguccuugugaucguacaguuugcauaugugacuccucuugacccucagaguaaaaacuguccgaugcucugacuuaaguuggcuauugcaugagacuuuagucugccucacuuauugccuccauccucccagcugaaggagccccauauccuccuacacacggcauuaaaacaaaaaauauaucugauaauauuuuuguguuuuucaaaaaaaaaaaaaaaaaaaccaaagcuccaaaauugucaguauauucuaguuacauaaugaacuaggaacuaguuggaauaauuuaacuuauucauccucugagucauucuauuuuugcauauacaauauaaaaauguaagcacauguagauaauauuuauauccauguaacuguauauauagaugaauuuaagcauaaacacuuuacugauuaucuuuuaaaaacuguuuuauuaucuuauuuguauagguguuuugucugccuguuuggcugugcaccauaugugugccugguacugguaggggccagaaaugggcauaggauuaucugaaacuauaguuauagacaguuaugagacacaaugugguacuagaaauuaaaccuagguccucuggaagagcagacagccucguagagucaucucucuagccucuuucuuccuucuuuccuuucuuucuuucuuuccuuccuccccuccccucccuuccucuuccccuccccucccuuccccuuccccucccucccucccucccucccucccucccucccucccuuccuuccuuccuucuuuuuuuucuguuuuguaguauuaaaugauucuuuuccuccaaagucugcuuugccuuuuguguguguuuuagcuuuuucuuuuugagacagagucucgccgagugaguaagccugcuagcugggaaguuaggcucaggcuggucuucagcuccccagggucuucugccucuucagucacaggauuagagguguguaccaucagcccagccaagcccuggacuuuuuaaagacacgauuguaauauuaacaguguagaaaaguuacaacuucauuagccauaucugcaaguaguaacacguuuuuaaauugaaauuuuguuuucauuuuaacuacuaugggggcugugauuagaaaugggugggaggaaaaaaguucacauuuuaauuuauaguuuugguuuuuuuauaguacagaaagcccagauauucaggugaaaguucucauaccuugaaaguuguaagcuaaaaucuaucuuuaaaauguaagauaucucugugugugcucaaugucaccugaucucggaagcuaagcaggggcuggcuugguuaguacuuggaugagauucucucugggaauauggugcacugcgggcuuuuucuuucuucuauuuaaaaguaagaucuuagcaauaauuuauuuuggguuccauuguuuaaagaauguaguuuacaaccagguuuaaauuguaaugaaucaucuguuguaaaggaaguuguuguaaaguagauuucugagggaugguguucauuuggauugguugugaaacaccuugacuggaaacgucaggccaugucauuuuaugauuuugaucccaaguaagcaguauuuauuuucuuucuuucuuuuauuuauuuuuauuuuuuaaauucacuuuacauacguuuucucucauagcccccaucccuccucucuucucagucccacccuuacaaaucuuuccccccacuggccccuccucuucuccucagagaaugggagcccuacuuggguaccaccucacccuggggcauccaguccuaguaggacuaggugcauccucuuccacugaggcccaaccaggcuguucaguuaggggaaggggauccaaaggcaggaaacaaagacagaaacaaccucuacuccacuuguuaggggucucacaugaagaccaagcugcacauuugcuacaaauguguagggggagucuagguccagcuccugcaugcuaccccccacccccggguugauggccuaggcucugugagcccacauggucccagguuaguugacucugugguuuuucuugugguguccugaccccccuccuacuugcucacuucuauccccuacucuuccacaaggcuccgccugauguuuggcugugggucuuugcaucugccuccauccauugcuggaugaagccuccagcuaguuaccagaguugccacccuccccucgcccugauuugcauucucacuuccagcccucuccagccuccuuuuuuccccauaccugaucgccauccccuuucuccuuucagcuccucuccuauccaguucccucucuccauccaccuccaaugacuguuuaguuuccccuaagugagacucaagcauccuccuuggggaccuuauuacccaguuuuauuggguuuguggauuguaacaugguuguccugcacuuuauggcuaaugcccacuuauaagugaguacaugccauucaugucuuucuagcuuugaguuaccucacuugggaugauauucucaaguucuuuccauuugucugcaaaauucacgauguguuuaacagcugauuaguguuccauuguguagauagauguaccacauuuucucuauccauucuucaguugagggauaucuagguuguucucaguuucuggcuauuaugaauaaagcugcuaugaacauagcugagcaagugugccugugguacaguagagcaucuuuuggguauaugcccaggagugguauagcuggcucuugagguagaacuuuucccaguuuucugagaaaccaccagauugguuuccaaagugguuguaccaguuugcacuccuaccagcagugcaggaguguucccuuuguuucauacccucaaaagcaugugcuaucucuugagguuuugaucuuagccauucugauggauguaagauggaaucaaaaaauuguuuugauuugcguuucccuguugaauaaggacauugaagauuucuuagaguguuucuuggucauuugaaauuccucugcugagaauucucuguuuagcucuguaccccauuuuuuaauuggaguacuuauuuuuauuugggguauuuauuuucuuugacuagaugccauaggaaacauacugugucucuguuugccuucuuagugguugcugaaguuuccuggcccuuucaaaaggaaaaccaaaccugaaguggggguugggggaauccagaaccuguuuucuuuuccuuucuuuuuuuuucuuccuguuuucuguaacaucucucucuaauucuucauaccuuuuguccugucucacuuaucuuuuccuuuuucacacugaaacaaugucuuaccucuggauaaaacuaguucauaaucucacaccccccaccuccgcuuugucuuuaaaaacuuuguuuuaaaaacauauccucacuggggagugguggcgcaugccuuuaaucccagcacuugggaggcagaggcaggcggauuucugaguucaaggucagccugguguacagagugaguuccaggacagccagggcuacacagagaaacccugucuugaaaaaaaccaaaaccaaacaaacaaacaaacauaaaacccaaaaucaaaaaccaaaaaccauauccucauaccaucauccuuuuaacaucuuccucgaaagcaucacagagcgacacucaggcuuccgugaagauauuccaguucugccacacauugccugagcauugaugcccugggacacucuuaauuuugcgucuuucauuucuuuaaagucaggacuauguggauggcacucccaaggcuugccgcagguucugauggagccucugccaguugcagcuuuguguucagaggccuuuccugcuguccuaaugcuuccagaggaauuuuugguuuaaaggugcugaucucaaauuaaaacuccguucucagccuuugugccuuguaaguuguaguaaacauguccccuuaaaugaacucuaacuuauucaauggcuuuucuaaccgaaagcuuaaaacuccucuauauuccucuuguauaagucauaguucucuggagguacaguacuacugauagaaugaacaugguuuauuagaguggcuuacaggcuaugaucacacacacacacacacacacacacacacacacacacacacacaagcacacaugcgauuuauuaaaguggcuuacaggcuauggugccaguuauccuaacugcugagucaccucucugacccugcaucauaaaagucuuacucaauuuugauuuaagaaugcuccauaagaaagcagguacacacuuccaaauuugguuuauggggaaucacagaguauauauucagagaauauauucaagucccucacaugaagagugaugaaauaccuacuugucuuagucacuguucuaagugcugugaggaagcaccaugaccaaagcaacuccguuuagugguguuuuuccuccuaugucccuguucccagaaauaaugaguuugagacucacuuauguuuacaaacaccuuggcuguuauacuuuguuuauucuaaucuaaguucuguuacgcggcuaguuaacagucugcucaggucucaugugucugugccuccccacccgaacaauugcaaggccuggcucuaucccagaauccuuuaugucuaugggaugccucaccuucuauucuacccuuuccuaugggucauagguuuuuuuaauugacaggugguguauccauacagugcacaagagauucacucuauacaacucuguuuuggguagggcaggagggugcugaagacggaacuccaauccucuugaaaaguaugcagugcucacaaccagaaauauuauuucuuuuuuuagguaaguuuucuccguguaguccucgcuguccuggaacucacucuguagaccaggcuggccuggaacuaagaaauccaccugccucugccucccaagugcugggauuacaagcaugcaccaccacugccuggcuauaaucacaguuucuuauaaaaguuguuacagugaccgaguggacaaaaagaaauaagcacauauuaugagggcaaagguugcccuauccgcugcuguuugaccagauuguuccagucuacugucagaaucgcugcauuagagaaucuuaguaugcaugaacaguuuaagaguauggugaccaagacaacuugcaucuauggaacuuggaauauggugucacaguaaguucuuaugaaaccuaggucucugguagcaggaaguucaucugugugacauugcaugugggcucuuucaggagcuggugaccuucgaggauguggcugugcacuucaccauggaggagugggcucugcuggaucuaucccaaaaggagcucuacaaagacgugaugaaggagauauugagaaaugugguuuccauagguaaagacauuauccuacucacaauaggucauucaucguugcugcugcagaagcugaaguaugguaaagaaccguuggguuauacucaccuggcagagagacaccaccaucaggaaggcgcuuuccuagaguacggcucauccacuguucuugggaugugcggaccccugagauuuccccaaaugcagaagucuugagugcaugauuggagguagugggggacuguguucucucucugaccugaaguagggggaaauggguaauuauaugaggugggcuuacuacacgaauuuaguuggacucuacuaauguuuguaguguacuauaauaauucccaaugauuuaucuuaauuuguauuuuuaggagacauaaggaaacaccaaaagauugacaauaaauaccaaaauucugggagaaaacuaagguaauccaggcuccuccagguuuguggugucauaggacauuuuaccaagagauaaaagaaacaaauauaucaagcaucaaucugaguugaucucaggaaauugccaccaagauugcugauauguuucauagcaucagugagaauaucucagagauuugaguguuggaaaccaugggagugucaugaagccaggagagaaacuuaaucauacuucacauguacaaacuuuacaccauauacauuauggaaaaugaaguauaaauuuaucuaccaucuuagccaggaagugcauauaaaacaaaacccagagaacuuuuuuacacaagaacuaauagaugagauaacaugcauaggugggggugggguugcaccuuuaauccgagcacuugggagucaaaaacaggugguucuuugaguuaggugccacucagcacuucaaagugagacucuuaucucaaaaaaacaaaaauaccucaauguagacauuugucuuaagguuucuauuacugugaagagacacuaugaccacagcaacucuuuuuuuuuuuuccgagacaggguuucucugugcaguccugacuguccuggaauucacucuguagaccaggcuggccucgaacucagaaacccaccugccucugccucccaagugcugggauuaaaggcguaugccaccacugcccggcucacagcaacucuuauaaaggaaaacauuucauuggaacuggcuuacagguucaaagauuucgucuguuacugucauggcguggaagcauggaggcaugcaggcagauguggugcuggagagguagcugagaguuaugcaucuggaucugcaggcagaaggaagagauagugaugcuaagccuaguuugaccuucucaaagcccauccagugacacacuugcuccaacaccgccauaccuccaauauugacacaauauaaacucccuaugaguuuauaggggccacuuuuacucaaaccaccacaacauuaaguaguucaaaauacaacaugauuuuugucaucaguauuguacaucaaauuguguacaauauuaguauugaaaucucuguuuaaaugugacauaccuucaguauuuaccaaacauguaaacaauauaacgcaacuugucauuguggcuuuuuuaaaagauuuauuuauuuuuuauuuauaugaguacacugcagcuaucuucagacacaccagaagaugguaucagaucccauuacagaugguugugagucaccccaccauguaguugcugggaauugaacucaugaccucuggaagaacagucaaugcucuuaaccacugagccaugucuccaguccgucuuuguuuuuuuauaccauuauaccacuugcuuuauaauuauagcuguccucaaucauguugcauaacauccagucaaaauauguucaaaaucaucagaauguauaaaacuaauauuucuacuaguaaaucauuaauaaucaaaaacugagcaauucacuuuuucauuucuuacagaugucaacuuguggagaaacuccaugacuguaaagaaggucaugagugugcagagaucuucaaauucucuacagagggcacugugaaccaugaauuuuauccaggaguacauauauguaaaagaaauggguuugucaauguacucauuggccauuuagcuauaaaugugcgacugaaaccuaggccagggcagaagucaaaugaaguccaggaacauggaaagaauguguauacuaaggaaucucagggcaccuccagcgcuuccccgucucuucagaagcaucaaagugcugagccugcagagaaaucugauaaaacuaaacagccugaugaagacuugagacuuggucagaaucaugaaaggacuccugcugaagaaaaacaccacaaauguaaacacugugggaaagcuuguacuucucucagcuccuugaagaggcaugaacaacauuaccaugcaaagaaaugcucuaaguguaagcagugugggaaagccuucccuuucccgaguucccuacaaguccaccaaaggauccacacuggagaaaagcccuaugcguguaagacgugugggaagaccuuuggacauuccaguucucuccuaagacaugaaagaauccacacuggcucgaguccccaugaguguaaacugugcaagaaaaccuuuacucguuugaauucgcuuuuaaggcacaaaauaauucauacuggugagaagcccuaugcauguaaucagugugggaaagcuuucucucgauccgcuucccuucagagacacacaagacuccacacuggagagaaacccuauguguguaagcagugugggaaagccuucauuaccucuacuuaccuacaaguucaugaacgaacucacacuggggaaaaaccauauguauguaaggagugugggagcaccuucaugcuuuggacucaauuccaaaagcauaaaauaguucacagcggugugaaucccuuuguuuguaagcaaugcgggaaggcuuucacucgucuugguacccuacagauacaugagagaauucacacuggugagaagcccuauguguguaagcagugugcaaaagccuucaugucuuugacucaguuaagacgacaugaaauaauccacaguggcaucaaacccuacaugugcaaacaauguggaaagggguuucucugcucuacuacucuucggagucaugagaagauccacaguggcaguaacccguauguauguucucaaugugagaaaguugugaguucugagagcgcuuugcggaaacauaaaaugauucacacuggagagaagccuugugucuguaagcaauguggcaaaacauucacucauuuaaguucucuucaguaccaugcacugaugcacagcggagagaaaccccaugaauguaagaaaugcgggaaaggcuuucggucucuuagucaccuuaaaaagcacgagagaacucaacacuaaauagaaacuauaugcauggaagcaauaugggaaagccauacacaguggcauaaauccauaggcuuguuuguaagcaguguucacagccuuuaaauagcugugguguuuucacauaaacucacuggagaaaagggggacuuuuugcuaacaauaugugaaaguucccuauaggauugauuuuaaaaaacaaaaacccaugaaauagccagaguggagggggaaccuuuuuaaaaaauaauauggaagccaggcagugguggugcaugccuuuagucccaguacuugggaggcagaggcaggugaaucccugugaguucaagaccagccuggucuacagggggaguuuuaagacagcugaggcuguccugucucaaaacagagaaaccgugucucaaaaaaaaaaaaaaaaaaaaaaaag

SEQ ID NO: 8531 - RNA, 1285 nt, Mus musculus
uaaagggauggaacuagacugagagucauaggcuuagguggggcauccucagcguuuaaccuuucugccugaaccagagacaaaggaguuacaaaggagauuccaaguuuaggagugcaccugcccuccaagggcuaagggguggcagauaaaucucucuagcuccucugcauaguugucuggguaacagcaugcagaacugugaggcucugaaaugcauuuccucuccucuccccacgcccaacagcugcacagccuggcagagaucgauuucuuccuucuugaacccuagguucuagguggaccaauaauugcaacccugcuggaacccacugggucagagaguguagguuaagcucaugugaggcugaagcucagagaucugagggaacagcuaaaaggggccgugagcagaggggacacaggcugaaggucagaucugggcgugggcugaugucauagauaugcguuaaauauugggggucaggaaacuucuauuuuauuuuauuuugcuggucauguuuuguucuauccuagguggcuggacuauccagccucugucuccugacccuccagcagugccaggcauggguuuccucucaugguguggaucugaaguuggaccaguaauaaauuggcaacuuccccgaguuccuucugugccaccuagcccaacacaucuugcagguaagacaaauuguggacugaggguuuuguggcuggcuugguauccuaagcaaugaacuggaagccuugcccgguuauugaaaaugggcugguucaggcuaggaguuuuaugcuaggaguuuucaguaggguuggccuccuggaaguuuccauuguacuagguuucuaccucacccccaaagugccucccauucuagucauuucuccucaccccaaaaaugcccuacccccaucucccaguucucccaguauuuucucccacccccaccuauuccuuccuguucuaucugucccaguccacccuuggaaucuauuuuauuucuccuucccagagagacccaucuguaccacuuugagccaucuuuagcaucucuggguguggacuguagcgcaguuauccuuugcagcuaauauccucuuagaagugaguauguaccauguuggccuuucugggaaagagauaucucgaccgagaaaguguuuccaucaggauaccuguagggaaguccauagagcauuuucuugauuaauggcugauguggaagggcccagcccacugugccuggugccaucccugggcaggugaguccucaagugu

SEQ ID NO: 8532 - RNA, 14760 nt, Mus musculus
acuccuuagaacugaguuaucagguucagcaacgcuuaccaccgaaaugggucuguaaguacagauugcaacaacugcccuguccaagcucauaccuuuucuccgaaauaaaugugauuucauccuggaggguuaucacauuucagaacaccuuccagcccgggagugguggugcacuuuuuaauaccaguuccacgcuagcuuugucuacguuauugaguuucgagucagccagagcuauauagucagaauucucccgucuacaccacacacagguccagggcuucugaaagauuuguuaguuuuaugugucuacguggaugaauccgugugugcgcgagugcucacugaggccggaagacggcagaaguccacucgcuuuuccauugaggcaggguuuguuuguuuguuuguuuguuuguuucacucaucacuuuaccuggggcucggguuuccuuggcuaauaauggaagccagcuagccacagcgauccucuuauuugagccguccucauagauagugauucagaaaugugcaggggaucucuaacgugagugcuggaaucugaacuccaguccuagguguuuaucaugcgcccuuauccaccaacucuccagccccauucacagccucuugggcucagcgggcucuuccugguauuuuuuuuuuccgacauacaaauagugucauaacgucacuuuugaauaaauccuuugcucuucaaucagaguaagcugggaaaagccaugauagcaaaccaaaacugauuucuguuuaaauuccucugugaaauaacuuugauuauguucacucugauuggcuuuuuaaaaaucccucugccuuaauaaacauccuucuacuuucauuuugccuacuuaggcucaucauauaaaagcaaacauguaauaucuguugauuugagccuggcucauuucccuaacaugaugaucuccaguuccguguuuuuuuuuuuuuuuuuuuuuuugcaaacaacauucuuuuguggaugaauaauacuucacuuucauaaauaccacauauauucuauccauuuguuccuccacugcuaggcuccuugggugacuccaucacuuggaugcucaaugcugcaauaaauaugugugcaggaaucuuaguuacauggugacauuuacucucuucguguauaucuagaacgguauagcuggauaaaaugacuuaauuuuuaguuugggguuugauguuaaauaccaaagcuuguguguugaagauaugguccgcggaugcugcuuggaggugauggaaacuuagugauuggggggcugcugaguggaaguaaaguccugaaagaugugcccuugaagcaaguauuggaacucuagcccuuuccuaagcaaccaagcaugaacauuuaucuauuuacuucccagccaccaugagaugagcaacuugacuccuugggcuucccaccaugauccucuguuuuaccucaggccuaaaccaaggagaucagcugacugugaccuaaaaccaagagccaaaauaaguuccuccuuauaaacuguuuauccaggguguuuuguuaaagccacagauuuuugacuaaauugcauucuaucuacauauauauuuaucugaagauaugcuucauauuuaacuugagguauauagcccagguucacuuuaaacuuauacuccuuaugccucagccucucagaggaggggauuacacauguguagcaugccugccuucuugauccaugugguuauuugacugacaaguucaaacccuguagagccucuagauccaagcagaaacucacacaugcugaggcuauagacacagagcagaauuuugucuucacugaaaaagucugcucucguggccuuucagcuaaagggugagccccauucauguuaaccaagguuaucaucuccuuuuacaguaccaaggaaggaauccaggaccucuugaaugccagacaugggcucuaccacugagggccacaaagcacuugacauuaccacauauagaugcaccugauuaaaucacuaagugccuuaauccaucuaaauugacaaaaugauccaccacuauugcaaccccucaauggaagagguguuguggauagcccuggggcuaauuauauuugcuguuaauucuguucuccuuugagugguugugaacaaggaaugagucagcucucagcuucccaccuuaauuuguaaaguaaaggagaacugaugauuggacagauaaaaggaaagguagaucagaagggguguguaugugugugugugugagagagagagagagagagagagagagagagagagagagagagagaaaggagaaaggagaaaauggaagagggagaggaugcaaaggaggaggaggaagaagaagaaaaacggagcagaagcacauggccuggagaaaccgcaaguucuaaggggucucauaaagguggaagaugguaguguagcagcaggucugcccaaucuaggcgcacagcuuguaaucauauuaacucuguuguguuuucauugccggagcauauuugggagaagauuuucugcaacagagagguaacagguugauacugucaggaaauggggaacuucuuauaacaugagggcuacacuccuuuaagagcuuucauucucuccauggccuggcauguuuggugguauuccaacugaguuuugucaucugggguuggggggcaaugaagagaagagagaaagaaaggagaagaaagagaaguccaaaaacuagaaaggauaaaaagaaucagcgagucacauucauucuuagacccccaaugucacucacccucucauuuuuuacaaaggaaaacaaaucucuuuuguucuuguaccuuccagaagagcucacugggcccuucacagcccagcuagggguucagccagcgcucaagcugcuguagcccccacauucuuucagguguuccaucuggggucauguagagucucgcuguguagcucugccugaccagaacucacuguauagaccaugccggccacaaacucacagacaucugccugcuucugccuccugagugcagggauuaaaggagugucacacuaugcaggcuugcuuuuuuuguuguuguucuuggguuuuguuguuguuguugaaguuuuguuuguuuguuuuuaagauugauugauugguugauugauugauuuagucugugugacuacacuguagcuauacagaugguugugagccuucauguguaagguagaaaauuuaaguuuggcccccuagaccauguuggagccaagaaagaaaaauaguuggucccugaagcagccuguuccaagaacuggcugaccacagaacacaugagccaguucagugacccuguuccaggaccuggcuggccacaaaaguuagauuaaaaucuugagaacaaucuugagaagcagggaguuuucccuugugauuuuuaguucccccugugauucuucacuguuauucuugguauuuuccaauaaugcccucccuacccccuuggguugugguuucuuccuuuaaauauccccuugcccagcuacucaguguccacaugguccucuaccccugcaagguauaugacugugggccccagagugcucuuggaauaaaaguccucuagugguuugcaucaagaccguuucuugcgagugauuugguaugucaccucuccugagucagaacgugggggaguccuuauaguuguugggaauugaauuuuuaggaccucugcuugcuccagucaaccccgcucacccagucccugcuagcucugguccaaagauuuauuuuuuauuauuauaaguacacuguugcugucuucggacacaccagaagagggcauccgaucucauuacgggugacugugagccaccaugugguugcugggauuugaacucaggaccuuuagaagaucagucagugcucuuaccugcugagccaucuugccagccccuuguuuuuguuuuuuaaugaaauuuugcuuuguauguaguccaggcuugucuugaaacagugaucuucucauggcuucuaaagucuuccuuuuuacuccuaaauuguguguguguguguguguguguguguguguguguguguguguguguguauucugagaugguaauggacugugucuuagggcugugaacagacaccaugaucaaagaaagucuaauaaaggacaacauuuaauuggggcuggcuuacagguucauaauccauuaucaucaagguaggaacauagcagcauccaggcaggcaugguacaggaggaguugggaguucuacaacuucauuugaaggcuguuaucagaauacuagcuuccaggcagcuaggaugaggguauuaaagcccacacccacagugacacaccuacuuuaacaaggccacacccucuaauagugccacucccuggaccaagccuauacaaaccacuacagauugaaccucugaaacuguaagccauccuaaauauccuaaauuaaauuauaaauauauugguucuuuaagucaggguuucuuuguguaacccuggcuguccuggaacuugcucuguagaccaggcuguccugaaagucacagggaucugccugccuuugccuccaccaccaccaguguguuuccuccuccuucuccuccuccuccuccuccuccuccuuccuccuccucuuccuuccuucuccuccuccuuccuccuccuccuucuccuuccuucucuuccuccuucuucuccuauuccuccuccuccuccuccuccuauuccuccuguucuugucuccuaaauucuugaaaagcaccuaaaccauuuuacuuucagcugugcuggcauguaauuacuucucuuugugacuuaagcaagugacugcaccucucuguuuccucuuuccuccugcuauuucucaccaucuacuauggucuaggaaucuugcagaaucuggcucuccucuggaagguggaucugccccaacaaggagagaagagaaucuagggaccauguacuccaagaugcugaagccuccacagccuucuaagaccagaaauuggacuagcuggauuaggagacaugaugaagauggaaagaaauguuggcuaccucugagguuucuugcggucagacuuccaggugaggaugaguaccaugaaagaugacauuagacaagagugagagcugaaggagaaauucuucugccauagauagaauguugaggaggccaagugugguagugaaggccugugaucauagcacucacgagucucaagcacuccugaguuugaggacggcugugguaagauccugucuagaaaauggggauaggggcaucuccccaauaaucuuuccugucuguuugcucuguguguguaugucuuugagugaucacguauguggagacaugaacauggguggaugugagcagauuacggaagccugaauuugaugucaggugucuuccuccauugccuuccaucuuguguggugaaauaggaucucaggcgaauccagagcucacagauucagauagacuugcuagguaucuugcuguggaaauccucugucucugucuuacacuggcauuacaaaugaggacaaagaagaggcaggagcaggaggaggaggaaaaggagacuaucgcuccaguuuggcauuuauguagguguuagggaucuggacuuuauuucuaaauuuguacagcaaggucuuuagccacugagccaaucuccaggcccuuguaggaagggaugugacugcagacagauguaguuuuuagacuugggacugauggaugccuuuggagucaagaguuuuccuacaaagccucaguuuccucaucuauaaaauggaaauaauucucugcucuuagaagaugaucaaaacgaugucauggaaucaugauccuagcauaccaaggagcucguugugguaguuugaauagauauggcccccauagacucaugcauuugaaugcuugacucuuggggaauggcacuuuuaggagguguggccuuguugaaguagguguggcuuuguuggaggaagugugucacuguguagguaggcuuugaagacuccuagugcucaagcucugcccagggccaaagagaguauccuccuagcugccugcugaggacagugucuuccuggcugccugcagaucaagauguacagcucuugcuccuucuccaacaccaugucugccugcaggcugccaggcuuucugccaugaugauaaugguaggaacuguaagccaaccccaauuaaauauguuccuuuauaagaguuaccucagucauguugucgauuauuaaugaaaacccuaagacauucagcaaaguacauuuucugcucuguuacacaguaguccuggaaagcuauuuguauuaguaauuuuuuauugcuauaauaaaaaaaaucaugacugaggccacuugugaaagaaagaguuuauuugguuuauaguuacagaaggcuguggguccauugugacaggaaaacaugacaacaggcacuagacacaggcuggagcagaaacugauggauaacauuuugagcgacauauaugaggacaagagagcaaacccaaaauggcuuuuaaacucucaaagcccacucccugugacauaccuucgccaacacggccaaaccuccuaagccuccccaaacaucaccaccaacugggggacacuucuucagaucccugaaauauucugagcaucucauucaaauccuacaucaauguugaccacuugauaacauuccguccuaauuaucacagcauuuaaacuuacugacugugaguuggacaaugugaugagacacacuuguaaucucagaacuugggugacugagacagaugugugauuuccaggccagucugggcuguauaacaauaucuuguugcaaaucaaggccguggguguugcucagugcuagagggcuugcuuagcaugcacaaauucuugagcucugcauccaacaguagaaaaagaaaaguugaggaaacacaaaacaacuagaaaagcaacuugcaucuuuguugggccagcucgacccuucaugugucuccuccauuccuuguugggagucaggguuuucugguaagaagucuggggcucugagagggaagcaucagaacuuucagcaucucuccgagcuuagcuucagaaguagcagaaugcuuacaacacucaucaggccagagcaaguaaggccccauaguucaguucaaguucacagcauggcgagacagcuccaucugcagaggcuagcaaugaaggcacuauaagaacaacugaggugauuuauauagucacuuagcacuacauuaaugagaacaggaugaugguuagcaauuacucggcaucuacuuuauaccauaaacaauaugccaguugucggauauaauuuucagccuauccugagguaggucucccuuauaacuauuaccuugugggucgugacaccgagggcccgagaggucucagggaacuucuccaaauucaccaacaguaagagaauaugaggaguagaguagguauucaagaauuauucgauagacagccaaucaggucaacauaaugcuaaacucuggaugagugggacaucgaaccuggcugcuguugacaggauguaaacuugaacucaaggcuccugacuccuuacuuacaucuuuaugucuuauaggcauaccuuuugcucccugcuguggagucaggcaccugaacagaagaccaggagucugguucugggucagggaucuguucugauaucuagggcuggucagagacucagagccaaggcacaaccuuguuuucuucucuggcuagaacaaguggcagugccugaccuucgagagcagcgcuucucucuggcccuguuugaacauaugaaccucacgacuguggacagucugcagaaaugugucuucagcuuccacagcaacugucaggagugagugacuaccuuugccugagaaccugaaccaugaaccaagagagaaagcuggagaaugaaagacuggccagaggaagcagaggugccucucucaaagugguagguuuugacugacauugaacgacagugagaggagccagaguguuuggacuggcaguguugcaguagucacagcugauuaugcacaaccaacucuggaggauggacacucagguagaugccggaugcaagaggagcuagagaggagaagauccgagguugguggggaaaugaggcauauuucagaaagcuaaggaagaacagcuggaacagauguggagugaaaaagcuaaaaaugguuccaguaucugccuuggaauucugggugcucccuguggagaguaaucuaccauagcuguguuuuugguuucuauauaagugaauuuauuuaguguuuagcaagcaaaaauagcagaguaucagaucagguauuuccaucccucugcaggaacaggaccggacaaaccccacaaaaauagggagcuggagaacuugaucaauaaagaggguucuggguggaaaaacauacuuuuagauugaacguccaauuuuaguuuccaucacagguauuuacagauucuaggaggaaagguaagaaagagaggagcuagcaaaaaaguuuagaugguaaagcaagugugcuugugugcuugcacuuacaugcgggaaugaauguguggcaguuagaggcaugggaauugguuuucuccuucuauccucagggaccccggguaugcaggcuuggugaaucuuaagguuugggaaggugcccaguuuguccugagaaugauuugccuuccagauguucucaaggacacagaguaagcugugagggcaaucuggcugugaaaugugugcugauuuggcuaaccuggcugguuaggcaaggguugccuuucuccauuacuucccccacaaagcuacauacccaguugagucaauacuuacagauagauacagguccacucuugagucaaggguauauaaauaauggaaguccccugcuagaaccaccaaacaaauucucaaaggcaugguaguuuucuuuuaggcuguuguccuuuucaccuuccucuuugucacaaggcuggagcccaguccaucccuagacaaaggggucuuggaggacacugugauacaacaaacaugcuuauguuuaaaauggagaagccacauugcuuccagagccaaucauucagaaaacuuaaccagcacauggcaguuuacuacuauaaccuguuacaccagcacaugaaggcucauaagcagugagaggcaaagagaaguacacuuguagggaacuuuuuuugggggggagggagggucuuaguucugggucucugcugagggucuucuagguuuucuuaauccuaagagucugcuuucugucuggccugcccugcaggucuaacagcaaauacauugcugccaucuuggagcucaucuccuucaacagcaccaguccuuccuggauguggacuuccuguacuaacuaccucaguguugaugggugaugcuuccacaaggccugcaaccugguggacaguuucacagauguugucaucaccacagagggacccugcaaccuuaauacucaggguguugaugaguuccugaaagcuaaggcuaaggcuaaaacuuuagacuucauugauguucucuugaagaccagagugggcuucuuaggugucugaauuaaagagguaaccagagacucugauauucauuguuacacaagagaagcuggaauuggucaaugggguaccgaggagccaucauggguccuugugaaagggagaagcagguuagaaauaaguuuuaaaggugauuugguugaauguuauuugaaaaagcaaauaacaagauggggagagaguccuaugaacacuauggguagcagagcuaucucgggucgggucaggagcacucagacaugucaugaguugagggucucacauugucuccagaaugaacacagaaaaaucugucagaugaggacuucugucuuagucaggguuucauugcugugaagacacaccaugaccaaggcaacucuuauaaaggaacacauuuauuuguggcuggcuuacaguuuuagagguucaguccaauaucaucauggugggaaccauggcagcaugcaggcagacauaguccugaaggagcugagaguucuacaucuuuaucugaaggcagccagaggagauuuucuucugcaggcagcaaggaggagggucuucccuuuggcacugaacagagcuuuaacacuaggagcccccaaagccugccugcccagugacauacuuccuccaacaagacccaccuauuccagcaaggccacccaucuucuaauaaugccacaguuaagaguuugagcuuuaaccaauguguguuagccaaaaaucuuuggaagccugagauucugaggaaaaagagggggaggggagaagaggauaaauaaacauaaaaaugaagaauuaugccaggcauggugguguauaccuuuaaucccagcacuugggaggcagaugcagguggaucucugugaauuugaagcuaucuuggucuacaaaucugaauuccaagacagccagagcuguuacauagagaaaccaugccucaaaaagaaugaagaauuacugugcaauaauauaccauugaccuagugagaauuaaaguaaaagacugagaugucuacaaucaacaaauacaucuggaauauacaaauaauuccugaaaaucaaagacaugugguccaagagaagaguaaacacgggauauaauguaggaaaucacaagcuucaaacacaaagaguuuuguggguguuguuguuguuguuguuguuguuguuuugagacaagguuucugcuaucugucccuggcuaguauggaauaugcaauauagaccaaguuaaccucaaacucuggcuccugagguuugagacuaaauguaugcgcuaccauacccugcaagcacaagagauucaagaagagauugucaaaaugagaauguaaucaccaaaggcaaagacagaaagauaaugaguuccaggccagacuggguuacuuuguuuuguuuaguguuuuguuuuguuuuguuuuguuuuguuuuguuuuuaagggaaaaaaaaaggcuggaggccaggagaugguggcacacaccuuuaccccagcacucagggguaaagauaaugaguuccagaacagccagagauacauagagaaauccugucuggaaaaaacaaacaacaauguugguggugguggcgguggcgguggugguggugguggugguggugguggugguggugguggugguggugguggugguggugauaaauucuuacugccagugcacagaggugucucuuacaucgcuuucuuugaacuucauauuuucauuuugcccuuaaucagucucggaaggaguugaguagcugaagagugggugcagaacuaagguugguuaggaggaacaccucuaaggauaaaaucauacauaagugaagaaaaauuacaaaauacuagaagaugacuugguauuuuaggaaaaaaacaaggcaggggguggggugucagugaauacaaggucucauguagcacaagcuggccucaaacuuccuguuagccagagaugacuuucaacuucugauccuccugccuccacguagggaguguugggaucacugugcuaccaggcccaguuguauacuguacuggaaacugaauccaccauggcuuuaugcaugcuaggggaacucucuaccaacugagcuacagccucaguguucagcaauauuuuaaagaaaauaacaccccugaaaagauauccuuaaauguucucuuacauuuccauagaaaagcuuuaaagauuauacagggacccaggugcagugguauucaucagcccggccuagagauaagaggauuaggaguuaaaggacaauuuggaguuuaaggucagccuuggccacauaaauccuugcaucagaaaaaaaaaauuauuaaaaaggagacaacaaaagcagaagcagauaauuguaagggcuuacaaaacuauuuaaauaaauagaugcuguccauacuucaggguggaaugaccuauuuuuacaauuuacagguguaaauuuguugggcuugguggcccaugccuuuaauccuagaacuugggaggcaggucucugaguuugaagccaucuugguaucaaguuucagaacagccagagcuacacagagaaaucuugucuugaaaaaagaaaaaaaaagaaagaaaaaacaaaaacaagagcaacaacaaaagacauaaaauucuucuauaguaacaaauucaacucaaccuaauaaaauucugcuuaggcuauguuuuaggaccugacaaugguucuuucuuuucagcccugggucagacacagccuugugcacugaggcaaguuucccaccacugagcugugucccaaacccuacaaaacucacucugugacaaagaauuaaaacuuauuaaagacacauuauuuuuaagauaggaaacggauggugagauggcucaguggguagggaugcuuggaccaagccuaauguucugaguucaaccccauuguagaaggaaauagauaaccuauugaacuuguccucucaccuccacacucaagccaagggauggauauaugcaugggcacaugccaaucaaucaaucaaucaaucaaucacccaaucaaucaauaaaauggagacucaauauacuaguuguuaaaacuuauuacaaaaguauaguaauaaaaauacuuuuaaaaacuugguuauuauuaaacaagaacaggaaaagaaccuuuaagcccaguccucgggagguagaggugguaguacgucuuacccagucgugaggcugagugggcuuuuggguuugcucuugaggaauugugugcugugucccuuaagaacgaccugacucagcugcccuuccugaccaugagcaugaaggagagucugaggcuacauccaccaggcucuaugaucucccucugcugcauccaggacauucuccuucuggaugaccuggucaucuccagcauuggugggcuuaggguucuggguagaaggaaggucacuaguggcagaacuaaccuuggacugacuguaguacccacccaacagggcacgucuguuaccagcaucuucaggagucaucacaauccuucagucuggccagacccugagguguaaaccccuccuuucauaacuaggauuugggaaccuggcaagaucaggauagagaggagguccggacacuggaaaccuaacgccugucuuccaccucugcccuuuccgggguguguacuaacuggguuugcugagaaacccaaaccaucugucgcucuugcucucucccagucuugccucucucccaggucucccuuucucucugacccagaaaacccggagaaguaggucaccacugauuucuguucccuucucggcaggguaagggugggacuccagagggcuuguggugucaggcuguugucuggggcugcuggagaggacaggcaaugguugggauggucgggguuccagaucgccuuccugcccucugcccagguaaagguuuagagagucaggauugaaaggguggacagauuagcucuguucuccuucugcuaaguauugugggcuuaagucugaguuagggucaaggguauguagaugucaaaaucgagucccggguaagccuucggugggaucaaucagguugcauggcuggguccugacauagucagaguccccacccuguccucccgcaggaauugcauaggacugacuuuuggccaugagugcaaugaagaugaugauggagcugacgcugacgcugcucgcuucugcguccugccaggugacaaggggccacgccggcuuucggcgcugaugcugcggacggagggcgggcuguggcugcagguggaacugcugacuccacaccggauuuggaaccgcucuacccacccaucucaucaggaucccagaaucaacagagcaguugcucaugcucgaaccucaccaaguaccagcagggggcgcgguggaaccaggcuggugccuuugaguccaagagccuuccuagcaucccugagcuauauagacuauccuauaagaaccacaguagaugucuaaacaucuagccuaggcccgacuguauggaccaggcuggucucaaauuugcagcaaacuucugcugagaccucaccacccgagugcugcauuuagaagagugggcuacuguacuuggcgugcccaaucugaaggaaauuuuguagaaauaaaggucaauuucccaagaaaggagccugggagccguugacaaugguguuaaaugacgucgagggcuagugauguccaagacgaguaaaacggcuucaauuuaacaugaccucacgcuggcaggcuuccugugugguggugugugcuuucagguucccacuuacuccucguggggcuggggagguggcucaguggggagacaggcggaucccagcgccucacuggccagccagucuugugaaaacaggaaacuucagagcguugaagccaaccugaucuacagagcuaauucuaggacagccagggcuacgcaaggaaauccugucugagaaaacuaaagggguaggaggugaagugggggaacuccaguucaaugagagaaucugucugaugaaauaaggugaacagaaauaaagacacuugaugucaaccgcca

SEQ ID NO: 8533 - RNA, 953 nt, Mus musculus
cuuagauacuuuguugacagacauuccuguggaagcuuuuaauuauagcauucuucagcuccuuauuccugaggcugaaaauaauuggacuaaggaagggggugaagacuguauaggugguggacaugaggguaucaguguacugugaguagaguccccuggacuugagguaaauuauggaggcaaagccguagugcacaaucacuacagugagaugggaugcacauguggagaaugucuugugccggcccucaguagaugggauucucaagauggcggccacaauaaagauauaggaaaggauaaugaagaccaggcauccuaugaggggugugacacacaccaggaucacagcaauagugacaaaggcuguccuuuccccacaggcuaacuuuaagagggaaaacacaugacagagaaugugauggaucacauuagauucacagaagguaaggugaaaaauuauuauugucaaugccaucccaauaagcgauccaccagcccaagaccaugccacaagccgagcacaaccuuggaggcucauaagugcaugauaaugcagggggcggcagauggccacauagcggucauagcccaugaccacgagcaggaaggagugaguguagccaaaugugaaggagaaaaacaauugguuagcacaagcuauaaaugugauggaucgauggguggauagcaugucagacagcauucggggcgugaugacgacagugaagagaauuucagaaauggagagggcacacaggaagagguacauggguguguggagucuauguucuguccagauagcagccaugaugaccagguuccccagaagagugaacaaauacaucagcaaguagagcaggaacagagcagggagcaucuggugugggaaggcugagaaaccaaagaggauaaauucugauauggugcuguaguucugaccgggcaug

SEQ ID NO: 8534 - RNA, 1241 nt, Mus musculus
auacagcauauuaagagggguuuauuagauugaauuacacagucagggcauggaaaauacagcagugcuacuuacagacugaaaagauugcuaaacaaguauacggcacaagagaggcacgauacaaaagcagucggaaccuaaggcuuggaagccucuugaagaguugcuaacauaagugaauacuggcaggaaaauugcaaguuuaaaacaaacaaaaccuuaaaguuuguucacuucagcuguccugcccacaguaugaugcuuauauacaggcuaggaacucccaaugucauuucacucauccucauguccauugcuucuugauacuuuauuagggucucauugugaaauggaguuuacauaaaaggugaccuucaaucuaaccacucaguuaagauuaaucaauaaacuaagagagaacaauagaucauaucccaagcccucgugauuacugauuuugaaaauuauuguguacauaugugugggcaacuauacauaccacagugaggguggaggucaaagacugcuuggaaucgggucuccucuucaucuuuuuugguuuuucaaaacaggauuucucuguguagaucuugcuuuccuagaacucuguagagcaagcuggccucaaacucagagaucugucugccuuggccuuccaagugcugggauuaaaggugugugccacuaucacacaucucaggucacuucuuuuacuaugaacccugggguuagaguucagaucaggguugugugguacuuuaacccaccaaaccaucuuacuggcccaugaauguuuuuaaaaccuuucuuuuguaauuacuccgucuauugguccgguggcugaaucacauuaauaugcucuuacauuuuaacaccuuugcaacgaauacaauauauagauauuuuguauucagucuuucauuuuacuuuugguuuucaaccuuaaaggcaagugacuuugucuuuccuuuguauuuauuucugugucucagcuuuuuaaaguaagauuuaucauuuuugugugugugcauuuguggggguauaugcaauuaucuuugagugcccacagaauccugaagagggcauuggaucugcuggaaucggauuuauaggcuauugugacccacccaaacccaggcacugggaagugaacuuagcaagugcuccuuacugcuaagccauuucuccagccccaugacucaguuauauuaaaugugcauaugucaugcacauggaag

SEQ ID NO: 8535 - RNA, 28100 nt, Mus musculus
uagucagagggugccgccauugccgcccuguuugaguccuguguagcuccagggaggcagguggugacuuggccugagucgcugucccuucugcugauuguaggcccuuuaggaagcacacugcucgcgugugaaaucaggaaauggugagugugcccuguguuccuggagucgugcguggcacguuggugacaucgcggaggcuuugucccuguguggugccgcggcacugacguucgccugauucugugcaggagucugucacccgcgcccucucacccacgugcguuuuaauuccgugcagagcaggcagcggggagccuggggucugguccugucgguccggcccugcccugccccgccccccuucugaagcagugucuucuaguccgcugugcucucgggugagacagcgccucuccagacugcaucgcuggcgaguuggcgugaugcucuguagcauuuagacuguugugaggggcuuugauaaacgcuguucguuccuuccuuccuuccuuccuuccuuccuucgugggcaucgaaccucaggcuuugcucauucuaggcaauccuuuuaccaaugaacuguaaaccuaucccgcauccugguuuuugcuguuagcguuaaugcaggaggauuuguuugcucccucugggcugagagugggaggaaugcuccggcuugcaaggaagagaggauuuucaauuugcuucaaaauuguuuggauucaccaaccaauugggcaauuaauugucuaggcacaggugaaauuugggggaauuuuuuuuuucuucuagcauugcuggcuguaaaaaaaaaagcaugagaugggaugaauaauuuaauuguaaaaacaaacaaaaacgugguagauucuuuggcuguggacuugaacagaagggaugagaggguuauaucuguuucuaucucaucguuaugaauauucguaaguuguuuauauccucuugauuuaauuuuagcuuguuguaugcgacucagaaucaaaccauuucuugcauauauuucuuuuccucgugggggguauuuuuuucaaaauacuaccaaaugguccacugcuuuucuuuuuuccugucuuuuuuuuuuuuagucucuugcaaccuccccuaauuuaugacuuuauuaauuugucucuucccucuuuuuuguuagcuugacuacaguuuugccuauuuuacuguuuuuuaaaagaaccauuucugagauugacauugacuguguguauucuuugagucaauuucaauaauuuuucaacuuauuuuuuacuucuugcugucuuuugcucuuaagucugacauuuuguuguuuuccuaagaccuuguguuugagccauuaaguugaacuauuuauucggcauucugaauucucaguguguguaugggaagccgcgguagcuuuuuuggcucuaaauugaagaugaacuuggaggguaaccagaggaaaauuuaaucgaguuuuugagguugagagggggaaagcagaaaacagggcaggcaagcuuuaaauauuggcauuugugguuaggcgagaaaacaaaacaaaaggaugccuuuuaaguucaacauggagaucagagaaacagugaggaagccaaggguguuaaggaaagcauauuuucuaaguguugagacuuggauuugaguucagaggggaccugauuuacagggucuuguuucauacacggaaggauuacaccagagacaaagucugagaaaaugugauccaugacauguugugagacauuugcaaaacauccaguuuauauaccaggagcuuuucuugagcgcgccccaguaagaaagggcuuaagaucuuccuuugcugacuggcuucuuucuuauguuaaucuucagguugcuuuuuguuuuauuuuguuuuuacuccuauuuugcauuuguauguaaacauuuguagcuaugagagguaugaaugagcuuaccucuugcuacugucuuguuuucccacuugaaaauagauuuucuaccuauauauuuauauauccugauugugguuucuucucccuuucccaucacaguucccuuucugauucucauuaggaaaacaaacaaaaacaacaacaacaacaaaaaaaaaacaaaccagguuucuaagguagaauaauaaaauguaguaagauaacaaaaauuaacauaucuaaauuggacaaaacaaacagaaggaaaagagcccaagagaacacacaagaaucagagacucacucccaugcacacucaggaaucccaaugaaaaacuggaaaccauaauauaugcagaccugugcaggcccuaugcauacugcuucagucucugaguucagacucaaguagauuuuagauggccuuguuuucuucauguucuccaucugcccccccccccccgucuuacacucuuucugcuuccucuuccaaaggguucccuaaaaucugggggacuacacagaccccuucaacuccuugggugcuuucucuagauccuccauugggggcccuguguuccauccuauagaugacuaugagcauccacuuuuguauuugccaggcacuggcauagccucauacgagacagcuguaucagggucuuuucagcaaaaucuugcugguguaugcaauagugucuggguuuggguuugguggcugauuaugugauggauccccgggugggguaguuucuggaugguccauccuuuugucuuagcuccaaacuuugccucuguuacuccuuccaaggguauuuuguucccuauucuaaggaggaaugaaguauccacauguuggucuucccucuucuugauuuucuugugauuugcaaauuguaucuuggguauucuaaguuucugggcuaauauccacuuaucagugagugcauaucaagugacuucuuuugugauuggguuaccucacuaaggaugauauccuccagauacauccauuugccuaagaauuucauaaauucauuguuuuuaauagccgaguaguacuacaguguguaaauguacuacauuuucuguauacauuccuuuguugagggacaucuggguucuuuccagcuucuggcuauuauaaauaaggcugcuaugaucauaguagagcauguguccuuauuagaaguuggaacaucuucuggguauaugcccaggaaagguauugcuggaucuucugguaguacuauguccaauuuucugaggaaccaccagacugauuuccagagugguuguaccagcuugcaaucccaccagcaauggaguaguguuccucuuucuccacauccucaccagcaucuacugucaccugaauuuuuucucuuagccauucggacuggagugagguggaaucucaagguuguuuugauuugcauuucccugaugauuaagaauguugaacauuuuucuaggugcuucuuagcccuucaguauuccucacuugagaauucuuuguuuagcucaguaccucauuuuuuaaugggguuauuugaauuucugaaguccagcuucuugagcucuuuguauauauuggauauuaguccccuaucaguuuaggauugguaaaaaaaauccuuucccaaucuguuaguggccuuuuugucuuauugauauugucuuuugccuuacagaagcuuugcaauuucaugagguuccauuugucaauucuugaucuuacagcacaagccauugcuguucuguucaggaauuaucccccugugcccauaucuucgaggcuuuuccccacuuucuccucuauaaguuucagugucucugcuuuuauguggaguuccuugauccacuuagacuugagcuuuguccaaggagagaagaauggaucaauucacauucuucuacaugauaacugccaguugugccagcaccauuuguugaaaaugcugucuuuuuuccacuggaugguuuuagcucccuugucaaagaucaaguggccauauguguguggguucauuucugcaucucgacucuauuccauugaucuaccuguguguugcuguaccaguaccaugcaguuuuguuuuguuuuguuuuguuuuguuuuuaucacaauugcucuguaguacagcuugaggucaggcaucgugauuccaccagagguucuuuaguuaguuuuugcuauccuagguuuuuuuguuuuuccagaugaauuuguaaauugcucuuucuaacucugaagugaagaauugaguuggaauuuugauggggauugcauugaaucuguagauuaauucggcaggauagccauuuugacuauauuaauccugccaauccaugagcaugggagaucuuucuaucuucugagaucuucuuuaauuucuuucuucagagacuugaaguucuuaucauacagaucuuucacuuccuuaguuagaguuacaccaauguauuuuauauuauuugugauuauugugaaggguguugucucccuaauuucuuucucagcccauuuauucuuuauguagagaaaggccauugauuuguuugaguuaauuuuauauccagcuacugcacugaagcuauuuaucagguuuaggaguucucugguggaauuuuuagggucacuuauauauacuaucauaucaucugcaaaaagugauauuuuugccuucuuccuuuccaauuuguauucccuuaaucuccuuuuguugucgaauugcucuggcuaggacuucaaguacuauauugaauagguagggagaaagugggcagccuugucuagucccugauuuuagugggauugcuucaaguuucucuccauuuaguuugauguuggcuacugguuugcuguagauugcuuuuaucguguuuagguaugggccuugaauuacugaucuuuccaagacuuuuaucaugaauggguguuggauuuugucaaaugcuuucucagcaucuaacgagauaaucaugugguuuuugucuuugaguuuguuuauauagugaauuaaguugauggauuuccguuuauuaaaccauccuugcaucccugggaugaagccuacuuguucaugauggaugauuguuuugauguguuccuggauucagagaaacuuuuucuuuuuccuuuuuuuuuucucccucccucccucccucccucccucccucccucccucccucccucccucccucucuuucuuucuuucauuuuuucgagacaggguuucucuauauagcccuggcuguucuggaacucacuuuguagaccaggcuggccucgaacucagaaaucggccugccucugccucccgagugcugggauuaaaggugugugccaccacgcccagugagaaacuuuuucuuaugccaacgaguucaaggcuauuucccacuuuuucuucuaucagguucaguguaucuggcuuuaugcugauguauuugauucauuuggaguugaguauugugcaggguaaugaauaugaguguguugcaauucuuuuauauacagcuaucuugcuugaccagcacuauuuguugaaggugcuuucuuuuucuauuuuauauuucuggcuucuacauuaaaaaaaucaguuguccauaauaugugugguguuuugaauagguagagccccauagacucauguauuugaaugcuugguucauaggguguggcacuauuaggagguguagccuuguuggaguggguguggccuugcuggugaagugugucacugugggggcaggcugugaagccuccugugcucaagcuauacucaguguggcacacaguuuccuucugcugccuggcgaucaagauguagaacucucagcuccuguaggaccaugucugccugcauguugacauucuuccuguuaugauaauaauggacuauaucuuugaaagccagccccaauuaaaaguuuuccuugauaagaguuguugugguugugcuguuacuuaacagcaaugaaacccaaacuaagauaauagguguguuuguuuauaucugggucuucaaugugauuccauugauaauugugucuuguccaauaucaugcuguuuuuguacagcucuauaguacaacuugaaauuggggauggugauaccuccuugcaguucuuuuauuaauugggauuguuuuaacuauccuggguuuuuuauguuucuauaugaagcugaaaauuguucuuugaagaucuguaaauuauuguguggaauuuugauggggauugcauugaaucuguaaauuaguuuugauaagaugaucauuuuuccuauauuaauccuagugauccaugagcaugggagaccuucccaacuucugaugucuucuuuaauuaaaguuuuaaucauacaggucauucauguguuugguuagaguuacccccaagauauuuuauauuauuugaagcuauugcgcaggguguuuuuccgauuucuuucucagacugcuugguuuuuggugugugugugugugugugugugugugugugugugugaaggcuacuaauuuuugugacuuaauuuugucuccagcuacuuugcuggaggugcuuaucaacuguaggaguacccuggcuacccugguggaaauuuuaggauuauuuuguguacuauuauauugucugcaaauuaaugauacuuugauuucuuucuuuccauuuuguaucuccuugaucuccuuuaguugucuuauugcucuagccaaaacuuaaaaguacauauauagauauggagagaguacgcaacccugucuuguucuucuuuuaguggaauugcuuugagcuucuuuccauuuaacuugauguugacuaucagcuugcuauaaacugcuucugguauguugagauauguuauuaguauuccuaaucucuccaggauuuuuauuaugaagggacauuggauuuugucaaaggccguuuuugcagcuaaugagaugaucgcgcgcgcgcgcgcguguguguguguguguguguguguguguguguuuucuuuuagguuuuuuuuuuuuuauuuggugguuuacauguauuaauuuauguguguugaaccgccccugcaucucugggaugaagucuacuugaucauaguggauaauuuuugugauguguucaauucaguuugcaacuauauuguugagaauuuuugcauauaugcuuauaagugaaauugaucaguaauuuucuuuauugaaaguaaauuucuuauuuuuuuuuauaaguuuagauaucaugguaacuguugccugguaaaaagaauuaggcaguguuccuucuguuuuauggaauaauuggaggaugguugguauucauucugcuuuuaaaaccugauagacugauuuccagagugguuguaccagcuuaaaaucccaccuacaguggaggcauauuccuuuuucuccacauccucaccagcaucugcugucaccugagguuuugauauuagccauucuaauuggugugagguggacuuucaggcuuguuuugauuugcauuugcugaugacuaagaauguucaacauuucucuaggugcuucuuggccauucaauauuacucaguugaaaauucuuuguuuugcucuguacuccauuuuuuaauaggguuauuugguucucuggagucuaacuucuugaguucuuuguauauauuggauauuaccccucuaucagauguaggguugguaaauaucuauucccaaucaguugguugccauuuuguccuauugacaguguccuuugcuuuacagaagcuuugcaauuuuaugaggucccauuugucaauucuugaucuaaaagcauaagccauugguguucuguucaggaaauuuuccccuaugcccaaguguucaaggcucuuccucacuuucucuucuauuagauucaguguaucugguuuuauguggagguccuugauccccauagacuugagcuuuguacaagcagauaaaauggaucaauuugcauucuucuacuuguugacugccaguugaaccagcaccauuuguugaaaaugcugucuuuuuuuccacuggaugguuuuagcuccuuugucaaagaucaagugaccauagguguguggcuucauucaugcaucuucaauucuguuccauugauguaccuaccuguuucuguaucaauaccaugcaguuguuaucacuauugcucuguaguacagguugaggucagcgauggugauucccuaagaaguucuuuuauuauugagaauaguuuuaacuauccuggguuuuuuguuuuuccaaacaaaugaaucugaaaauugcucuuacuaacucuaugaaggauuaaguuggaaguuugauggggauuacauugaaucuguagauugcuuucugcaagauggccauuuugacuauauuaauccugccaacccaugagcacgggagagcuuucccucuucugagaucuucuucaauuucuuucuucagagacuugaaguucuugucauacagaucuuucacuuguuugauuagagucacaccaagguauuuaauauuauuugugacuauugugaagggugucauuucacuaauuucauucucaguccguuuaucauuugaauauaggaaggcugcugauuuauuugaguuaauuuuacauccagccccuuugcugaaguuguucaucaguuuuaggaguucucugaugggauuuuuggaguuacuuaaguauacuaucauaucaucugcaaauagugauauuuugacuucuucuuuuccaaaaggaguucaaaggauauacuucaaguacuauauugaauagguagggagagagaggacagccuugacuagacucugauuuuagugggauugcuucaacuuucucuccauuuaguuugagguuggcuacugguuugcuguauauugcuuuuacuaugagcacaauuguggcuucauagaauaaguuggauaauguuccuucugguucuauuuuguggaguaguuugaagaguauccauauuaggucuucuuugaaggucugauagaauucugcacuaaacccaucugguccugggcuuuuuuuucgguugggagacuuaauaacugcuuuuauuucuuuagggguuaucuggcccugauuuaacuucgguaccugguaucugucuagaaaauuguccauuucaucuggauuuucuaguuuuguugaguauagauuuuuguaguaggaucugauguuuuuuuguuuguuuguuuguuuuuuguuuuuuuggauuucuuuguuuucuguuuuuaugucucccuuuucauuucugauuuuguuaauuuggaauacuguaucugugcccucugguaagucuggcuaauggcuuaucuaucuuguugauuuccucaaagaaccaucuccugguuugggugauucuuuguuuaguucuuuuuguuucuacuugguugauuuuagcccugaguuugauuauuuccugcaucuccuccucuuggguguauuugcuucuuuuuguuuuaaaguuuucagaugggcuguuaagcugcuaguguaugcucucuccaguuucuuuuuggaggcacuuagagcuacgaguuuuccuccuaguauugcuuucauugugucuuauaaguugggcauguugugccaucaguuucuuccuugaauaaaauaucaaugaauagaggauuguucagcuuccauguguaugugggcuuuuuguuguuauugaagaccagccuuaguccuuggugaucugguaggaugcaugggaucguuucaaucuuguaucuauugagacauguuuugggcccaauuauaaggugaauuuuggagaagguaccaugagguacugagaagguauauucuuuuguuuuaggauaaaauguucuauaguuaucuguuuaauccauuugguucauaaauucuguuaguuucacuguaucuuuguuuaguuucuguuucggugauguguccauugcugaaaguggaguguugaaguccccuacaauuauuaugugagaugcaaugugugcuuugagguuuaguaaaguuucuuuuaugagugugugugcccuugcuuuuggagcauagauguucagaauugagaguucaucuagguaguuuuuuccugugaugaguaugaaguuucucuccuuaucuguuuugauaacuuuugguugaaaguugauuuuauucaauccuagaauggcuauuucagcuuguuucuuggaaacauuuguuugaaaauuuguuuuccagccuuuuacucugagguagugucugucuuugucacugagguguguuuccuguaugcagcaaaaugcugcauccuguucucauauccagucuguuagucuaugucuuuuuuuugcccgggggggggguauugagucacuaauguuaagagauauuaaggaauagugauuguugcuuccaguuaguuuuauuguuagaaguggaauuauguuuguguggcuaucuuauuuuggguuuguugaaagaagauuguuuucuugcuuuuucuagagugcaguuucccuccuuguguuggaguuuuucaucuguuauccuuuguagggcuggauuuguggaaagauauuguguaaauuugguuuugucauggaauaucuuguuuucucuauauaugguaauugagaguuuugcuggguauaguagccaguguucuuuuaguaucuguaugacaucugcucaggaucuucuagcuuucauagucucuggugagaagucuggcauaauuuugauaggugugccuuuaucuguuauaugacuuuuuucccuuacuguuuuuaauauccuuucuuuguuuagugcauuugauguuuucauuauuaugugauggaggcauuuuguuuuuucugguccaaucuauuuggaguucuguaggcuucuuguauguucaugggcauaucuuuauuuagguuagggaaguuuucuauaguucuguugaagauauuacuggcccuuuacauugggagucuuagcucucuucuauaccuauuauccuuagguuuggucuucuccuuggguccuggauuuccugaauguuuuggguuaggaguuuuuugcauuuuugcauuuucuucgacccuugugucaguguuuuuuaugguauuuuuugcaccugagagucucucuucuaucucuuguauucuguuggugauucuugcaucuaugacuccugaucucuuucccaguuuuucuaucuccaggauugucuuccuuugugauuucuuuauuguuucuauuuccauuuuuagacucuggauggcuuuguucaauuccuucaccuguuugguuuuguuuuucuguaauucuucaagggauuuuuguguuuccucuuuaagggcuucuaccuguuuuccuguguucuccuguauuucucuaagggaauuauuuaugcccuucuuaaaguccucugucagcauaaugagaugugauuuuaaaucugaaucuugcuuuuccgguguguugggguauccaggacuugcucuggugggaaaacuggguucugaugaugccguucuuguuuucuguuaguaggguucuuguacuugccuuuggacaucugguuauuucuuguguuacuugguccugcugucucugauugaagcuuuuaccuccugugggccuguaagcuugugucagaacuccuggugaaaccagcucgcucauggguagguuuuguguguggaggguugugggacaacucuaagucucgagugcagagggagaccagaaggaucuuguccucagcugcugcacucuuucugugcccugugcacuccuggcagguccugcuuuggacuguuauugggguaaaaguggugauuucaccucugagcuuaggagugagaguacucccgggguaccagcucucuccugacuggauuugugcgcagagagcuguggggcagacuuaggucuggagugcaaauggagaccggaaagauccuaucccccagauuuagacuuuucauggugaccaaguuuucuggauguuuguccuguaaguuuuuuagauuuaacauuuucuuuguuugagguaucccuuucuucuauuguguauccaaugccugaaauucuuuugcccaucucuuguagucuauuagugagucuuuauguuuccuguucaaauuccuaaauuuuucauuuccugauauuagcauuauccaucaucaucaucauuauuuuuccauuaucaucaucauuauuauuaugccuuuucuuuauucuaguucuacuuucaggucuugaacuguuuauuucauuuccuuccacuguguuuucuagauuucuuucagggacuuuucucucuuugaggcccauuuucauguucauaagggguauuuuaaaauauuuuucuugugcugcagcuguguuauaauacucagggucuucgaugguaggguugcugggcucuagggcagacauauuguccuggcuguuacuguuuuuauguugccaucuaggcaucuagguuugggaagauuguagugcuaggugcuaauauuuggucaucuuuguugggucaguguuuuguuccuugguuucuguugucaccucugguucucaggagaguaugguggcucuguugccugauagcuguggucacuagggauuccagguaaaauguguuucuggguauugugaccugacaguaguaauuggguaugaguuaggauagaggacuaaaggguccaaaagagggcgcaaagcaggguaucucacuagggucugcuuugucuccugggaaugagggcacagaguaaggaaaggucacagcaggucugccaccaagcugaggauaagaaugggggauuggacuuggagggauggagggaaagggaaaggucugaauuauuuagucuuccugcuuuucuggccgauguggcccacugguuaacagagaaggucuuuuggauuugggggcuggauuaaagcagaguggggugaaggaaauuuagaaaggaagaucugugugaucccuuggagaaggagacagagaggaaggggaagcugcagagcuuggcaugagaggggaaaggauuggauuuggaagaccagagagagaaaugaagauaugcaguuagccugccugcuggaguuagaggaacuuuagagaagaagaucugugagaugcauuggggucgugggggaagagaggcuucauuagguggucugcaacauaucuaagacuggaguauugguuuuggaggaccagaggagaggaucuauuuugcuaauaauucccaccaaaauuaauaaccagugguuguauauuucuggaguaacuacucaggaagacgaggaagaaaauugaugaaacgugacucuaacguguaggcauaaauuuuuguaacauuuuuaauaaggguuccacuucuccuuuagucuauuacccagcagagguaguggaagagaaaagcuauuaggacaugggggaagugggccuguuuaguaauaguucuuuggggugagcucaaucuuuucuuuuaguaguuuagcccuguagcacacaccaauuaucacuuaguagcuguagacaaguccuaggcaggcagacagcacauuuaccuucugaggcauuuguccuuacaugugguuuuuguacucuacauuaaaaaaaaauuguuacacugugugugugcgcacaugugugauauaucaaggagugauggggacauucugaaaaauuuguucuccuuaugucauugccuauugacauucuucaauaaaauuauaguauuuguauacuagcuuagaaaauuucccugaugaaucuucuuuuuuugggggggcauauauauauauauauauauauauauauauauauauauauauaugcacauacauauauauaaagaaauuuauuuucuaaugauaaaucuugugguuugaacauuucuuuuuuuuguuuuuuuuugaauuagguauuuauuucauuuacauuuccaaugcuaucccaaaagucccccacccacccauucccacuucuuggcccuggcaguccccuguacugaggcagauaaaguuugcacgaccaaugggccucucuuuccacugauggccaacuaggccaucuucugauacaugugcagcuagagacaugagcucuggggguacuggguaguucauaaugcuguuccaccuauaggguugcagaucccuuuagauccuugguuacuuucucuagcuccuccauugggagcccugugauccauccaauagcugacugugagcauccaauucuguguuugcuagguuccagcauagucuaacaagagacagcuauaacuggguccuuccagcaaaaucuugcuaguauaugcaauggauccauccccugauugugggauggaucccuggauauggcagucucuagaugguucauccuguugucucagcucugaacugugucucuguaacuccuuccauggguguuuuguucccaauucuaagaaggggcaaaguguccacacuuuggucuuaguucuucuugaguuucauguguuuagcaaauuguaucuuauaucuuggguauucuaaguuucugggcuaauauccacuuaucagugaguacauauugugugaguuccuuugugaauguguuaccucacucaggaugaugcccuccagguccauccauuuggcuaggauccauaguacuauguccaauuuucugagaaacccucauacugauuuccagagugguuguacaaacuugcaaucccaccaccaauggaggaguguuacucuuucuccacauucucaccagcaucugcugucaccugaauuuuugaucuuagccauucugacuguugugagguggaaucucaggguuguuuugauuugcauuucccugaugauuaaggauguugaacauuuuuucaggugcuucucagccauuugguauuccucaggugagaauucuuuguuuagcucugagccccauuuuuaaugggguuauuugauuuucuggagugcaccuucuugaguucuuuauauauauugguuauuaguccccuaucuauuugauuuaggauagauaaagauccuuucccaaucuauugguggccuuuuugucuuauugacggugucuuuugccuuacagaagcuuugcaauuuuaugaggucccauuugucgauucucuaucuuacagcacaagccauugcuguucuauucaggaaauuuuccccuauacuuauaucuucgaggcuucuccccacuuucucgucuauaaguuucagugucuaugguuuuauguggaguuccuugauccacuaagauuugaccuuaguauaaggagaaaggaauggaucaauucacauucuucuacaugauaaccuccauuuaugccagcaccauuuguugaaaaagcugucuuuuacacuggaugguuuuugcucccuuuucaaagaucaagugaccauaggaguguggguucauuucugggucuucaauucuguuccauuggucuacuugucuguugcuauaucaguaccaugcaguuuuuaucacaauugccauguaguacagcuuuaggucaggcauggugauuccaccagagguucuuuuauccuggagaagaguuuuugcuauccuagguuuuuuguuauuccagaugaauuugcagauugccuuuucuaauucauugaagaauugaguuggaaucuugauggguauugcauugaaucuguagauugcuuuuggcaagauagccauuuugacuauauugauccucccaauccaugagcaugggagauguuuccaucuucugagaucuuuaauuucuuucuucagagacuugaagaucuuucacuuccuaauuuagaguuaugccaagguauuuuauauuauuugugacuauugagaaggguguuguuucccuaauuucuuucucagacuguuuauccuuaguguacagaaagaccauugacuuguuugaguuaauuuuauauccagcuacuucauugaagcuguuuaucaggcuuaggaguucucugguggaauuuuuagugucacuuauauauacuaucauaucaucugcaaaaaagugauauuuugacuucuuccuuuccaauuuguauccccuugaucuccuuuuguugucgaacugcucuggcuaggacuucaaguacaauguugaauagguaggaagaaagugggcagccuugccuagucccugauuucagugggauugcuuccagcuucucaccauuuaguuugauguuggcuacugguuugcuguagauugcuuuuaucauguuuagguaugggccuugaauuccugaucuuucuaccacuuuuauuaugaauggguguugaaucuugucaaaugcuuuuucugcaucuaaugagauaaucaugugguuuuugucuuugaguuuguuuauauacuggauuacguugauggauuucuguauauugaaccaucccugcaucccugggauagaaccuacuuggucaggauggaugauuguuuugauauguucuuggauuugguuagcuagaacuuuauugaggauuuuugcauugauauucauaagggaaauuggucugaaguucucuaucuuuguugggucuuucugugguuuagguaucaggguaaguguggcuucauagaaugaguuggguagaauaccuucugcuucuauguuguggaauaguaugugaagaacugggauuagaucuucuuugaaguucugauaaaacucugcacuaaaccuaucugguccugggcuuuuuuugguugggagacuauuaaugacugcuucuguuccuuucuuuuuuuuuuuuuuuuuuuuugguuuuccgagacaggguuucucuguauagcccuggcuguccuggaacucacucuguagaccaggcucgccucgaacucagaaauccgccugccucugccucccgagugcugggauuaaaggcgugagccaccacaccuggcuagcuucuguuucuuuaggggauaugggacuguuuagaucauuaaccugaucuugauuuaacuuugguaucugguaucugucuagaaacuuguccauuucauccagguucuccaguuuuguugaguauagccuuuuguagaagaaucugaugguguuuuggauuucuucaggaucuguuguaugucucccuuuucauuucugauuuuguuaauuaggaugcugucccuauguucucuagugagucuggcuaaggguuuauccaucuuguugauuuucucaaagaaccagcuccuuguuugguugauucucugaauuguucuucuuguuuccacuugguugauuuugucccugaguuugauuauuuccugcccucuacuccucuuggguuaauuugcuuccuuuuguuuuagagcuuuuagguguguugucaagcugcuagugugugcucucucuaguuucuuuuuggaggcacucagagcuaugaguuuuccucuuagaaaugcuuucauugugucccauaaguuuggguauguuguggcuucauuuugauuaaacucuaaaaaguccuuaauuucuuucuuuauuccuuccuugaccaagggaucauugagaagaguguuguucaguuuccacgugaauguuggcuuuccauuauuuauguuguuauugaagaucaaccuuaauccauggugaucugauaggaugcaucggacaauuucaauauuuuuguaucuguugaggcuuguuuugugaccaauuauguggucaauuuuggaaaagguaccaugaggugcugagaagaaggcauauccguuuguuuuaggauaaaauguucuguagauaucugucaaguccauuuguuucauaacuucuguuaguuucacugugucccuguuuaguuucucuuuccaugaucugucuauuggugaaggugguguguugaagucucccacuauuauugugugaggugcaaugugugcuuugaguuuuacuaaaauuucuuuaaugaauguggcugcccuuguauuuggagcauagauauucagaacugagaguuccucuuggaagauuuuaccuuugaugaguaugaagugccccuccuuuuuugaugacuuuggguuggaagucgauaucauuagauauuagaaugguuacuccagcuuauuucuucagaccauuugcuuggaaaaguguuuuccagccuuucauucugagguagugucugucuuuuucccugagaugaguuuccuguaagcagcaaaauguugggucuuguuuguguagccaguuuguuagucuaugucuuuuuauuggguaguugaguccauugauauuaagagauauuaaggaaaaguaauuguugcuuccuauuuuuuuuguuguugacguuggcauucuguucuuguggcugucuucuuuuagguuaguucaaggauuacuuucuuguuuuuucugcgacgugguuucuguccuuguauuguuuuguuuuguuuuguuucuuuucuguuauuauccuuuuagggcuggauucauggaaagauaaugugugaauuugguucaguccuggaauacuuugguuucuccaucuacaguaauugaaaguuugucuggguauaguagccugggcuggcauuuguguucucuuagugucuguauaacaucuguccaggaucuucuugcuuucauauucucugguaaaaaaucugguguaauucugauaggcuugccuuuauauguuacuugaccuuuuucccuuacugcuuuuaguauucuaucuuuauuuagugcauuuguuguucugauuauuauguguggggaggaauuucuuuucugguccagucuauuuggaguucuguaggcuucuuguguguucaugggcaugucuuucuuuagguuugggaaguuuucuucuauaauuuuguugaagauauuugcuggcucuuugaguugaaaaucuucauucucaucuacuccuauuaucuguagguuuggucuucucauuguguccugaauuuccuggauguuuugaguuaggaucuuuuugcauuuuguaguuucuuugauuguuguacugauguucucuauggaaucuucugcaccugagauucucuuccaucucuuguauucuguugcugaugcuuacaucuauaguuccagauuucuuuccuaggguuucuaucuccauuguugccucacuuggguuuucuuuauugugucuacuuuccuuuuuaggucuaguaugguuuucuucauuuccaucaucuguuuggauguguuuuccuguuuuucuauaaggacuugcaacucuuuagcagaguuguccuguauuucuuuaagugaguuauuaaaguccuucuugaugucuuuuaccaucaucaugagauaugccuuuaaauccaggucuagguuuucggguguguuguggugcccuggacuggcugaggugggugugcuggguucugaugauggugaguggucuugguuuuuguuaguaauauucuuacgucugccuuuugccaucugguaaacccuggagucaguuguuauaguugucucugguuagagcuuguuccucuugugauucuguuauucucuaccagcagacaggguagacuagcucucuucccgaguuucagugggcagagaacucucugcaggcaggcucuacucuuucagggaagguacacagauauguggcguucagacuugccuccuggcagaagaugaaggcuggaaacaggaccugucccagaagcugucagcuucuguaguccacacucucaccuuugcagacuaguggaguccgggagccaagauaucuccugcagaugcucaggcaaagcccucuccguccuggcggacaccuauccucugucagggaaggugcccagaugacugugcagaguagucucaauggagucugggauccaagaugucucccguagaugcucaggcaaaguccucccuggcugggcagacaccuauccucugugcagaguagucuagguggagucugggauccuaaccugaugaaucuuuuuuagaauuuaaaugaaagcuggucugaaaacugauucuaacccauacagcucuuuaagaaccuagugcacccuucuugaagaugucuucagugaaauuauaaguggauuugguuuuuguuugguuugauuauuuguauguuuauaauauaaguugguggcuauacguacauacauacauauauacauacauacauauauggcacauauauacucauauauguaaucuguuauuucagaaggauuuuaaacuuucuauuuguaagaguuuucuccucuauuauaaucuuguauuccuauuaugguauuggccucacaggguaaggaccacuugcccaaacgugguaaugcauacaaugaauugggcccauacaaugcauggcuaugcuaccauccucuggagcacagagagugugggucagagacaggcuucagaaguuaguucucuucuuucagugaugcaacucaggcugccaauuuggcugcagguuuucuuaucugaccuugguguaacacacuuugacagaagauguuucauguuaucuaucauaccagaggagguuguuuauauauuuuuuauuuuaugagaauuauaugcauaauauaauaaugaucauaucugccuuccauuuuccaccucuaacauccuaacuguccuuccuaacaugccccuccccaacuucaucucuuuuuuuuucuuccuuauaaggcauuaagcucauuuaguacaucccauaugugcgugcacugguaugguaccauccacuggagcauaggaaacuaccaguggccacacccuaaaagaagaaugcuucuccauccuccagcagcuacccacugccagcaacuccuuagugaaggugggaacauggagagaauuucccuauuuaugccagaaauuuggcuggguugaucuugugcggguaaccauagcuguuguaaauucaaaaguacaauagccauguuauguucagaagucagcauuuuauagcacuccuguccacccucuggcucuuaaauucuuugcaccucuuucugauguucucugagccuuggagggguggaaguggaguugauaaaaauauuuuguuuagggccgacauucucagucccucccucccucccucccucccucccucccucccucccucccucccuuccuuccuuccuuccuuccuuccuuccuucccuccuuuccuuccucccucccucccucccuuucucccuucccucccucccucccucccucccucccuucccuccuuuccucccucccucccucccucccucccucccucccuucccuccuuuccucccucccucccucccuucccuccuuuccuuccuuccuuccuuccuuccuuccuuccuuccuuccuuccuuccuuccuucuuuuuugucaagguuuuccuacguagcucuggggguccuggauuucgcuauguaaguuaaggcuggccuugaauucauggagaucuacuucugccucuugaguauggcauuaaaggcaugugccaccaugccuggcaaauucucagucuugauaagaaagaguucauccagauuuccauuggguuuugaucagagaaaaucucuuagcaugucagaaacaggcaaaaaguuggaaagauacuaggaguacuucaaauacuauauuguuauaaagcauugcauggcagugacuccccuuuuacuguuaagcugguuguaucuauuccaaugauuguccucagucuucauaauuaacuauuauugacaaguagacauuucuacuaacauacaggcucccuagagcuggugucuacucugauggauuccaaauuaauaaagaugcaggauucagagaguacugaggcuaacaucacaagagauagucauguucugguauuuguuuaucauauaguuccauauuagcaucaggauugugugacagugugagaguuagaauaaauagaaaaugaguauuuacuauuuauaaauacuaaaaguaaugucaaccaugaugcauaggaauauaugaagaacaaaucaugaagcgaggcaaucaagucacacuguguuuccaguguuucuucaccauuagucuuguaaauguauguggauuauuuuaggaaccagugaccuuugaggauguggcugugaacuucaccuuaggagagugggcuuuguuggauucuuaucaaaaggagcucuacagagaugugaugaaggaaaccuuuagcaaccugaucuccauagguaaaaaauacagcaugauaacuuuuccuuguucacucagaaaaauaacuguuucuuauucaucuguguacuugcauaauuugaaauacugaaagcuguuggugaauauugcaugccuuguuacauuguaccacagaguguggggggaaccagaauguaaugauuuuuaauguaauguugaauauaauacuuucuuuggguuuaccuuucagggaaaagcgaggaagacaauauugaagauuaccaaaauauuaggagaaauuugagguaauguauucucaaagaaaacgaguuuacaucaaauacuugaaaguuauaggaaaucugagccucaaguaaauaauccaaauuuacaaauuugcuuaaugugaacugcauugaauuugaccauucagaauuggggaaucccaacucuguacuggaacguugcacaauauccugcaacuuuacacuguaugagacauuuuccaauucucucauuauacagaaacuuuuccuuuaaauaugaaauuauuuaauauauucuuagacuuggaauauaaaauacaugucugggauauauugugacacaccuucauaaaauuccauuaaaaauauucaucuaugucaauuccauaaaaccugacccucaucauuuugcauagugaacauucaauuuugguaaauugggaaagauaugagcuagccaugaaauaaggauaaguaaagaacaaagucugaaaugagcaaaauaaaccacuguguaucuacuuaucuaccacuguguauuacagcuuuuuguaaauguauguguugauuguuuuaggagacagcaaugauauuagagaaacuaagaagauuguaugauguccucagggccuguaguucaguguucaguccuuucagguuuauaaauuguuuucccuuaauaugaggucuuucuuugugacucagguugaccucaaacuugcaguugcucaaccuuuacccucuaaguauuacaauaacaaguguggcaaacccagccuccaacacuuuucgggcuagccauaagacuauaguacuauucuuuuuuuuuuuuuuuuucagcacucucaugguugaaggauucuaugaauuugaacgugguauucaguauagagaaaugcaccaacagauucaagagcauaucguuaauaaguacauaccucccggaauaguaguauaugaaaacagugcaaguaaaaaugaugucauuggucuuucacagucagaugugcaccucagacuacuaacuguagagaaaccauaugaguaucagaaauguauggaaaagccuauuaagcauaagaaauauuggaaagaucuugcauauucugagucuuuucuugcccaugagaauccucccaaagagaaaccauauggaaauaaacagucuaaugaccccuguaggagucucacuucugaucaagauuaugagacaacacauacuggugauaaccuccaugaauacaagcaauuugaaacggcuaucaugacauguaguuauggucagucauaugaaagaauccaaacuggagaaaaaccauuuguguguaagcaguguggagaagccuuuguuaauuccagucaccuuaucaaacauuauaaaauucauaccagagagaagacauuugcauguaaauauugugggaaagcuuucauucauccaagggccuguuauaaccaugaacgaacucauacuggagacagaccuuauguguguaaacaaugugggaaagcauguauucauucuuaccaccuucuccaacaugaaagaagucauacccgagaaaaacuuuaugcguguaagcagugugggaaaguauucggacguucuucguaccuucgcaaacaugaaagaauucacacuggagagaaaccguauuuauguaagcacugugggaaagccuucagugaucccacaacccguaacaaucaugagagaacucauaccggagagaagcacuauguuuguaagcagugugggaaagcauucauucguucuucucagcuucugauccaugaaagaauucacacuggagagaaaccuuacuccuguaagcacugugggaaagccuucaccuauuccagugccuguuacauucaugagagaauucacacuggagaaaaacccuauguguguaagcaguguggaaaagcauuuacauguuccacauaccuucacaaacaugaaagaauucacacuggagagaaaccguauucauguaagcaaugugggaaagccuucauccaacauagggcuuguuacaaucaugaaagaauucacacuggagaaaaacccuaugugugugugcaaugugggcaugcauucacuuuuucaaaaucccuucaaauacaugaaagaaaccacacuggagagaaaccauauguauguaagcagugugggaaagccuucacauguucuacauaucuucaccaacaugaaagaacucacagugaaaagaaaucuaguggguagaacuuauaccaauguaaaucauuugagagucuuuguauccagcuugcuguuauuacaagaaaagaaggaaguauggagagaaaccaagagaauaugagcaauuguguaauuuuuacuuacaaugcaaguauacauaggcuauaaagccuguuguaccaggcuuguugguuuauggccuuuuauucuaacaccagggcaauggaaguuuagagaauuacaacauucaguaaccuuaggcuaccugaaggguuugagcaaugcuugagagauuuaagaaguaccauuucuaaccaaaugaaauugucauuguacaaaauaaaaguguacauuuuaaaugagagucauuacauuuuuuucauggaguucaauauuguauaagcaagaaauauugugaagaaacagaggcaguuuuuuguaaacucuuaguuaaaaccugaaauacacuaaaacuguaauaaaugauuuauuuuuguuccauucuuaagcauauacuuaaaaauaacugaaaaacuuuuaaaauaugguuuagcaaauaaaauaacuuuggcauuguuucaccugccuguuuuuuuccaauggcuggaaaacuggggcagaacagggacuuuagcccacaguugcaauccacaggauacgcuguaaggaacaaugguagcaucuguauaaagaaaccacuugcauuuuggugauaaaagacuguuugguaaauuauuaaauuucaauuuacuggcugcuguuuuuaaaacaaguaaugcaguuucuuuuguuagacggcuguauucgauuuguuaaauucaaauguauuuguaauccuccaguauauuuaauuuuuagguacauuuugaguaaucuuguuuccuguaaaguuaugaagguauacuuguuguuaguguucuucaggcuguuauuuuauggcauguuauuuuuugauaauauuaauuauuuugcaguuucuuuacauuuaggugcauacuugagaguaacuuuguacauagauuuuauauuuuguaguuuuaauguauguuuucuuccaauacguuuuugguauuuuauuauuuauuuuguacaaguauguuugugugugugugccgcagcacagguauggagaacauucaagaguugcuccccuaccaggccuccuuagcaagcaccuuuacucauugagccuuaucaucagccccaaauaugauuuuugcccuguuguuuucuuuuauuuuuuugagacauagucucucuaggaccucacuacagauaccagacuggccuugaauugcagagaucugccugccuaucugccucccaauugcugaaauuagaaaagugugugugccacuaugucuggcugauuuuuauacauaauuuacauucuuuagcuguuuucuaguaaguagauuaaagaguguuagcuuuccuauugacucagaagggaccuucaguuacucuuucauauucaacaguuuaaaauugaauuaucuuuauauguuagaacccauugucacguugaagaguuugaaacugauguguaucauguaauuucugccuuauguuuauguuguucagcuuuuauugcaagcuuuuaauugcucauuaaaacaaguauaccaugcugauauaaauaguuuccuggucaaaaauaaguaagaccauaccauuuauuccaauaaaauguaugaaucguaguaaucuuuucuaguaagauuaauguugguguuauucuucauuaaaugcaauuuuaaacccgcuugguacuuguuuuaaaugaacugauuacauuuucauguaguuuggugucucugucuguuaaaaauacuuugugauugaauauacuucugucuuuuggaauuggucucacccggaagauugugauacaaaggaaguagugacucaggaguccaaguugaucucauuuuuaaaagguggugauuguguuuucaugauugcaauuauguuugcauuuucagacaucuguccaggaugucacuuuuuucaucuagccuaguuccugaggagacuuacuuccuuuuccuacugccaggccuuuagacccaauuguguggacuuguuuucccuggugucaacucaguauuucauuauuuacugaacuguguuuuccauuaauaccagugcuuccuagauuccauaagauugcauccugauacauccugauaaaugggggggguggggggggaaugaaugagauguauauuuaaaacaaacuggugaacacuuaacuuuuuggccuacaguguuacuuaguauaaaguucguuaaaaacaucaaaccauguguauuuuguacuagaccauucauucauuuggacuauguagugcaugcuacuuuuguguauauguauacauauugucuccacagugcagcacuccugcaugcggaagggcuagaaagaggcagaguagggaauacagcuaguuaaaauucaucuuuagugggcagugauagcacaugcuuugaaucgcagcacugaagaugcagaagcaggaggaucucuugaguucaaagccagccugguuuacaaggugucgggacaaucaaacuguuauagagaaaccgucucaaaaaaacaaaagaacaaaaaauaaauaaauauaaguaggccagguggugguagcagaugccuuuaaucccaguacucaggaggcagaggcaggcagaucucuaaccuuggucuacagaauuccaagacgccagggcuacgcccugucucaaaaggacaacaacaacaacuaaagcuuucaaacauuuaccaaacuuuuucaccuuggcuuugaucccaccacucccaaaauaagaaaaaucaaggaucaaaauaaagguucuuaaugaaauuaaacuuuguaaauaggaaauuuguauuucauuuguuucaucaaaugaauucuuuuuuauuguucuuuaaaauaucacaaacauuuuuaaaagguagccgagcaccuugucuccucuuuucauuucuguuggucuccauuuucuaggcauuuggaagccuauuuuauguauaauaaacugggcaacagaauuacauaaaacaugucuguaaaugucaacuaccacaauagaaaguaauucuaauuuuugacaguuuguaugaagaggaaauaaauaacuuuuauauauuuacugaguauuuggagcucuuugccuagaauucuauucguuuuauuggcucuuuuaaggguucuuuaaauccuuaguauuuauuugcucugugugugaauucugcagcuaguaaggcauuucuccagcucugagagcuguaaacaugaccuuuucacuguaucauccuuaucaucaggaccaagaacacgcuuuuauuaauuuuucacauaacaacugcaauugaagucuugugaaagccagguuguaaaggaauuauaggagaaaaauaaugcaaccacaaguauuagggacugaguaacuaaacuacuugaagggagaaccaguuuuu

SEQ ID NO: 8536 - RNA, 16617 nt, Mus musculus
cgagaucugagaagcgggaaaauggcgccgaugugagcgagagaccgugucgccgaggaagacgccccugcuggagccagagccuccgaaggcacgggaaccagagguguaacugaguagaggauggugagcgcagcaccccgcacgcggacgcggaagagcagcgggacugacagggaacgguccugccgcgcgccccccuccagcugaccccgcccccacauccggguccccgcccgccucugacugucacuuagcuuucguccagcccugaaggccgggccacacccacucuccuagaguucagucccuaaauuuaacacguauuggcucagagcgucuaucugcucagcucuagcuuagccaguauuccccaucaucacacgauccacuguaggcccuccagcauuuccuaguugcuccucuaggccacaccuccgccccuagugccucuccugccaaaauugaggaagggauguuaaugcugcuuuuuuaugcauaaucccugauaacuccugcaauuggaauuaggagacaguagcucggucugcccuuaucucccguaucuugcuggugacucagaaaguggaaugacuggguaauaucuggugaguguugaaggagucugucuuguggaccuuuguaguagaagggcaucugucugaccuagggaucccagccugauuuuagccacuucuugcaccaggaggaaccauccaggcccagcucggacacgcugaccacuguagaauccagcuccggugagccagacaaggagguggcaucuccagauggggcagcuccagccacuuuuuccuccguggaggagcccagcccuaacccaacagccaugccaccagugugggaccauggaggaccucugcagcaaguugccuauccagccucagacaguugccagacuggcucaaccaacacaggcguggggaccaaugaggaccuucgguugcccagacgccguccaccgccagguuaucuguggaccuuucuggggagucacaugccuuugauagggcugagauggugcaagacaaggaaucaccuuuuaucccauugcggggguggggggguggggugggggguggucuucaccauuuacugagcaccuugucaauaugucagguguggcuccagagaugaacuaaaccaauccagcccuuccgggcaguuuauucugacaguggcuggguggggaguaaucaaggcuuuuggguaggucaguaaggaagagaguaaugacacccauucguuccugcagggaaacaaauacccugcucuagccccggcugcugccucaguuuccccaguguucgugaucuagcacagcaucuccguacccacugcccacccacacagucacuggaagguaagaugaggguugcugauagugaagcagauaggcagagcccccccccccagaguuagucuuaaccaccccacuccacaucugcacuuuaucccuaccaggcaaacucuuccgaugcuccgcgcugagcugcacugagaguuuccccagcaugcaggagcugguagcccacggcaagcugcauuacaagcccaaccgcuacuucaagugagagccugaccaucccccucuuucaauucccagaucuuuagugcuucuuaguguguguggaggaaggguggguugaaguaugaguguggccugggaaaccagcuccaaccaugcauggaaaacagaugggaauuaagucauucuggcuacgggcucaguuuggaggugcaggguauacaugccgugguuccguccaguucuaccucaugucuuauguggaaaacuggcacuuaaguaaaaccaaacuugagauucugagcuggaaagguccagaagaauuaagacuacaguaaaggagggccuguaggccaagcuccuuuacuuugugugcaguacuacagagauucugauauagauacccuuccuacaucuuggucccugggaagcaguggauaggcccuuccuguugcccaggauauaguccaguacugugccugcccccaggugugagaauugccuccugcgcuuccgcacucaccguucacucuucaagcaucugcauguuuguauagaccauggucagaacccagccccgccaccacccccugcccuggacaaagagccaccuguacccgagcgucccccagaguccgacccuucgucuucccugggccugccauucccacuacuugagccuuuuaccucugcccccacugggcccuuccuuccauacuugaacccugcacccuuuggccugagucccccucgacugcgcccauuccuggcugccacuccagggccaccagcauccagcacugccaucuggaagaagagucaaggugaguauaggagcagguugccugcaaagcuggcugagcccaccuuuauucugaacuugaacugcuucuuuccugcaggcgcuaccaguagucccagaagaccucaggguggcucugaugcgcccucaggugcgugcaggugaccaccagggcaggguggaggggccuucauuccuaugcccugugugggccuugcgaaugcuggaaagcagcagugccugucccuuaaaauacaugauuuuuaccuuuaaaaugacugguaccuaugccuucaucugcgcuggcguuccuguguaaacauuugugucuuguccaaucucugagugcucuucuccggugguggauccagggauaggaggcaaauguggugccugcggugaugggcagucaagcccaggaaaaagaauccagcuugccuggacccuggcagcugagggggauggacccagggaaaagucuaaucuguucuggccaacgucuaccauccaugguugaaaggcuuucuggagggagacugaggugccugcaggguaccuggcucccagccacaucacguggaaacacacagauggcugcuauuuguguaugcagugugugacuucuucaagagccucacgguccacuuccaggaccaucacccuggucaccccacagcccugacaccuggguuccuuggugccaacacccaguuggauaaggcugagcaauguucaggcauagagcuagaagcaagggaugagaccuaggcucagcuggcccccccucaacucuauacagacucaacccuguuugcuccuggggugucacaacugucagagggggagaagcuaguuuuauggaagcuuugaaacagcucuguugaacugagugggaaggaauacagagaguuuuguaauuugagggaggaggggacaauagaggaggcacguugagcuagugugugcugucuugggucccuuaccccccagauaagauuuuuuuucuaauuuuuuuuauuuuuugagaaaguaugagaguguauguguguacacaaguguaauuaaugcucauggaagccaaaagaggguauaggagccccaagcacuuguaagcugucgggaugggugcugggaaccaaacuugggucuucuguaagagcaguaugagagugaauuuuuuuuaagcgucacagcuaauuucuuuuaaaaauuaauuuauuuuaaacuuuuaacugugauuccucuccugcaacccaccaccaccaccccccaaauaagcacuaggcuguuggacuagggugcucacaugcaaugggagggcgacuuagaauuggcuucacagaaucuggcccucaucaguacuccuguuuuccuggcaccucagccaugggaucucucuccaacucagugcccaucguagccagcuguagauaggguagucagugcccacuguucuguuccacaacuuccagaaaccagauacaauaggguuguucuuuauuccagguuguuuuccuuuauuuaaaaacaaacaaacaggcauaguggcacaugccuuuaaucccagcacuugggaggcagaguuaaguggaucucugaguuuauggccagccuguucuacagagcuaguucuaauauagucaggacuacacagagaaacagugucuugaaauuucauggcucaccauguucaagugcuugccuaugcagcccugauggccugugugaggcagagagggaaagaucaagucuccaaaguuguccuuucauauauuaggccccgaguuuaaaguauuguggcacgcaccuuuaauccccgcacuugcuagacagucaggcagaucuaagugacaagguccagccaggguacauaguaaacacuaucucaagaaauuuuguuauuaguaucaagaauuaggaaggcaagccgggcggugguggugcacgccuuuaaucccagcacucgggaggcagaggcagacggauuucugaguucgaggccagcuuggucuacagagugaguuccaggacagccagggauauacauuggaaccuugucucgaaaaaaaaaaaaaauuaggaaggcaauguggaaaucuaggugugaguaaacucugagcucuucugcauuagaccuccaccucccuugcuccugaggccaauggauucagagagagaagagccuggguuacuguaguugaagaguugagaaggggcaagauggggaauugaacuuuuuccgcauccuccuuucagucagcaaaccuuguguuguugcuggcuucugccccaaucuccauucuggagaguuggguccauuugaaauguacugaggauggagauguagcucaguacaguacuugccuaccaugcacaaauucuugagcucuuucugucccaagcaccacauaagccaggcaugcuaauaagugcauacauuuccuccagaacuuggaaggggugggagaguggacucgagaggauuaggaauucaagguuguccuggcuauguauagaguauauaacacacuuauaccccccacccccgccccgcccgccccaccucaccucuuucuuauauauauccacaaagaaaauauggugccuugcuucuguuccagaccagagccagacuggccaugccucuuggaaauccaaguguguuguuuagaaguccaguguucagccaucgccuagagguuggucuuauucugucuagcuagggcauccccuccuaucucagucagagcacccgcggaaacagccuuucgccaguguuccucagugcccccuauagcucuggauaaagacuccuugggcuggagagauaguagguacaaacaagaucugaguucagauucccaguagccauuuuaaaacuauaugguagcacaugucuguaacccaguaaugggggaaacagggagaagacagucaucuuuggggcucgauggccagccagucuagccaaaacaguuaaaaguuccauugacagaccuugucucaaagugaagugacuuugaggaaggcauucuaauauuaacuucugucuggucuccacaugugcuggcaugguugccuguaccccacaugcacaauacauacacaaacauagauccuguucuaguagcccacaaggcuccuucucaaaccuccauggcucuacucuucauaccugcuucuucugggaaauguaagaaucuggaaaagaaaaacccaaagaccuccuugguaccacccuaguuugucucacucaccacuuccuuguauccuaacuuuaaaucagaauuacccucuaucaccucuuuguccugguaucuauaaccaaaaggugacauuagucaccugcuaagcuagguccucuaggcccuggaucccugucacaacccuccuaccuucuauuuaacuacaguuuguaggaaccagagaauaauuuacagcagccauacuugguuuugaaugaguuuauuaagccaaaguaaaagaguaaauagcaaaugguuagggaaaggaagaaagagguggguagauaccuagggcugcuuggucggccagucuaguaaauaguaagcuucaaguucggagaccuugucucaaaaaguaagugggacacugauggcagccauuaaccucugcaaacauaggcacagauucaugcacccacacagaaugggaucuucuggaugagagagguugaguagaaagacucggggauucugagauuuccugucccagaaacuuaguacaggggggucagauaccagggacauacagaacuuccauugcacuccauuugcugcccaaaguagcuauccuuacugcuuuacacaugcccagucuuugcucuucugggaugccuuggggauccccauccgcagcucaacccacgcuugugcaccccacuuccugcuccugaacucccauaauccccaaccuccuucucuuuaaacuggaacuccacaguguucuaccuccaccucccaccuaaacaaugaagucauccuagugccccagcuuuccagcagacaacacccaagagugucaguguggggaaaguaucugcuggcaggaacuuaugcagcugcucagguugacuugaauagauggagaaauuccuggagauuugucugcagacucagguuucaggcuaccucguggcaauuaugcacuaacagaucugucaccugagggauguggaauugcuucuauuuauccuaagagaaguggagagcagcaacaaccccagguggaucccagcucaugccucuggaccacgcucccgcucccuccuucaaagaacucccagaucuuccaggaacaccacaauaauuggcccuccauuguuuuagacuucuaguuccauaguuuaguuagggccaccaggucauccucaugcaggucaaauacagucugccagccaugcugggagguuaccaacaacccugcauucuccccuguugggucuccugccguucaauccuuuagcuugugcuggccuugauggccuacugugugcuuucaggccagcauaaagaucagaggacagcugugggguugguuuuuccccuccaccuuacauguguuccaggaaucgaacuauggucauccaguuuguguggcaaauguuuuaaccauaaccacaaccccuagccaucucacugacucauuguuuucgguuuugagauugggucuccacucaguuaccaaaccugaauugaaucugacauccaccagccauauucucaaccaguaccugggauuauaggcguggcguggcuucuuucauauuucuaccugacuccauucaccaagauucuggaaacuauccacuugagacuccuauaaaagcagacucgucucuaggaacugugacccaagacaggaaaacaagcaucagaaucuugaugcuaugugcuaaaauaaggaaggugugccucucaaccuaagcugcuuuauuuccauuuaaauaagcugaaaccauaccuggcucauucccaagaguuauacaaguucuugcuacucuaucagccuuauaauacccaacagcaggcccaucaccuaagucaaaacauauauuuauuuuguuucuaagauugguuuucauuguggguuuuuuuuuuuuuucuuuuacucgagacaggguuucucuguguagccuuggcuguccuggaacucacuuuguagaccaggcuggccucgaacucgaaauccgccugccucugccucccaagugcuggaauuaaaggcgugcgccaccacugcccggcuucauuguauuuuuacaaggcacugcaacaauagccuuaaacuaccagacuuuccaauccuccugcuuuuaacucccaagugcuguuuuaugagauucuagaaaucagauuuaaggcuuuguacaugcuauauaaguacacuaccaacagagcuacaaacuuuggauuuaguuuauguuaucuuccuucacagggucucaacuuuccagccgggggauggucaugcacuuaauauccucuucucccacaugcgaggauuacggaugugugccacuauaccuggguagaacauguacuuuuuugguuacguuucugagucagggucucauuauguagugcuggcuggccugaaauucacuauguagauuaggcuaaccuuggaaauguagugaacuuccugcuucugcugggauuacaaguaugcaccacuacgccaguugcuuagagcauguacuuugugacuccagggacauagacacauguacacucaucuauacaccagaaccauccugcuaggguguaaguaguccuccuccuuggaccacaucccagacuggugacaucagaaucucuggaagauauuuuuuuaacagcucaaagaauucuauucuguucccaaacugagaaucauaccucugaacccugcugaguguucuuuguuccuguggacugaaucacgugucagggcucuccuuuccuauaucuaccuuugucccacuuugggcuucauuuuccugcaauccaguuuucuuguuucuccucucucugcuuccuuuaaccacugugaacuugagagguccuaaaaccccauaccuucacagcaacagugaugucccuucagcccaggacuuagacaucuuuuaaugccacccacccauaagucugcuuaucccaguugaugaugcuuugggugcauagcccuggcugauggggcauuugucaccuuaacagggaaguccuguugagaguacaaauggugaaacaagguagaugaagcaauacaggaggacagauauguccucaccauugcaacagccauauccuaggucuaccucuuuagagacgucuuaagacccagagaaagccauaaaauccccacuaaggugcugugacuguccugaguuuguccuaagcuugccucuucagagacaaagcuugucaggaccccaaaguguuaaaacuaagggggacaauagggaaucaagaggcuaguaggagcuaggaaacuugugcuuuauagaugugcuuaggucuaaugaccugacuuuggggacaguaguggacaggcaggaacucaaggaggggacagaaaggcuaucuccgccuccuuccuccucugcccuccccagcccaacagcuccgacuuggugugucagcccguggagcagaaaccacacuuaacuuccucaaggcagaagccuaagcucagagcucauucacccugugguucaucauccccugaagccauggugaguccucaagcccccauuggaaguucauucagguaacaagggucccaaguagaaacuggggaacugguaaauaugcccucauggguaaccuagcagaacagagcuagaacagucuuggggaugagauggcacaggaaaagauaagaaacaaccaaggcauaauagcuugagcucuuguggaccagcuuuguaucugugacugcaaggcaguguggugcugguugggucugccuggaaugauauacccucaauccaggucagcagcugggauauaagcagagguuuccugugaagugauuaaaugggucacgcaccugcuacaccaguccccaucuccaguccguuacccaagcugugcucugcuaaacccuuccuuaucuacccuuguggucaucaacucacuuagacuggggcuucaacaaagaaaugucugaccccaggcaagaauugcuuccuucccagagauccuucugaguccaucucuagauagauuuacaagguucuguccucucuguccuccaaucuuuuuuacccuuggugaagauaggcuggggauaucuaccagcaccuauggcaaagagcaggucagacuugagagcaccagaaauguucuaaacauaucauauagugccuguacauuuggggagccucccuucugguccucaugagacaugucagggacuaugacaccuaauacccacaucuuagauagauguauguagagcuuguuaacuuaguuagaauggcuagccaacaagcccuagagggccuccuggccuaagcucuccagagcuaacuaggaugacagguacugcuccugacuuuguuauguaugaguacugaagcuagaacucaggcuugcaugacaaguacuuuaccuacugagaaaucucucuaguccccccaacuaaauuuuaacaauuuauagucaaaauggguauggugguauacaccuguaaugccagcacucagauggcugaagcaguagaacuguugaaucccagccugggcuacauagugagaaacugacuuaaaauaaacaaaaaacaaaaaaaggaaaggaaaggaaaaaggaaaaagggaaaagggaaagggaaaggaaagaaaaagagaggggggcgaggagaggaagagagaagaggagaggagagaagagagaagagaaaaagaaaagcaagcaagcaagcuaaacuaaugguggcacacaccuguaaucucagcacaugggaggcagaggcagaagguuauccucaacuauaaagcaaguuugaggccagcccaggauauaugagacccugcuucaaaaaacaaauuaaaaaaaaggaggaggaagaggaggaggagaggacgaugacaaaaaacccucaucacugggaagauauaguucauugcuagagcuuguuuagcaaggugcuaaguuccaucccuaacaccacaaaaauaaaaauccucaaaacaacccuaauauaagaacuaauauaaaaaacuucauagguaaugggagacaaagagaguagaaaauguuggugacugugggcaacugggaagagaaaacugauuuaaaaugggguuaucuccgaggucacccuuaaggagcauuaucauaaagacacagaggaggaagaggagagacccaugcauugagugguaugcauuacagacaggacagaggcgggguggggggaccacugcugagucauucagggacuguuugcuuuccucagagaugaacucgcugagagauugggagcagacacuuuauaggccuccucuagggcagcagaccacggaggaggagcccauuacagugaucuggacuguggagggcaguuccucuacuuggggugacagugagaaguaguugaauuccggauguauuuugaaaucaggaaaaaaaaaaaaaaaaggacuggggagaaccggugaucaggcagagggcaaagagaggucaagggggagcaguggcacaaagcacaaagguugaagauauuguugaucagaagcgugggccaugggcuaguagaaaggaauaaguaguuagguccuguuagagguuagacacagcuuagguggaggagucuggagggcguggguuccaggaaccuggggacaggaguaguucuuacccaaaaagagaagcugagauuggggaagaaccaaaguuagaaugagaaccuaagggaagaggagggugauggguuugugugccugugaccaacuguaaccguuucuccaucugccgccuugugaugagagccuuccugaaugacccaugucuuuuaggggagcaaucaggacuuccgaaaccuccaagcuaaguuccaaaccucucagccagaacuuggagaacuguucagaaaaaccccaaagccugaguuaaacaaaguccugaagaaauuuccacagacugaguuaagugagcagcccaagaaguccucacagucugagcucagugcagugucuuugaaaccacugcagcugcaguuugcagaccuccccaggaagcccccacagccuggaguucuuaaaaagucaccacagccugaguucccucaucuagccaacaagccuguacaggcugaauucccaaggaagccucuacauccagaguucacaggucucaaaaagccuucccaggcugaguucacagaucucaagaagcccccacagccccaguuugccagccuccccaagaagcccccaaaaccugaguuuggagagcucuccaagagaccuccacagcuugagacaccccaggagccuagugcuccuccugcccagaagcuccugaagcccgagccuaacaauccugccaggccucuaggagagcucaaacccaagauguuuuggcaccuugaggccaaugaggcaccuaagaggcccuugccaucugaauccaguacuuuucccaagaagccacugcagccugaggcuguuguugguuucucuaggaagucccagccacagucagaguccaucgaaguuucucagacaucccccucuaaguguggguccagggagcuugacucucacuccccacagccugacaucaguaccuuuccuaagaacaaugagaacuuuaggaaaccuucauauccucaagccacugguugccccaaguccccaaagcagcccauguucuaugaguucccccagacacccccucggaagccugagucauguaacccccagucucacuccccgcugccagacuucaaugcauucccuaagaagcauccacagcuccagccaagugaccuuaccagggcauccucggagccugaagucugcaagguucccaaaaagacucagaagccagaccccaaugugcuuucucagaagcccucacagccagaauugggucaccucccuagaacauccucggaccccgaguucaacucgcucccgaggaaguuucugcagccucaacacggcaaguucuuccagccugaguuccccaagggucugccuagaaagcccaagcuuccugguucagugucugaaugcucccugcccucugcuagugcgggcuccagcccccagugcccucucagcccugggcuuauagucccugggauaccccgcuggagaucagaagacuuccaaguccagcgcccaccccgacggcggccccugcccucagccagcagccugggacaccccccagccaagcccgcacuaccaccuggccccaucaauauccaaagcuucaggagagccgcagcaacagccgcagguaaggcucaggcagaagagggugcuaaauaucugcgcagagccauuucccuuccuugcucuuuccuccacagcgguacugaagacaggcucuucuacugggacccacuuccaagcucaacaaccucaacauauugcacagugaguguauggagaguggggucagacauggguguaaggcuaaagaaaguccucauucuaaguauccuuccaggaacccggaugagaucuacgaacuguaugaugcuguggaggccacagaugacucuaguaucagccccagaggcagagguuuguagguggucuuggugguuggccugggcacccaugaaacauuaauugcaaaaaggcauucauucucucaugccccagguuuaagaccacgaagugauccauacaggccagauggugaggcagggaaaacccagagguacccaagcagccagguuugcuauagguagaggcaugguccagugagaugacaagagaaugaacagcaaugaaagaauugaagaaaucaaaguuggcaaacaaggcuagacagugugagugagaucaugguauggcauguucccuuuauaaagccuagcacucaugugcagaagagacauggcagaguaaggcauuaagguugcaaagcuggguacaauuaauuauaaugcacaccuguaacuucagcauuuagaagggggcaggaugaucaaccuuggcuacuuagcaaucaagaccaaccuggauuagaugaaaccuugcaacaaaaccaaagcaaauccuacccauccuguuccuugcagcccauccuaggaggaugccccagcaagauguaucccugaaaucaguuuaggcuggagcaguguggcagaagguucuuuuaagucauuucaaggggcuccaggacuggugccucaugguaacaugaguuucuaugagaaaacugcgauucugaagcuacagccaaggaagguaccccauuaccaaauucaaauaucuaagacuaggucaaccaguugauuccaucuguugggauuccagcugagcuucccuuccccugucuuacugggccuccuaggaggggacucuaggcuuugagauccacuugcucuuccggucccagguggagguccucauacaaagccaggugccuucaaauucuccugcccuugcuccuuccugggucccuuuuguuugcuuaucguaguauaacugugacaauauuugcaauacuuccuuuaguucuucuuuauuucuugagauaggguuucuguguaacaguccuggauauccuggagcucacucugaccaggcuguccuugaacuugaagaucagacugccucugccucuuaagagcuggugguaguuucuuaccucgcccccucaugcuuccauugagaagauacucuauggguuuuauuuuggggggagggggugagggguuguuuuguuuuuuugauaggguucagcugugcagagaggcugaugagauccuugacuacuauuuccaaggacugcuuuuccuaaauagaccacaccccuggcccccaaugauuuuaguaacauccucccgguuuuuauccaccuuucuucaagaugauaaaauuuaccagacuucuuugaguuucuuucaguggaacauggugugagccuuccucugggcacagagccucuuaaaggcugcugcuuugagcauuucggugaucuuucuaguaccagaguggcccgaaaccauuagcuucucccuccuacacuuggguuccuuugaagcaugacagccuaccucuuuguucaucuggggacucaucugggagacaggcaggguucagccuuuccaggauaugugcagaccaaaaaagggcagacuuucaguggccugcucagaacaagcuguauguaggauaauccaggaccacaggauccaggaauaucagucaaguuugccucugugagaccacacaaagcugaggcagaugagagaagcaggugcaguacagguucuaggcaggaaccagguaucugcuggaguggagaucaaguagugcauagauaaccccucugugggcugcucaucagaaaagacuguuagucugaaacguccacagagacauuugggucauuaacaaaaggaagcuguugauucaggcccucacucacucaggcuucaagagguuggcaugcaaacucucugcuaacaguuggacucacucuggaagccuggcuuacugcuggcuuacuacaaguuagccccccugggcuucagcaucagcaucagcagcagaagguucaggcgaagaaccccacccuggcuacuacuccucagaggcaagcagugggugccagaagaggacgcccguuuuuagcucugaauccaaacuuccaccauauucugggaggcagaagcaaaauggcucccaaagccuacagcuuguagacuggucaugguggccacaccuuuaaucccaguacucgaggaggagguagauagaucugaauuccaggguagcuuggucuacauaguaacaaaaaggcccaccccacaaauccaucccaccucuacaauuuuacuagcuggguagccuuaaagagcugacaaacuuuucagccuuuauuuuccucaccaaagugaaccuuacccacaggagcuaaugagaaagguggagaaaagugauugagauucaggggucacugaaaacccagaguggguaggaucaucucacaagucacuaggguagagguacacaacagggggccuuuguccugacucuguccaaugcucucagaugaaaugcugucuacccagcaagccaccagauggccucaacaggagccagagcucagguacacaaggcaaaugggguguuaagguguugggcugagcucugguacucagaugggacuacuucuugcucauaaauacuccaauaccugggucuuucaggaagaaggccacucagccacagcagcugccagcuacagaccccaagcugcugaaacagaucaggaaggcagaaaaggcugagagagaguuuagaaagaaguuuaaggugagaacauggaguaaagaauucugggaggauugguaucuaggacccaggacuuccauccugaggaagaaaccaaacuaacagcagaaguuaagucuuaacaugauguucuccaaguuugaaggugagauugugauucacacgaagaugaugauugaccccaaugccaagacccggcguggggguggcaagcaccugggcauccggcguggagagauccuagaggugaucgaguucacuagcaaggaugagaugcucugccgggaccccaagggcaaguguaagugugcuuggccuacauccagagaaaggaggggugcuagggcugagaauucacucuacccauucucuccugcagauggcuaugugcccagaacugcacuguugcccuuguaaguguugguccugccuggguggaauggggaacaccaggguuggcuucugcugacuauaucaugcucucucugccagggaaacagagguauaugaugacgucagcuuuggggguauguacagugauuccucauagggaugcuuuguaucaugccucuguggcacagggucacuugaaauucauccuucucuguagacccucuggacaugcaaccauuuccucggugacaguauggaacagcagauaaguggguuccaggaccaacaguccagcuacugcucacucaggagcccgggaucccagccuggcaaacagacacccaaaggcaugugcuuauauaaaacuccucuuuaaaauau

SEQ ID NO: 8537 - RNA, 16617 nt, Mus musculus
auauuuuaaagaggaguuuuauauaagcacaugccuuugggugucuguuugccaggcugggaucccgggcuccugagugagcaguagcuggacuguugguccuggaacccacuuaucugcuguuccauacugucaccgaggaaaugguugcauguccagagggucuacagagaaggaugaauuucaagugacccugugccacagaggcaugauacaaagcaucccuaugaggaaucacuguacauacccccaaagcugacgucaucauauaccucuguuucccuggcagagagagcaugauauagucagcagaagccaacccugguguuccccauuccacccaggcaggaccaacacuuacaagggcaacagugcaguucugggcacauagccaucugcaggagagaauggguagagugaauucucagcccuagcaccccuccuuucucuggauguaggccaagcacacuuacacuugcccuuggggucccggcagagcaucucauccuugcuagugaacucgaucaccucuaggaucucuccacgccggaugcccaggugcuugccacccccacgccgggucuuggcauuggggucaaucaucaucuucgugugaaucacaaucucaccuucaaacuuggagaacaucauguuaagacuuaacuucugcuguuaguuugguuucuuccucaggauggaaguccuggguccuagauaccaauccucccagaauucuuuacuccauguucucaccuuaaacuucuuucuaaacucucucucagccuuuucugccuuccugaucuguuucagcagcuuggggucuguagcuggcagcugcuguggcugaguggccuucuuccugaaagacccagguauuggaguauuuaugagcaagaaguagucccaucugaguaccagagcucagcccaacaccuuaacaccccauuugccuuguguaccugagcucuggcuccuguugaggccaucugguggcuugcuggguagacagcauuucaucugagagcauuggacagagucaggacaaaggcccccuguuguguaccucuacccuagugacuugugagaugauccuacccacucuggguuuucagugaccccugaaucucaaucacuuuucuccaccuuucucauuagcuccuguggguaagguucacuuuggugaggaaaauaaaggcugaaaaguuugucagcucuuuaaggcuacccagcuaguaaaauuguagaggugggauggauuuguggggugggccuuuuuguuacuauguagaccaagcuacccuggaauucagaucuaucuaccuccuccucgaguacugggauuaaagguguggccaccaugaccagucuacaagcuguaggcuuugggagccauuuugcuucugccucccagaauaugguggaaguuuggauucagagcuaaaaacgggcguccucuucuggcacccacugcuugccucugaggaguaguagccagggugggguucuucgccugaaccuucugcugcugaugcugaugcugaagcccaggggggcuaacuuguaguaagccagcaguaagccaggcuuccagagugaguccaacuguuagcagagaguuugcaugccaaccucuugaagccugagugagugagggccugaaucaacagcuuccuuuuguuaaugacccaaaugucucuguggacguuucagacuaacagucuuuucugaugagcagcccacagagggguuaucuaugcacuacuugaucuccacuccagcagauaccugguuccugccuagaaccuguacugcaccugcuucucucaucugccucagcuuuguguggucucacagaggcaaacuugacugauauuccuggauccugugguccuggauuauccuacauacagcuuguucugagcaggccacugaaagucugcccuuuuuuggucugcacauauccuggaaaggcugaacccugccugucucccagaugaguccccagaugaacaaagagguaggcugucaugcuucaaaggaacccaaguguaggagggagaagcuaaugguuucgggccacucugguacuagaaagaucaccgaaaugcucaaagcagcagccuuuaagaggcucugugcccagaggaaggcucacaccauguuccacugaaagaaacucaaagaagucugguaaauuuuaucaucuugaagaaagguggauaaaaaccgggaggauguuacuaaaaucauugggggccagggguguggucuauuuaggaaaagcaguccuuggaaauaguagucaaggaucucaucagccucucugcacagcugaacccuaucaaaaaaacaaaacaaccccucacccccuccccccaaaauaaaacccauagaguaucuucucaauggaagcaugagggggcgagguaagaaacuaccaccagcucuuaagaggcagaggcagucugaucuucaaguucaaggacagccuggucagagugagcuccaggauauccaggacuguuacacagaaacccuaucucaagaaauaaagaagaacuaaaggaaguauugcaaauauugucacaguuauacuacgauaagcaaacaaaagggacccaggaaggagcaagggcaggagaauuugaaggcaccuggcuuuguaugaggaccuccaccugggaccggaagagcaaguggaucucaaagccuagaguccccuccuaggaggcccaguaagacaggggaagggaagcucagcuggaaucccaacagauggaaucaacugguugaccuagucuuagauauuugaauuugguaaugggguaccuuccuuggcuguagcuucagaaucgcaguuuucucauagaaacucauguuaccaugaggcaccaguccuggagccccuugaaaugacuuaaaagaaccuucugccacacugcuccagccuaaacugauuucagggauacaucuugcuggggcauccuccuaggaugggcugcaaggaacaggauggguaggauuugcuuugguuuuguugcaagguuucaucuaauccagguuggucuugauugcuaaguagccaagguugaucauccugcccccuucuaaaugcugaaguuacaggugugcauuauaauuaauuguacccagcuuugcaaccuuaaugccuuacucugccaugucucuucugcacaugagugcuaggcuuuauaaagggaacaugccauaccaugaucucacucacacugucuagccuuguuugccaacuuugauuucuucaauucuuucauugcuguucauucucuugucaucucacuggaccaugccucuaccuauagcaaaccuggcugcuuggguaccucuggguuuucccugccucaccaucuggccuguauggaucacuucguggucuuaaaccuggggcaugagagaaugaaugccuuuuugcaauuaauguuucaugggugcccaggccaaccaccaagaccaccuacaaaccucugccucuggggcugauacuagagucaucuguggccuccacagcaucauacaguucguagaucucauccggguuccuggaaggauacuuagaaugaggacuuucuuuagccuuacacccaugucugaccccacucuccauacacucacugugcaauauguugagguuguugagcuuggaagugggucccaguagaagagccugucuucaguaccgcuguggaggaaagagcaaggaagggaaauggcucugcgcagauauuuagcacccucuucugccugagccuuaccugcggcuguugcugcggcucuccugaagcuuuggauauugauggggccaggugguagugcgggcuuggcuggggggugucccaggcugcuggcugagggcaggggccgccgucggggugggcgcuggacuuggaagucuucugaucuccagcgggguaucccagggacuauaagcccagggcugagagggcacugggggcuggagcccgcacuagcagagggcagggagcauucagacacugaaccaggaagcuugggcuuucuaggcagacccuuggggaacucaggcuggaagaacuugccguguugaggcugcagaaacuuccucgggagcgaguugaacucgggguccgaggauguucuagggaggugacccaauucuggcugugagggcuucugagaaagcacauuggggucuggcuucugagucuuuuugggaaccuugcagacuucaggcuccgaggaugcccugguaaggucacuuggcuggagcuguggaugcuucuuagggaaugcauugaagucuggcagcggggagugagacuggggguuacaugacucaggcuuccgagggggugucugggggaacucauagaacaugggcugcuuuggggacuuggggcaaccaguggcuugaggauaugaagguuuccuaaaguucucauuguucuuaggaaagguacugaugucaggcuguggggagugagagucaagcucccuggacccacacuuagagggggaugucugagaaacuucgauggacucugacuguggcugggacuuccuagagaaaccaacaacagccucaggcugcaguggcuucuugggaaaaguacuggauucagauggcaagggccucuuaggugccucauuggccucaaggugccaaaacaucuuggguuugagcucuccuagaggccuggcaggauuguuaggcucgggcuucaggagcuucugggcaggaggagcacuaggcuccuggggugucucaagcuguggaggucucuuggagagcucuccaaacucagguuuugggggcuucuuggggaggcuggcaaacuggggcugugggggcuucuugagaucugugaacucagccugggaaggcuuuuugagaccugugaacucuggauguagaggcuuccuugggaauucagccuguacaggcuuguuggcuagaugagggaacucaggcuguggugacuuuuuaagaacuccaggcugugggggcuuccuggggaggucugcaaacugcagcugcagugguuucaaagacacugcacugagcucagacugugaggacuucuugggcugcucacuuaacucagucuguggaaauuucuucaggacuuuguuuaacucaggcuuugggguuuuucugaacaguucuccaaguucuggcugagagguuuggaacuuagcuuggagguuucggaaguccugauugcuccccuaaaagacaugggucauucaggaaggcucucaucacaaggcggcagauggagaaacgguuacaguuggucacaggcacacaaacccaucacccuccucuucccuuagguucucauucuaacuuugguucuuccccaaucucagcuucucuuuuuggguaagaacuacuccuguccccagguuccuggaacccacgcccuccagacuccuccaccuaagcugugucuaaccucuaacaggaccuaacuacuuauuccuuucuacuagcccauggcccacgcuucugaucaacaauaucuucaaccuuugugcuuugugccacugcucccccuugaccucucuuugcccucugccugaucaccgguucuccccaguccuuuuuuuuuuuuuuuuccugauuucaaaauacauccggaauucaacuacuucucacugucaccccaaguagaggaacugcccuccacaguccagaucacuguaaugggcuccuccuccguggucugcugcccuagaggaggccuauaaagugucugcucccaaucucucagcgaguucaucucugaggaaagcaaacagucccugaaugacucagcagugguccccccaccccgccucuguccugucuguaaugcauaccacucaaugcaugggucucuccucuuccuccucugugucuuuaugauaaugcuccuuaagggugaccucggagauaaccccauuuuaaaucaguuuucucuucccaguugcccacagucaccaacauuuucuacucucuuugucucccauuaccuaugaaguuuuuuauauuaguucuuauauuaggguuguuuugaggauuuuuauuuuugugguguuagggauggaacuuagcaccuugcuaaacaagcucuagcaaugaacuauaucuucccagugaugaggguuuuuugucaucguccucuccuccuccucuuccuccuccuuuuuuuuaauuuguuuuuugaagcagggucucauauauccugggcuggccucaaacuugcuuuauaguugaggauaaccuucugccucugccucccaugugcugagauuacaggugugugccaccauuaguuuagcuugcuugcuugcuuuucuuuuucucuucucucuucucuccucuccucuucucucuuccucuccucgccccccucucuuuuucuuuccuuucccuuucccuuuucccuuuuuccuuuuuccuuuccuuuccuuuuuuuguuuuuuguuuauuuuaagucaguuucucacuauguagcccaggcugggauucaacaguucuacugcuucagccaucugagugcuggcauuacagguguauaccaccauacccauuuugacuauaaauuguuaaaauuuaguuggggggacuagagagauuucucaguagguaaaguacuugucaugcaagccugaguucuagcuucaguacucauacauaacaaagucaggagcaguaccugucauccuaguuagcucuggagagcuuaggccaggaggcccucuagggcuuguuggcuagccauucuaacuaaguuaacaagcucuacauacaucuaucuaagauguggguauuaggugucauagucccugacaugucucaugaggaccagaagggaggcuccccaaauguacaggcacuauaugauauguuuagaacauuucuggugcucucaagucugaccugcucuuugccauaggugcugguagauauccccagccuaucuucaccaaggguaaaaaagauuggaggacagagaggacagaaccuuguaaaucuaucuagagauggacucagaaggaucucugggaaggaagcaauucuugccuggggucagacauuucuuuguugaagccccagucuaagugaguugaugaccacaaggguagauaaggaaggguuuagcagagcacagcuuggguaacggacuggagauggggacugguguagcaggugcgugacccauuuaaucacuucacaggaaaccucugcuuauaucccagcugcugaccuggauugaggguauaucauuccaggcagacccaaccagcaccacacugccuugcagucacagauacaaagcugguccacaagagcucaagcuauuaugccuugguuguuucuuaucuuuuccugugccaucucauccccaagacuguucuagcucuguucugcuagguuacccaugagggcauauuuaccaguuccccaguuucuacuugggacccuuguuaccugaaugaacuuccaaugggggcuugaggacucaccauggcuucaggggaugaugaaccacagggugaaugagcucugagcuuaggcuucugccuugaggaaguuaagugugguuucugcuccacgggcugacacaccaagucggagcuguugggcuggggagggcagaggaggaaggaggcggagauagccuuucuguccccuccuugaguuccugccuguccacuacuguccccaaagucaggucauuagaccuaagcacaucuauaaagcacaaguuuccuagcuccuacuagccucuugauucccuauugucccccuuaguuuuaacacuuugggguccugacaagcuuugucucugaagaggcaagcuuaggacaaacucaggacagucacagcaccuuaguggggauuuuauggcuuucucugggucuuaagacgucucuaaagagguagaccuaggauauggcuguugcaauggugaggacauaucuguccuccuguauugcuucaucuaccuuguuucaccauuuguacucucaacaggacuucccuguuaaggugacaaaugccccaucagccagggcuaugcacccaaagcaucaucaacugggauaagcagacuuauggguggguggcauuaaaagaugucuaaguccugggcugaagggacaucacuguugcugugaagguaugggguuuuaggaccucucaaguucacagugguuaaaggaagcagagagaggagaaacaagaaaacuggauugcaggaaaaugaagcccaaagugggacaaagguagauauaggaaaggagagcccugacacgugauucaguccacaggaacaaagaacacucagcaggguucagagguaugauucucaguuugggaacagaauagaauucuuugagcuguuaaaaaaauaucuuccagagauucugaugucaccagucugggaugugguccaaggaggaggacuacuuacacccuagcaggaugguucugguguauagaugaguguacaugugucuaugucccuggagucacaaaguacaugcucuaagcaacuggcguaguggugcauacuuguaaucccagcagaagcaggaaguucacuacauuuccaagguuagccuaaucuacauagugaauuucaggccagccagcacuacauaaugagacccugacucagaaacguaaccaaaaaaguacauguucuacccagguauaguggcacacauccguaauccucgcaugugggagaagaggauauuaagugcaugaccaucccccggcuggaaaguugagacccugugaaggaagauaacauaaacuaaauccaaaguuuguagcucuguugguaguguacuuauauagcauguacaaagccuuaaaucugauuucuagaaucucauaaaacagcacuugggaguuaaaagcaggaggauuggaaagucugguaguuuaaggcuauuguugcagugccuuguaaaaauacaaugaagccgggcagugguggcgcacgccuuuaauuccagcacuugggaggcagaggcaggcggauuucgaguucgaggccagccuggucuacaaagugaguuccaggacagccaaggcuacacagagaaacccugucucgaguaaaagaaaaaaaaaaaaaacccacaaugaaaaccaaucuuagaaacaaaauaaauauauguuuugacuuaggugaugggccugcuguuggguauuauaaggcugauagaguagcaagaacuuguauaacucuugggaaugagccagguaugguuucagcuuauuuaaauggaaauaaagcagcuuagguugagaggcacaccuuccuuauuuuagcacauagcaucaagauucugaugcuuguuuuccugucuugggucacaguuccuagagacgagucugcuuuuauaggagucucaaguggauaguuuccagaaucuuggugaauggagucagguagaaauaugaaagaagccacgccacgccuauaaucccagguacugguugagaauauggcugguggaugucagauucaauucagguuugguaacugaguggagacccaaucucaaaaccgaaaacaaugagucagugagauggcuagggguugugguuaugguuaaaacauuugccacacaaacuggaugaccauaguucgauuccuggaacacauguaagguggaggggaaaaaccaaccccacagcuguccucugaucuuuaugcuggccugaaagcacacaguaggccaucaaggccagcacaagcuaaaggauugaacggcaggagacccaacaggggagaaugcaggguuguugguaaccucccagcauggcuggcagacuguauuugaccugcaugaggaugaccugguggcccuaacuaaacuauggaacuagaagucuaaaacaauggagggccaauuauugugguguuccuggaagaucugggaguucuuugaaggagggagcgggagcgugguccagaggcaugagcugggauccaccugggguuguugcugcucuccacuucucuuaggauaaauagaagcaauuccacaucccucaggugacagaucuguuagugcauaauugccacgagguagccugaaaccugagucugcagacaaaucuccaggaauuucuccaucuauucaagucaaccugagcagcugcauaaguuccugccagcagauacuuuccccacacugacacucuuggguguugucugcuggaaagcuggggcacuaggaugacuucauuguuuaggugggagguggagguagaacacuguggaguuccaguuuaaagagaaggagguuggggauuaugggaguucaggagcaggaaguggggugcacaagcguggguugagcugcggauggggauccccaaggcaucccagaagagcaaagacugggcauguguaaagcaguaaggauagcuacuuugggcagcaaauggagugcaauggaaguucuguaugucccugguaucugaccccccuguacuaaguuucugggacaggaaaucucagaauccccgagucuuucuacucaaccucucucauccagaagaucccauucugugugggugcaugaaucugugccuauguuugcagagguuaauggcugccaucagugucccacuuacuuuuugagacaaggucuccgaacuugaagcuuacuauuuacuagacuggccgaccaagcagcccuagguaucuacccaccucuuucuuccuuucccuaaccauuugcuauuuacucuuuuacuuuggcuuaauaaacucauucaaaaccaaguauggcugcuguaaauuauucucugguuccuacaaacuguaguuaaauagaagguaggaggguugugacagggauccagggccuagaggaccuagcuuagcaggugacuaaugucaccuuuugguuauagauaccaggacaaagaggugauagaggguaauucugauuuaaaguuaggauacaaggaaguggugagugagacaaacuagggugguaccaaggaggucuuuggguuuuucuuuuccagauucuuacauuucccagaagaagcagguaugaagaguagagccauggagguuugagaaggagccuugugggcuacuagaacaggaucuauguuuguguauguauugugcaugugggguacaggcaaccaugccagcacauguggagaccagacagaaguuaauauuagaaugccuuccucaaagucacuucacuuugagacaaggucugucaauggaacuuuuaacuguuuuggcuagacuggcuggccaucgagccccaaagaugacugucuucucccuguuucccccauuacuggguuacagacaugugcuaccauauaguuuuaaaauggcuacugggaaucugaacucagaucuuguuuguaccuacuaucucuccagcccaaggagucuuuauccagagcuauagggggcacugaggaacacuggcgaaaggcuguuuccgcgggugcucugacugagauaggaggggaugcccuagcuagacagaauaagaccaaccucuaggcgauggcugaacacuggacuucuaaacaacacacuuggauuuccaagaggcauggccagucuggcucuggucuggaacagaagcaaggcaccauauuuucuuuguggauauauauaagaaagaggugagguggggcgggcggggcgggggugggggguauaaguguguuauauacucuauacauagccaggacaaccuugaauuccuaauccucucgaguccacucucccaccccuuccaaguucuggaggaaauguaugcacuuauuagcaugccuggcuuauguggugcuugggacagaaagagcucaagaauuugugcaugguaggcaaguacuguacugagcuacaucuccauccucaguacauuucaaauggacccaacucuccagaauggagauuggggcagaagccagcaacaacacaagguuugcugacugaaaggaggaugcggaaaaaguucaauuccccaucuugccccuucucaacucuucaacuacaguaacccaggcucuucucucucugaauccauuggccucaggagcaagggagguggaggucuaaugcagaagagcucagaguuuacucacaccuagauuuccacauugccuuccuaauuuuuuuuuuuuuucgagacaagguuccaauguauaucccuggcuguccuggaacucacucuguagaccaagcuggccucgaacucagaaauccgucugccucugccucccgagugcugggauuaaaggcgugcaccaccaccgcccggcuugccuuccuaauucuugauacuaauaacaaaauuucuugagauaguguuuacuauguacccuggcuggaccuugucacuuagaucugccugacugucuagcaagugcggggauuaaaggugcgugccacaauacuuuaaacucggggccuaauauaugaaaggacaacuuuggagacuugaucuuucccucucugccucacacaggccaucagggcugcauaggcaagcacuugaacauggugagccaugaaauuucaagacacuguuucucuguguaguccugacuauauuagaacuagcucuguagaacaggcuggccauaaacucagagauccacuuaacucugccucccaagugcugggauuaaaggcaugugccacuaugccuguuuguuuguuuuuaaauaaaggaaaacaaccuggaauaaagaacaacccuauuguaucugguuucuggaaguuguggaacagaacagugggcacugacuacccuaucuacagcuggcuacgaugggcacugaguuggagagagaucccauggcugaggugccaggaaaacaggaguacugaugagggccagauucugugaagccaauucuaagucgcccucccauugcaugugagcacccuaguccaacagccuagugcuuauuuggggggugguggugguggguugcaggagaggaaucacaguuaaaaguuuaaaauaaauuaauuuuuaaaagaaauuagcugugacgcuuaaaaaaaauucacucucauacugcucuuacagaagacccaaguuugguucccagcacccaucccgacagcuuacaagugcuuggggcuccuauacccucuuuuggcuuccaugagcauuaauuacacuuguguacacacauacacucucauacuuucucaaaaaauaaaaaaaauuagaaaaaaaaucuuaucugggggguaagggacccaagacagcacacacuagcucaacgugccuccucuauuguccccuccucccucaaauuacaaaacucucuguauuccuucccacucaguucaacagagcuguuucaaagcuuccauaaaacuagcuucucccccucugacaguugugacaccccaggagcaaacaggguugagucuguauagaguugagggggggccagcugagccuaggucucaucccuugcuucuagcucuaugccugaacauugcucagccuuauccaacuggguguuggcaccaaggaacccaggugucagggcuguggggugaccagggugaugguccuggaaguggaccgugaggcucuugaagaagucacacacugcauacacaaauagcagccaucuguguguuuccacgugauguggcugggagccagguacccugcaggcaccucagucucccuccagaaagccuuucaaccauggaugguagacguuggccagaacagauuagacuuuucccuggguccaucccccucagcugccaggguccaggcaagcuggauucuuuuuccugggcuugacugcccaucaccgcaggcaccacauuugccuccuaucccuggauccaccaccggagaagagcacucagagauuggacaagacacaaauguuuacacaggaacgccagcgcagaugaaggcauagguaccagucauuuuaaagguaaaaaucauguauuuuaagggacaggcacugcugcuuuccagcauucgcaaggcccacacagggcauaggaaugaaggccccuccacccugcccugguggucaccugcacgcaccugagggcgcaucagagccacccugaggucuucugggacuacugguagcgccugcaggaaagaagcaguucaaguucagaauaaaggugggcucagccagcuuugcaggcaaccugcuccuauacucaccuugacucuucuuccagauggcagugcuggaugcugguggcccuggaguggcagccaggaaugggcgcagucgagggggacucaggccaaagggugcaggguucaaguauggaaggaagggcccagugggggcagagguaaaaggcucaaguagugggaauggcaggcccagggaagacgaagggucggacucugggggacgcucggguacagguggcucuuuguccagggcagggggugguggcggggcuggguucugaccauggucuauacaaacaugcagaugcuugaagagugaacggugagugcggaagcgcaggaggcaauucucacaccugggggcaggcacaguacuggacuauauccugggcaacaggaagggccuauccacugcuucccagggaccaagauguaggaaggguaucuauaucagaaucucuguaguacugcacacaaaguaaaggagcuuggccuacaggcccuccuuuacuguagucuuaauucuucuggaccuuuccagcucagaaucucaaguuugguuuuacuuaagugccaguuuuccacauaagacaugagguagaacuggacggaaccacggcauguauacccugcaccuccaaacugagcccguagccagaaugacuuaauucccaucuguuuuccaugcaugguuggagcugguuucccaggccacacucauacuucaacccacccuuccuccacacacacuaagaagcacuaaagaucugggaauugaaagagggggauggucaggcucucacuugaaguagcgguugggcuuguaaugcagcuugccgugggcuaccagcuccugcaugcuggggaaacucucagugcagcucagcgcggagcaucggaagaguuugccugguagggauaaagugcagauguggaguggggugguuaagacuaacucugggggggggggcucugccuaucugcuucacuaucagcaacccucaucuuaccuuccagugacugugugggugggcaguggguacggagaugcugugcuagaucacgaacacuggggaaacugaggcagcagccggggcuagagcaggguauuuguuucccugcaggaacgaaugggugucauuacucucuuccuuacugaccuacccaaaagccuugauuacuccccacccagccacugucagaauaaacugcccggaagggcuggauugguuuaguucaucucuggagccacaccugacauauugacaaggugcucaguaaauggugaagaccaccccccaccccacccccccacccccgcaaugggauaaaaggugauuccuugucuugcaccaucucagcccuaucaaaggcaugugacuccccagaaagguccacagauaaccuggcgguggacggcgucugggcaaccgaagguccucauugguccccacgccuguguugguugagccagucuggcaacugucugaggcuggauaggcaacuugcugcagagguccuccauggucccacacugguggcauggcuguuggguuagggcugggcuccuccacggaggaaaaaguggcuggagcugccccaucuggagaugccaccuccuugucuggcucaccggagcuggauucuacaguggucagcguguccgagcugggccuggaugguuccuccuggugcaagaaguggcuaaaaucaggcugggaucccuaggucagacagaugcccuucuacuacaaagguccacaagacagacuccuucaacacucaccagauauuacccagucauuccacuuucugagucaccagcaagauacgggagauaagggcagaccgagcuacugucuccuaauuccaauugcaggaguuaucagggauuaugcauaaaaaagcagcauuaacaucccuuccucaauuuuggcaggagaggcacuaggggcggagguguggccuagaggagcaacuaggaaaugcuggagggccuacaguggaucgugugaugauggggaauacuggcuaagcuagagcugagcagauagacgcucugagccaauacguguuaaauuuagggacugaacucuaggagaguggguguggcccggccuucagggcuggacgaaagcuaagugacagucagaggcgggcggggacccggaugugggggcggggucagcuggaggggggcgcgcggcaggaccguucccugucagucccgcugcucuuccgcguccgcgugcggggugcugcgcucaccauccucuacucaguuacaccucugguucccgugccuucggaggcucuggcuccagcaggggcgucuuccucggcgacacggucucucgcucacaucggcgccauuuucccgcuucucagaucucg

SEQ ID NO: 8538 - RNA, 1039 nt, Mus musculus
ucgagacaagguuccaauguauaucccuggcuguccuggaacucacucuguagaccaagcuggccucgaacucagaaauccgucugccucugccucccgagugcugggauuaaaggcgugcaccaccaccgcccggcuugccuuccuaauucuugauacuaauaacaaaauuucuugagauaguguuuacuauguacccuggcuggaccuugucacuuagaucugccugacugucuagcaagugcggggauuaaaggugcgugccacaauacuuuaaacucggggccuaauauaugaaaggacaacuuuggagacuugaucuuucccucucugccucacacaggccaucagggcugcauaggcaagcacuugaacauggugagccaugaaauuucaagacacuguuucucuguguaguccugacuauauuagaacuagcucuguagaacaggcuggccauaaacucagagauccacuuaacucugccucccaagugcugggauuaaaggcaugugccacuaugccuguuuguuuguuuuuaaauaaaggaaaacaaccuggaauaaagaacaacccuauuguaucugguuucuggaaguuguggaacagaacagugggcacugacuacccuaucuacagcuggcuacgaugggcacugaguuggagagagaucccauggcugaggugccaggaaaacaggaguacugaugagggccagauucugugaagccaauucuaagucgcccucccauugcaugugagcacccuaguccaacagccuagugcuuauuuggggggugguggugguggguugcaggagaggaaucacaguuaaaaguuuaaaauaaauuaauuuuuaaaagaaauuagcugugacgcuuaaaaaaaauucacucucauacugcucuuacagaagacccaaguuugguucccagcacccaucccgacagcuuacaagugcuuggggcuccuauacccucuuuuggcuuccaugagcauuaauuacacuuguguacacacauacacucucauacuuucu

SEQ ID NO: 8539 - RNA, 18426 nt, Mus musculus
ugauaggcugcugaaucugucauuucaaaaagguccgcauuccuuccgccuuucuccgggagaccgagggcuagaaggguggaucccaggaggcuccuaccccccgagcucgguuucucagccugauuggcuuguccaggugccugucacuaccgcuuucaccguugacuggccuuuagaccgccgcucuacgcggcgccgguuccgcccccgacggguguuugugguggggcugcggagucgccgaucccgccggaagcgccaggacaauggggacccgggacgacgaguacgauuaccuauucaaaggugcgccuugugggguacagacaggcgagguggcgguagcgacuggagggccgaagccgugcuacaggaacagagagcucaggguggaggcccggacuucaacggggccuauccgggcugggagucggaggaagccggggcaaguggaguucgcuaggcuucgggcccuaguacgcaguggugaggaaagggaggcucggcgaggccuacggaccccggaugcgccggggcggggccggggccuuggggggguggggcccgaggugguaggagaggccguuggggcggggcgucccgaggggcggggcuuuccuggguuuggcgggcggacugcguugaaagcaggauuguagcugguguuaaggcgaaggagaagguugugggcgugcccacaaagccugauuggugugagccuucuaggacugacugacacacccggggccuaccuuggaguggagccuggaucaugugcaggaacccuauauuauggugcuuuggaauuggguagauuggggccugucugucgacuaguucaaacucuugauauucauggagaagugauucaguugguagcauuccuagcagcagcaugcucaaagcccuggauuuuaucacuaacaccgccuuggugauggugcaggccuguagucgcaacacuugggaggcagagguaggaagaucaaaagugcagaggccaggcuggauuacuggaacccuuucucaaaggaaaaaaagaaaaaccacacauggacaacguuaaaugcaguaccuguacuauucugaaacuuuuuaauaauggucccuuuuacuccuccuuauuaguuuauacagcccauauuauccaggaaacaggccaguaguggugcacaccugcaaucccaguacucagaguuggagguaggaggauguacuggcuaguuuugugucaacuugacacagcuggaguuaccacagagaaaggagcuucaguugaggaaaugccuccauaagauccaaccguaagacauuuucucaauuagugaucaaggaggaaaggccccuuguaaguaggaccaucucugggcuggcagccuuggguuuuaucagagagcaggcugagcaagccaggggaaagcaagccaguaaagaacaucccuccauggccucugcaccagcuccugcuuucugaccugcuugaguuccaguccugacuuccuugggugaugaacagcaguauggaaguguaagccgaacaaacucuuuccuccccagcuugcuucuuggucaugauguuugugcaggaauagaaacccugacuuaagacaggauuucuuugcaguucagagccaaucugggauggugagguagcguagguauuuguguacacugccaggccugaugaccugaguucaaucuugggaccuucaugguggaagagagucugcaaauugucuucugcccgucacagguacuccacaucacauauagagauaaacugaaaaaaaaucguguaauuuagcagaguguggugucacacaccuuuaaucccagcuucaggaagcagagacagacagagcuccaugaguucaaggcaagccuggucuacauaaacgggugaggugggaguggcaagucaacagaaugagauuuuucuuguauuuuuuuuuuuuuuuucgagacaggguuucucuguguaguccuggcacucacuuuguagaccaggcuggccucgaacucacagauccgccugccucugccucccaagugcugggauuaaaggcaugugccaccacgcccggcuucuuuuaaauuuuuuaaaagcuaacuuagguuacacauccauaguaugucuuuaaaaaaaaaaguggggggggcgggggggggaaacaaguucagaaaggcagguuccuaaggguggagcaagguugagcccaagacagaucuuaccacuuagagguuaaguuuaggggcaaagauugaagcuuagauauggaaaagacaguuguuauaccuccuuccuucaacacauauguauccaauuacaggaagagcuuuccuacuuagugagccucuguccgugucauugggguuccucauuuucugaugagcauauuuagggaucucuggcauugugacaccuucuaugccaaacugagcuuuuggguccucuaaccauucaugcuggacucccugauugauagugaaugauuuugagagcuaacuccuggauccucaggggacauaccuuugcccuucugggaguguguccugguccucaaagcuagccuuggcaucuugggacuguggagguacugggguauccuuggggcaaaaggcuccugagauggagccagacagauuucugcaaagauaugauuaccacacagcaccaugggcugggagugggcucuauccagaugugagaccaauuagcagguguuagauuccggguaucacuuuagaggcagaguacguuuuggaaagguuuuggagaccagagauuugaaaggcucucuggugaugggugggacagauucaaauccugcucuguuaggggccuguccccacucagaccacccagaggaagcuucuaggcagggcaggggaucuguucucuuccagucagcacauccaggcaucugugaucauucccugcuuguuuucggcuuuuuacuguuauaaauagccuggcauugaaugugugcccuaguccucucuuugcccugugggcuaguuccuugaugugcguucccagaagagcaguuacuaggucaggggcaauggaacuccuuugccauuacugguacuugucuccagaacucacuuccuggaagcaccaaucagcuccugcagcagcuggcagugggggaguggccgccugccccgacugcccucccccacuggccuccuuuccuggucuggcagguaccuucuucaguaagucacaguagcugccuaacccccaagguuagcauucugucugugcuuacccuagguguccucuccauuccuuccaucucaucugaggauuaacauuuguccuuuccauucagacuuuaaaccauuaaauuagaaaaaggagugcuaggaaacgaaaagggaagagagcuagcagcagacaggccacuaucuucacuugccuguauauggcaaaucccucagaaugugaauacacugcaccugccagucccuuuugagacucacagccuucagaggcucaggcuuagggcaggucagccauuauaacaaugguggugaccuggucagccuuggagagucaucuuauauucaguggcaagaagauaaauucaaggucaaccuaugcuauguagcaagaccuugucucaaggaaaaaaaaaucuaugguugcacuaaaaguguuuacaggggcugauuuugucacuuuguggcucucuuugccacccguaggaacucaggaaguauaguagucuggagccuugccccacccccaaacccuagggcuggauccaccaacuuugucugucucuaccuccuuauccuaggcuuuggucacauuucuuugacauggagggccacaagucugugcuugagacagugcuuggcucauacacaaacaguuuuuggcagccacaucacacuuuggccccuuuguccuuaaggcuggggccaagaggucucaagaguggguggccacaugccauuuguuuuccuccauaaauaguuucuucagccccaggagugagguuguuuauuuguaccuaauuauagauccucacauuucuucucccaccauuuucuccugucagccacuggccauuuuccuaaccuacugguggauccccagggauagcugugauuucucugaggaacacugacuuaggguuauugcacuuugaccauccaagcuccagaguucccagccauuagugcccacccagucuucaaggacauagauccuguaggaagcacaggaauucuguuauuuuaaguuguacccacccgugcccaaggacauagaaaggacaccagggacagggcuagcccuaaaauuuguaauccucugccaaguacaucagacuaggcagcuugucugcggggccugcugugcuagggacucgcuagccucagagaugaaggcaagaauccuccccugugcuagugccugggcuaguucgagccacuucauagagugcaccuuuccuacagugggucuccagggcugcuguccugucaggacaggccagagcauccagggcuccugagaggugucagaucuuuguuuuugccaacuggacuugccuguucaagcagccaaaugacauauccagggggaccguuucccagccagcaaagccaccaacuucuuuggaaaugcugggggcuguguccugaagggcccauuauuuucccaagacaacugaucacuuguuuucuugacaaugacauuucacacccauucuacauguagagccaguccagucaccacucugguauacugggcaccuugugccagggauggcccgagcagccucgccuuccugcuguuccccugggcauggucuauugacucucagccuggucugugcauucuuguucuaaguguguaaccuuggacuggggauuuggucuccaggguugaguagcccugacugcugugggauuauugacauuugcgucugucccugggguggcccugagucauuugggcgugagcuuggcuccaggucccguccuggucguagugcaggugcuguggcugagggucccugaggcugugcaacagaggcaggacugagaagacagcgagggugugagaggccgccugagcagggcacauuuuccagguuacuucugugggcaugagaaugagcaacaaaguucuggcuguggcagcuccugagagaaggaagcgaagggcagaugcuguggagagagauucccgcaguucagcuuguuucuguauggcucagaagucagucaauaccccaacccguguuguuagaaguucuuggcucuggauuauaggcucuugucuacuagcuccacaacuauccuuuauuuuuaauuauuuauuaaaauuuuuaauuauuuauuuuuauuuuuauuuuuaauuauuuauuuauuuauaucccaaauguugcccccucucccagaauuugacauuuuggguacccagagagucuuggaaggaugcuaagccugucauuacaugucuugugaaccaggccaugugauagucugcauggggaaugaaagccugaacugaggagucucacagacuaguggaucuugaugaggagucagaguuuguuggcuaucccugaugacugcucagguguuuugaaccugggaaauaggcaggcugaggugcgcuggguuucacugccucuagggggagaaccaggaccccugaguuguaugacagagauguaaggagaaugacagggaagacaugagacuaagauggaagagaaaggccuuguuuuagagaccugacuucacauccugccuagacauuuucccaggcaaguugcucuggacauguauugcuuggugaaugugauuggggguuugggggcaaaucugcacauaaacacaggcucugacuccugcuuuguuuccacuucccugaucauagcaggguucucauuccucaacugaaccucagucuccuuuucuauaaaaugggcuguaugaggugguguuugccaucuuuuuuucacguagaagagguuuuauugggagagagagacaaggugacagcagaaagagaagaggggagagggaggaaggaagagagagagagagagagagagagagagagagagagagcgcuagcgagcgcgggugugcgagcgagcgguguuugucaucuaaacagccucuuuuuguucucucucuuaguaaucaguuuguggauuguggugguggugggguguuguuuguuuuguaguuuuguuuuuguggguuuguuuugagauagguucucacaguauaucccuggcuggccuacacuaguuuuccaauccaaugcuaggauuaaaggcaugugccaccacaacaggcuuauuuuguuuuuaagagucucaugaagcuuaggccuguuucaaacucacuauauaaccaaggauaauaaugaacuucugaucuucugccuccaucuccagaguaauuucaggguauaccaucaggcuuggcuuuaugcccaccacacucaguuuaaugcagugcuagggaucgaacccagggcuuaaugcguauuuagacaagcacuguaccaacugagcagcauccucaguacuguuuguccauugagacagggacucaaaauauaauucaagcugacauugaguuuacuauguagcccagucugucuuuaaacucaaaauucucuugcugcaaucucccgaggccuggaauuauaggcauguaacacugugccugcuucaucguuaagccugccucagucuuauuauucuuggcucuaaagcaaccauucccaaaggugaaauggguuggguucccuguuuugccucauucucaccugugcccugaggugaccugggcauccucccaguauguuacagguugauuuggacaagguaggcaggggagacccuuccaccugcuuuggggugugcuuauuuauuccacagacauuuguuggcacuugauguauaccaggcccuguguuaggccuggagauacaacagggaacaagaguccugcuuauagcgcagauagccacaaaaaagaaaagagugaaacuagacacauaugaggguugcaauagcugggggcuuagagggaggggccuaggacagagaauggggaggguugggaaaguaguuaaaauaggauuguggagagggucuucuugaccaaguggcauccacaggcuuacaaagacaugaggcaagggccagagaaagaacgaucaggcaagaauacucuguguaaagguccuaaguuaggacuguguuugauguauuaggggcagagcgggagcccauguagcuggcuagagcaugugggagagagaaggaaggggaagagguuucaggacacauagugcugugccuuguaggccccagggaggaccugggcuuugauucuuagggacuuaggacccaucuaaguucuucugcucguaagucccuggcuggggcaagcaguauggcucuagugcucacagauguuuucuuguggccgugaggaguacaagcuuuuggcugggaccucaaaagaaggcugauucugugauaacaguguaagaugacagacaaccuggccuuugaagguagcagggauaaacacacacacacacuuauacuuugucuagcaacugaauuuguauacacaaguacauauacagggcuagggauguagcucaauugguagagcgcuuuccuagaaugcaugagacccuggauucucagcccuaguaucaaauacaccagguaggcaugguaccaaauaccuauaguccccacacucaagaggaaaggcaaaaugauaaguauuucuagguauuucucagguacaucgucaauuggaggccagcuugugcuacaugagacccuaucucaaaagaaaguacacauauacguauaauucuguaugucuucagcaucugaagccaucugauggaaccuacauggguccccagaagcauucuagugucccuucaguuacaaaggggaugcaggauugaucuuagagucugagaggaagaaagaacugaagaugacuaucggugguugucaugaguaccuuucaaguugagugagucauugacugagcccaggaaggugaagguagcaccuagugaguagauugggugagcaggagacuauucuguugugcugauuugaaauguggggcucugucaggauauaaaggcagagggugcaccaaucugagcuugcagaauggagguuaauguaagagucaccagcaguauuuacagccagaagucuggggacccaguuauguggcucccuuuuauuuucaaguagaaggauagcuugcagcagcucuaacauggguaguguggcaccacugaagcacaggaagaaacaguguaggagaaggagggcccucugagcugcugcauggggacaaggcagugauaguugaccucuuucuuguagccccuaggaugucuguagguugguauauucacugggggggggggggguccugaguuccuccugaggguucuuccuauuaugugccccucagccugcuuagcagggcuagugagcucagccucaagucuguugccugacuguaucuuuuccacugcaccauuggcuccugauccaaagaugaaugcuccucccacucccuauacccuggaugacaaugcucagucuggggccugugaagccuuggagaacuggaggcagagacagaaguauagauaguacuuuguagggguuaagugugcagaaaggaggaaauuagggcagugcuuggagagguaaagcaucaagagaauguauuccuagccuggccuuuugguucacuccuauaaucccagcacuuaggagacugaggcaggacgaugaaguuaggggucagcaggacuacccugucucacuguccucuuucuuuccccuuucucuucaccccacaaaaauguauucuuuucaagaaagaaaaaucagacauguaaacugagcagcucacuugacuguaggaagggaagggggcuaccuguugggccuugagcccuccaggccuuaaaacucccagguagguccuagguuccuccugagagcucucccacuguuugucucucacacacucaguagggccagagagcucagguucagucuguggcccugccaugccugucucucccuaggcugggagccagauccugggugaauacucuuuccuauuccucaggccuuggaugaccaagccugcagcccucccuuggcucuccacugguaggcccaccucagcuacagaguuccacaccucugcuuccagggaccacaagcuuucuggcuaagguaucugauuagaugccuacugccaaucacaucugcauuguguacaugugaacagaaaugugagcauguguacaugugaacacaugcauggugaauccugggacuaagaacagcccucccaggcccugucccugggggcagacauggcuuuuugagacagggucucacuguguagguuugaauggccuggagcuugauauguagaccaggcuggccucccaagugcugggauuaaagaucuuagauuucuaaucagccugccuccacuucgggaguucugggauuacaguucuguuauuacaggcaugcaccaccaugcucuguuuaugcggugcuggagacugaaccaagggcuugacccaugguaggcagucuaucaucugagcugcagcccgagguucauaucuucaugauuggcuccagcugcaaggaggcauucacaggguuagagaccuuuucugccugucacuguuacaaggcuaguuuuuaggcuaaaggaagccauacacacuuacauaucaaccuuauaaagagaugacagugaugggacccucuaggagcacugaguagaguaauccugaccucaggcaggagugguggccagcugugucuagacugcagccagaacgcauauuccuguuguucauuugacugucaguguugucugaagcagcuggagaagaagcauggacagggaggugcauugcuuccuguuacuuaaaacaccggacacaaacucuaauagauaguaacccauccugugcccugaacaaagccauuguaauaaugacgugcucaccugugucccuucuuuguacugcaugcuggcugguuccugacucuguguacucucauuuccaucuuucaaguaggccagcugccuuccuguucacacauguagaauagguggcccagaaagguuaagugacuuguucaaggucacucaacuucagaccuuucuuucugugaccauucuugacuuacucagcugucagguuggugaguuucaagccacccuccuacaguauggccuggaaugucaccauauucuagcugggacaaucuuccucugaaggcaagagacaggcgaaggcaccugugcuguuucugaagcuuccacuuaccagugugucccagcgugggaaaauccguggguggcagaaaucagggagccaccaugcagguuugcuggguggauaugggaaacauugguugcugccggauccucaccucuccucccucucucccugcccgcaaguggugcuuauuggggacucagguguagguaagagcaaccugcugucacgcuucaccagaaacgaauucaaccuagagagcaagaguaccaucggaguggaguucgccacucgcagcauucagguggacggcaagaccaucaaggcucagaucugggacacugcuggccaggagcgcuaccgugccauuaccucugcgugaguuuagcuagggucaagaccuagagauagcagggguguguggauauaugucaugggagcuuggaaggguauguaggggcugaacuagagcauggaaaauuugagaucagggcugugggacccagaggcagaccaauauccagccuauugcgcaaccuggcugugagguuauuacuggguagacagugaaggucuagcuuaggccuuccauuuucacccaaccucacccaggcagccuaccugcuuuucuauuccuggcaucuucucccagucuuagcauacauuuugccucccaguugcuaagacccacccagauugccucuuugugacccccaacccccuggcuguugccucaccucauuuguugugcuuugcauuuucuucaccauggccucaucauggguccuuuauccccagaggauggaaauggucccaucugugguacaggccuguuugcacaguggacacuggcacuucugccugguugcagccuuuucccuacacggcugcuguaucuucuccuucuauugauggccuuugagugucuucuauuacugagccccaaauucccuccucagucucucccauuccugaagggccuccuucaaagauaggacgacugccccuucugggcccugugcuugggccauccuguaggguuuccaugaggcugccaccgcccucccaucuaaggcuccuaucuguacuuacucugcagguacuaccguggugcagugggugcacugcugguauaugacauugccaagcacuugacauaugagaacguggagcgcuggcugaaggagcugcgggaucaugcagauagcaacauugucaucaugcuggugggcaacaagagugaccugcgccaccuucgggcugugcccacugaugaggcccgugccuuugcaggugagcuuguggcagacaugccagacugugcucugagaacuagacuggacagguucagagaaacaucuagaaguccggcacccaccuccuccagugucaaggcucauagucauagugcuuguguucagccucuugucccucaguggucccaccuacuagcagcaacucuucagauccugaguuggcaggugggcagguaugguccuggaggggagugucgugagaggggugugggagccagacccucuuauuuagagagaauuuucucuuuuccagaaaagaacaacuuguccuucauugagaccucagccuuggauuccaccaauguagaggaagcauucaagaacauccucacaggugggccccgggucuggguggccguuaggaagugcuuuauguguaggacccaguauagaccuuccuugccccacagaaucaggacauagcuagcccuugcuggcauguggacacagagguccucaccuaagucccugugaugugggcccuucugggucugcaggggaaggaaggaacaagcagccuggguuagauaggaccgguucugugacuugcuccugccccugcccacuuggcugugccugggaaccuccaagagcccaaccccgaauucuguuuuacugugaugugguagggguucccuacagugugguggagaauugucuuuguuuccuauugcuaugauaaaauacucuaaaaaaggggcaaauucggcauuuauuuuggcugucagcuuaagguacuagaagcagcuggucaugccaucacagucaggagacuggggauccaugcaagcuaccacuucgcucccuuucuccacuaaacagcugagcauccccugcagggaauggcucugcccacgucaauuaaugucaucaagauccuccccgacgggcgugcucagaggcccuucucccaagugauucuaggcucugucgaguuggagauuaggaaucaucuagccaauacccugcagaaagguaaauugccuucccuaggguacacagcuugcucacgacauccucccuguugcagaaaucuaccguauugugucacagaagcaaaucgcugaccgugcagcccacgaugaguccccuggcaacaacgugguggacaucagugugccacccaccaccgauggacagagacccaacaagcugcagugcugccagagccugugacugcccugcacuuucuuuuucuuuugguuuugguuuguuuuguuuuguuuuucuugguuuuuuuugguuuuucgagacaggguuucucuguguagcccuggcaguccugggacucacucugucaaccaggcuggccucgaacucagaaauccaccugccucugccucccaagugcugggauuaaaggcgugcgccaccacugcccggcuugcccugcacuuugacccagcgugcgugcacguccucgauccuuggccagcccuucaccaguguccucccggccccucccuugucccucuaggacaggcugcucccacccuccaagugagcuccgccugccagcccaauggcccaggaagagcaggaguccaguggccucuccuguccugccugcucaagagaagcuaaaagccccuugcuuauguaccugcucuuggauauugugggcaucuugacaggauagggagguugguaggauggacaaggccagccagaggugaggaagaugaguggaaggaaccugcuucuccuguuuuccagacuucagagaucgaaaccgccuuuccucucuggccaguugaccagcuggcccuguauccucaucccaaacucucucugagcugauacccgaagagccaggcaucagaggcugagcagguggacauucugggcucugccuccugccuacaccaccauagccagugccagcacggccuccagcauucccaggccugcgcacuccugcuccugccuguagauuuaugcugggagaagacacccuugccccucucccuccuccucugcacgcagcgcucuccucugcccauccccacuucucugucucgucuccgugucuggucaggaaccugucugcaagugaagcaauaucuucguguuuuguauauacaacugcucuuguagccuuugguuuuuguuauuguagagaacagauucuuuauacacuuuguaaaauuuacgccaaaccccagcucucgaacucuuauucucccuguagcccuugcacuguugcccguuacuaaaauguauaagccacuucuguacagaaaccuaccacucagcuucugucuucuuucucuccaccaaaugaugcaccugaaccagggcccuuuuacguguccccaauaguagguuagcguaguaccugcugaagacagugggcagacaugcugaucuugcacaguaggcugugagauaaggaucuugggcuccaaggaggggagagugaguccucugcaaguggcuccuguaguauggaggaaggaaaugauggugaccugaaguggcagccuucacuuggaacaguuuaaggagaaguuguaccagccuuucccaaaucguuuguaucuaggauugacaggccuaggaugcccccuggugugaaugggaagcaugagcaugcuugccacuuccaucugcugccaacaauggacuccuuaucuggaguccuggcaaggaaggugugcuugauaacagugggugaugucagcucuaccauggcugucuuuacucaagaaugacacuugauggggacaguagagggcaacagugacuacaaggugagcagcucuugaucuucacuggcgcuucccagaacccauugcccuuguuccuguacccaaagcagauaguaaguaacgagauguguucuucuccaccccugaaggaaaucuuacaauccaaauacagccagcuauucuagaaacccucaucucuaaaugaagagaaccuggggguguccugccuccugauucuggaaugaauguagccuccuuguguguguuggaagagggaaguggucaaucccagauacaucucucagauccaagcugggcacaguggcucagacuuguuaccucauacuuuggagguggugacaggagaucaggaguucaaggccagccucagcuacauaagacccugucuaagaaaauaaaauuuaaauuaaaaaaaaaaaaaaaggaaaaacuaaagaccccaaagaaguugggguggauuuuaugggcaucucacaauccagaaguuacccuuggccaaagcuaugauggaagguggacugucuagcagacauaagcaggagguagcauaggucuaagacucagcucgcaggaacugccaauggaguugacguacuggaagaaccaacuccaaguugucuucugauuuccacaugacacuaaauauuuuuacaaaacaaaugucacugggugggggcaaaggcucuagguaaaagugcugcaugaguacagcucccagaacucacaaaguuggacucaauguaaacaccuguaaugucaacaauccuucggggaaaugagaggcagagccaggguauucagaagcucguggacuagcuucuguagagguaaaacaagaaagacccugucucaaaccaugugaaagaugaggacucccuauaaaguuguccucccaccuggacccuuaggagagacuauuugcacacacaaaugugcacauagccacaugcaaugugcacacacaaauguauccacauagaguauacacugaugcucucacaguguacacacguaaguagauaugcaauguccaugcaacacauuauaugcuuugguuguaagaaauggaaaaaucaaggagaacugaucuggaagcuuccugccuagcuuucauagugccagaagcuguguagcagcuagaggagaacugucuuugacagcucugccuguagacccugcuacaguacuaacauguuaggcaagauaugccugcuggugccauaguggcaugacuuacgaguagcaguuccuuucugauuaaaucuaaagcccauuccacagaagugaguucacauuugguaccgugagccuagucaaaagcuugcagcuagggauguuguaggcucuuacaggaugcacaugccugcacucaccuauacuagcauugucuuucacaacaaaaauaaaauuagugcauaagcaacucauuuuauuguuuggucaagcuuuuagcugcuguguccagguagggacuagacuagaacuagaggcagaauauccagggcuaagucuaagccaaacaaacuuuuauuauagaaucguuggguuuguaacugucauaguguagcaagggacuggagaaaacacuacaaagaccaacacaugaaagacaaaaacacaaaacuacugaaaacccuuccccacaugcaacaaacggaaccugcucaagaaagcccgugaacuugggaggcaggaguaucccuuaguuugaggccagucuggucuacauagcaaauuccaggacuauacaggaaaaagagaaagcccaagauauaaaaauguggggaagcagguacaaugcuaaugcaccucuaaugaaucaugaaccuuguggcuuagcaugucugaguacauauuuuccccucagcucacagagcucuugcuguccaggccuugauuuguaauccaggguggcccugaacucaagagaucuaccugccucuaccuccugaaugcugggauuaaaggcauguaccacuaugcccagcuugcuuuuucuuucuuuuugaaacauuauguguaugcauguuuugacugcauguaugucuguauaccacaugcaugcaguuuccacagaggucagaugaacaugucaacuggaguuacaaauaguuguaaacugccaugugagugcugggaauugaaccugaguccucuaguagagcaaccugugcuauuaaucacaaagccauuuccaucuuuccuuuucuuuauaaacuuucucuuuuugucucuuuauauauguauauguugaguuugucaugucugcaugguguauguucauauguguguagagaugcgcauauaccuauggagaguaccagagguaaguuagaaagugucuuccucuauuugagguaggauuucucccagcaagcccaagcaauccccuucucccugcaucaucagugcugggaucacagaugugugcagggugacacuugguuuauuacauggaugauggcacucaaggucuggucuucuugcuuacacagcaagugcucuuagccacuaagccaccauucagcccuagacucuauuucuaaccauauguccuagugcaauucucuguccuggaacaguagacccuggaaaccucaguggguggccucgaaacucugauccgaaccugaaacaauauguuagugguguugggaagugugaccuuucugaguuaacuagaaacagaugaggucaucagaguagggcucccaugacagcauugcagcuucauaagaugaggaagagagacccagcucggcacacuuagcgucucaccuugcaauuccuucugccacguuacaaaguuguaagaaguucuucaccagauguugcaccuugcuccuagaccucucagucaucagaauagugaauuaaauaagcaucuauacuuuaaaaaauuauauucuaugucugccugccugccugucugucugucuaucugagcuuaguggacaauuuauuuucuggaauugauucuucuucacuguguggguuccagggaucaaacugaaguugugaggcuugguggugggcacccuuaccugccgaauuauccaacugacccuccucuuuccaauauccugcucccaaacccuuugucacggcaacuaaaaugaucuuagacaggcgauguggcuagaaguuugauuggaugugaguuggaaggggcuguugggaagaugaauaacuauucuggaccaagggagccggagcagucagagaaugaagagucugggauaauuuugguacuugguuaguauuagaagauuauuuuggcuggcuuaaugucaacuugacccaagcuagacacaucugaaagaagagacuaucaguugaaaaaaaaaugccugcauaaguuccagcuauaaagcauuuucugaauuagugauugauggggcuagagggcccgguccauuguagguugugucuccccuggguuggugguucuggguucuguaagaaaggcuaagcaagccaugaagagcaagcugauaagcagcacucaucuucugcauuggcuucagccuccaggaccuuacccuguuugagguccugucuugaccuucuucagugauggauuacaguaugaagugugagccaauaaacccuuuccuucucaacuugcauuuuugucaugaugcuucaucacagcaagagaaacccuaacuaggacaaagguauuuucuuguuuuggaaauuuuguuuuuguguugauuauuuuuauuuucuuucuuucuuucuuucuuucuuucuuucuuucuuucuuucuuucuuucuuucuuucuuucuuucuuucuuccuuccuuccuuccuuccuuccuuccuuccuuccuuccuuccuuccuuccuuucuuucuuucuuucuuucuuucuuucuuucuuucuuucuuuuugguuuuuugaggcaggguuucucuguguauccuuagcuguccuggaacucacuuuguagaccaggcuggccucgaacucagaaauccaccugcuucugccucccaagugc

SEQ ID NO: 8540 - RNA, 12433 nt, Mus musculus
gaacuuaguagaaauacuuuuauuaggauguuucaugaagugaguugagggauauggcauuacccaggcuuugccucacucuuuccccucagcauccuaacaagcuagagggagcaucuucucaaggugcccugcugugauucagacagcagagagagucuagauguaguuagcagcucacagagguagagguuccucauuugucauugcauuccuuugcagugggagacccuguggaagacugucccuagaacaaagaaaagggguccuauaggcaaaaggcuaguuucagacacccacuggggggcagugcaguagaaggauggaagaaauaagaaacaaucuuccaagcuuccuagguugaauccauguuagauaccuacccuagcuugguugguaaauaacugggaucagugaugcaggagacccagcacuugcucauccccauuugagucuugcaugaaauaacugaccuguuuggcaguuucuccaucuuuggucuucugaaggugcuuaacaucuuuguuucuuggggaccacacuuaccuggugguuugaugucaggugggcauggagcagugcagccaccucauccuguucagccuccagugcaauggccagggcacuugugcccuccugagaaguaauaggacauuggucccugggcuacagaggcaaccaccaccacuacuccaggcccuugcuaguggcucacauugucuaagaugguuaggucacaaccuggcugggccaacaacaauugaacuguaucaaggcguccauacucgcuggcacacaucagugcuguggccccaucagcauccuguacauugacaucagccccgcauucuagcaaggcagcuaccauguccugguggccauggcugauggccagcaugagggcugucuguccagucugggaaaagagaaaaggaggucucgaguauuuuaaaaguagaaagggacaccaccuuacccacccaucaggacuggaguguccauugcaccuggcuagccuuggcauugacaucacccauacugaaaagucucugggccacagccaugucuuccuccucuuguccuacagaagugagugcagccaacaugagggcagaguagccagcucuauucuggugauucacaucacagaccccugggaagaagaaagguuagucacuucauguaagccucaaaugcacugauuuguugggggggggcaguguugggucuccaaaucacagaugguggguaggcaucuuuuaucccaagcugaccacagacaaugacaaccaaugaacuuguacugcuuccagcuccccagcacugagacugcuggguaagaacucucccaguugacaggacuacaucccuugucccucagccaauugcauucuugugcauacaugguguggcuauguguaagaacuaaauacagagauuagagagaccugaguguucccuaccuagguuggcagccaguaagguccuguagccucuacuacucauagccccagaaauaaaccacuggcuuacauguacucugaaaaugcuaaguguucuuuccugugucugucccucuuuaaaaauaagauuugcuaauuauuucuccucagguccacucauacaugcuuuaagaacaaggacacagacuuaaacacuggagaauuugccagauauguaauuccagcacuuaaaauauuggccagccugagcuauauaguuccaggccuauacagugagccuugucucaaaaaguaaaguaaaauuuaguaauuuuuuuaaacuuggccaggugaugguggcacacaccuuuaaucccagcauuuaggaggaagaggcaguucaaauccagccuaaucuacagagcacauucuagagcagccagggcugagcaauuuguaagacucaaaaaaaaaaaaaaagugccaugcugaggugaaggucccaacaaagagaauaaugaaguuaguaacagguaaagguuaguaauagguacccucuauguuguuucauaagcaaaacaauuaugaguggucacucaaggauggugcuaguauacacuagauuugauaguuaugaauagccaccugaguguauuugccucaguggggcaauaagaugaggcagaguuaggcaggaggcaaguaaacagcuugaugacagucaaccuuaacagugugagcagcacccgccccccaggggauagacaguggagcccaaaaacucaggaaacagcaaggcuuagguauaugcuuuuaauuccagcagagacagguggaucuuucgugaguuccaggcuagccggaacuacagacagugucucaggaaaaaaaggaaaugucaaggccuagagauaauauacccagggaggaaggugcuaaauugaggucucuggucucaaagcugauuguuauuggggcuggggagcuagcucagaacagcugaagauauaauaauaucaaaaggccucuacaucccuguaauuucaguauuuggaaggcagaagcaacauggucacagauuugaggccaggcaggggcuagauaucaaggcauaaggccuugauggguuaugucugguacgccuuaugucugggugcacagagggguuagaacuacugcaagcuugaggaccacacuuggaucccagcacauacauagaaaguugagcaccauuugcaacuccaaggcuggggagauggaaacagaugggauuugcuggucaaacagcucuagguucaauaggaaguucagcuucagaaaacaaaguagggagucagaagaaaacacccagugcugacuuuggccaagugaacagccaccaagaauaacuuaagagaggcucaaugggacccucugcuacucaucugugccccucagugauccaaccuucaccugccuuagcccucuucuccacaacucugaccuguauccaguagcaggcuggaaauggcgagauucccaugagacacgcuguaaugcagagcuguguuuccauugccaucagccagguucaccacauaagccagcagcucaggccccaggcuuuucaccccucgaagaaccccagccacagacucugccugagagcguuuuuggcuggacacucgaaaccauuccugggccacaaggcgugcugcauucuggcaggaccaggacaaagaauuaaucaauggugagaaaaaaaaugggagaggccaaaaaauagugugugugugcauaagacauguuuggugacccuagggaggccaaugcuuucuaaguagggugucaagaaaccagguggagccggucgugguggcgcaggccuuuaaucccagcacuugggaggcagaggcaggcggauuucucaguucgaggccagccagggcuacacagagaaacccugucucaaaaaaacaaaaaaagaaaagaaaccagguggagagcggggaccucacucacccucuucgagaaggagguacagucagugaaguuuguaugcucaggaaaacaagaguuuacauacggggaaaugggagugaguacccacuugcucuugaagcgucauggaugggucuggggcucuguuuacuugaggcuguggcugggcaguccaagaaaaggucacagcucuccuugggguggggguaucucuuuggagagguuagaucaaguaaggucuuucuagugagaggggaccaaacuugguacucuugcucuaggaaacucugucggagaguagaaaucuggcccacacucacgccaucucugcuggugacuccacguggccgguucagcugcugauucagagcaaugcaagccucccucaaacggggguucaguucacaccugccaaggaggccagucuagacucagaauccugaacagugaugaccaggaggaaagaggcuauccgcauuccaaaucuuuagagaaagcucaccucccuucucucccugccgucagcucuggaugugucucaagcucgcaguccccagcaucuuugucauugugggggccagggguuccagcgucagaucccccacugcuaucaucugauccagaagagcuacuccugggguguucagcaacaccaucuucaucaucgcuguugccauccucacuggaggaacucucauaccuaagaacaggaugggaggcccuguaggcucauucaaguguguugaagugagaguggcauuuuaaagaugaggaaacugaggacuaucaaagccacuuuaugagcagaggggcagaacugggauuaauagccugugucccuguggcugcuauggaaaggaaggaaagugcucacucuccguugaggaccccaacgaacugcagacucuugggucccugacuggauugugcaccuggaauaccaucuuucuucuucaugauggauuugaggaugccuggcagggaaucauaugagagcacugaguuugacuucagcgaccuggcaggccaagguucaaccaguaguggagacucaccaacaggggccaucucgucuccagccgugggucugggcugguucuccacuggcagcucugucugugugguuuucucagugcaacccaauguagucugggcagcaacgucgcgagacugaggccuggucacugcggccucgugggccuccuccaacucccucaaucggccccgcaagaguucgcucaccccucgcugaugcuccaagcuggugcggagcagcuccagcucacgcucugcagccucaggcaacccuaggagcuccucagucacccacguguccaccucaacggucucagggaccaccuccacuccagccuccccugucucggguacugccugggcauccaccucucgggucucaggcacgacuucggugcccgucucccgaguccgggguuccccaucggguguccuagaccccgggucgagcaccugcagcgcuccuucgcugcgccuggcagccaacccgucgggauccucugcccgggggcuagcccuggagcgcacuccacgauccgagguggccagacgcucggugaggcgccgaagcugggcgagcuugucugggcgcgccucgaucucuacuucuuguucuggcugcacgcgcccggccaguagccgcgccuucucggcacgcagcgcgcgcaccugcuccugcagcucgggcagagcgcgcgccugguccucgagcucacgcaggcgccgcagcgccgcggccaucugcucccucacuagcugcagcugggcagggcccggggaggcaagggcgggguuaggggcggggcugcuacggccggacccgcgcggacugcgugugacugcgcgggccgggcugagcgcgcgcucccgagccugcgccugcuccagucgucggcuggucuccaagagcgugugcucaacgcgcggauugcgcgacaaggagcguggcgacagcggagguagcgagagccccgggaacgcaccaggagagagugcacccgaggcuccgccgucgucacuggccagggauucgcuggaaguccaagcuccugggcuccgcgcucccgcgaggcccguucgagacgcgcgcgggcggcgugcaugaggagguccuggaguucggcgagaggcagggccacgcucgauuuccuccacguauuugaggaaguccagguccaaguggaagccauagggcgucuccacagaauagggagagcuagggcugcgggcacuuccaguggggccuggguacaggggagggccgcccaggucugugguauaacaggaggguugagagggaagaggggucaaaccaagaagcucccaaagagagugaacaaacauguuuccucaucccuugucccugcggugcaccuguacugcugccagagcucaagaccacaccugaggcuugcaggcguaccugcacacgaugggcaugcaaccauguuuaagcacccacuaugugacaaauacuuauauucuugggacacuauaauaaggaagacaauaucuugaccccuuguuagcuauaaauagacacaaucauuucaaaugauuuucaaggcacuaauacauggugaauuacagaaccacugcaggagccaacuuuggcucucacgucagaaaaaaauuuccuguggcaggaacuuaagauugagcgcuucauaaggcagacgcagcugcaagagcagaagguuccaaaaaggaaaaacagcccauggaagacaguagacuguagagugacggauggaauucagaugucuccagaauggugaaggggguuggggggagaacuaaagggugggcagagggcacacugggggggggggucucuccuaggcaaccacggggaguugggacauuaauuaugggggcuguuaugaguggguuuuaaacagaaccauuacguuugcuaauaaugcuuuuuguuguuguuuuuguuuguuuguuuguuugcuuguuuguuuuuccaagacaggguuuaucuguauagcucuggcuguccuggaacucacuuuguagaccaggcuggccucgaacucagaaauccgccugccucugccucccaagugcugggauuaaaggcaugugccgccuggcugccuauguggcuacuguguuaauaaaaauaaaagggaauuguuaagcuauauccauauauacaagcacccaauguggaucuguguaaauacauuuaccucauuuuguaaacucaccaggaagguucugauucaggacaaacuuggccauguuuccuggagcagccaccagacagccugaaaaaaugucccccagaaaaguaagggugcaaauccaguucugccccuugcuuugaccuugauauuagcuacaccaccauugaaacuuugagcaaacaguuacgccacauugaaacuucaaaccucacccacccccagguucuccuccucccuuccggaaccucggaacuacucugcaacagauggauuccaagugcucuaccacuuuugcuuuugagacaaaauauugcuauguggcuaauacuggucuacaaaucgugauccugccugagccucucaaguucugggaugacaaauaugugccaccauguuuagccgaaauuugaaguuuaugaaguaugagcaccuaaguugcaaagcugggaagaaggaagcaagaaagacgucaagcaaagaaaaauaagaaaguggaaguacugcagacucuggaaacugagacuagaguaucacaauuagagcuaggcacaguagugcacuccuuuaauaccagcacuuagaaggcagaucuugggcuggugagauggcuuaguggguaagcuuagugcucuuccgaagguccggaguucaaaucccagcaaccacauggugacucacaaccauccguaacgagaugugacucucaguguccuuacauauaauaaauaaguaaaucuuaaaaaaaaaaaaaagaagaagaagaagaagaagguggaucucggagugugaggccagucuggucuacauaguaaguuccaggacauucagaacuacauaguaagaaacucuuggggggggggggguaacgggagggaggggccagagagauggcucagagguuaagagcacuuccagaaguucugaguucaauucccagcaaccauauggugguucacaaccagcuguaaugggauccgauguccucuucuggagugucugaagauagcaacaguguacuuauauaaauaaaauaaauaauucuuuaaaaaaaaaaagguacaagauaagccuaagcaacuuagacagauccugucucaaacgugaaaacagagcugaggauauaguucaguggccaaaugcucaccuaucauucuccagguucaacccccauuuuucuuaagagaaaugguaagaagauuuaauguguagaauuuuaaccaagguuacuugcaaacccccuguaggaacgauagauacaaaguauaacucuagcuaagucucagugucacgauaguugaacaccugucucucuggaaugucucuaggacaggcaaacaccagcaccaaaagaggcaaagcuguaacuaugcaugaggaguucagugagcaggacuccucagaugacauuugaaggcuaagaaaaugagggucuagaacuggggauuugccuggcauacacaaggacaugaauuugaucuggagcagcacccaaaaagcaacaaauccugggcuggagauguaguucacuagguagaauacuugucuagcacccacgaagcccuugguuacugacuaguggugaaugcccaucacucaagagguagaagcaggcagaucaggaguucaaaaucaucuucagcuacauaagauuugaagccagucuggaauacauaagagccuaucucagaaaaguagguuggagagauggcucaguaguugagagcacuuaacuauucuuacaaaggacucaaguucaguucccagcacccacacuggacagaaagcucaaaaucacuuguaauuccaguuccaggggauccaacagucuucugacccggaggacacuaggucuacauacauacucagauacguucacauauaauaaaaaacaaaauuuuaaaguaaagaaggggcugaagaguugaguaauuguuacucuuccagagaacccaaguuugguugccagcacucacacaguggcucacaacuuccuauaacuccaguucccguguauucaaugcccucuucugccacacacguggagugcauacguaaaugcaggcaaacacucaugugcauaaaauaacuuuuuuaaggaagggaggaauaaagaagagaaaagaaagaaagcuagauguggugguacacuguaagccuuccuuccacucagaaggcugagauaggaagacagaucaggcugggcuacaagcaaggcuaaguuguauacugaaaaacuauuuccgaaagaggaagagcagguagagaaggaaugaaaucacauguaauggguuaguuaagaucaagcauuaaaucuagaacuuuaaucccaggacucagaagcagaagcuggagaauaccaguggguucucagacaaccagagguaccuagagagacccugucucaaaaaccagaagcaggauaggauagggacggggacguaguuucaggcacugcaguguuguaacacgcauaaggaccugugcucaauccucaaugccuagcauccccauauacaugcaaaaauggacaaaaagggaaugaugagagggugggacuuugaguacccacaugaaaagccuugggggagcaaaaaguggcucacauugauuuucuaccguauacucucccugaguagccccuguagaauucugcaccauggauuauugguggcaauuuacagugcaauucaguccauugccuaugugaaacaccuuucagauuagguucucuccaccuucuagggaccccuuguuuguagugaccagucaagcccuugauuguguagcuuuacaucgagcagacccaacccaucuucuugcuaaccaacccucugcuucaaacaacuaaaaacccagccacucuuuccagcuuuucaaauucugcauggcgaucugagugccagacauuacuagcucuucagcacccaucagcaugacuaacacauuacccucuccacugcugggagaaccccuuucuacucucugagcucccuccucuaacccuuccccuguccaaccuaaggcucugaaguuuuccuccccaccccaagcagcuguuuccuguccccucacacuggcuacaagggcaggacagcaggucaccauggaggacagccagugccucucaggacuuguuuuuaggaaauugccagggaaaaacugagcuucagaaaaaaccuggaccggggcucaggggucugaaacugccuuuugcgcagcugcagugugauccugugcagucugccccuuccuccagaaaccuggucacauccgaauccaaagcaacaggaccgagaaagcagccccaggucauuuuuaagacugaagcauccaggcacaaagacuggacugagacauagggcagagauuacuagagugguaaacagcaauaaggguugcuguuugcuuuuaauuuggaugguuuggggcuguguguggguauuugcccauggaugccaaaagcuguagcuccccuggagcuggagucacaggugugaguugacuaagacagcuggaaucaaaugacaagggucguacucaaccguaagcacugagucaucuuuccagcccauuaguuuuguuuucuuugguuuuguuuugagacaaggucucaggaagccuaggcuggccuccaacuccuuccauaguugacagugaacucaacuccccucccuccaacccuugagugcugagaugaucacgugugcuuuaccacaccuggcuugugcagugcuggagauggagcacaaggcuuucaugcacacuaaacaaauacuguaauaagagagcuacugccacagccucaguuucccucuuuuacauauggaucagcuucguuuuguucuguuuuguguuugagaaaaauucucccuauguuaucuagaccaggcuggccuugaacucaaagaacuuguucugccucucccugcugagugcugcccuguuugcuuuuuguuuuauuuuauguauuuaagacagggucucacuauggagagcuagcuggccugaaauuugcuaaucaggauggccucuaaaaagagauuccccugucucugcuucuggaaugcuaggauuucagguauguaccacuacgcccaaaugaaugcuuuuuuuuuuuuuuuuuuuuuuuugcccucagccccacugacagaagcuaggugaguuuuaagcuacaccacuaaccccuuuuuaauuuuuuuuuuuuacauuuuauuuauuuuauguaggagguggaagggugggugggugcaaggaugccauggggugagaguggagggcagagggcagcucuauagagucaguucucuccuuacacgaguaaaucccagggaugcaacaaggaugucauucccugaucaaguaccuuuacuggccaauccaucucacugaccccuuuacucaauuguuuaaacaggcguugaacucacucugcagcucucaggcaggccuucaacuuucuuuucuuuuuuuuuuuuuuuucuucgagacagcguuucucuuuauagcccuggcuguccuggaacucacuuuguagaccaggcugcccucgaacucagaaaucugccugccucugccugugcugggauuaaaggcaugcgccaccacgcccggcgccuucaacuuuuaaucauccuaccuggaccucucagguaacuaggauaauaggcgcuuuuggaaagauucccuuuugcuccccuagaaacugcagggaacccaggccacauaucacccucccagcucacagcugucaguuccagccuugggaguaaggagugugguggggcaagccaacauuagacugcuacacaagccaaugccucccggaguagggcguguagcugcccucauaucucccacacugccuggcuaucaaaguuaaauccggauccccugccugagacccccucauuaggcugucagagcugaagccacacgcccccacacccagcccugggacuauuucgggacacagagcugcgaucagucuagagagcugugaucaggagagcugucaucaggaaaccugaaggacaggacacagagcaugcauacccgagguccugaagaaguuaugucuuacugauaaggcucuaggugggagcccuucauguugggauaggauucucaaacgcaggaugggggaaagagcuagaugauggcaggacaagggguccuugaaucaucacacacacacacacacacacacaccuccccaaacauacagaaccaaguccgcuuagaaaagacagggcaguuuccuacaggaaaaaccgcugggcgguuccauccgcugcuauugucaguagguccggggagugggggacauccguuccucccuccaacaccguuuccguaccauccgcccacuccaccccacugcaagaaacccauucccaggucuucaagccaacucuggggaaggguccccuaaggcaucuaggagacuaaaaugcgcacaaguuccucugguuagguccuggauggccaugugguggcgaucugccuaauaaucuaggguccccccucuccggucggcuuuaaaccaccugaggcucccaauguccaaauggucaccauuacaggacacggcgcccaccccguugcaacgcacagaacccauagaagggggcuaaaagcaucacaccccucccggacacuuggguccacuguuccccuccaggacucgcgugguugacuuuaccugaaugagaagccccggcagcgcccgcaccgcacccgagcccgcccccucgaagcuccgcacggguuaucaaggcu

SEQ ID NO: 8541 - RNA, 1138 nt, Mus musculus
aauugugaaaagaugggggaaccuuuauuucagggaaacccauuuugagaaacccaaggauaagaaaauuaaaucaucucuuaagaguccggucagccauuggagagcuaccccaccccaccccaccccgcuccuauugaaaugcuguaagcccagaaggccggacacaaugagaggagguggguuuaaaauugaaguucggguccucugagagcagcugggcuucuuucuugguccugcaaauuggcaagaugcccaccaccguggaaggaaggcugcagagccgaagucuccgcgcagaguguugacguucaggcuuccucaucaacaccugcggaccuugccuccccacccugggccgggcgggcaucacagugguuucccccucuuccuuuucuccgcggcucugcgggagaagaagacaccccgcgggauuucaugagccucuuuuccuagagcucccagcggcagcuugcacggcuucuccccaagcccgcgccagguuaucccgcgcuccgccucccgcccugcaaacccaggcagugaagcacugccuucuguaccggucaagacgacuccgggacaaacagggggcccacgguucgcaccagggggcucggucauaacgacaguggugcagucugagaugcgugucgccgacgacaauaaaaacaauagcucacuccagcaucaugcugugcucauuuguaugcguguguucgugugugugugcaccuggcccaggaggcccggcuggacagccucgaggugcacgccuccucucgaaggaagggaagggccagcguaggcagccaggcgguggaacuccaggggccggagggagagcagagaaggcggugcaaggcuuacaccaacccagggcaggaaaagcauaucuuuuauuucguucccuggagcccugcacagccauagagacaucagcuccuuagcuaccugcaggagauuccuuacccuccuaggguggagggaccggucuuacccgaugcgacuccacgcgauggcuugggguuguggggcaggucugaggcuggaguuucugauuggccgagcggcuucggcaagcuccuggugcaaagagcuccacgccucgccgcggagcaggccggugccguacggc

SEQ ID NO: 8542 - RNA, 21791 nt, Mus musculus
guucagguaguguuuugguuuauuuucuuaguguugucacagugacaggaauccccagagugggacaagaaccucuugucacugcccucugccccaggcucagccucuaggccuucccuuggccugucacaggcuggcauguggcagggaccaguacucuucccagcacagaugauaaugccacauuccgcagagguggaagcuagaugcagguauccaacaugguuacguggucaccagucccacggggcuggggcuggggcuggcuuccgcagugguuucguaaacaggugacuucacugucccaggguggcuggccaccuuucaggguuucugcucuaauauuguggccaccauguguggcugcucacuccugguaugaguugcuauguaaaccaauaggacuucauccucagaacagugcccgugcaaucuuccuccccguggccuugauccugggaaaggagcccccuccccccucgcucggaggaguuccugaggcagaggggccgcugugggaacccgggguggcagcagagggucuucugcgcugccgcaggaggaagucaugagaugcaccauccauggcauagaagacguuagcugagugugggauggucagcucuguggguucagaagagggcggggauuagcguucggcccucucuccgagcgccucccuucagugcgccaucccuccauccugcucaccucgauccccagguagcagcugcaccagcucgaacucugaagccacagcagaaucacgauuguuuuucuuaaggacacgacuaauaacacuuggagcuuuguccuggcuugucaccuugcagaagagauuaaaugaacaauaaacaagucgggcagugguggcgcacucaggaggcugaggcaaggggaucugaguucuaggccagccugguccggucuacacagugagugcuaggauguacagggcuacccaaagaaacccugucuuggcgggagucagggggaacaauaaauauaccaugaugaccuguuucccguccuuuuaacaccaaccaaaacaggucaccugugucuuaauacuuaaaaaaaaaaaaaaaaaaaaaaaaaaagccgggcggugguggcgcacgccuuuaaucccagcacucgggaggcagaggcaggcagauugcugaguuccaggacagccagggcuauacagagaaacucugucuccaaaaacaaaacaaaaaacaaaacaaaaagccaggugguaguggccaaugacuuuaaucccagcaccugggaggcagaggcaggcggauuucugaguucaaggccagucuggucuacagagugaguucuaggacagccagggcuauacagagaaaucgagucucagaauacaauaaaauaaacaagaaacccaauauaguggcugccagugccccaucagccagcccacguagcucccagcgcagcaaagcugcaucccugugggaaaacugcuggcucugaucacgucauacagcuccgaaaacucagaucguggcucacuaaugcacaguugccaccaacaucaaacaacugccugaguuccacagaagcuacaauugaguccuggcuacccaaaccaagccgaaugccuaauaagguaagguccgccccgccccaggcucccucaccaggaugcucuuguagacgcugccauccucccccagcuccaucuggacucggaugauucggcaaucagaggacccuggcccagauaccccgcccccacauccagcacuccuagaggucccuucuccuguguuuccacucaacggagacccacaggaggcugagcgacggugaccccgggaaggccuaggggaggaggcuggaggagagagguggccagggucagcagggcugugcaaggaggggcugcuuuccagggcagaguccagagaugagacugauggccacuucaugugcuaggggcaaagaggugaggucaugagcgaacggaggccgaagggaaaaguccugauguggucagaggcgagagcaggcucaccugggcgaggcgagucagcagaggugcugggguuccaggcaccucaucucccccgacacugggccgaucccaggacacaagcggaguggggccuccaacagagcccagaacucugcagaggcaagauaucagacagugacagcggcagcagcaaguccccaugaaaccagcucccagccagccagccagcaguguccucacuccguccacugugugaucacuaguguuggccgagguguccuugcagcgggggagucacuggucccugguggcuccacuucacaggauacacggugacuggacaggauagccaugggcagaggucaggacaugccaccaauacacacauacacacauguccccgagccagaguccuagaacccgaccacccagccauucaccucugagcuucaguuaaaggcuggaggcccuggagccauugcuggauaucagaguuaggucggaggucguagccacgacauucuuucuggaggcgcaacagcuccgaaaggauagcaaacuccugggaaggagcccucagacugcaggagccaaaacucagggccccugacuucaccucccucucccccuuccugggaacacagagagggaaauccaccacccagccccacccccacacuccucucaccuuccuccgcuugucaaaauugauguagccauucugcaagggcaguaggagggggauaaggggcuaacccugcucaggcgccagcgagaacauccccucccccaagcacaccucggcaucccaucccuccucaccuucccagucacgucucagaccugaacccaucuugacuugauccuuuuuuguuuauauuuugagacugggacucacuguguagccuuggcuguccuagagaccuucccccaacccccaccccaaugccuccaaagugccgagagaucacaggcgaugcccagcuccacuugacacucagagaguaucuagccacuagaugagaaaauggagcccacagugggacaaggaacuuucuggaagccucggcguuucauuuucuuugcaacgcuggggauggaacccggggucuugaccaugccagggagucagucacaccaccgaccgccaccuacucagccuuuguauauuuaauaaacuguaugugccgaagcuuccaguaugcccugagcacuugacaaauacaaaagcauguaucucucccacuaacaggcuguuguacauacggugggacagauagugacagacuacugacguacagagguugaacuacuucccgugguaacagaaccugacucgagagacugcccuguuucuccugccuguagccucucugugaaaggcugucugccugaccugaggugcacauguugagucacccagggcagaucacacacacagacacacaccacaccacauacacacacacaucacacacacacacacacaccucacauacacucacacaccacacacacacagaucacacacacacacacacauacacacacacacacacacaccacacacagaucacacacacauacacauacccacgaucacacacacauacacauacgcgcgcacgcccgcucgcgcgcgcacacacacacacacacagaucacacacacacagaucacacccacacccacacauacacccacacaccacacacacacugaccuccagcucauccuuggaggccgcauccagcaucacgagguccuucaggaagguucccagguagggaaccacacccugcaggcagagauggcagagaucaggaugugagcccuucucccuuucccucagacacaacuguguauucuccucaccagguaagccacccauucccagccccacugaacacucaccccaccccugaagccagaccuuggggccuucuuggaguguggcuccacagggggcugcggcuucacuuccuggugacaaagcaaggugagagaggagggggcuggggaggagggggcaggugcagagaggcuggggaaagcaagaccgcccucaccugcaugaggagcucucugcucugggaauaauuauccuccucugagaaaaucuggcacaggcuggaaaagacucggaggcugucccuagagaggaagaacaggccucugagcacaagccuggcguuccgaagcuuccgcaccccaggccucgggcacuucaguccuccuaccugguugucuccccccaggcugcccgaagccuguggauagggcuggacugcagagcggacacaacagcauacacugaggagaaguuccgaagcaggcggcacuccugugaggaccggagaacagucaaggcucuagggucccucaccacuccggagacgaagaguccccagccagcaggccugcucucucuuaccucggccacacggauccacuucucuaggagccgggcccucugugggggccgcaguggucucacagucaccucucuuggccccucuccaauugagguggcccccaagacagagcuaacuaccgcccccgccaccuuguugaacugugugacgguagcucggacagacgggcagaggugagaauguccuggccggucucugugaccccagaggccucccaaacacugagaggggaucagauuaagaaacaguuccugcagggcagagguuacaauuuagagucaagccagacaaguuuccaguaucagggaucugaggcucuuaaguggccagggaccaguggggccagaguucaaggggaacagccaaggggcgaagggcagagaagggucagagaagcagacacggaagaggaacugcaccaggacaauuggaagcaagaaaaggauccggagccaaggagagguuaguaagggggcagagaguguggggucaaaggucaaggucucaccgcaucuagcagggucagcuguucggccaaguggucagcgaggaacaccaggacauccguggggucagcaggggaaucgccaggaagggccaggggcuuaggaaggucgggggcccggggguccacccgggcccggagguuucggaugaggucagcacugccccccacaacacccucccgugcugcauacccuguccgaagcaagaagcucucaagccggucaaguugacccuugaccucagagccaaaauccucagggugagaggccagccaaguugaaaguacagagauggcuacccugagagaaggggaaucagccaggggucagaggucuagccucagcacccugaggggacugagguucagacagggccacucacccugugguccucucuagcucaccgggaggaugagauucaagggcuuccagccuggggaugaggagagggucuaccuuguggcuuuuccagcccccgcuggugcugggggugcucaaagggaauccaggagccuccuaacccuuggccccugaccugucagccacaagcccaaacagggcaggaguggaggugaaggcccgguggguggccagcaaggccggagugaacaucaugucagccccugcuguccuggcauccaagaggugucugaccagggccuccagagugccagcgcggagccgucgggaggagcgagguggaggcaagggagccuggagaacauggagggugucucaccgacgggccuccucaaucugacugcuagacaucugggauaauccagaucuagcuuauuucugccccgguucagaaauggcuuaaaucacacaacacagaacuaccuucacacuaccagaacuucuucaaccuaauguuccggaaaauaaauaaauaaauauuaaauuaaaaaccgagaggcaagaccucaaagucgugaucucaccaaggggucaagaggccuguacuggcggcuugugacaguaaaggucgcaccauccuccuccucgucccagacugacacagaagccuggaggagcaagaagaggaagugaguuccacagcaccuccaguccccagccauuguccccaggcccuguuccucccucugcaccccucaccugugauggcgggggacaauaccagcgagugcgagggguagaggguacuggugaccccaggucuaccccacccuggggcucagacagcccccccggccaccucagagcucggugggauggaagagguugcagugaggguuucaacugaaugcaggaaccccucuucuggccaccuccaaccccccuugucccacagcugagcccaacgcagaaaagcagggcgcaaagucaggagcagagcgcgcccgaagaggcacaaagccaaaggaagagagaccugaagcagagagaagcugaaacuucacaaggcccgcccucccugacagaaccagaggagcccaaauuuaguccuuccgcagagacuccuuuuccccagguccccaauacagcuuccacuuaaucucagcacuggggacccccugaagguggcggcuccaaucccaguuacaagaaggggaaguaaggaugauggggggggggggcgguagacucagagucauguggcccuagccccucccccgaccgaucccgaaaaaccagccuugcuagucacccuaacuuuaccaaugucggggcccaggagucuggauccucgggcuccgaaucuaacuucuggacccuccugaaucccuaaaucuugcugcggacuacauccuaucagucucuuuggacgaagaugaccacgcucuaccuaucccgggaucaucucuccaggugccggaaccucuuggcuugcugcccucuauugagcaccagggggugggggaagaggcggcgaaaucugaggguucccuccccaauccuagagucugaggagcugguuacuguggaaacaaaccccucccagccaaacaaaaaacgaggagggagacagggaccaagauacaacugcccaguggcacccgucuaagcagguaugggcaaagagggccugagccccgcaggcacagucagcccgucugccagccagccauucugguuccggcagguuccuacgggcagguuccgagcagacagacagggcgaacuucauagacaccaggacccgcagccaggggacagauauccagagagaguguggcgggcgggaugcgagugaggcggggaggaagagaccgagggacccagagacaccgaaaggaggagagucucagaaauauuuaaugcccugccucccgccacccgcgucucaccucuucuucuuccucauccucuuccuccugccccccgcccacggcccggccaccuggguccccacccucuucggggucccggcuccggaagcugcucagcacgacucccccggggggggucguguccaaaagcagccgcaggggccgcgggagcauggccgagagaagcaaucagcggggucgggccaugggggcgccuggggagagacgggugggauuggguggagucagacgggcgugggggagacggacaagaagggaccuaggugggagucccugaggaaggcugggggagggagauacgggaguggggaaacccaagcccucggugcuugcuugggacuugggggcuaacuagugcggaaugggcagggucacccggugcuccggcucugaccugcucgggaagggcgagggcugcgcgcgggucccgggccucuguucuugucggucucuggcccucuaccgaguccccuccccggcuuuuccgcgaugccccccuccugcaccccgccgggcucccgggcccucccgcccuuuccgcuuccccccuccccgcguccgcccgacagcaggagccaaaaagggaaggaagugaggacaggagccagggagagcgacuaggggagugcuggacgccaggggcugggacgcaggcugcaggugcacuacuccgcugucccuugcagccccacucgguggcucugaagcccgcgucucgcagcagacacgcuggagaccaggguccugucucaagccuccacaggaaggcaaacacggaauuuuaagucacuuuuucuaaccagagcggcgcugcaacugccgaggaaagugcccuagcaguggcgcgaccccguuacugcagcucgagaaugacacugccgccccggcacgagugcaacggagcgaauccgcgccggguuuucugugccgcccuuaugcccgcccacucgcggggagggggcggaagccggcuagugcggcgcuuccgguuccacucggguccgucgcuccgggcguccggcucucaccgugcgcccgagcgcgcgcgguucccacgguggcuaugucgucucccgggugcgagacgaggaccgggaggugaccgagguuggcugugcuuggaaacgggagaaugagaggcccgcauggaaacucggaaagacuuuauuagcucacgaggaccggcgaacaggagaggacgaaccacacggggacauucguaaagggccgagacccaccaggcccggagaugguaaagguggaccaggcaaaagaaaagcugugguaggaauggagagcuggagagguaggcuuuaguccgcgagggagacacauggaccuuuccgucucuagacuacugcugugggcugucccugaggucucuagaaucuuaagaugcuaugaagaccuuucguccuaauccccuggccagugguucucaaccuucuuaacauuaacgcaguucaaguuguaaaauuauuuucuuugcuacuucguaacugccuuuacuacuguugugaauccuaaugucugguauuuccgauggacuuaaaggggguugugagccacagguuaugaacccgccucucuggcgcauacacugguucuucucaacccugggacucuacgcauguguguucuuauauuuaguucucucaacaaagccccgccaaguaaccccgacugaccugaaacucccuauuuguagaucaggcuggcauggaaaugucagagauccacugccucugccucccgacugugggcaucaaaugaguguggcgcuaagucucgcuuuuuucucaucuuaaaaguuuaguucgaguccagcggugguggcgcacgccuuuaaucccagcaccugggaggcagaggcaggcggauuucugaguucgaggccagccuggucuacagagugaguuccaggacagccgggacuauacagagaaauccugucuccaaaaaccaaaaaaaaaaaagaccucuaggcaugguguccagugccguuugucacuccgaggcagagggacagguggaucucugggacuucgaggccagccugguuggcuuggugaggguucaggacagccagccaaggcuacauagagagaccuugucuaaaaacaagaacaaaacaagaaagauugaaacaaacaaaaaaaccuuaaaaaaaaaaauccgagcuauucaauggagggagaagaagagaagaaggcuguuguucuggggcaggggcuacuggagucaucugggccagagaugaggguggcuuccacagacgagaacuucuuuacugugacuucugcaagagaagaaagaaguggggaauuggaaguguugggagggaagugaguuucucccaguuaauguagaaacauucucacaguuacaggcgugggagcaggcuggggcugucauuucccaccggccagacauggucaugaguguccucgcuccugagucuuccagaagacccagugggucagcugagaauccaagcaaaccccaccccugggcugugcucugagcuuuggaaguccuuauguugucuacauguuuacauugccuggauaggucagagccggacuuggccacugccgcacaguggucucccaggccacucccugucacacuuuaggagccuuucccuccauacagucucuuugcugccuauucucaugcuuugaugguaucccacuuuacccuguaauaaauucugauugucuucugcacuuuaaaaacuuaugcugggagacacucagcaggcagacucaaucacuggucugaguuugauccaggaucguacaagguuguaggagaaaacuggucccaagaguuguccucugacauccaaccuuaugugugguaacacaccacacacauucauaugcacacauaggggaaaaucuuuaagaggaagaaagacgggcuagugggguagcccaggggguaaagguacuugccguucugagugugauccccaagacccaugggguagaaggagaaaaccaagucccacaaauuguuuuuugacccccacaugucugcugugguauacacagucccacacaaauaaauguaacuucuaagccgggcaguggugacacacgccuuuaaucccagcacucgggaggcagaggcagguggauuucugaguucgaggccagccuggucuauagagugaguuccaggacagccagggcuacacagagaaacccugucucaaaaagccaaggcaggagggagggggagugucauccucaaauauguagcaagcuugagggcagccugagcuacaugagaccuguaucaacagaaacuuaauaaaaugugugauuaaauuuuaccuguuucauuuaacuccucucucccccaugagccaagguuucuguguagcagccuugaacucaggauucugcacagggcucugaaguguuaggccuggccuggccuggaagcacugccaacacaccugguuuuuucuuuuuuucauauagcuaccaauucuuucaauuuaugugugauuuacaucucuaauggacagaaccaccugcauaauuuuuaaaaaucacuacuccuagggaaacagauagaggucaaaagucugaggugagcuacacugaggaagaauuuagaccaggugugugugaagcggacaccugccacugcagccaccauuccucccaggaauaaccagcaggaggcggcaaagccccagaaauggaacccuguuaccuuugaguuccugggaauggucaggcuggcagcuguggccuucuccuuugagacuucaggaaugguccaguaggcagcuacuggggaagagagagggaugagaugugggcaugcccaacgaaggaaggggugggugagacuucagagagugggcaggguauguccugugggggcaggccucacaccuacccagccagccuagcaccuugaggaguccgaggaggagaaaagcagacaggaacaggccgaugccguccucgauggagggcccugagaagccuggcaaacggaagcggugcgcgugaguuugguguuuccugaggcccacccugguucugauguuccccaggcgauuaccugccaccuccagggugacgucagcacugcgccccgaugcuggcaggcuagagugguacacccgacagacauagugaacuccaugcugcuuggcagugacuggagguagcugcaggugcccagacuggcugacagagccaucggaaugguggcggaugguggagagccacgucuuccccucaaccuuucuagaacuuccuccugggccgccucugagcucccacuugaccuccagacccuccgcagggaagaagugggaugcaagacagagcaguucugggggugccucuccuggggcagcccacacaacgggugcugguguuagagacacucugggggccucugaagaaagaauaggaaagguaacugagggaauuaaccucccucccucccucaguuggucuucuggcuucccuaauacugcagggggcgcucugucuccccguuagaacuucacaacaaucccauguuaaagcuuucagaugccuaggacucccaacugucuucaguaucaccccugccaugguguuccccgacucacugugcacagucagcuccagggagaccuguccuugcagguagggcagguguaccguagccagguagacacccuccugagaaggcuucacggcuggaagccagaaggucccauucccaguccacgggccccagggcucaucgucaucccaagcugcaaaugccguagccuuuuccugggcugguggcauucucccggccagcccggggguggcagccaacagcaggugacccuuuccccugugcuggcgucgccacuccagcccaaagggaggagggccugcguccagagagggagaaccuuccagggcggagggugcguaggcgaagcgcagguccagcacugcauccuuucccagcuggacucgaggggcaggguuaugggugaggacggucagcaccacugggcgugcguggggagaguggaaagaaacggaaaggagaaggagaguugguggcccgaccaagcuccagguuacccacgcuucagggacacauccauuuacaauaucauagggguaaaucaaggugaugagagguuugcagcccuggagguguugaacacacacacugccaaccacgauucucaaauccuauagauggcccggaucucuaagggcacaauaaaauuucgucgugcgugugcgugugcgugugcguguguguuucaccuacauguaagugcaccaugugugcaguaccaaaggaggccagcagaggacacuggaucccuggaauuagaguuacagguggcuaugagccaucacauaggcacuaggaccacaacuaucucagccaaugcucauaacugcugggccaucucuguaccaccacacacacacacacacacacacacacacacacucuuucuuucucucucucucucucucucucucucucucucucuuccuuucuuccuuucucuuucucccucucucucucucucucucucucucucucucucucucuuuuuggagauaagacucauuuuggcccaagguaacuuggaaacucacucugcaugcuaagcuagucuggaacucaauagauaagagauuaucauaccccagccucccuucuuucuuuccuuugugugugugugggauggggaguuuuguggggcagauaccacugcugugcuauggcugacccuaagccucaggcacaggagcaagcacuacacuccaucacugagaaacagucugcagcacagcggucuguuggcccucccgaccccgccucuccagugcaagcacugcaggccugacugucacacacagcaggcaaugggccuaccacugagcuacaccucagccccaagccccaaucuccacaguagaaauggaagcuggacauaguggcucacauugguaacccuagcacaugagaaacucuggugggaagacugcccugaguuccagacaaaccugccugagucucagucucaaaaacaaaccaaaaugagucacaggcagucacagugagaacaggaccuaccuacuggggaugcugggagauuggucuuuuuuuuuaaagagacacagcauaacaugcuuucauuuuaagcccagguaugggauaagggcagcuucagacugugugacagcugacagauuugccucaugcucuagcagaggcguggcuuugccagcugcagacagugucugugauugggugaugcuuggaauucugggaacuuuucaaaguguagauaaaugcuagaaccccccaagaggagggguagguggccuuuggccauucaggggguugguuacaguuuguuagucaugcucaaagaagcaacaaaaaccagaaauuagauucagauugcuuucucucucucucucucucucucucucucucucucucucucucucucucucucucucucucucucucucucucauccuuccuucucuccuaucuaugauaaggagugaaaccaggggauaaaggguggaaagagaagaacccacaagguaacaaagaccuaccuacugagcuacugaguuuguggugaagguuacgccauuuaauaccucuggcuaaccaaaucuuguuccaguccuggcuuugccuaaugaaaaucgcuauaggggcuggagagauggcucaguggcuaagagcacuggcugcucuuucacaggucgugaguucaaaucccagcaaccacgugguggcucacaaccaucuguaaugggaucugaugcccuccucuggugucugaagacagcuacaguguauccacauacauaaaauauaacaaaugauucuuuuuuuaaaaaaaaaaaauucuagccaggcaguuguggugcaggccuuuaaucccagcacucgggaggcagaggcaggcagaucucugaguucaaggccagccuggccuacagaguuaguuccaggucagccagggcuacagagaaauucugucucaaaaaaaaaaaaaaacaaaaaaaaacaaaacaaacaaaaaaccccucucucuaggaggcaaauuaguaaucacaggaaaguuuauggaucagagcucuccccagccccagguguuuaacauuuucuaagcugccuuuuacauuuuuauugauucauuuguguauguguguuccugcauggugugcauguggagggcagaggaggacuuccgggagccagcucucucccugugggccugggugaaacucacagcuuucaucaacuuuacccugucaccucuguaacccugcaggacacacgcuguuuguucuugagauuguauuuuaauuacaacacuucucucuucccuacccucaagcccucccacacacccccuccuucaaauucuugaccuccuuuuuguuauugcaugcgugcuuauauuuguguguauguauguauuccuguacuauaaccugccuauaacauguuucuagagucggugaaaccgcacacugugcgcacuaaguguugaggaagauggauuugauucugguuaugaagcuccacggcccguuguguguccagcacaagcaaggccuggcucugggaccucagacauuccaacaaggagacuaaccggggcuggagagauggcuaagugguuaagaguacugagugcucuuccagagauccugaguucaaaucccagcaaccacaugguggcucacaaccaucuguaaugggauccgcugcccucaucuggugugucugaagauagcaacaguguacucauauaaauaaauaaauaaauaaauaaauaaauaaauaaauaaaauaaaaagggagacuaaccaagaugauuuccuacccuaguguucugugaaaacauagccauccaggugaggcugccuaagccugcugcagcagcuucugcaaggugagcgaggaaaguccucaacugaccugccugggcugcacaggaagggcaagggaaccugcuuaggagcugacccugugucucaaccaaaggcugaaggaagcuggggcugagguuugcuggcagagagcuucccugacgcugucagugcccugggagcaggagggggaaggugacagcaacaaauaaaccacuuucauuauuuucucucuuuuuagaagauuuuaaaugguuucuuuuaggugcacugguguuuugccuguguguaugucugugagagugccagcuccccugagacuggaguuacagcggugagcugucauguaggugcugugaagugaacccagacccucugggugaucagccaguccucuuaacugaugugccaucuacccaacccccacccccacccccauuuucaugauuuucauaucaagcagaagugaccugaaagugaucugauggggaagacaggccauaguaacuugauuuuaccccaagucuaugcgaaguagucuucugagagucagcucugguccagagcacucuaggacucagauaagggccuagagaggcuacucagcacuuuaaaccacagacugcacuucugaggacccaaggucgguucccacgccacauggcucacaaccagccguaacccagccccagaggauccaacaagcucuuuuggauucccugggcagcugcacucacacgcauauacccauacacacacacacacacacauacaaaacuaacucugcaaauaacuaauacagucacugaggcacacacaccugcccugcagaagccacaugggauuaucuuugacagaucugagaagcacggugagucgacaucugaucacccgucacugagcacgcagggccaccccauacacugugauucccaagcccaagcuuucaguagguucuuugcuaguuaucuggaggucgaucuggggaccucaggguccuaacuuuuucuuggugcuaauaacauuuauuggaccagcacauagcugcacagggccuugcuucaaugccacaaauaaaaguagcuggcaaaauagauccuacuucuuacaguuggaaaaaaacgacccauagggcaaaagguagccaacaccaucccacaugaagaccagcagugugagggcaggugguuucaagagaacuacuguccccacaaagggccugcacaggguggagcuaagaguagaggugccaguggaguuucagacuguccccauuuggagacuucaaaugaugaaggcaaaggacugaguucggugagaauauuugcauaaaagcaccagaaauggggaaagccaaugacgauucuaucuaccuguuaggugguguccagagagaaaagcaaacauucaggacauucaagacagaucuaccccauagagugccccuuccccuguccagcacagcaaagugguggguggaucucugggaacucaagcggcagaaccgcaccugugcacaagccaccguucugcccacuagaggccacuguugaggcacuaaagaccguggccgagagccuuggcaagagguuccuugcugggcugacugucccuagucucuagugcgcuuugaagagacucaaagugugauuuuugaaaccuaggaugggugcagaaaaaauuuggguuucgggacgccuaaccuuaugaguuucucaaacucugggaucuggaaaccgacaccaugaccgccucugcaaagucccgcccccaaaccacaguagguuucaauuuuacucucagccuacaaugaagggugaagauaaaaucuaaccaacucccuucccuuaacaaaagaauauauacugauccccaguugaagaaaugacccauucaaaccucuuggcgagucgccgaacuggcccaucuagauccuuaaaaacuacccauccaucucgcgcgccucucggcggcuaccuguugccauggugaugacgacaggcucccgcagaggcuccggcuguggucgcagcaggcuggagaggcugaagagagugcuggauacgcugaccagcagccaauccccguccagggcccgcgggcaguucugcuccggacucagacuucuagcccacuucgccgaggcagggaacgggaugaagcggcucaucucgcaguguggggcggaggcgccugcgggguaccgccugaaggcggccaggagcauucccgccgggucugcagaaccgaaaaggguguaacgguagcccggacuggaaaugugcugacuacacacaggccggaaggcacaaacuagcaaaguagugaacgacuuagagagcauccaaacguauuuacaaaagggaaaacugaggcccagcgucccugcgugagcuaagaggaggcgacagaugcagguaagucccgaagacucaccauccaccuugaaguauagcuuugggucaagaucuggccggggcggcgguccccuggguccauggcgcaguagcaguguggcagguuucuuagacaggccacccccaccugcauccuccacgaaccagcacucgaucgccucugguccagccgagacgacggagacgacggucgcuaggccuggggagaggggcuccggugaccagagggccauaggauguccggcgaccggcgaccggcccgccccuucagacccgccaugggaccuccucccucuccuucccagugugucuauuccuaaacaagaagaaauggggucugcucacccagugccacagcgacgagcaggagcagaggcuucauggugcuacgaucucuccuaccaagucuuuucuuccccuuucacuuucauuuuccuucuaaggcuggggugaggaacuggaaauuccccgaucuggucaggugagggcgugacugcgcguuggaggaacgccgcccacaggggccaaacagaguugccgaaacccugucuguagcucuccagccacuccucgcccugcacccacccccuuggcucaccggacugcgccaacuuugagcccuuuaucagccuagacuccgcccuccugcugugcccucuccgcgccaccucccuuaaaaccacacucccgcguucccagaccugugccaggucccagcaaacagagggguguugggaagccaagugaagugaccaauaaauauuuuaaucaccguuaaaaauuaagaccuauacuacgcggcucccaccuuguguccacccacuuucaugacaacccaauuugggauccccauggcaagggugggguaguacagaaauaaggggcguauccuucaagaggagaaaggacaaucguuaagacucaaaggccuugucccacaacacaaacacagacuucaggcacaaacuagcacaaccugacuguuggcucugugacucuaggaugcucaaaaggucccuuuuccauucccccaccuuguuggcacuacuccgugaagguggggcucuggugugcucaggggaaaagcaaaaacacagcuuaguuccagagaucucgaggaaggggcugaggaauggaacgggcuggcgacggugcaacccacgcccuucucuagaauauauacaaguccaccgagguaagggaagacuguuuggugggggaaaccccgggagccauugcucuuagacuaagcuccccaauugccugcucuucagugugcugcaccuccacccccacugaaauccaucuccacuuugugcacgcuggguggggaccagacacgccuaugggacgggggcguggccgaauuugccucaucgccacugcccccacccacuguggaagacucccucuuggguugcaaugcuggcccagaaggugucccggguccagguccaggacccgguccagauccgaccccacccacacccauccggugccgacgcucacaguguccccggugacgcaugaaacugucccgccacaugaacuucuuggcgcagacacugcauucguacggcuugaggcccgugugugucuucaugugcucggucaggugguguuucaucuugaacuuuuuguugcacacggggcagucaaagggucgcagguugagaugcauauucacgugccggucccgcaugcucuuaugugagaaagccuucccacaguggcacagaaagaucuuauucccgucgcuguugccugucccuccaggagccccaccagagccacuugguaugcccagccccaccgcagaggugcccccgagggucacugccccgugcucagcuguguucccugguggcuggccuggagccugugaagaggaggaugggaaaaccaagaucugguugcccggcacauccaauggaaggaggggucguggagggugggugagggcauaggaggaagggguggguccuccggggucaucaagcccugccccagcgcccccacccucauaggggccaaagucauuggaggauucacagaaguugaccugcucuucccccuugucugcaggcucggucaagguccgaacaucacugauacugaggguagccucgggcucucccccugcaggaaccccagagccgccucccauuucuucauccucaucauccucacaagucaacaccagaucuuccuccucuuccucaucuucuagaucggggucuugguggaccagggaggcuggugcagggcaauuucuagcuugcuucacauacacccaguguuucuguggcacugcacuggcaggcaugcaguuagaccuccggagcccagccccgggggccacggccccucucccauccccaccgucaucgcauagcucaucggccuccagcagcaacuucccggaggugguacccgcacugccaaccacaggggcugggaacaccgggccaccaucccgacgguucccacuaccugcugcugaggccacaaaugcauccugggagguagaggagaaaucagucgacucccgggggcugaaguaguugcuacugcugggagacugauucucacuggcccugcuggagguaugggaacggacagagccuacgguggcaggggcgacagugcccccauucccugaugggacacuggcacaagggacagagacagagggggcugcagcaguagugacagugguuguaguggcugcggaucgacccucccgaaggaguucagugcacuuauccacaaugugccacaucuggaggaccgaccccacugugaggaaguugacaauguccgcagcagccaugcugaggcggcccguguaagcugaggccaggacagucucaaaagcgccuggguccaugacgcuuggcagggaaauggaagucaugccuuucaguaggaccuggucguggaaguaaggagaggaggcagccaagacggcccugugagcgcggaacucccgucccugcacgcggauggacacaucacagagcugacccuggagccgcugcugguugagggauuccaggagggcacuggucaccucagggaaggacacguguaccacugcagcugccggcagaggcaguggcgguggagccagugacagaggcagugggaguguggccccacugggugacagagcagacggcuccaugcuguggaaggagauacccccccagccacaggaacaaaggaaagaagagggcggccgggggggucucuagggaaaaaaaaaaaaaaagaauaacagcauuuugaaagcaucacugauuuuaagccaucacaguauuuaaaaaaaaaaaacagguaccccugucaaccccaugguacagacggggcaacugaggcucacuauuaaguaaaacauccaaucaaacaccaccaaaccgcagcgcuagcaaagaaaguauuccaaguuuaguacucucgcuccugggucaggaaauagggggcucucagggaaggggcgucuauccuagucuacggcuucacucucaaaagaacgcccccuccuugguguugcguaccgauuuucuuggggugaagggguguucuccacaguucucaagcuccucccccuagagcccccaguugaucccgaccccgccccuucaggacccuccagggcuccgcccccuggauccccgaccccgccucguguuugcccccgcccccgaaccccgccccccaguccuccccaaucgcgcccucggacuguuccccagccugaggggggcccccagccccgcgcgcccccgcuuaccuggccgcgcgcccccgggcccccccccucacuccgcgaccagagccgcagccccagccccucccgccgccaucuugugccgacucccuccgccuuccgccuccacuccgccucccggaccugcgaccuuaaaggcgcaggccagcaccccuccugugccgcugggcaaaagucgaccgacagcgacacuuuuccuuuaaagaaccggcgcuucauuccgccuuaaagguaccaggucccgucugcggcugaggacucaggaauugguuuggccgaaaccuucguuccccuuuaauccgacaagccuaccuugucucauugaccagugcuggcuuccgcuucccaggcuccaccccgagcucuggacguuagcuug

SEQ ID NO: 8543 - RNA, 1209 nt, Mus musculus
auaggucuuaauuuuuaacggugauuaaaauauuuauuggucacuucacuuggcuucccaacaccccucuguuugcugggaccuggcacaggucugggaacgcgggagugugguuuuaagggagguggcgcggagagggcacagcaggagggcggagucuaggcugauaaagggcucaaaguuggcgcaguccggugagccaagggggugggugcagggcgaggaguggcuggagagcuacagacaggguuucggcaacucuguuuggccccugugggcggcguuccuccaacgcgcagucacgcccucaccugaccagaucggggaauuuccaguuccucaccccagccuuagaaggaaaaugaaagugaaaggggaagaaaagacuugguaggagagaucguagcaccaugaagccucugcuccugcucgucgcuguggcacugggugagcagaccccauuucuucuuguuuaggaauagacacacugggaaggagagggaggaggucccauggcgggucugaaggggcgggccggucgccggucgccggacauccuauggcccucuggucaccggagccccucuccccaggccuagcgaccgucgucuccgucgucucggcuggaccagaggcgaucgagugcugguucguggaggaugcagguggggguggccugucuaagaaaccugccacacugcuacugcgccauggacccaggggaccgccgccccggccagaucuugacccaaagcuauacuucaagguggauggugagucuucgggacuuaccugcaucugucgccuccucuuagcucacgcagggacgcugggccucaguuuucccuuuuguaaauacguuuggaugcucucuaagucguucacuacuuugcuaguuugugccuuccggccuguguguagucagcacauuuccaguccgggcuaccguuacacccuuuucgguucugcagacccggcgggaaugcuccuggccgccuucaggcgguaccccgcaggcgccuccgccccacacugcgagaugagccgcuucaucccguucccugccucggcgaagugggcuagaagucugaguccggagcagaacugcccgcgggcccuggacggggauuggcugcuggucagcguauccagcacucucuucagccucuccagccugcugcgaccacagccggagccucugcgggagcc

SEQ ID NO: 8544 - RNA, 1209 nt, Mus musculus
ggcucccgcagaggcuccggcuguggucgcagcaggcuggagaggcugaagagagugcuggauacgcugaccagcagccaauccccguccagggcccgcgggcaguucugcuccggacucagacuucuagcccacuucgccgaggcagggaacgggaugaagcggcucaucucgcaguguggggcggaggcgccugcgggguaccgccugaaggcggccaggagcauucccgccgggucugcagaaccgaaaaggguguaacgguagcccggacuggaaaugugcugacuacacacaggccggaaggcacaaacuagcaaaguagugaacgacuuagagagcauccaaacguauuuacaaaagggaaaacugaggcccagcgucccugcgugagcuaagaggaggcgacagaugcagguaagucccgaagacucaccauccaccuugaaguauagcuuugggucaagaucuggccggggcggcgguccccuggguccauggcgcaguagcaguguggcagguuucuuagacaggccacccccaccugcauccuccacgaaccagcacucgaucgccucugguccagccgagacgacggagacgacggucgcuaggccuggggagaggggcuccggugaccagagggccauaggauguccggcgaccggcgaccggcccgccccuucagacccgccaugggaccuccucccucuccuucccagugugucuauuccuaaacaagaagaaauggggucugcucacccagugccacagcgacgagcaggagcagaggcuucauggugcuacgaucucuccuaccaagucuuuucuuccccuuucacuuucauuuuccuucuaaggcuggggugaggaacuggaaauuccccgaucuggucaggugagggcgugacugcgcguuggaggaacgccgcccacaggggccaaacagaguugccgaaacccugucuguagcucuccagccacuccucgcccugcacccacccccuuggcucaccggacugcgccaacuuugagcccuuuaucagccuagacuccgcccuccugcugugcccucuccgcgccaccucccuuaaaaccacacucccgcguucccagaccugugccaggucccagcaaacagagggguguugggaagccaagugaagugaccaauaaauauuuuaaucaccguuaaaaauuaagaccuau

SEQ ID NO: 8545 - RNA, 6864 nt, Mus musculus
cgugcgcccgagcgcgcgcgguucccacgguggcuaugucgucucccgggugcgagacgaggaccgggaggugaccgagguuggcugugcuuggaaacgggagaaugagaggcccgcauggaaacucggaaagacuuuauuagcucacgaggaccggcgaacaggagaggacgaaccacacggggacauucguaaagggccgagacccaccaggcccggagaugguaaagguggaccaggcaaaagaaaagcugugguaggaauggagagcuggagagguaggcuuuaguccgcgagggagacacauggaccuuuccgucucuagacuacugcugugggcugucccugaggucucuagaaucuuaagaugcuaugaagaccuuucguccuaauccccuggccagugguucucaaccuucuuaacauuaacgcaguucaaguuguaaaauuauuuucuuugcuacuucguaacugccuuuacuacuguugugaauccuaaugucugguauuuccgauggacuuaaaggggguugugagccacagguuaugaacccgccucucuggcgcauacacugguucuucucaacccugggacucuacgcauguguguucuuauauuuaguucucucaacaaagccccgccaaguaaccccgacugaccugaaacucccuauuuguagaucaggcuggcauggaaaugucagagauccacugccucugccucccgacugugggcaucaaaugaguguggcgcuaagucucgcuuuuuucucaucuuaaaaguuuaguucgaguccagcggugguggcgcacgccuuuaaucccagcaccugggaggcagaggcaggcggauuucugaguucgaggccagccuggucuacagagugaguuccaggacagccgggacuauacagagaaauccugucuccaaaaaccaaaaaaaaaaaagaccucuaggcaugguguccagugccguuugucacuccgaggcagagggacagguggaucucugggacuucgaggccagccugguuggcuuggugaggguucaggacagccagccaaggcuacauagagagaccuugucuaaaaacaagaacaaaacaagaaagauugaaacaaacaaaaaaaccuuaaaaaaaaaaauccgagcuauucaauggagggagaagaagagaagaaggcuguuguucuggggcaggggcuacuggagucaucugggccagagaugaggguggcuuccacagacgagaacuucuuuacugugacuucugcaagagaagaaagaaguggggaauuggaaguguugggagggaagugaguuucucccaguuaauguagaaacauucucacaguuacaggcgugggagcaggcuggggcugucauuucccaccggccagacauggucaugaguguccucgcuccugagucuuccagaagacccagugggucagcugagaauccaagcaaaccccaccccugggcugugcucugagcuuuggaaguccuuauguugucuacauguuuacauugccuggauaggucagagccggacuuggccacugccgcacaguggucucccaggccacucccugucacacuuuaggagccuuucccuccauacagucucuuugcugccuauucucaugcuuugaugguaucccacuuuacccuguaauaaauucugauugucuucugcacuuuaaaaacuuaugcugggagacacucagcaggcagacucaaucacuggucugaguuugauccaggaucguacaagguuguaggagaaaacuggucccaagaguuguccucugacauccaaccuuaugugugguaacacaccacacacauucauaugcacacauaggggaaaaucuuuaagaggaagaaagacgggcuagugggguagcccaggggguaaagguacuugccguucugagugugauccccaagacccaugggguagaaggagaaaaccaagucccacaaauuguuuuuugacccccacaugucugcugugguauacacagucccacacaaauaaauguaacuucuaagccgggcaguggugacacacgccuuuaaucccagcacucgggaggcagaggcagguggauuucugaguucgaggccagccuggucuauagagugaguuccaggacagccagggcuacacagagaaacccugucucaaaaagccaaggcaggagggagggggagugucauccucaaauauguagcaagcuugagggcagccugagcuacaugagaccuguaucaacagaaacuuaauaaaaugugugauuaaauuuuaccuguuucauuuaacuccucucucccccaugagccaagguuucuguguagcagccuugaacucaggauucugcacagggcucugaaguguuaggccuggccuggccuggaagcacugccaacacaccugguuuuuucuuuuuuucauauagcuaccaauucuuucaauuuaugugugauuuacaucucuaauggacagaaccaccugcauaauuuuuaaaaaucacuacuccuagggaaacagauagaggucaaaagucugaggugagcuacacugaggaagaauuuagaccaggugugugugaagcggacaccugccacugcagccaccauuccucccaggaauaaccagcaggaggcggcaaagccccagaaauggaacccuguuaccuuugaguuccugggaauggucaggcuggcagcuguggccuucuccuuugagacuucaggaaugguccaguaggcagcuacuggggaagagagagggaugagaugugggcaugcccaacgaaggaaggggugggugagacuucagagagugggcaggguauguccugugggggcaggccucacaccuacccagccagccuagcaccuugaggaguccgaggaggagaaaagcagacaggaacaggccgaugccguccucgauggagggcccugagaagccuggcaaacggaagcggugcgcgugaguuugguguuuccugaggcccacccugguucugauguuccccaggcgauuaccugccaccuccagggugacgucagcacugcgccccgaugcuggcaggcuagagugguacacccgacagacauagugaacuccaugcugcuuggcagugacuggagguagcugcaggugcccagacuggcugacagagccaucggaaugguggcggaugguggagagccacgucuuccccucaaccuuucuagaacuuccuccugggccgccucugagcucccacuugaccuccagacccuccgcagggaagaagugggaugcaagacagagcaguucugggggugccucuccuggggcagcccacacaacgggugcugguguuagagacacucugggggccucugaagaaagaauaggaaagguaacugagggaauuaaccucccucccucccucaguuggucuucuggcuucccuaauacugcagggggcgcucugucuccccguuagaacuucacaacaaucccauguuaaagcuuucagaugccuaggacucccaacugucuucaguaucaccccugccaugguguuccccgacucacugugcacagucagcuccagggagaccuguccuugcagguagggcagguguaccguagccagguagacacccuccugagaaggcuucacggcuggaagccagaaggucccauucccaguccacgggccccagggcucaucgucaucccaagcugcaaaugccguagccuuuuccugggcugguggcauucucccggccagcccggggguggcagccaacagcaggugacccuuuccccugugcuggcgucgccacuccagcccaaagggaggagggccugcguccagagagggagaaccuuccagggcggagggugcguaggcgaagcgcagguccagcacugcauccuuucccagcuggacucgaggggcaggguuaugggugaggacggucagcaccacugggcgugcguggggagaguggaaagaaacggaaaggagaaggagaguugguggcccgaccaagcuccagguuacccacgcuucagggacacauccauuuacaauaucauagggguaaaucaaggugaugagagguuugcagcccuggagguguugaacacacacacugccaaccacgauucucaaauccuauagauggcccggaucucuaagggcacaauaaaauuucgucgugcgugugcgugugcgugugcguguguguuucaccuacauguaagugcaccaugugugcaguaccaaaggaggccagcagaggacacuggaucccuggaauuagaguuacagguggcuaugagccaucacauaggcacuaggaccacaacuaucucagccaaugcucauaacugcugggccaucucuguaccaccacacacacacacacacacacacacacacacacucuuucuuucucucucucucucucucucucucucucucucucuuccuuucuuccuuucucuuucucccucucucucucucucucucucucucucucucucucucuuuuuggagauaagacucauuuuggcccaagguaacuuggaaacucacucugcaugcuaagcuagucuggaacucaauagauaagagauuaucauaccccagccucccuucuuucuuuccuuugugugugugugggauggggaguuuuguggggcagauaccacugcugugcuauggcugacccuaagccucaggcacaggagcaagcacuacacuccaucacugagaaacagucugcagcacagcggucuguuggcccucccgaccccgccucuccagugcaagcacugcaggccugacugucacacacagcaggcaaugggccuaccacugagcuacaccucagccccaagccccaaucuccacaguagaaauggaagcuggacauaguggcucacauugguaacccuagcacaugagaaacucuggugggaagacugcccugaguuccagacaaaccugccugagucucagucucaaaaacaaaccaaaaugagucacaggcagucacagugagaacaggaccuaccuacuggggaugcugggagauuggucuuuuuuuuuaaagagacacagcauaacaugcuuucauuuuaagcccagguaugggauaagggcagcuucagacugugugacagcugacagauuugccucaugcucuagcagaggcguggcuuugccagcugcagacagugucugugauugggugaugcuuggaauucugggaacuuuucaaaguguagauaaaugcuagaaccccccaagaggagggguagguggccuuuggccauucaggggguugguuacaguuuguuagucaugcucaaagaagcaacaaaaaccagaaauuagauucagauugcuuucucucucucucucucucucucucucucucucucucucucucucucucucucucucucucucucucucucucauccuuccuucucuccuaucuaugauaaggagugaaaccaggggauaaaggguggaaagagaagaacccacaagguaacaaagaccuaccuacugagcuacugaguuuguggugaagguuacgccauuuaauaccucuggcuaaccaaaucuuguuccaguccuggcuuugccuaaugaaaaucgcuauaggggcuggagagauggcucaguggcuaagagcacuggcugcucuuucacaggucgugaguucaaaucccagcaaccacgugguggcucacaaccaucuguaaugggaucugaugcccuccucuggugucugaagacagcuacaguguauccacauacauaaaauauaacaaaugauucuuuuuuuaaaaaaaaaaaauucuagccaggcaguuguggugcaggccuuuaaucccagcacucgggaggcagaggcaggcagaucucugaguucaaggccagccuggccuacagaguuaguuccaggucagccagggcuacagagaaauucugucucaaaaaaaaaaaaaaacaaaaaaaaacaaaacaaacaaaaaaccccucucucuaggaggcaaauuaguaaucacaggaaaguuuauggaucagagcucuccccagccccagguguuuaacauuuucuaagcugccuuuuacauuuuuauugauucauuuguguauguguguuccugcauggugugcauguggagggcagaggaggacuuccgggagccagcucucucccugugggccugggugaaacucacagcuuucaucaacuuuacccugucaccucuguaacccugcaggacacacgcuguuuguucuugagauuguauuuuaauuacaacacuucucucuucccuacccucaagcccucccacacacccccuccuucaaauucuugaccuccuuuuuguuauugcaugcgugcuuauauuuguguguauguauguauuccuguacuauaaccugccuauaacauguuucuagagucggugaaaccgcacacugugcgcacuaaguguugaggaagauggauuugauucugguuaugaagcuccacggcccguuguguguccagcacaagcaaggccuggcucugggaccucagacauuccaacaaggagacuaaccggggcuggagagauggcuaagugguuaagaguacugagugcucuuccagagauccugaguucaaaucccagcaaccacaugguggcucacaaccaucuguaaugggauccgcugcccucaucuggugugucugaagauagcaacaguguacucauauaaauaaauaaauaaauaaauaaauaaauaaauaaauaaaauaaaaagggagacuaacca

SEQ ID NO: 8546 - RNA, 1525 nt, Mus musculus
cuuguuuacuuccggguuuauugauuacagcggguagagcgugaagagguuagcguuuggcuuggaggguucggggaucucuucuuucgcucuccuuugccuagggaguggcuauucuggacgaaaagaggcugcggcgccucggagaguugcggguagaaagugcuguccuucugcagggucagggaggggggauucaggugccucccagagcuugagacccagcgacccccgcccaggaggcuuucuccuucaccauggcugaacugauccaaaagaagcugcagggagagguagagaaauaucaacagcugcagaaggguaagagagggaguugguguggucucgcuccuguccgcucucaucuaugaugaagcgucgcgccccauugggggcugcgggggugcaucuuguuaccccucgccucgguaucgucgcuuucuuccucacacccagucuccccagaauugcgcgguucugggcccauuugauguuuuuaaucgugcauuuccucucuccaccccagacuugaguaaaucuaugucagggaggcagaagcucgaagcacagcuaacggaaaacaauaucgugaaggaggugaggaugggacgcggggguggggggcgaggagggacucuccugggcacgaucaucucauucacugccucauccccuucucaggagcuggcccugcuggauggauccaacguggucuuuaagcuucugggacccgugcuugucaaacaggagcugggggaggcucgggccacaguagggaagaggcuagacuacaucacagcagaaauguaaguccugcggauggcguuuucagugcacaaguguuaaacccgugcuggauaguucuccacuuacccauuucuguaaaguccuggcugcccuggaacucgcucuguagacggggcugaccugacacagaugcgccugcugccgccuccuaaaggaugggauuaaaggcauguggcaccacuccuggccuuucuugcugugugacaucuggugagggcacuugucaaaggacaaccugcgggaauguuugccucccuacugugggguucuguagcuugaauucaggugccagccuuggaggacagcagcccucucuuccccuuagugccauccccgcuuucugucccacaaaccuccagucuuccaccauaucauugagcccuggcugauaucuccucuccguuugccucccuuugcccuccucagcaagcgcuacgaaucacagcuucgggaccucgagcggcagucagagcaacagagggaaacccuugcucaacugcagcaggaguuucagcgggcccaagcugcaaaggcuccugggaaagccugaccccgugggagggggucaggagggagggaugaggcuaacccugagccaauaaaauguaaacagaaccaagccuacuuuacagccagucuuucuucacuguacuuccauucccguacacuuuuacaccucuugagauucacggucuugugacugaaaucucucaguggc

SEQ ID NO: 8547 - RNA, 1582 nt, Mus musculus
ggauggagcggaguuccgcgugcacgcuagcuagggaaacgaagccuuccggggccagcuguggugggccagggccgcauugcacgacagcaucuggagaacagcaucugugaugcgccagagccccgcgcaugggucaccgcgucuccucagcagcagcugguuaaagccguccucccaccuccccacgcucuaacagcugugcccacaggucucugcggcacgccaugccccucagccucuuccggcgcguccuccuggcgguccuacuacuggugaucaucuggacccuguuuggaccuucaggcuugggggaggagcugcugagccugucccuggcaucccugcugccggccccagccucgccaggaccgccccucgcccugccccgccucuugauuucuaacucucaugccugugguggcuccggacccccucccuuccugcucauccugguguguacggccccggagcaccugaaccagagaaacgccauucgggcaucuuggggugccauccgcgaagcccgggguuucagagugcagacgcucuuccuccugggaaaaccuagaagacagcagcuugcugaccuguccucagagucagcagcacacagggauaucuugcaggccuccuuccaggauuccuaccgcaaccucacccucaagacccucaguggacugaacugggugaacaaauacuguccuauggcccgcuacauccucaagacggaugaugacguguaugucaacgucccagagcuggugucagagcugauacaaagaggggggccuucggagcaauggcagaagggcaaagaggcccaggaagagacaacagcuauccaugaagagcacagaggccaggcagugccccuucuguauuuaggcagggugcacuggagggugagacccacucggacaccagagucccggcaccaugugucagaagaacuguggccggaaaacugggguccuuuuccacccuaugccucgggcacaggauauguacuguccaucucugcugugcagcucauccugaagguggccagccgggccccaccucuaccucuagaggaugucuuugugggaguaagugcaaggcgagggggccuugcccccacacacugugucaaauuggcuggugcuacccacuaccccuuggaucggugcuguuacgggaaguuccugcugacaucccacaagguggaucccuggcaaaugcaggaagcuuggaagcuggugagcggcaugaauggggagaggacugcacccuuuugcuccuggcuccagggauuucuggguaccuugaggugccgguucauagccugguucaguagcugagaacccacagaaaacagcaccucagagaccuuuccccaaaguuggugcagaggcugcagaucccuguggugaucuaguuccuccauuuucucacagcaaacucugaagcugcaaccaaccaaguuuaccaagauaaacuugggcccuggccugccagcuccggggagggauaaagccaagggcgggaaggggacucacaagcagggacaaggguccaauaaacaugucucucuaccuca

SEQ ID NO: 8548 - RNA, 4490 nt, Mus musculus
caugccucucuaggccggaagccgacaagcggcgugcauuucacauagguccagcccuucccgguccgucccuacuguaaagcacgcggaauaccaggcugcuuuucuagagcagccagcaucugcuguuaacucacccgagcagcagcaucuggcggagcuguagccacuucacaacagcuuagcacggcuacggcaggagacucaauugaagccugcccaagcuuccccuggagguuuucaacaccggcugccccaccuuuaacagugguugccgcccaguuugcugcaccuaaggcagucuccuugugaacacccaacagaaagggaggagcaaacaccagcaggagccuaugagggacauuuccguucaagugcaccaagagcacuguacccagaaggcaccugcagccagauuaaacuaccagagcucaggaucgcuguggcauuaaguacuaucagauggaagacaaacugagacggaggucauagguauauaaacuauuuauuaacagcaaaggcccagagacucauuucuucuuggauacacccacaguucggccccugcggccaguggucuuggugugcugaccgcggacacgaaggcugcagaagaaaaagauacaggucacagagcagcaggaggcgagccgguggacugugcagccugauugggagugggcagcuuaagccucaucacccacuuacccccaaaaguggcgcagcccucuaugggcucgaauuuucuucagccucuccagguccucacgcagcuuguugucuagaccguuggccagaaccuagauuuugagacaggggagacaacuuuaucuccugauucugcacccaguuuuaacggacaacccguguccaccaguccccuaacacaccuggcuguacuucccauccuucacauccuucugucuguucaggaaccagucugggaucuuguacugucguggguucugcaugauggugaucacucgcuccaccucauccuccgugaguucuccagcccucuuggugaggucgaugucugcuuuccucaacaccacaugagcauaucuccgccccacgcccugaggucaaaaguuugggcuauuagacuuuuguuuuuaaagaucugaguacagaguuuucagagauaccagaggguaucagaauccauuacagaugguugugagccaccauguggucacugggagccucuggaagaagucauagcuuuuaacagcuggauucucucucuagcccagucuauuugugucuuauguuugccugcauuguaugucugugugucuguggcacacugaccagaggccagaaggcgcugauguucuggaacuggaguuaaugguuguugaguguugggucauugaaccuggauccucuggaagagcagcuaaugcucuaacagccaagccaccucuccagcccccucacacacacccuauuacucaaaagcagaggggcugugcagauguuaucccagcucccugaacucgggacugcuauggccagccuaaguuagagauccugucauuuuucagaucacuuuccagagacaaagccugccuacuaacugaagggaacgcuguucgggccacacuggacaugugucacaaacucaacaaaagcagcacagaugaacaaagucaaaccuuuaacagguuuuuugagccccaagagugggugugacuuugugacuaccagaauuagcggggagggggaagugucauugaaugagcuagagaaauggcucagugcacuggcugcucuuccaggaccuggacuauauaccaagcacucauucauaacucgaacucccaaugagagaggaucuaagucacucuuuuggccuccagaggcacaguaugcacagacaugcaggccaaaaaccuucacaacccucaccucagccuccauauaauuuuuuacuuuucuugagccuguuuuacugucaagcugugaguucuaaaggugcaugaugccagguugguuauggugacaaggcaagggaccuaugcucagcuacaaaguguggccccacgcccaccuugccuucugacuuaagcacuaacuuaaauuauaaagaaccgacuccuaacacuuaaagcaguuuggagggacugggauucagacaguacuagacugccucacagauaagggcagcaagcacuucugguccagcacaugccuauaugcuuccaaauauucaaauucucaccuugagugagcagaagacacuucuuaauuaauacagaaaucugcccggcgugguggugcacgccuuuaaucccagcgcuugggaggcagaggcaggcggauuucugaguucaaggccagccuggucuacagagugaguuccaggacagccagggcuauacagagaaacccugucuccaaaaaccaaaagagggaaaaaaaaaauuaaagaauacagaaaccuucccuguccuucacccuuuguuggucagcuugcaaucaccucuggaggaacucaccccgaaaucucucuccucaaacucccaauacccaccacccaccucccaaucagcuucacccuuuuguuuuccaggcagguuuuuuuuuguuuuuucuuguguagcccuggaacuuauugaucgggcuggcuucaagcccagagauuuguuugccucugccucagggagugcuggcauuaaagauguguucuucacccucucacacaggaccaacagaacccucaguacccaggcucuacaaacacugugcacagccccuucaagagccuccauucaccuugucugcauucgaagucagcuguaaucaucucccagcaggucacacggggcacaggcauugccccaggcccuucaacccccuagacacugcucugcccaccacaccaggcaccuccugcugugcuaucauuguuugccaaagugcagaauuaaaaaaagucaacauggcaaggacuuaaaagugagacuucacaagguuaaaaaaauuuacuccaacuuuuauguccaccugacauuaccucggcuccccaggccuccuucaaaccucucagcagccacccaguuccaucuauacccuagcaucccacaaggucccaccacugacaggucucauggcugaacacaccugaccagcaacuccucaaaucaccaacuucaaguccugucccugucuacaagacuuuuagcucugcagagaaacaucccagcuuccuccuacgaccucccuuuuugccauaauggggaaaacugccagcuucugugucaccuuccacuguggcaucugccaauagcuucugcagaccacccccaaccaucaccgcuaagccuggacaccucuuaggauguuaguuuacaggaauucuacucaagguuugcugacagcagagacugcucucggaagcugaagaucucgggaaaccucugcaaggugggacaugacuacacucacaccccacuaccccuggagcaauguuuugguuuaacccugggucaucaucaggcuuuuauugaaacggguugggugaguuuagcugcuucucuuuugccccuaacacuuuuaccuuaauggcagugauggcgaaggcuauuuuccgccgcccaucgauguugguguugaguacucgcaaaaugugcuggaacuucucagggaucacuagagacugaaagaacacgggcaguuaucaagacagguuacccccaaaccgggaagguggccgaggcaggguuggauugucugcuaaguucuuacacaacuccucagucaccggggcucaccccuaacgcgcucaggcgcgggaaaucgcaaccucugacaagaggguggacgucggccgcggcccccaauucccuggacaggggaagcgggaggagcccacacacagccaagcuccuggcagcuuugcuguguaagaggagcgagcauuccucggggccccgauccccgggauuucacgucuuaggucguccccucucgggucacacuccaucgcuccacagagggcugugggcccgcagcauggggcacucucugaguccugacggaaaucucucccugccccggcuccgaugucgcaggaucccggcgcggauuccgcucuuaccauggcggcggcacagacggcggcguguaggccuccuguggaagagagagcggaagugacguauaagucuuauauagauuccuggcggaagaggcggggcuauccccggagguccacuuccggaaauugcuucucuccccgucucccccuaagggaggaguuguauugagacaguuuuggaagggaccggagcuauaacuuccgguucggccuucucugucgucguaccguucuugugugggcgcggagcgaagguuccggaacagaguuguguucgagacguucaccuuccuguuugcacuugaccgaaaugaucaaagccuaaccggagaggcuggagccgaucgccuuagcucaaauaucugggacccuuuuuugcuccaua

SEQ ID NO: 8549 - RNA, 3869 nt, Mus musculus
cucucgcuggcaucucucuggcucugcgcgccuugcgcucucucgcugccuaaagauguaacaauaggacucggcgcucuggcgcgcccucgcucucccgcgcgcucuggcgcucuggccccauaaagauguaagcaauaaagcuuugccgcagaagauucugguuguuguguucuuccuggccgggugugagagaacgcguuuguaacaguuccuguugcagaggauccagggugaguuccaucagcacaugguggcugucaaccaucugcaacuucaguucccagggaucgaaugcuagugcuagugcacauacauauucacauacaaaaaugauuacaucucaugacaauaaaauuuuaaaaauaugauuugaaaaauacuccuucucuuucuccuacacauccagagugugaggacaggaguggagggcacaggaauguuuggacaucacugucccaccagccaaugaagagcgcucuguaacaggacaggaaaagaugguugaaauagaguguauugaaaugacaauuugucaaaaagcauaaaauuaaaaauacagaugauauuucauuuuaugaaccuaccaugcccagugggucacagccucaucccaggaagaagacacagugugugcucaucuuugcacuugagcugaugugaguuuuugauucccuaugaacaagauaaauucgacucagacguuugaaugcuaauuuguaacagcccaugacaucccaacauccagagcauuccugcagagaaagguguccccuuucccaucuucccucccacugcagacccuccagagucucaccuguugaagaugaaagagaagcaucgcauucuugggcaacagcgccgccugguggaagaaacaaagaggacagcgucugaacccacagagcugaggguaaaggggauccaggcugcugagcugccccagggccuccuuccuaucugcacuucuccagggcucucaggucucaggccgcccugcucucaucaaacuacauccagaagaacuuuacgugcuuuuccagccgugggaagaaaacucccuguaagaggggaggcaggaggcagagccaugggugcuaaaaggagcugcaaagccccagagagcaguuccagaacucggacagggaccauggugaugauucuuugaugucagcuacaugugggguuaacuaaaaccucaaaauggagggcagcaucugugagguguuuuugcuuaauuugaagugugaaaaucaauuucugauccuuuucuuugagguaggaagacacagguguaaaccagaauauuugagcaggagccccucccacuuuuugcucugggccaugacuucugcuggaagccuacaugaagaccuggaagaaggaaaggcuugcucugugucugcuugcucuucugguuucuacaguugcugauucaggcaugguguuucccuacugagaggacuggacuguaccugcugguuccuguauggggucugcuggccaagaagucuggacugaagcuguugauucguauuugguguuugccaugggacugaacugcugacaaagaaaauugagcuugccccccaaaagcuauuguuaaacagguccacuucccccauaucuaaauaacuuuucucuuccacuaccucuucuggauugugagcaaaaggagaggcuaaacauuuuguuauuauuauuuauuauuauuaccauuauuauuauuauuaaaacuaucuuucuuucucccccucuuucuuucuuucuuucuuucuuucuuucuuucuuucuuucuuucucucucucucucuuucuuucuuuuuucgagacaggguucucuguauagcccugacuguccuggaacucacuuuguagaccagcuggccucaaacucagacgucugccugccucugccucccaagggcuuggauuaaaggcgugugccaccaaugccuggccagauaguagagaaagaacgacugagagaaaaagagagagagaaaccccagaaucuaaucuccuucccuuuguuugcuccaugaccagaaccuuuaagaucuugugaccacugcuacuuauucuacacccacucaacaaccacauaccuaccaccccacucuugggaaugagggcuuaguguguauaaaauuguuucccgcuuucugggaaugaugauaucucucaggggcaccaaggcaaugaggauaauggucaaguccuaagaaagcaagcuguaacauuugcugugcauucgcugugugcuaggaaggugcagggcuuagcugaauccuuggguggggcagucuuugaggcugcaagauuagcuauuuugaaguuguucuggaugcauaauuuugaggggccagccauuaaggcaguuugagguuggaucauuuaggcuauuugucuugucuucuuuggugucugguccuuucucuguaaacacacaaacuuuuauaggugauaugcauuucuacauuaacacauguauggaauguacagugugcacagagcuuuauaacucuguuugcgcuauauacucaagcugcaauauaaauauccacuugugccacaugaaaggauaaccucauaagucauguggacuuuguagccaacaagauuuauuggacaugaauagcugacauccuggcuggagacauuccauucuuggccuucuucauagcuguuuccacauagagggaugagaauucauguuuuguuuaguuuuguugaucugcuuguugucuucauuuuugcagccaagauuuucaggaugucuccucuggucaaaucucaucuuuaugaauuuugaaggaaguuauagcuuuacuuuucauguugaaacaaaggcaaaccauuucccugaacucaacacauuuccuuccuuccauucugagguucucacauaugugcgccaaucgaauccaacaguccuuucucaacuccaggguuguucagcagcuguguuaccugucucuagaccuauaaccagacuucagacaaaguagauuccaggagggaagguggaguguguaguccaugaggaguaacccugcacuucugugcacucauguaaggagcuugacgaguuugcuaauucauuaaguagcauguggggaacaugugugggaauggauucugagggugugggauaauaguggaaggaacauaaaacugggucaggcugaguuuuuugacauggguccacuguguaaagauuguagcuuuaguauggaagauuucacauuuuaaaaaguugucaagacuguguuugaaucuuuagcugaagugguuauggaaagauggucuacugaaaaggaguugaagaugucuaauaugucuuggcuuaguguugauggagggauuuacagcugagggaauaugcaaugguggaguggucaugcugugugaaaccuaauucuuuagccaugggacagcccagaagacacgcccuucacugaucauauaaggcacaaaauguugagagggcaccagcacauuugaagagcuuugucgucguccuuuuccuugugcagaccuuaggguuggagauccugcugcugcugaauugaaugaauuaaaugcaguggguuuaauucucaacagcgcccaauugccaaaggcagggugauuguaauuaccacaaugggaagcagagacaacauaauguccacaguggacugcccuacccagaauggucaucucuggcagcaugaauuuuauagugucuugacucccaaggaacuuuggucguagcuaauuaacuaugguguuucuaugcaugaaauacauaagaaaaugucuuagucauuguuguauugcugugaggagacaucauaaacaaauaaaaacacauuuaaaaauca

SEQ ID NO: 8550 - RNA, 3891 nt, Mus musculus
cuugcagagaacggccugccuccaccuuuaauccacccacucaacuagcuuauuuuuaauuccguguguuugguuguuuugccugcaccagucaguguaccacguguuccuggagacuguagaggucagaaaagggcauccaacgcccuggcacuggaguuacagaugguuggaagcuaccuuguggaugcuaggaaucaaacggauccucugcacaagaggccagugcucuuagccgcugggccaucuuuccagcccccucccccugagagacacacacagagaacugcagguuucaaagaagaaauaagcaaauuuguuguugggaggagggcggggagggggucuuguccacccugccuaucaccagcaggguaggaaacuagggucuauagaaaaggcaguaguggguacagggcccgugcuguccaauauagacuaauucaauauagauacuuuguauaaaagccauuuguccuccuuuguccucuugcugucuggcuggggggcuuugggagaugaagcuggcaggcugagcugggacacagagacacccugugguccccauguuccagcuguccccuugugacaucauuuuggguccuucgugggggcauagcagagcucuaagggccuggacaccuuccagaacuucucguuuacaagcuccaaggucagugauccauucagcgucuagggauggagagagggaggcagggggagggaaguuaaaagaggaaacggacaagaggaaaaggggggggggcgggagaaagggaaaaaaacccugaaaaccagugaggguguggcucaacagaagcccccagagaaggacagagcaggggcugagacgggucaccacccuggcucucuguuaccaucagaugcucaccgugaacgcuccgcccccaggagcgauguagaugguguacugcuuuucgcugacaccuuccaggcugggcagcgcaggcuccucaggaccuucgccuccuccggcaacgccucucuccccaccacccccaucagguccgccuguguccgaagcacccccaccaggcccuccgggcucugugguuuccugcugcugccuccucuccagggcaaugcgcagggccagguacuuggagagaugauccacuguggcauucccaguagucuucacguaccuggggguggagggggcaagaguccuugagugcacagccuucuccaaaaguucuggcugggggcgggggggcacucagguaccccaggcuagccucuaccuugcuauguagcugaagaugaccuucgacuucucaucccccugccucugggaaugacagguguacacuaccacccuuggcuuauauguugcuggggagcaaacucagggacucauguaugcaugcuugacagacacccuacugacugaacuacaccccaggcccgaagcccccuucugacacagauuucugagcucgaguuuccagguggucuggcuuugcaaaggcagggcuccucaccgagucuggcaguacucuccuuucuccacaagcaggggauggggccggaacacaagcucaaucucuccaccgggcucuggagggcugggggccccaggagggcuugggggccccaggguucccccucccagggugccgccccggucaccagagucuucagaaccggcacccccgcaagccccaccagcagccccacccccugucccuacacugcuggccccugcacccgcuccgcggggucgcuugggagcagggccuggagcagagucuggggcggagucagagcuuacauccucuccauccccuucucccuccccagguucuccuucccccccacucauuguggcggucugaucagauccaggcaucggccgccucacacgcugggcccugcagaaacaaacacuccagguuauaaagagcaggauucaagcccuuaguguuaaacuucagggggagccccccccaggccguggcccuacuagugaggcuuccugcuucuaucugauggcuggagacacaggccuaaagagggcuggcagagguuagcuuguuugagaacagacacuucccucaaaucccaacgucagcugcacggucgccaccuggcagcucgaaugcagacuaucaggcccguacuccagacaagacccauggguaacaaggucucugguucuccacaccugugcauggccugcauccggagcccuuccucgauacuggagcucagcgccugcugguugugcaggcggcugaggcggaugagcacccgguccugaugggccucguauuccucccggcuaggguagauuuuggagaucagggcgucgaaguugggguccggccguagggaccgcuuggauaccagcuuuuuccggcagguagggcacuccuuguuccugggugugggaggaagggagcucuguagggccaacucccaucauggaugcccaggcugacccgccuggccccauggcaaacaugucccuccuguuacccgcuccgcagggcggugacgaugcaguccgagcagaaccuaugcaggcacuccuugguggucauuguguucuucagcauguccaggcagaugggacacaugagcucagaaugcagugaccgaggcgaaaccgcaaucucuguaccauccaugauggcuuccugggucaucagaagguggcaguggguugggggaaggggacuuuagaggcaagcuuugagaaagguaagaaccuggacagccaugcugaccaaacugaugggaauucugggauggaggagaccaaugacuuggagauuaccagaacagaagggaugagggcccauuuacaaggaguuuugaaacagaaaggccaggguuuguugagaggacuagggcugggaauggcacagaucuauggguuggaggauauuuaugcuacaagacuucuucauuuuuuguuugcuguuuucaagacagggucuccauaugcauguauuccuggcaggccucuaagcaggcugaccucaaacuuaagagauccaccuguccuggcuucaggagugcugggguuaaaggccuucgccaucacauccggccucaacaggcuuucuuaaaacucuaaagagcaagacuaccuagacuagaaguucagggugucugucaaacagauuccgaugucgucccagcgcacgugagucagaaaacuggagagggaauuauauuuaagcucgcaggaugaauauauauauguguacauugacauguggcuguugagaugggacagggccgggacgguaaguucuguuuaccgugcuucaauuaaaacggugauaucugcuguaccucgcugccauggccacuuugagggguuaaaucggaucaaaugagguagguguuuuagugcuuugagaagauaaaaggugauucaaagacagagucgggccaagaguaguguggcagggagggagagggcuggugggaggggguaagcuggggcuggaagaucccugucaccugcgggguccggugcagcucauagagacucaguucccacguuuugcuggcauucugugcauucgccggcgucgucauggugacggggcacagacccucccccuccaagcggggcuccgcugagagaggucugcggaaggggguggggggagacgcugucggggccgccccucugcagaccccgcccccugacccugggcgugcgccccgcggccccucacccagcuccggccuucgcgcugcccugcugcgggccucuccccaggaaccccggggcuccgcugcccugguccgcucgguccgcagcugccacucacgccgcaacccuugcugccaccgccaccgccgccauggccugggcgccgaggcucgacgucacuuccgcccucccug

SEQ ID NO: 8551 - RNA, 2979 nt, Mus musculus
gugagauggcauaaaaacauuuacuaauguggccccgcuggguggucaccacccagaacuccucuugaugcucaggcgucccugaccuguaaguacugaccccgugaaaaggacacacgcaaggacucuuaagagaauuuagugcggcugccagagcuguggauggcacuggagcugugagugaaaugggguaccagggcaggagacugcgcccacaauguucuccugggauuuggugaacagagguugaugccacucgaggucaacacugucacaggcugccgcugagcacgcagaagcuuccagaaguccgccaggaaucaucucucaaggguuucucagaagagaaguuaccuaaagucgcgaaacccaggugaccgaagccauucacauucgcacacccacuucuccaaauucccgcuuuucuagcuccucccccuuccucugucuccuccacccccaacccccacccccggcgucccccaucuacucuccacgccuuccucccuuugcccacagacucccggggcuucugcaccugcggauacugggccugcgugugccugugaucaugagcacggugcccaggaggcagcccauaaggccgagaaccaggcccaggccacagaucagggucucuaugguguccgguggugggguaagcacuuggggcucuaaggaaagaaagcaagggucagaggacacaggaagggaucuggaguaguggagacacagacgugaacaggcuggggcagggugcucccuaccccagugcuggaggagcgguguauccaggccccaguguuccaccuugcagucguacacauccuccgcagagggcacgaaggucagguaguggaacuuccggaaccugugguuaggcugagaguagaagcuggucugggccacucccuuagugaugggcuggcuguugcgcagccaggugacauugaucacaggcgggaagauaucauccacgaugcagaugaggacguugggcuuuccgagcuccacacgagucuuggggagaacggucacucugggaggcacuaggaggaaugagaaccuaaaucccaaagucccgucccucacagcucuuggucuuacuagagccgagauuaagggauacuuccucccguguggccaccugcagaaacguucugggaucuuccuggggcaggaggggaggggagggcaggauucugaagagggguuggggauucuguccaucaccuucccugccuaguuaggugggguggagggagggccagguaccgcugacagcucugguucgguuggagcguuccaccaagauguccagaugagcuuugaucauggaaaugcucaucagcccacucugaaaguccgagugggcgaagucuccaaacucaggcagacgccacacgaccuccucguucuucagauccacggagaaaauuuguuccccgucaaauucgugugugaacuguccagaagcgucguaagauugguagaaggccgguccauaggagcccauguggucggcuguauugggugagggaaggaugggagcugagagaagcaugucucagcuucugagucucagccuggucucauccugggcuguggggugaggacagcccugcaaagccauagcagccccuugaaaaguuccagagacacgaaagggggagggcagagggggcguggccacugcaugcauggguggagcugacaaagcaggcugggaaaaggagagacagcccacaggagauggugucagguuuccaggccuccaucaucugcuguagcuguagaggcagccacccugucagaccuuguguguaagaugguaaauuuggggcgaggaggaaaugguuaaggggaagcacugaagggagcuuuugggaaagaaagcuagcauaggagugggugagggacagugacagacaggagcaugauguaauaauauccaugauccagagaccagggugaggaaaagggccgcuuuccacaagccaggcaugacagcacaucccuacaaccccagcacagagaggguagagacagaaagaucagaaguucaagaccagcgugggcugccuaguucaaugaaacucugccucauuaacacauggagggagagagaaguucccaaaguauuguaagauaacacaggacauaaagucaggaguucaauccuggcagcagcaacggcgcacuugagaggcagaggcaggcagauuucugaguuugaggccagccuggucuacagaguaaguuccaggacagccagggcuacacagagaaacccugucucaaaaagccaauuuaauaaagaaacaaacaaacaaacaaacaccccaagauucaaacuuuacauuccaccuuccaucugggaguguugauuaauaggucucacccucgacaaagugcuguuuccuggugucagggcuacauuuccacugacucuuucagagcucuacacuucugaggaauguaagggacugucaugagcccagcgugacagaaaacaaacggggaaaaccaaaacacugcaacaaagcuggaugagaacugcuuguugcagccaggaagugguucaggagccagggugcucugcagugaggcgggugagggcacggaucucagaaaagaggaagagcugaggggggcucugaauguaaaagaagcccagaagagacccagccucagcccagugguuaggcccacaauggagguggcagggauuugucugcagguggagggaguugccauauacccgacacagagagagacacuuuccccugugcuguacucucccacucccagguguccccagcacuuacccuugauggcccuuacuccucggggacucaggaagcucauugcgguuaggaguaccgggaccagcuccacaaaaaggaccauugcuggggugaguggcucuaacaacgucuguuugggaagcaagggagcaagaucgagguaaaaagaaac

SEQ ID NO: 8552 - RNA, 9897 nt, Mus musculus
ggaaagugggcgaggagaccgcugucuguguauagcugcagcuacugagguugaagcagcagguggagguugauuucacugcauuagaacagggauuuuguagauaaaacagcuuucccagcaguagaaagcuggucugacugaggggccgcucgcugcgcuggcacacacugaggaacuuaccugagacugggauuuuuggugccaucuguuggucaugccugugacuuccacuuaaaucuucauucauuucgucuguggggucucuuccauguuuuaacaggagccuucacucuuguacuguggaggaucauagauaaggucuuaggccuugucucuuguuaccugagcccuugcuggagagagccuccgcuucgaggaagauaucccuuguuacaccuugauaacucucugagcaacuauccagucugucuauagaccuuacaguccaacugccugaugguaguguucauagggcugcuaacacucaacauguccacaaagaccugcuuuccaaacaugccccuuggugccagguaucacugagguacaucccuaaccuggcgagucauccguguaauaagcauuucccugugcuuacacacaugugcaccucuacagucagcuguuaauccuagaggucgggauuuaucaugcaagcuucagccuagugacccuggcuuguuuccucucuuguuccccggucaguuaggccuugccggccuaaguuguccagcuagccaccacguuucagggcccauccuccucgucucauuucugcuugccuuuuuaaagucuucccuuucugggguacuaagccuguaacuuuaacauggucaagauaacucccaaccuuuucuuuuuuuuuuuuuuuuuuuuuuuuaaagauuuauuuauuuauuuauuuauuauauguaaguacacuguagcuguccucagacacuccagaagagggagucagaucucguuacagaugguugugagccaccaugugguugcugggauuugaacuccugaccuucggaagagcagucgggugcucuuacccacugagccaucucaccagccccaaccuuuucuuguuagacaccagacuacagacucuuaagugcuuuuguuucucugucaugcaaauacagaaguauuccuauuugccaagugagaaugucgaauacugucagaugaacuagcauuugaguugagguuggaaaagaaaaggaucuauuuagccucgaacagcaugaacuuuuggguaguauuugggggggaggggaguugccaagcccuguucuuuauaacagggucucuguguacacaaagcuggccccaaguuuguccugaucuuccugucuuaugagccggaaugaaaugcuguuauuagcugcagcucccccaccucagaaucaauggcuaugaggaagcacugcucauuuaugaaauacuuucuuuccugcaaugucaguccuagaacugacuggccuuuccuuuuuuuuuuuuuuuaagauuuauuuauuuuauuuauaugaguacacuauagcuguggcugucuucagacacaccagaagauggcaucagaucucacuacagauaguugugagccaccaugugguugcugggaauugaacucaggaccucuggaagagcagucgguguucuuaaccucugagccaucucuccagcccguggcuuuuccugaagaggugaauuguggugaggauuccugcaagcaucgucauuuccuuggccaguguaguucuaguuucucauccgccauugauacuaacuaaacugaagacagccucguuccucuuguuugaaaaaaaaauauuucauauauuuucaagguuuuagaauuugcuuauuugcuuucacuuaagauauagccauacaggaauaagagcugaaacagcacacacuacauccuuaccauugcaguaggcaaaugaugguaaucuaugguacccacaguacaaguccuccuguggcaggcuggguucucagggaguccuguagcuuaggauggccucagaucccugggucauccugcucuuauuucccaagugcaaguauaggaucacacaugugugccaagugcaaguggaggaucacacgugugccaagugcaaguggaggaucacacaugugugccaaguguaggaguacaugugugugccaagcacaguauaggaucacacaugugugucaagcacaguauaggaucacacaugugugccaaauguaaguguaguaucauacaugugugccaagugcaaguggaggaucacaagugugugccaaguguaggaguacaugagugugccaagcacaguguaggaucauacaugugugccaaguauaaguguaggaucauaugugugugccaagagcaaguggaggaucacaugagugugccaaauacaaggggaggaucacacaugugccaaguguaaguguaguagaaucacacgugccaagugcaagugaaaaccacgcgugugcugcucagucccacauucauuccugaugugagaaagaguaaugcugcccagcgucugugguuccaguuucugguugcaccugugacuaacucccugccuaucccgcaagucccuggugucugaucacgaccugagaacuuucuaagcuucuguguucucuguacuuuuuuuuuuuuuuuuuugcccuggaccuguuuucaccaagugaccuuagucacaaaucugcugauagccugccucuugggcuaacucagcacgugcucucucagcaccccagaacccaacugugguuuccccagcgucuucagcugagugucugagagaaaacucagggccggaaagaaugaagacagauauugcuucugagagcagcuagguaaauggagggcaggggcuuucuacaguuaaccucaguggaugagccaggaugagucugauuucaaaguuauacucuguaucggaacuuucuggggaugcccuggcgauacaggcaaauacuucagaugagcugccccccaacaccaccacccagauucaggguaggggcggggcuuuugggggcuagagcagcuagagauacggucugucuacauuuuuuaaauuuaagauuacauacauaugugugucguggugauuguggagguugaagacaacuugcaggaaucaguuucuccacaugugggucagagauauaaggauaccagacuuggcagcugggucggagucuuuaccugugugcgccauccugcuggcccccaacccuuuuaaauauagaaucugccaacuauuauuguguagugcuggaauguuucacaaagcccaaucaaaggaauuuagcuaaagaacuguuaagaaguggggaggcacaaacggaaugugguuguucuacaagcacggguaaggggagaccccuacuguugguuucagcucagcuguaggacaagcuggacggagggggaauucuuuuagacugaguuaugagguccuaguaacauuuugggaacauuuugccuuugcuauugucuuuuguuaguccugaugauuuuguuaauuggaauugaccauauaaaucucaaacauagaaaagaaguuagccugggcagugguggcacacaccuuuggucccagcacuagagaggccgaaccuggcagauagaucucuguagauuuaaggccagcuaauuccaggacagccaaagcuacacaaauccugucuuuaaaaaaaaaaaacaaaaacaaaaacaaaaaaggaggaagaguugaggaagaggaggaggaggaggaaaaagaagaggaggaagaggaggaggaaaaauagaagcuaguugcagaaaaaagauuugaugugcauauuuaauaauggaggaaauuaaaggcaagagaauaaaaaaauagcuaaaagucaacacaguaugccccucccuaaaugaccuauucacaguaauggucccuaaugagaucuacuuagauaaaauuuuagaaagaauuuaaaaugguuauaaaucuauucagggaauuuacagcucagaaaugaacugaggaguggaucccaagggaucauaaacaacugaaucaucgaucaggaaauaagaucaauucaacagaaaaaggccaaagugaugugaaauagacacuucagcagggcagaagcucagugggaggggucgcaugcaggccaggacaccaccucuugaagacuugacagggauuuuccacuaaggaaaugguaaucuuuaagaaccucuuaaguaggacaauugagaucuuugugacaccacaaaaggaccaggccaagaacuguggacauagaggaagagaauuccauaccaaaagcauagaaaauaucuucaauagaaaaaaaaaauuuuuuuuuguuuuguuuuuuuguuuuuuugagacaggguuucucuguauagcccuggcuguccuggaacucacuuuguagaccaggcuggccucgaacucagaaauccuccugccucugccucccaagugcugggauuaaaaggugugcgccaccacgccuggcaucuucaauaaaaucuaaaaaaacauucccaacucuagagggaaaaggccccacccacccaccccauccagacauaagggaaugacagaaccaaccaaauaaaggagaagggaaaaaucaagugauggucgacccacuaaauagaucaaagaacaaauacugaaagcuggaagagagaaggaccauacacacgcugucagcuagcagcugauuucuuuuccaauggaaacugaaagccagagcgucucgggaggauguuucaaguuccgagagaccgcagcugcuagccuagacaacuacaccaaacaaaaucuuaacugggggaggaaugaaacuucccugucagaagcagacuaaaggacauaugaccacacagacagcucuacagaggaugauagaguacuguaggcaggaaagaagggcaucuucgaggcuacggggcaaauuaggaagaugcccuaugagaacacggcccacagaaucaacucagcagggcucauaggggcuugcagagacuggagcgacacucaugaacucuaugaggguccgagcuggguccucugcauacauguuuugguuaggugguauucuuguggugugcuuggcgcucuucugcaacccauaacaucaggagugagggcaucucugacuuuuuagggauccuuuuccucauaccgaguugccuugcucagcccugauaggagggcuugugccuagucuuauuguaacuuguuacgccauguuugguaucagggauuaauagauuugggguuggugggagaguggaggcaggggaaacuuugguugggaugugucuuagucaggguuucuauuccugcacaaacaucaugaccaagaagcaaguuggggaggaaaggguuuauucggcuuacacuuccauacugcuguucaucaccaaggacgucaggacuggaacucaagcaggucagaaagcaggagcugaugcagaggccauggagggauguucuuuacugccuugcuuccccuggcuugcucagccugcucacuuauagaaccaagacuaccagcccagagauggucccacccacaaggggccuuucccccuugaucacuaauugagaaaaugccuuacaguuggaucucauggaggcauuuccucaacugaagcuccuuucucugugauaacuccagccgugucaaguugacacacaaaaccagccaguacaggauguaauguauguaaagaauaaaauaaauuuuuuuuuaaaaaaugagacaccuuaacagcaauaauuggggauugggaaaacaccacacacuacaaaacccagcaaauugacaauuagcacacaccuuuaaauaacuggaucuuaguggucucuguccaccauccaaaagacacagaccagcagagcggcucagagcacaggagcuucccuuuugcugcauacaaggaucacacuggagcaucaagcaggaaaggugggcauaggaaucccaagcaacaagcaacggaguuccuguuccaauaucugaccaaacaggcuccagacuaaacccaucagaaggaaugaggaggaucacgccaugcugaugcuagaaaccaucccucaagcuggcauuccaacucuaagugugaaaaaccagcaguacccucgguuuccuagaacaaauacuaccaaauaaaaagugaaacagugggugacauaaauaccccacuggcaacaaggggcaggucauccaggcaaaggcguugaaggacaucuacagaacacuccacccaaacagcacagaacucagucuuuucagcuggccacaggacuuacucuaaagaagaaagucuacacacauacagaaagguaaauugcuccguuuuccauuuguauucuuuucuggaacgaagcuaggaaucaaccacaagaaaaacuacagaaaaaauaacuuggagauuggaugaguaggucauugaaaaaaaucaagaaaaaaaauuaaaguacuagaauagaaaaaagaaaaacgaaggcuguccugauuggaagguuuccacucugcccccgcuacaaaagcagaaccgucccaagcagagcugucccaagcgauaccaugaaccuuaaaacauuaggaaaacaagagugaacuuaauccaaaggcaguagaagggaaauucgcaggagagaaaugaagagaaugaaaacgaaacaaaaagcaaccaagaguugguucuuuaaaaagauaaacaaaguugacaaaccguuagccaaauuaaacagaaggaaggaaagucccuguuuaguaggcucauaggugaaagugaaacauuacaacggaugccaacaauaaagauguaaagaugugcuacacuuuaaagaacuguauuugaucuggaaaugguccugcacgccuuuaacaccagaacaugggagguggaagcaggggaauuucucagaauuagagcuuagaauggucuagauggagaguuacaggccaaccagagauacauagugagaccccgucucaguaaaacaaaccagucuucaucuuggacucauaaauaggacaugguauaguacucgaauauccguugcucuugcaauggcugccaguguaauucccagcaccuacacagagcagcucauaacucuagcuccauaggggucugaugccucuggccuuuucuaauauuuguuuauacuuguauuuauaugcacauacaauuaaaauaaacauuuaugagaccggagagaugguuccgcaguuaagaguacugucugcuuuuccauaaacuuaggacucaguuuccaguacccauauggcaacuccuaacuaccugucauuggagucccaggggaucugaccuguucucuguccucugugggcaccggcuguguuccuggggagaggggcaggaggacugcaugugauaugaaaaggggggagugauaggucuaaaaagguugagaugagaauggcagugaggaugagggaaaugagaagacuuuauggguggggugugaguccagcacucgggaggcagaggcagggagaucucugugaguucaaggccagccuggucuacaaauugaguuccaggacaaacagggcuacacagagaaacccuguccugaaaaacaaaacuaauaauaauaauaauaauaauacaaccacuuaaugaacuaacuaaaagauacaauuaauuuuugaaggcuuggcuauaccaugcagagaugaauaaugccacccgucagaaaccauagaucucuaagccgaaaucccauugccaaguguggguuuucucccuguguguugcuggccaagaagcccugagaagcgcucaagacagggcggauacugucgucacucucaguuccuguucugcuuuucuuccugcuguugugaucaaaagccuccuggggaggagagacuuuguuucagcuuguaccugaaggccacuguccgucauggagggauguaagaacgggaauucaaacuggagcucccaacugaaaccacagaggcacgcugccuacugccucacagcucucauauacaggcgcggccaccugccuugggauggcccuguguccccgggcuugguggguugauucuaugcugugucaaguucacaguuagagcuacacacgcgagcgcccccugguggggauuuauugcuaacaucagcuaaauggucuuagagcaaagcugcuuucaaacugcauuuagguugccagauugguucugccccgucuguggccagagaagaugcuuuucaugguaggcaauggccaggacauacucuuaacuggacaaaguucuggaacgaaugacagcuaauggcucagcccuaagagagacauugauauuacccccccuccaagccuaagggacaugguggaacggggacagaaagacuaagguaagagccugaggcugggguugaggaggggcuaugagacaccaccucguggguaugacauccugaacacacgaaggcugugaugacuguuuccaggcagaguguaagaggggaccuggaacagacuaugcuaaaagucugaaaaagagggggguuggaggauggaaacuaggucugacugguguaggcagguaguuuucaggcaacagguauaccaagaggugucucugagaccaggauuaccucuacugaaggcagucaguaccuacagugaucuugaaccacaagaugaagccaaaucccaaacugcccgagucagagucccaaauguggugaagggaugugaggggcagagccagccuuaguggcuauucuaagaagucugacaaggggacaucacagaugagacggaugaaggaagugcauucagaucucccuggugacuccaggaccugacaguuuccaaugucacccauuucuucccauccauuccugcugagccugccaacaggagucacguucaggaagggacaaacauccugggccuuugccagcacugcugcuauguguccuaccgucauggugacuccauuugcuauggguagcaggggugcaggggauaggugcaccuagcccucacacagagcuugacagccaugcugucugucugaaagcuaagucaugugaaugggccuuuccuccuauauaaagugauggugguugugaggaaagagacugggggccuguaaggcagaauaacacuucuccuugaucuuuccuuggauuuaggcuucuggcacaaggcaacagugaugucaucucagagacccuuccucuucuggcuuugaaucucccaaauuuccccugcuaacuacuaacuacaucagcugucccaaauauggguaaggguacuggaacacaaggcagcuagggggauucuccuagccuagagugcacuacagucuguaggucuuaagaacccgcugccccacccccugcacccaaggagccccaggggagacaggggacaaggccggcuacaccuuugcaggaccaccucuuaccaaaggcuccuccugccucauaucccggaaacggcaaugugaaaaauaaauccaaguguuuccucccagcccccgcucccagaaugaggacucugaggcuaauuauuuguuaauaaaugccuacgccauaaacuucggcuugcucucugacuugcuccuaacuuauuaucucuuuucuucuauucuguuucccacaugguuaguuaccucuccucagcuucacgccuccgagucccagggcaaaucuccucuuuauccaaugcugguuucugucuguccaucuccucagcguuccugggcgaaugucuccuguauucuggccuccuuuccgucaguccgggacacuucuuccucagcgucuauccuugaaucucucgugccucuaucucccagaaaucugucucucuuccu

SEQ ID NO: 8553 - RNA, 1655 nt, Mus musculus
cgagccacaccuggaauccaggcugguuuuguuaagaaagacagaugucccuauguaguugaagcuggccucaaacucauagcagaguggccuuagcccacaguguugggcuugcaagcacacuagacugagagaaccggauauauaaagucaguuucaaagauguuaaagaggcaggaagagcccaagggaggaggcugccugcagcugcagccgcgagagauggaugugcaggaucagacacugcccagccccugagccaggaucccugucuguaucugcugcagcccuguagacaccggcaggggcagcagcagcagcagcagcagcagcagcagcggagauucaucugcugagaagcugccaccaagcucaggaucucgggggagcuuuccccaggaagcuguccagacuucugcaauggcuaccuccuccaccaagggccacaacugucagucacccgacuggaggcugaagcaguaaguuucugggguuuuccgucgaucuuuuuuuucagagccgacugcuggcagaauccacaaggaagccagccgggagggugguucuucagagaguaacgaacacuguauaugcuaagaaucuggaggugccgggaacgccuagcaggggaaggauggaggcugccccaggugauggaggcacacagcagguaaggcgcuaaacggcccacucuggaugcaggaagggcugaggaguaucagaucugcaguuauaguuggaaggcgcauuuacugagaacacucuccgaacuguaggagucaacuccagauuguggugggcuguggagggggaggggaggaagaaacugucgcugugugugcgacagaggaggagacggagggugggggaagaggcagagaaaagaucuaaugcaaugaacuaagcuaagcaguucaucuuugugaaaauggugcuucugaggcuugugaaaccugugcccaaccccccuuuuaauuuauuuuuauuuauguauauuaguguuuugccugcauguaugucugugugagggugucagauucccuggaacuggaguugcagaccguugugagcuuccaugucugugcugggaauugaacacugguugguccucugcaagagcggcagccagugcucuuaaaacagugagccaucucuccagccccauccuguggcccaucugacgaaucacaguagcaacuguagccaaacacaaaaauaaaacaacaugaagagcuccugauguuguagaacagcaagcuccuucugucgguacgugucuagguggggagauuucaggagauuguuuuuaacacuccgcaggggagacacacuacacaacuuucuuccacuuaaguucuggagguggaacccaggcgcucacauccuggacaagcauucucugugggaacacaagcccagccacccaccuggaacuccaaaccagagucugcaagccuucugaaggcaauuagaccaaagagugaccaagacucugcccuuguccuuccuuccucaggcuucccaggcugcucuaccucccucauagaccccucugcucucuacugaucuucccuggaguucuguccuuaacucucuuauuuauggauacuaaaaugugaauuucacauuuccauguuucaugaaacauucuugcu

SEQ ID NO: 8554 - RNA, 14496 nt, Mus musculus
caacuucccuuagacgcuuccagcucaagccaaagaacgcaccuucucaccagcuucgcaugcggaucccuccacagaccccuggacaccacacuucugagcagggauacccuacguucacuguggagcgcaagcgcugggcgcuacaagcuuccuaagucucuugguuuacuuccagagcuuuaggggucccugaucacuccacccgcugacucucaccccgagacccauuaccccgguguggacuucuuccguccggaacgagccggcgguaggugcuccugcccgcagcaucucagcagagcggggcucggcuuuccaaucagcggcugcgcgcggugcaggcaacuugcagacugaggccccgccccaucaucgcgcaaggggcgugccguucuaccagcauuuggcgcccagagcaaaccugagcagggcaaaucugcccagagacaggugacgacagaggguccugcccucaaucugggguggggccugggaugggaaaauucacgcaagcaaguuaagggggcuggggaagaagaggagaaugagauucauggagaagaacacgacaggccagggcugcuaggcagaacuccaacuacagcuucagcggcagcuuccagaacagccugagcaagccagucucagaaggaggcgugucuagugauucgaggucggcuuucgguuucuucuuccucuaaacgccagcacuucuagucagcuccaccagcucgagcggguucccgggacuuuacgcgcacgcccucggacccgcccuucuuccuuccccacggagacuccugugcagcgcggacgucgagagucccaggcuaggaccagacucuggacagcucacgcucgauggcugcgcacgucuggcuggcggccgcccugcuccuucugguggacuggcugcugcugcggcccaugcucccgggaaucuucucccuguugguucccgaggugccgcugcuccgggucuggguggugggccugagucgcugggccauccuaggacuagggguccgcgggguccucggggucaccgcaggagcccauggcuggcuggcugcuuugcagccgcugguggccgcacugaguuuggcccugccuggacuugccuuguuccgagagcuggccgccuggggaacacuccgggagggugacagcgcuggauuacuguacuggaacagucguccagaugccuucgcuaucaguuauguggcagcauugcccgcagccgcccuguggcacaaguuggggagccucugggcgcccagcggcaacagggacgcuggagacaugcugugucggaugcugggcuuccugggcccuaagaagagacgucucuaccugguucugguucucuugauucucucuugccuugguaagggagacugggugaaagagcaggccacaggggacagggcaaugggcauuccaggcagaaagggagaguaaaguagucccgggaagcgucagagacacuaaggaggcaacuuaggcggaaagagaaggacccaggcccgagaagggguccagacaagggcguuggggacagggucuucugggagcagaacuucacaucauagcccaaaugugaagguuucuuuccacaccgccaucuucuccucuccucuucucucuccucuccucuccucuccucuccucuccucuccucuccucuccucuccucuccucuccucuccucuccucuccucuccccuccccugcccuccccuccccuccccuccccuccccuccccuccccuccccuccccuccccuccccuccccuccccuccccuccccuccccucccccuuccccucuuuucuauucuuuccuuuuugagauagggucuuucuuuguagcuuuggcucuucuggaauucauuauguagcccagguuggucucaaacccagagagaucugcucgcuucuacuuggagugcugggauuaacagccugugcccccaaggucugcuaaccgcccucaaguagcccuugagaaguuugauguagccgagcaggcuugggucugugaacaggcuugggucugggagcucagcuuccuggauaguggugaagggagaggggcagaaguugcggguaguuugcucauaauguuugugacugaggugucucuccucucuccccaggggaaauggccauucccuucuucacgggccgcaucacugacuggauucuucaggauaagacaguuccuagcuucacccgcaacauauggcucauguccauucucaccauagccagguguggaggaugggaaugggggucccagagcagaggggacuggcuguugggacugucauuuaaguuacacuucuguggggaucugggacucugucucaggaaggagacaacugauccucccgugucucugacucuagcacagcgcuggaguuugcaagugauggaaucuacaacaucaccaugggacacaugcacggccgugugcacagagagguguuucgggccguccuucgccaggagacaggguuuuuccugaagaacccagcaggucucucaugaaaccuuuucacuuguaugcuauaaucucuauaccgccacacacgcucucgacugccccccccccccaaacauguccacacacacaugcccaggcuggauccucagaaccauauggauggggugugguaauuccaacacuugggggauggaggcaggaccuagaggucaaaguucaaagucuuucagcuacauagucaaucugaggcuacccuaggcuacaugagauccuuucucuauauccaagacuuccuguauguuagggaaaagcucuaacaacugagugacccccaagccuuauucaugguauaucucaaauguagcaaaacauugucuuuuuuacccuaaggaaaacuguauuugcauucauuguuccccauaugaagcagcagacuuacagcccuggaaagccagagacccucaacuccaacggccucauuuuaaauggaggaaacugaauccuagacacuagacgcugaaaccuaccuaggcagaugcaccgagguuagacccgagggucuccauuuccuaaaggacccugggccugccucucugguugcuuccucccuucucuccacggcuacuggagggagggccagcggcaggcaacagacaggaguuaaaguaacugaagagcugaaagcuuucagggaacuggaaguucacuucacauuacagggcaucacuguguagccuuggcuggccuagaauucacuagguagcccagaguggccuuugcugccuuugcccccagucuguugggauuaaaggugugugccaccacacccagcgacaacuccuuuacuggcaagcacaggccuaaccagaucuuuccuuucuuuucccccugcauugaaguuccugcgccuccccagucuccuacccguuacccgccucaggaugcugugcugacgggcccacccuggcccccacugucagcuccucuugucucugugaaccgcuugcucacugucucucuucucaaucugggcagguuccaucacaucucgggugacugaggacacagccaacgugugcgaguccauuaguggcacgcugagccugcugcugugguaccuggggcgagcccugugucucuugguguucauguuuugggggucaccguaccucacucuggucacccugaucaaccugccccugcuuuuucuuuugccuaagaagcugggaaaagugcaucagguacguccccagauccucagcuccuacauuuaguuucuccuagacugcuuucaguguggcuuuccaguccuccaucauccugaaccucugaccugugaccucugaccccgcacugcccugcaccugcaucucuguacucugccuucuugucuaacuucuggccacaaucuguccuuaaagaauaggcucucaggcuggagagacggcucgggguuaagagugcugacuguuccucagaggaccugaguuugauucccagugcacacuaagcaguuaguucucuguggucuguaguuccagcuucaggggaucugacucccucuucuggucuccauggagaucuauacacaugaugcacacacauacacgauaaaauaaaucuuacaaaaacuggauucauuuccuccacgccccuucuaccuagaaguauggcuguagaccuuucucuucccucugucccucugacucuugacucuauaaucuccacgcagcuaaccuagguguccauauucucucucauuugcaccccgugugaugucucugguccuugucuuccauagucacuggcagugaaggugcaggagucucuagcaaaguccacgcagguggcccuugaggccuuaucggcgaugccuacugugcggagcuuugccaacgaggagggugaggcccagaaguucaggcagaaguuggaagaaaugaagacucuaaacaagaaggaggccuuggcuuacguggcugaagucuggaccacgagugugaguacaggagguggauaucccauccuuugugugaacaugucuugauucugcuguuuuccaaccccccugcuccuccuccagugggaagugauuggcuucggcucuugauuacucaauuaaggacucugcccuuaauucucucaguguuuuguaguguuaagaaucagccuuccacauuggcacacaaagcccacuugaccuguguguuaaggagauaccacucucccaacuccggcacuuccuuggcuucucagaaagccacacauuuccugcacggugugcgcuucauguuggcacugugugggcaagcuagugggagccacgagaagugccagaggccagcggccaggggcagcuggaacuaaagcuguaaccgagauuccaggauccuuccugccacccaccaguucuguauccagcacauguuaccuuuuucugaggcuguugcccugauuugaaaaaugggaguaaaaccugauguggugguucacaucuguaaucccaggacucaugcugaggcaggaggauugcugugaguuuccagccaucaugagcuaugaugugagacuugucucauuaaaggguauuggggagugagaugacucaguagguaaaggugccugcugucgugcugcugagccuggugaccugagauccaucucaggaacccauauggaggacaggagaacugacuccugaaaguuguccucucaccuccacaaggugcacuguggugccuacucacauacaaaaauaaguaaacaaacaaacaaacaaacaaacaaauguaguaaaaaaguaauauuaaacagcagcaagaaagguauaacauaauaacauaaucuccuauacagaggcucgugaugugagccgcuguguuuagcuuuguaauacaggguggacaugguucagcuguuaaggaugcagacugcucuuccaggugaccggcacuuaugaagggcagcucacaacugccugcggcuguagcucuagggguucugaugcccucuucugaccucugugggugccuacacucauaugccuguacccgcagacagacagacagacagacagacagacagacagacacacagacauaauuuagaacuauaaaaauaaaucuuuuuaaaaagugucaaaugcuccugaaacaaggagccggcagcgaugaggaggaggacauggaagaugugagcuguguuugagucugaccauugaccccgccuucccccuaaucucacgugucugggagaaaagaccuuccaugugaucauugcaguucguuucaucccaugguuucccuguaggucucgggaaugcugcugaaggugggaauucuguaccugggcgggcagcuggugaucagaggggcugucagcagcggcaaccuugucucauucguucucuaccagcuucaguucacccaggcuguucaggugagccccgcccccgcagucggcggucucagccuguccauugccuucucugccgcuuugcgcauccuccgccuguucccugaaugcugucaagcagguuagacggcucacuugcuuucgugguccaucccaggcucacacacaccccgcucugcaaugcagguccugcucucccucuaccccuccaugcagaaggcugugggcuccucagagaaaauauucgaauacuuggaccggacuccuugcucuccacucaguggcucguuggcacccucaaacaugaaaggccuuguggaguuccaagaugucucuuuugccuacccaaaccagcccaaaguccaggugcuucagguacugucuacccaucccuuuuaugccuccuucuucuucuucuucuucuucuucuucuucuucuucuucuucuucuucuucuucuucuucuucuucuucuucuuccuucuccuccucucccuccuucuccuccuccuccuccuugccacgagcuucucuggccuccaggggcugacguucacccugcauccuggaacggugacagcguuggugggacccaauggaucagggaagagcaccguggcugcccugcugcagaaccuguaccagcccaccgggggccagcugcugcuggauggccagugccugguccaguaugaucaccauuaccugcacacucaggugagcaagaaggaggugugggggaggggaggagaucaagccaagagacaauucuccacgaaaacucuugcagagaguuaggggaugcaggcagccaugggcagagucggggcuguggacagaagucacgugacuguaugguaugcacaagauugugaaucuucagucccuggacaauaacacugguguuucuugccuguggcucuucacauuugaccucagguggccgcagugggacaagagccgcugcuauuuggaagaagcuuucgagaaaauauugcguauggccugaaccggacuccaaccauggaggaaaucacagcuguggccguggagucuggagcccacgauuucaucucuggguucccucagggcuaugacacagguaucugcacucucccauccagauuccaacaauccugccuuuauuauucaaucccucuugucccuuggaugucaauuuguaguugaaacucuaagauucacauccucagacuccaucugccuucauagggccuccauuuccacugccccugucagcugcgcccaugcccuugugugugugugugagagagaguguguauguguguguaugugaguguguaugagaguguguaugugugcccguguaugugaguguguaucauacccugagggaauguauguguguauuuaugugaguguguauguguaugagaguguauacauguaugcauguguauguguguaugugagucuguaugucuauauguguuugugugaguguguauguaugugugucuguguauguguguaugugugaguguguaugugucuguguaugugaguguguauguguguguauuugagugagucugugugucugugucuguguauauguguguaagugugugaguagguaugugugccuaugugaauguauguuuauguguguguauaugccuaugugaguacguaugugugugccuguguauguauguguguauguaugugucuguguuaugugaguguguauguauguguguauguauguaugugaauauauauaugugugccuguguauguauguguguauguaugugaguauauauauguguguguggcuguguauguauaugaguguguaugugugcuguguauguguacacaacuaucuacaucucagcuggacucuugucucugcagagguaggugagacugggaaccagcugucaggaggucagcgacaggcaguggccuuggcccgagccuugauccggaagccacuccugcuuaucuuggaugaugccaccagugcccuggaugcuggcaaccagcuacggguaagguucuggcucucacccuuugucuuuuugagccaucuugcuaugugaucuuggcuggccuggaccucacuuugaagacaaugcuggucucagacccuugguagucuuccugcugcuaccucuggagggcugggucacccugcugugucaucucccugaagucucauucccaugggagcuuugcuucugccacuccuccuguguuaguuauaccaacaacagaacuguucaaaccuguccuuggaacucuuggucccauuagcuuuucucccggacacgggaaccagugagcagggcuacuguccuaacaaucuguaugggcuaagcuugcuuugugucguagacguucuaucccacccuuuguacuaauuuguccaucagagucuuuugcugugcuuauucuguagaugacaaaauagaggcuaggagagguugauuaaccuucuaaaagucacacagcuuuugagcaguggagccuggguccagacacaaaucauccaaacacucgugcucuuuguuacucuuacucuuuuuuuuuuuaaauuaagauuaauuuauuuuauguguaugaguguuuagccugaauguauguaugugcccagugucucugaaagucagaagaagguguggauccccuggaacuggcguuauggaugguugugaaccacuauguggguacuggaagucaagcccuggucugcuggaagagcagccagugcucuuaacugcugagcugacucuccagccccugcauuacauuucuuuagauugacuauaaaaaauucucauuuuaggggcugagggguggcucagcaguuaauagcauuaguuuuaagagcauuagcugcucuuccagaggaccuggguucaauucucagcacccacauggcagcucacaaccaucugcagcuccagcuccaggguuucugacaccugcacacaagcaaaacgucaaugaacauaaaauaaaaacaaauuacaaaauguuuucucagcuuauuaguggguuauuaaaaauuuguaugacauaggaaaggugacauguggggugggugggggggggaagaggagggaaacgggaggugguaugguuauauuucauuauauucauauaugaaauucucaaagcauaaauuaauauauguuuuuuggaacguaaaaaaauuuccacauauuaaggcuggacgaggagacccuagucuuacuucacuuaguaugccaucucccaagacaguugguguccuugggaggccugcuuuuuucugaagggcaaucgaggagagguaggggguugaguaggagggacugggaggagaggaggggggaacagcagucgggauguaauauaugggagaagaauaauuuccuuuucaaauuucccagcuuauggguagagaugagagacuguucaguccccucccccaucaugcuuccgcucucucucucucuguaccccccucuugugaggacaucuuaacaagucauagguuuggaggggugcugcagaccagggauaucgacaaugugucccagcccuggaagcacagggguccccugaacuguaaugucuguguguuucuccagguccagcggcuccuguaugagagccccaagcgggcuucucggacgguucuucuuaucacccagcagcucagccuggcagagcaggcccaccacauccucuuucucagagaaggcucugucggcgagcagggcacccaccugcagcucaugaagagaggagggugcuaccgggccaugguagaggcucuugcggcuccugcagacugacaaggccucuggacugcacacugcgugcugucccccuccuguccucuacucugugugacagagaaccugggagcaaagauauuaccacacccacggagacaguugaggagcggaggugcuuguuacaugagaaaauguaaacucuaggagauacccggaauuuaccacgaauguguuuccccgacccgcucccuauuagacgggguuucagguaccucacaccaacacugagcugcuaaaucuccggucuccacccucccggugcugagcuuguaucacagcaugcacacacaaaccugguuuauguggcguugugauagaaugagaagaaacgcccaaaguguacagagagaaaggacaagcagcuugcaauuaaccaaaggcauaggcuggcauuuggguguucuauggguguuugauauuuguaauaaaacugguguuuuguacuguggcuucucccguuucuuagcucccgcaaaguccuagcugaguuagucagccccccccccccccccaggacagugucccguucuucuucagaauucuguuuuacuucuggguccaucagcuuuuauuuccuggggcucucauuucucuuuacugcucacccacggacuccuagugcugagcuggaccgggcggcagccccucccucuccgcaccccaaggcagcagcaacugcaucuuggaguccuucucuuccucgcugaggcuggaggaagcgcgguagcgccgcggguggggaccccagaaaaucagacuggauaaccucgcccgcccguucagauucuuucaucuucuccucagcggcacacgccgggauaaucucaaugaaauggauaggauuagccaguaaaucucuuccauucagggagggcccggugugugacgucagcaguuccugggcagauaauguccauaaagguugcaaagaagaggugggguugaggauucaaggaaggagcgcgcagcccugacuugcgcgacgugagcagccccgggcaagggcgcguccucguggguggcucaggguagugagacuguugaaccaagaggggcccuaggagggacacaugaaaaggcccgacugaguccucuccuugguucgucuuucuccguuuuuuccugguugucccaggaccuaaagaccccugugcauccauuuaucgcauuuuccaguuucuauaaaaugaugcucauuuauuugagugcugcccccauccccaggacgcacgccuagguggaucugcucaauacuccucucagguuccaacguucuagacaaccucuuuaggagauaggacccuauucaguccuccgcuguucccagaagaugcccccccccgucccccgccugugggucuucacgcaccccacugcuaggcggccuccgaaggcgcaccucuucuuccaccccacagcccauucucuagcugguuucacugauguggcagcaggaaaacucguccccaacacauuguuuuaguucagacacccauuaacugggcucuacucggaaagggcaggggaugggggugggggacugguucccuccccuugguacuguggcuuucgcuuucacuuccuugucgcagagucgacggaucuucggggccaaguggucauggcguuacuggaucugugcggugccgcucgggggcagcggcccgagugggcugcccuggaugcgggaagcgggggucgcucggacccgggacacuacaguuucuccgcgcaagcuccggagcucgcacuuccccggggaaugcaggugaggacuguagggcguucuggagagaugcaggagguggguggugguggguggcacagaggaaggagugucugccugggucugaggaggugaggacgccaggaggggccguccaggagagcagcaucgaggcuagcccugaagaaccaacguggagauuaaggcaugggaaggcgggagaaaggggugggggagggacagaaggagagagagucacgcacggaguugagacagcgagacugagaagaugguuggugccaaucccaagacacagugcacagaccaccaugccuuccacagacucacugcuaacuacuacaggggcuguacaguugucuuggaagaccuaugaacuuugguggccuuacuuggucucagcaacccacccuguguguccuacgacacauuagauggccuaggucucaagccccucuacuguaaaaugagagcaaguuauuaaaaugugcuuucgagaaccaaaggagccacggauuaggaaacaccuugaagucgccuaccaugaccuuuguucccacgugcuggaaagcagaaagcuggugggcuuaaauccugcuuuucuuucuucggagcuacugacaucuagagucugcagaccccuccucacucugccacccugccaggagccuccuagcacugaggugccccucugccucuugcaucucuuagcccaccgcauuccugagguccuuugguggugaccaggaaaggaauguucaaauugagauggcccacggcacaaccacacucgccuucaaguuccagcauggcgucaucguggcuguggacuccagggccacugcagggaguuacauuagugaguaugugugcuccaugugugcuccaaugguccgacucguggagcuguucccucaguagagcagaaggccugggccgaaguucagacagagcuggcauuauagcacacugagggugggggugggauggggggugagggguggguggggagcugugggcucauuucuuugaucucaaaacucuuccaggcuccuuaaggaugaacaaagugaucgagauuaacccuuaccugcuuggcaccaugucugguugugcagccgacugccaguacugggagaggcuguuggccaaggagugcagguaggccgguuuuaucaucucauuuguucagccccucccccguccccaccaugucccaggucacuuacacccccaucgggugauccauuuuagcaaccauaagggauauauauauauauauauauauauauauauauauauauauauauauauaucuccuucaugugauuaaaaaucucccaaauccuagccugggucccugcuuauaaaccagauaaucuggcagucacuuaaccugcagggugguaucauuuacuaggcuuuuaaaaugcggaucagagauuuuaaauucccaaacucuccuuuacucuuaugucccgucccacaaguccauaccuuccaaacacucaucucuacaaucccugcucccucgugcuaugggagaaaaugaaugcagguguagcugccgccccugaggccuccuucucucuccuccuccuccucgaucgaucguacagguuguauuaucuucggaauggggaacgcaucuccgugucugcagcauccaagcugcuuuccaacaugaugcugcaguaccgggggaugggccucuccaugggcagcaugaucuguggcugggacaagaagguggguggccuaugucugugagccccccccccccccgaggugucuuacccauugaacccuccccucccccaugcuugauccagguuuugauguuuaccaaagugugcugucuuuuguuuuuguuuuuaaaauucauuuauuuauuuuaugugaguacacucuuguugucuucagacacaccagaagagggcacuggaucccguuacagauggucgugaacuaccaugugguucaauucuggcaguugaacucaggaccucuggaagaguagucaggggucuuaaccacugagccaucucuccagcucccuaaagugugcugucuuaacucaaauauuucuaugguggcaucacuauguugcuugcucuccacaagucacacuugcgucuugauaugaucaauaaaccaaguucaacucgggaugguuucccaucuucuagggaccaggacuuuacuacguagaugacaaugggacucggcucucgggacagauguuuuccacuggcagcgggaacaccuaugccuauggggugauggacagugguuaccggcaggaccucaguccugaagaggccuacgaccuuggccgcagagcuauugcuuaugcuacccacagagacaacuauucuggaggagucgucaacaguaagagaccaaugcgccccacaacaccuggggagaccacugcuccccagcaccugggaggagggggauguggggggagcuuagauugggagccucgggggagaugaguggagaugucaggucugagaacacugaaguuccagacaaaggcuuucagugugugugugcuuaaugcucaugaaagcugcuuaugccacaccauucuggcagagacuugcccaagaaaggccugacgccauguucuuuucucaaucgcccacaguguaccacaugaaggaagacgguugggugaaaguggagaguuccgaugucagugaccugcuguacaaguacggagaggccgcucugugauggcugcugggcaggccucccccagcauugguggcacuggcuggcagacucagagaccugggacuacuucagucuuaggaaaaagaagggcucaaccugggcuggagacaaagcucuguuuacccucucggcccccgcacucacagauaccuucuaaguacaauaaaagaaaaacgguuauacaugucucuggguuguggcugaauggggucaggcuguggggcccuuuggagggagagcuaggg

SEQ ID NO: 8555 - RNA, 3707 nt, Mus musculus
uacuaugcccucaugaaauuuuauuaacaucaugacaggaucuguuguuccuggggucuguuuuacccaucccaucgugacaggaucuguuguuauuccuggggucccuuuuacccaugaggcccgggcuccacagaauccuaacuaugaagucaguuuugggaugggaggcccauuuuaguucuaggcugcuuucccaucucagcgggcccccagagguggugcuggucaucuucacaauagcuaccugaaugguuggaucgcuugcuugucacauccuugccuugcccagucuucauuuucuuguuucucucacaggcaugucuaggccauccuucaucgaauuuaccccagcggcugacuccagugaccucuggaaggaugggcagcagcaaccacagcaggagaaagcagagccuguccuggacggggcugcugcccgggcuuucuaugaggcucuaaucgcagaugacaguaguuccucuaagccccagagagcugaaccuaugagggagaggaagaagaagagaagaagagugacuagggagccugcagcagcaggaguccccagacaaggaagagcacuugaggaugaagacaggauggcccaguggauccugcuggcagcccagaauggggaucugacagaacuccggaggcugcuagaaccccaagaggcagggggagcuggagggaauaucaaugcucgugaugccuucugguggacucccuugaugugugcugcccgagcaggccagggcgccgcugugcgcuaucuccugggccgaggagcugccuggguuggagucugugaccugggaggcagagaugcugcccagcuggcugaagaagcaggcuucccugagguagcccguauggucagagagagucauggagagacaaggagcccugagaaccagaaccggugaggagggagccuucacuuacacccaucuuuauuguguucuuccuuuccugggcaccucauacuaagggcccacagcagcuaaagggggcuauucauccucuggcauauucagucauagaguaacaaugggcguggucuuugugcauuugaaucuugguuccauuuauuugcagugccagccuaaagucugcaaaucucaguccuugucugagaauuggggcuaagacuuuuuccucaaagggguguuaagauacaguagguuaauguggaaagagaugggguaggaugggauggugcuugucacacaguuugcacuuuauaaaugccagcacuacucauuauuccugagagcuugaggccuaccugacaguauuccaaauauucccuacugggaagacccuggggccccuuuccaagacaagauacaaccaaaagaugcugcugacauugggagaaaggcaaaaaguacuuugcucugcucugccuggugccugaacaacuugaggcucuguucaucuuuuuuuuuccuccccuauaacauauuucuuucucugcagaucuacccccuccucgucccaguucugugaggacuguggugcccacuuugaagacuccaaccaccacacaucuacugcucaccugcugucacuguccaggagaccccagcccuccaaccuuccccuuggggugcccacuuccaguccuggcuucaggcuacugcugagagguggcugggaaccaggaauggggcuaggaccccggggugaaggccgugccaacccuauccccacuauccucaagagggaccaggaaggauuggguuauagauccccaccccaaccccgagucacacacuuugcagcgcgggauacccgggcugugucugggagagagagagucccucgaguugccacacugagucagagggagaacagaaggcaagaagaaaagggcagagccugggagcgagaucuaagacuguacaugaaccucgaguucugacugauauggacuggcccuggucugucacucgcuggacuugggccucugacuuggacacuuggacuuccgaacccuuaggccuuagcuguugggcucugauuuuagagagaagggcggagaguugggagauaaauaaacuuccuuccuugugguuuguuuacuuucuugaaugauauaguagggaauuggaacaaaucugagagucacauagaagucucaccugagccaaaaggacaagcucuccgggugacaaaagagaguccccaguccugcuggcugcauucuaccugcuccuugaauccccgcccccacacacacauuaggaauugccccacuuuguaaaacaccccucugaguaugugucuaggccagucaagucagugacaaguaucacaaaccaagugugcuauguguuggagaggggcgggcauagcuugguuagagcaccugccuaacacugggaagacccuggguggggccccucuccaagacaagaugcauccaaaagaugcugcugacauugggagaaaagccaaagauacuuugcucugcucugccugauacaaaccuugaacuugaggaagccagcugugaugaaguguaauaccuugugguagggaaguuaaaaguccccagagaggaaguagaguccugcaggauuggccaauacaacuaaugucauccaaccugugugacauucuagcugugaccagagcucugaccucccagauaaaaaguucaagaugaacuuuuuuucuuuuuguuuuuugagacacagucucucacuauguguagaccaggcuggcaucaaacucagcuaaaacugguucuggagugcuacauggggcuuaaccuagggcuucauaccugcuuacugaguuaggauuccaaggcuuaaggcaguccuaagagaucauuucacucccugaaaaccaggcaauaugcuuuucuacacuucucuuacguacuuggcacccccaaucccuugagaugcuuauacagagugcuaggaacaugaaagcuuucaaaucccagucuggaaggccaaagggcggcugcuuaaaucacguggcuccuguuauuuaccuuucuggaccagcauuacaagauaucucaggugagaaauggaggaauggcggggguugugagaaagaaccacagagaggcuggaaucgucacacagggaagcaguggcaagaggaucgacucaaaggcagucugggcaacauauguccaagccuuuccugagcuauauauauccugagcuauauauauauauauauauauauauauggaucuaagcuacauauauaggggaccuguccuuaaaaacaaagcugggcaguggugcagcgugccuuuaaucaaggagacaagaggcgggcagaucucuuuugaguucaaggccagucuggucuaccgagcuaauucaagauagcuaaaguuacauugaaaaacaaaacaaaaaaaucccaaacuaagggcuagaauaccuaaccagugucagcggcgggaaggucugggaggugagcagccgaacccggguucgugcucagggucuggucuuaggugguccucucucuacgccugcgcuagugaaucgcgggggcuucggaggaggucgcucugucgaguccgccucacggguugcggagcuccgcccccgcuggucccucccgacccgguacagcugcuuccgggcucgcacggcucccggaggccgcuccccggacgcugggccccacagcuacucgcugcgcgagcacccagacgccug

SEQ ID NO: 8556 - RNA, 1764 nt, Mus musculus
ucaccaguaccuccaggcugucaggcuccuccauagcgguacuggcacuaucacucggcuccauggccgacagcucucuaaagaagaacgagggggggggguucgcugucggucgcacuguauuuuauacacccggaagccucucuggacccaaucuccgccccaaucccuucaaaguuucucauacacaagcagauauauucauccuccuucucauccccccuuuuugauucgggggcacaggaacagaaacacaaaggguaggagaucgacggcauagggagaugaaggacgagaggugggaggggcuccaccaugccaaucacaauagggagagccaguugggcuaggaaucagggaagcaagcacgagaccgaccagaggccagugucaucaccggucgcgaccgagcaagcgcccgagagaucgggaaauccuaggacaacgcgagggguggggggagggucgcgcuagacucggcagagaaaaguggcuucgcgcacgcgcagcaccacaaucgaacccgccuaaaucaccaccgacccaagaccgcggacacucacgggaggcuggacgggcucgcugaccgcccccgccuuccgccuccgccucuccucgguauuccagcaacacgacuuaaccaacacgcgaccaaacacauacaaacacacauacacagcccaccacccuguggcuccgcccccgacguccccacgguaccgucacuuccggucucccccaaccuggcaccaagggccacuuccguuuccccgaucguauuuggggggaucucgaggcgguacuuccggcucccccagucucccccgauuuacuuucguggggcacgaugagaaaguccacagccccgaacagugaguuucuggggggcgagacgggcccgggccggccgagaugggagggagccgaccacccggaggagccgccgccgccgccgucgucgcccgggggaccgcacugcgccugcgugagcggcgccacgcgugcgcacacucuaaguacuuccccgccccccuccggcuaugugcguuucuucccugcgcgcgccagagugcaaccggaccgggguggcuacuggaaacgccuaaagaaaaaugacugagugagaugcuguaauuuccucgagaaaaauugugagacuuguguggagugcaccucguuaaucaacgucccaucuugauggucagagacguuuacaggcacaauucuaacuaccuaaaacucugcaagaccucugguccucccaucauuucuguucuuccggaagccacucuuuuucguggacggcugguggcguuccgcgggcuguguuugcuugugcccgacucuaguuccuggcgggauuaggccgguugggcucuuugcagacuuugagcauccuguuuauugagaucuccgagggagugccauguuuaaggauaaaaaaaaauucuauugcauuuuuugguuuugagacauuucugcugcuuuuuaagagcuuuguagaaaaaaagaaagaaaagagaacgggugccuugcggaucagauuaaaggacaagacuuuaagaagggaccaagggaauggagagauggcucaagagaugaagagcacugucugcucuuccagagguccugaguucaauucccagcaacuacaugguggcucacaaccauccguaaugagaucugacacccucuucuggugugucugaagacagcgacaguguacucacauacauaaaauaaauaaaucuuuaaaaaaggaaa

SEQ ID NO: 8557 - RNA, 15824 nt, Mus musculus
cuuuuuuuuuuuuaaaauucuuuuauuauucuuuuuuaacaaacggccccagggauaggggacuaggggaggagaagaggggaagugagacuccagacccacaaccccuccccacccaccccuuucccccuuauauauuuauaaucuauauacaagccccggggaugggggucaaggggaacucccucagcggggugggggcaauccaggcuccuucuccccccgggacccaggcuccucugcucuucggggaggcccuucucgagaagguggcccugcccguucccaaggcuucggcauccagcgcagggcaucugguggggaagccugaggauagguauauauggaagaguaagucagcgauccuucaggagcucagaaggggauccgaacuuaggcuggggggagagggguguuacugguccucuccuucaccugcugguagaggucaaugcgcugaguucggaauacuccacuguagguggaagguggggccuugagacgggaauugagaccagagaagggccuaagggaggaaaggugacggucaggguaaacccaaggccugcccauguuucaaaaaaagucccuggggaugcagagccgauaucccacuccuguuuaccuuccagaugggggaguccgugacgacccaggacccccaagguugcugcucagcuuucgguaauccuggaaaggcuuuaguucuacugggugcagcuggaaagagaaacaauuuacccuaugaacuugcugucugaaccauuuacccuuuuucccuuuggauaccuugccauccuucaaaaacuugaaauacugaucuuuacaccuuaccucugcucgccccaagcuaggggcgaagggucuagcgggugaagguaagacccgagcagcaggagcaggugggggccgcacagcuagguuggggggcuggagagcaggacccacagguaacagagaaaggggggguggagcaggggguggcgcugguggcagggagccaaaguucaccacuggcagcugugagucuaccacagguagaagcaucugcaagaaauccccagugagcccauuagaacaggaaggccauguaggaaaaauccaaacuaagccaggggcagaaaacgaagggaaguaggaagaucaaagauaccugcugagcaggggcucccgaaggaaggaagccacucuggccaccaggcugcagaggaguagaguaaaaaucugaaggggauggcagauccuggcguaccuguugggaaaugaggaaaaggccaauucucaggugggugugauggcucaagauuuauaaucugaacuacauaauguuuuccaggcucuccugggaaacaagagaaaccagaacaggucgagucccccaaaaacauccucucugcugcccuagcagcugcccaccucauaccugaagcaagggugggucaggcaaagggcuggggcagaaagcugcagaguagaggaaggauggcggaggguagagaacucccccagcaggcaacuuccccagcucuguggcuugcagugcugagaaauccagaaacuggcccuugagagcuaccccagaaagcagugccgagggaggggcuggaccugggggcagauacagaggcugugaccugaaaagaauugggggaggagagguguuacucuuaauccacuguucuuugguauucucuccccugcaaucuaucuccauuccaagucuguagauaaucuaguuuuaccuguacuggugcaaugagggugucccaggacggaagccuccacuguugggauguaacugagagucgaugggugcacccccagagaccugcuggagaaaagcgagauaagagcaguuccagugucuuuguuaagaaaagauaacuuggggggcuggugagauggcucaguggguaagagcacccgacugcucuuccgaagguccggaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaaaaaaaaaaaaaaaaagaaaagauaacuugggcuggauauauacagcacagugguagagggcuucacugacaugugagucccaagucuggucucuaaugcagugugauggguaaucaacuggauugagaaauacauaggugacaauagagcacccaggacagccagggcuacacagagaaaccaugccucaaaaaaccaaaacaaauaagaaaaagagagagagagagagagagagagagaguuaaccaaaggaagaacacccaccccaaagugggcagcaccaucccacuggccaaaggccuagacacaagugaaaaaggaaccugguggaaccucaguuccuaggaagacagaugucaaaggcggcaaccaucaaguucaaggccaaucuauacuacagaguaagcucaaugccaauuugauuaacuuggcaaaaccaugucucaaaauaaaauauaagaacagggcaugaaugggcuggagggacagcuccagcuaaggacaggcauacucucucuaggccuacagccaucuauaacucuagcuccagggagacuagacaccucuggccuccauaagcaucugcaaucacugaauaugcauaauuaaaaauaaaucuacaagggcuggugagauggcucagcagguaagagcacccgacugcucuuccgaagguccugaguucaaaucccagcaaccaaccacaugguggcucacaaccauccguaacgagauccaacucccucuucuggugugucugaagacagcuacaguguacuuacauauaauaaauaaauaaaucuuuuuaaaaaaaucuacaaaaauauaaauagagaaaucucccggugguuaauuagguauacugguuguucucccagaagaccccaucuaucuuuaccauccacacgguggcuaauggccuauaaccaccucuaacucuaguuccaagggcacuguacacauauggugcagacaacacacccaugcacaugaaauaaaaacuuggggguggggggaaggaauaaaccacccauccuacucauuggaggaaaagaaaaaauggaacacaauggaauguuuuauaaguuaaccaacuucggggcaggugagagaucacggggcaaaggcacugcuacugccaccugguaaccuguaacccauccauguagggguggaguggacugcagaguuguccucugaacucugcucucaguguaacacaugcaccggggcacgcaacaaaaacauuuaaaaaauuaauaaaacaacaacaacaaaaagaaaccacuauccagcugagcaaguuggugggguacaucuuuaaucccagcaccuggaaggaagaggcaggugaaucugaguuugaagccagcuuguucuacauacuaaguuccaggcccugucucaaaaacaaacaaaaggcagaaaaggaggggacuuaugauuaauaauggagcuuaccugggaauuaggagguccagggcugccauagaagaccucaggguacggacgcugaccugaagggcugggcucuggaacacacugcccagaacccaggcucuugggcuguggcucagcugaaguagaagcacuagggagcagcucccagucucuggauaugggaacggccugagcgaaaaaaaaaagccuugucaaaguggaaggccuacagucugcccuagcgguucuccaugcaugagccaacccuuucacaggggucccaaucagauaucuaaacuauauuucauaagagcagcagaaugaguuaucacgcaauuagauaacuucagugcuggguuagccagcacgaggagcuguacuaauauggcagcugcgaaggugaggaggcccugccucauuacucuuacuggcaucaaagcucccuucccaccuaccucuguggcugaugccaccaacuccuuuucuccuuuuaaagugucuccgaccacuaggcacaagucugaguccuguaaugugugggaagauuguaguugaauucagacucccaucccacuugucaucaccucauacccaaacgaggacauguccaagugaagcccauucagaccuuguugguagugccaaacucaacuugagagcccggucggugggcuggucggagagggccuggcucugggccucgaucugugcgcugugaucguucugugccuaugggaccagggggcagaggcugcucccggggcagcuccuagauugggaaacaaaguguauuugggugacagagaaacaaaccaagaaaaagcaaagcacauuggcuaaaaaaaggacagucaaacucaggagggaggaagggcccugcugacauucuucauccauccaucgacuuuaccuuucuuuccccuucaugggaagcagguggccgucuccuaggagguucagaggguucagagccagaugcacucucaccaggaacagcauucaggggugaggguccuccaggccgcuuggggggucccucugcugaccccuuaaguccuccaucaggggaacuucgcugacugcagggaccugaugacaccugagaaucuccacucagguccacuccacugucagacugacucaucugcgagguggagaaggagcuagguaaaacaccggacaccugagaagugucacauaccaacagaggaaaggagacaauuccaagagaacggccucaagggcuaugucuauucagaacaggugaagaaacaugaccaacacucaguaaccucccugccacuccggucccagcgucuccuuaccucugugccugccacauccucaaagggacucaggggcuccauccagggcucgauggagccaggcugguaacucuuucggcuuguggcuagagaacaccaaccaugaggcaggcagugagaaacuaagacccaccucacaucaccacgccccacuccaaucuuuacccccccaccagcuucacucaccaguauguaaacgauuccagauguggggaguuagggccucugugccugaaucucuggauucuuccugagggccugggaccucaggcuuagagcccaagaauccagagcuaugagaagcuggcacaguuuccuaaagaaaaccaagaagggcaaaauacaaauaagcuggggcagaaugagaagcagcagcagcagcaacagcagggagacagagacaugggagacaaguggugaucgcuaaugaagagucuggggugagagugagcagaacagaauguaaaaagcauacagaaagcauaaccaagaaccuucaaaggugggagugcaaugaggcccagucuccagccccaucccucaccuccugcagcagcuccgguuuucggggaggccgcucccgccguuucggggggaagggauuaaccccggcagagucccggggagucccgcccaccccccucaccaucggcccuggcuccucgaagugggggucuggggaaaaggggaaaacugucagcaucuaccucauucuaccacugacccuagccugcucucccgacuccaccucccaguccuuccagcucugcagaucccaauagcaggggccccaugacaaacuccugcuccccacuccagcacuugaccuuuggggauggagucauucccacccgcuugccuccagcuuaccagaacugauagcgcugcuggcccuuggggggucauaacggguugggggccgaggggaggagcccugaggggcuuggggaggcccaggcuuaggccuugggugccccccuggugcaguuacauuuccuuggcggcugcuaaguugggccagagccuguuggauuccagcaggguugcuauggauaacuugguccaggcggaagacagcagaacugcugggggguggcggaggcagaggaagucccggaggucgcuccucaggaggacggcuggagaaagcagagcaucaguuccagggcucacuaaauucuguaagucaagcaucuacugucgcuucacuacuagcauccuaucuucuccugauaaaacccuuuccaagcuuccuguucacaacaguguguugagaaaaccagaacaaaacacgcauggggacugcuaacucuuuagcugacugccaagauggaagauauauagugccuuucugaugccugacuuacuaaaaaaacucuaacucccuggcacccacccucaacccagcaaccacacuacuacuuagccaucuacucuuacccaccuucgguucuugggagagggccagcuccucuuauccccucguccugggccgguccgucccccagggccugcaccaccaccuccgcuacugccaccaccacugccagucuugcccccagugccugggcgccgguuuugacgauccaugccuggccgcugacuugagaagcuccgcuugcucaaauccuuggcucguuggcucaggucuccacgagacauggcugaaaugccugguccagccccaccugcauuggccccaggaguccccacagcuuuagaggucauaagugcugcugggggagucuccuugucaccccggcgcucacuggcaaagucgcugcucucugaugcagucucccauuccucauuggcuuggucugaguucugguuugacagaucaggagacuuagcagcugugcggcgagggggugggggaacuguggcugcuguuagugucuccucagguccagggguagaggcugcaaggguuagggaagggggcuugccaucagcuccucuggcagcguuuucacguucuuguuucagccuucggaaacgaggugguuuguccugcuguugagcccugccaugucgccuccgucggggucgcuccccaucuuccaugccuacacccauguugccagcucgagacaugggggacagaggcccugagaucagcuucucuuucaaagguucuuuacuuggaggcaaaggaccuguuggagguuucuuuggaaccagagacuuggcaggagggcuccagccugagcaaacaggagggggccgccccccaccucggccacggcgugaugguacuccucuuggagugaagacacgaccaccucgggcaguggagaaucgggcuggggcuggugauggaggagcuccugguugugggggggcaagagggaccugaccaagcacucccucuuugggcggaggggcuuccuugucagagggggccaggucacucucaugagucucacugccuguuucagagccacgcuggcggcgucucuuggggauuucuucauauucugaacccucacuucgugucucacuggcagugcggccucggggagcagaaggaugguuuguuccgccugaaccacccccacgcccaucgucuccucggaacucucgguaacuucggaauucacggcuccgggcuccccgaccccggcccccauaggucccccgaaaaccccuuccucuggcaaaauacucgccucugccccgaccacggcaagauguaggaccuacucuuucauaggaauagucccgccgaagccuaggugcaggagacagguuuccaccuggugggguuucuuuggggcccaccuugcccuuagcugucuugagugcaucuggcuuugggaccuugggggucucaucccccuguucuagggacuuaggaggcagcuccucuacuuucacagguggugguggcuucuuuauaggcccagcucuucgaggagggacaccuggcuccucuggagggauuccacggcgacaacugccuggucgggggccccagcgagucucaguacgauucucucuccguggugguggugggccuuggccuccacgggcaggcuuucugccugcuucuggcccggacagcuguggcgguuccuccuucgaggguuccuucuugggcgguggagccugcaucuuggcagcuucaucauugccuggaggccaggguagugggcggggucccgggggagcagauuccuccagagggaaucucgagauugggggcccaggaguuccauucucuggaaaaccuggauaauuagccagauaaggugggggcggggguaccggaggagucucgcuccugaagagaaacagaagagaaguuuguuaugagaaggaugaggacacgcagagaagaacuaggaucuagacacuccuuccacgggcacccuaucacuucagacagcccacacuacucacaggcccucccuagcaacucaccucauacucuucuccuccucaucugcugccuggcgcaguggugagguaagaggacgaggaucaguggguguggugguaaagacaucuccaacccaggccaacuugggguccacugguggggugccccuuucccgcaacagagggggugcauggcguucaaauggcucugagcuugagcccccacugucugagcguucccggggaaccaggccuaagaaaacaaagaaagcaccuugcauaggccuuagaugcuaaaagcaccucugugugagaaccugugugcagcaccugcagcuccuguucugugaggguuugccuuucucaugaaaacaagucaaucacucagcugugaaguaaucaagccccacaaauaaacugugcccaaugaaggaucacuaccucuuccccaagccuauucucacaagcccccuagaagugcuaggcagauagaacaccaugcucccuggcugucccacagacaguauucccuccugggacuaaggagaucaccggcacucucaugacccguaccagagggaugcacaccaggaggguagaaguccagagggggccggcccuggagaagccgaggguccacguaaggaggaaucaucauccagcgggggucaaaguucauuggaggcauuggugggggccggcccagagcaccuggguacagggcuuugggaggugggggcggugcuuguggggcagguacagcucccagggucacagguugugguggugaugggggcacuggggcaggaggggcagugccuuguugcugcugcugccacugcuguugcugcugcugcugcuucaggagcugcuccugcaaguaaugagacaagaugaaaagguuaccauagccuacauacacucaagaccaucaguacagagaaaguuaaggcaguggcaugacaaagauagggcgcaagggaacugugcuacaacagaaagacgaacccaggccugaaggcaacacauggaaggaugcugaagagacaaaaacagccccaaagugaaagaaaaaacuuggcaucaccuguugcugccgcuggaagcgaggaggcaaugacuucugguauuugggguagcccaagcccugacuggggggcuggcgaguagaaccaaccccaucaccuuuggguuccaucuuuggggcugggggugugguagguggaggaaccucuucuggugguucaggacccucuuuugaaggcaguugggguuccacugcauugaagaacagggugacuugguccauuacaacagucaaacaucccagaaauuccacccccaguuaaguauuuaacaaaauacgaacugaauaaguggccauccuguuuaagaaccauagaaauacuuuaaagugucaaguauuccugugacaccaccagaaaacacaaaacaggaaccagaaguucuguucuacaagaugcuuagauucuccucccacauaccccgccacucacaguucaauagcguaaccuagcacucucucccacugacacccaucuuuacuacccacuauccccuuaagccuagcagacuugacacccaguaagccccaucccuuucuucauaccugggcuggcuucgaagcugccacugcuguugcuguuggcagugcaaccacccccacucaccagagugggaacuggagccaccccuggacugggggcggccugcacaggaggggcuugugccggcucuucagguucuuucucugguguugggguagguguugguggcagagcuggagcugcaggaauuucuuuggggacuacaggugguagagcuggggcagcagggguaacagguggggcugcaggcucugccuugagccgcuugucaggugccccaaacuuuucaucaagacgcuuaaguuucucagcacaggcugcccggcgcuccuccugcaugcgucgcucuuccucuucucugcgccuucgagcucguuccacugccagggagaucucugaagaagauugcuuccgacgcugccgccaugccucauccucauccucaggugcuggggguuugcagggaggacccccucgauccuggcaaugggcagacccagcaggccaggcaugucagucacucuaccuucuaccaccucuuucaaagaucaaacaacugucuacagcuacaggauaaaagaaccaggccugggaauuaauggucucugucuggguggagacaaauuccucacccuuaccucuguuccuuuuuuacuuuggaggaccaaucacgcaggccuucccuucccagcaucccagcucauuucaacuccccgagaaccaaaggcuccccaaacuuuucucagauacaacccuaguccugcccuagcuucuugucauuacugucaauuauucagcugauacccccacaacugacccucucggcccgaaauuguagauacucacuggguaguccccagggggcccccaguucccgacuggcccccggugagguggaggugggggaggcuuugggguaggaggagcuggcucugucucugaaggccgagcauucucuguccaggcugucuugggagggggcaauucgcugccaggggaggugcccuuuuugccaucugucucagguuccucagcagcagcugacugggaauccuugcugugggcagaucacaguguaacuaagcucugcuauaagcaacccuucuaugaggcuagcgcaccacaagaaaaacagugccucccuccccugggcccuaacucacuggcccucagcucccuccucgucggagucucguccaucuuccucaucgcugaauuugagcuuuucaguauagucaaccucuucaugggccccugagguaaaaaaaugaacauuuaaguaaacuaaguaaugugcucucucagauagcuucacagaacgcagcaaauagucuggaacuacaacagcagauagagucaaugcuaaccguccccaccacauguccugacguccucacuccucaguacuuggcaguacuaagcuuucuaucauucccucuuacccuuucacaucugccuuccucucacacgacccaccauuucuucuucacauuugagaacccaaauagucauagucaccugcccaaccaucaucauuuuccugguccaguuggucaaacucuuuaagauuauccucuuuaagaauagaaggccgacccacaggcucuacaaggcgcauugguggcccugagccccgggggcccgccacacggggaaaacggcugcauauuggaaaaaaaaauuuggagggggggauguuaaauauagcauguagcagaaucacauauaaaacugaaccccuaguuagaaaaaccaucucuccaaguagccuuacccuguuccccucccccaacaacaaacccagaaucugauuacuuaccugggcccaucaggagucggguaucuauaaggccccugggguccauagggcggagggaaugggagauaugggggauacaucugcaaaacggcccaacaauagcugcuuagaggggggacauauagucuaccagcccuuuaaacguauccuucuacccccucauccucccacccccaucucauuggggucuacuuucugugucuuccaaagacuaaguccuaacccuuaacaccuggcucucagugcaccacuucaagcaacacaggcacacucacaaagggcggcaucaucccgcgguagggagggaacuggggugggccugaaggcugcagcccaccccggggaucauggccaugaugaaguuuggaguccgggcccuccaggucaucagggccacgcccaccuccgucccuccaaguuguagaaucuguaguuuagaaacgcaaagagggaggaaaagauaaguuaccacuggucuaggccaaggggaugcaucagaaagacggggaaggaagugaguaacccagcacgcagccuuuccacagagcaggcgcgacccuggucugagggcagcuacucacuuugggggcggaggcuugguccgggcccagacgacuguucggcagacucccuuuccuuggcagccuuguccuggucuccagccgccugcagggucggaaauuccucucgagagaaucgcgacaguagguuugaugcccuuccaccuguugaaaugaggguauacaccagauggggucacuuccugagcauguacauaaaagcgggaggcucuagauccugggugauuuggacacaagacgaaggaucucuccucaaaaaugcauggccccugccucccucccauaugcuccaacccucuuacacucaccaucuccaugggcuccaugggugacacuggcuugugcccaggacuuuaccccgcuuggaaccgaaggaguguucugggggagcaaagggacaaauggucacagggagggcagaguaaguaucguaagggucauucuuccucauccaaccccucgaguucuccagguaccucgggggcuguugggggucguuucggcugguuggaggcaggcgucugugaagccggcaguggcugcgauuccggcggcugagcgguugaggcaucggaacugggagagcaggauggaaaggucgugcagagugagaugccacuuccuuaguucucuaagugguacaaagcuggggcugacccaagccuagcuacuaucuacaaacacuaggacaaagcaacugguacacaggccucgccuguuucuuccuguuuucucuccaucaaaguuuaagguuucaauucuuagucaucuaacaaacuaggugcagaaggugcuucucucagucucaugccuuaacacacuccccagcucaaagcuacgagccucaggaagucccacagcuaucuaccucuuggggucggacugcuccuguuugcuugcccauccuguuccgucuuucggcacuagugagacauuggggucauugccuuuguucucggcuuucaggcuuggaagguuggcuggggguggcaugcgccgggcaauggcaacuuuuccgagacucugcaggccaugucgaggggcaacugaagaaacgguggagagaaaaaggaucaaaaagaccucacacgggagaccuaacagcgucccgucaacaaaucccguuuagacaacccuaccaucuuuucacuauaggcuucucucagaaaccauuccauuacucaauaaucucuuaagcucuccugggaaaggugagauacagcauaaucaucugugggaugguugauccugagccugcggggggcaagcugguccaagaccuuuucaaauccaccacauuacuuugccuccgauucuuacguguccaaggacagggaaccaaaaacacgccuuuguaggaggauaagcuguguuucacccaaagcccagcacccccuucagcacugaagaugaaacugagaggucuccaguauucaucuggucuguuaguugccuuuguuggagagcucuaaagccuauaucccacacaugcucagccugcaaauaucaggaacgucuuuacaggacaggacccucaccagcggguuucuggaucucuaaggacuugcccuuauacguaucaaacagguugagcgaggaauacuucuuuccauccuuccccuuggcagucggccccgagcgaucggacauugcgcuggaagcucauugaguacguuggguccugcaggcaccucccccaaaacgagccggugccugugggccagacaguaggcaguucagguucugccccuuucagacaaaagcuuagaagcucucugcauucucuuuagggcccaaauacuugguucucuggcuuguguaaaacacuacagucucuuaagcaaccaccauccacuuggcuuccacagcccccuucccccugacauaucccaacaaagaaaaccaaguagcaaccuaguaucuuacccaucuauccuuugugccauuuagaaauggcaacuaaucuuacacuccuccaaaauaauuucagagacauacgauuaaauugaacaaccaagucaaagccccagagaaaaccagaaugagguacacaacucuaucgagcaaguacaagaacuucagauugucaaccuauuagacaccagcucccuaaucacgccccagggcccugugucccagguuucauucccagcagccuuaagucccaucugggagguuugaaggaagguaugcugggagcuuaaggauuuuuaugagcuugcucucagaccaggagcuggugccagacuaagccuuacuaaacaacaggggcuccacagaaccccuggaugcaaaauauuccaucuauuccuuacauagcccccacacaggcucuuggaaacaauucugcuggcagaaaaaaacaaaaaaacaaaaaacuaguggaccccauguaaaacugaggaaaaccacagcaugacggagcuaccucgacaacacccuguaaccaugggccaggcagcagaggccaaacccagaaccaacuaccauuuuuauccucauccagucucuucauaagcagucauuuguuccccuaacagcccuuacuccucaggcaggaaaaacucuacaucugaauccauccucgagugaccgggcauucauuugugggugggaacagugugaaaaagagauggaagauagcaagaaagcaugcaggccuaggaugaaagccaaaaucggggagagaacuaacuuuaccacaagccagagaaaagaagacagggguugcucucuaggcacuuaaggaaggcaaucugaaaucuaccaugaaagggggagaaagcagaaaaaccguagagcagacagauuucaacugcuaaagagagaaucaagcagaaagcagggagggaagcaggaacggcugaggaaggcugacaaggggcagugucaggggagcucagaagaaaagagggaagaggaggagauagggccauggggggaaaagggaacgcagaggcuugggggacgcagaaaggcgaagaugcuggccgaaagcggggcuccagaaccagagugacucgacgcaaagaccaagaaagaccgggagccauagcgccggguggcagcaagggcuccagaaacaccaagagccccucaaaggguaggucuacaggcggcggaggggccccgggccggccgaggggccgagggcgcgacgcgagcaggaaccgcggccuggagcgcggucgugcccugaggagcaggcugcugggccgcggccgcccccagcccuccacagcggccugggagcggccggcgcaggccgagggggaggggcaggccggcggcaggaggacaagauggcggcggcugauggcagcuucucccccggcccgccgccgccgcugccgccgccccgcgccggaaagggcgucagcgcccagcucgcccagacucaccuagccgggugcguggggguccgggacccgggcucaaaggcuucccggggcggauggcggcggggcgggggcggauggcggcggauggcgccgcgcucggcuccucccgucucccucgcucacuccgcggcugggcuccgacuaacggcccauccgggcaaccg

SEQ ID NO: 8558 - RNA, 3374 nt, Mus musculus
agcuauuaagcccagcagaagagggauuaguuuagucuugaccuucaggccuguucucagucccuggacuaugucugaugacaaugggaucugguaacaauugcacaaccaguaaguagggaccccuccguucggaaaggggagggaugugagggcuggagagugagggaagaaaagcaggguucaggauuaggagaaguggucagaaugaggcaguacagguggaagaggggccuccugagacccggaaacaguagggagugagcauagucaggagagguaacccgguaggugaaucucuagaggaagugagaaguugaagucuggguaacaaauaugucuggguaaugaauguguaggcacgaagcccuggguuauagugucuccuguaaucccagcaccagagagguggggugguccgaaggacuagaaaucaaggacaugacuugucucugcaugaggcuucaggaaauuuggaagcagccuaaacuauagaagauacugcagaaagaaagaaaaaaaaaaaaagccaggcagugguggugcacaccuuuaaucccagaguggggggaggugggagugagggggcaagagggccggagggguugggauggcggacagaggcaggaggaucucugugugugagaucaagaccagccuggucuagaguuccaggacagccagagcuccacagagaaacccugucuuuaaaaacaaaacaaaacaagcaaacaaaaacuaauacaaaaauacaacaccgccccccccucaaaaucuccuagaguauauuuuccuguauuuuaaacugugagaggauagcaggguccuggcuuugaccccagagccacauaaaacagccaugguaguacacucuugccaagcuagcacuuaagacacgacacaggggugugaggaucagaaagucaagcauacucggcuacuaggagaaucuaaggccucccaggauacaugagacucucaacauaaagugacagaaaggugggagagacauggguugggaggggggagagggagaaagggcuuuggaaaugaccaagagacuuuuuuuuuguuguuuuguuuuguuuuguuuuucgagacaggguuucucuguauagcccuggcuguccuggaacucacuuuguagaccaggcuggccucgaacucagaaauccgccugccucugccucccaagugcugggauuaaaggugugcgccaccacgcccggcugagacuuuuuauauauguaugaaauugucaaaaaauagaaaacaggauugaucggggagaggaagauaggauaaaauaaaaaauuggggaagggggacccaggaaaaauauaggaagcuaggaaacuuacauuuaaccaggagguugggaaauugguggggaaaaaaaaaacccucucagagauacuccuuccagaugauuuccugcuaaaugggagccugggacugggagggcuccuccuccugcuugucaucauccuguucaucugcuugugccgguucagucagagagguaagcccuagagcaucucggucacccacagcuugcccuccacacccuuccuacugcuagaaaaggccagaguuguccaaaagacccagguuuuggcugugguuccuauggcaaccagcgagguuggagggguggggcuccaguagguguguuguggaaggcaguucugggguggagaccugcugcucuggcguugggggccugggguggggugcuauucugagguagcagauucaaugagaggugcuguccuaggauggaugagccaauguggggugccauucuggcgggggggggggucagggaaggggucuuacugaaccauuuuuuuuuucuucuagugaagagacuggaaaggaaugugagucuggggggacgaggagacaagggggaagggugagggguggagcagaugaaggggcggggaaggaaguggcggcugggggcaagggggcgagggaggggggcuggaggugggagggugugcgggcagggggugaggggacgagggaaacccacguagggaguggggcugggaugaagggguggagccgagagaaaagggaagaggaaguagcaggaacgagaaaaugaaagaggcagaaaaagaggcaaccagaagagagggagggaauuguguguuuauaagaauauaaaacacuccagaaggacguagagaggaggaagugagugagagaggaaauuaaaaaacaaacaaacaaacaaaacgagagagaagaguuccaucaggacuacaggagccgcccugucucaaaagaacaacaaaagcaaaguggguggggcgugggcguggcuagcagugugguuuaguuaacaguccuuauccagcggguguagaacuguguuugauucccagcgcagcauaaaaccagagcgcuggcaugugacugaaaucccacauagaggcagggagucuguccuucacuacauauuaaguugaaggucagccugagcuacaugagacccugucucaauagaagaggaaguuuggagcuuggagagauggcucagcaguuaagagcacuggcugugcuugcagaggcccugaguucaauucccaguaaccacaugguggcucacagccaucuguaacggaaucugauacccucuucuggugugucugaccacaacuacaguguacucauauaaauaaaguaaguaaaggaggugggggagagaggagguucugagaaaguauuugcuguagucaggcaugguagcuugugccuggaaccccaguacugugggguacagacaggcaagcccuaggggcucccuggccaaccagccuaguggaaauggcaaacuccaguuuuagugagagaccuugucucaaaauagauagauggauagauagaaauaauguguagaaacaguuggaaaguugauguccaaacauccacuuaagggccuauacaacacaggcagacacacuuauauagaaacaaagaaagagggaaaguaagcgaaaacagguucaagagauauaaagaggagagacugagaaaaaaaagaguggagacacagggagaaagacaggugggagcugcggccaggcuggggaaggaugugugacaguaccccugguccucacaucauccucugcacugccaggcccaggucucagggcaggagccccacuaugcaucucuccagcagcugccaguguccaguagugauaucacagacaugaaagaagaccucagcacugacuaugccugcaucgccaggagcacacccacuugagugcccccaaaagcucuccucgcccugggugcgugcucagucacacuauggucaucuaguaaagucugguuccccacuucugcau

SEQ ID NO: 8559 - RNA, 4747 nt, Mus musculus
cagcuaucuacugugugucccagucuuuauuuaagaacaaaaugaugagugacagacaggccaggcuccugaucaacagcaucacugagcuucuuuccccaucccaccccccaccccuguugugcuuuuaaucccuccucaguaaaagaauuuaaccccaaagcuccagguucucuugucuaccucccuugccuuggcucacagcauccccagggagggcuggugccucaguuugaaugcaugggagagcccagagcagugacgggaacagagggaaaggccucgcccucaggaaaagggacugaguagaguguggugaagugggggcuuccauagccuggggugccaaaguggggaccugggggcagaggaaaggauacagcccccccugggaaaggugucccuguagccucauacucuucucguugggaauacucaauacuugaucuuuugcccuucuggcgccgguuacagaaccauacucgaaccaccuaggaugggcacagagauggacaucagaucauaagcucugggaugcugcagucagcgguggcggcggugggggugggggggugggggggguggggaaugggaacagggaaacauccagguaccacagggcaggaucuuggcacucacauccuucucuagcccaagcugauuggcgaugugagugaucugcuguagggagggcuucgggcacuucagaaacauggucuccagacuccaccucacacgguucucaaugcuaguucgcuuucucuuccgggccugcaccagggucuccgauuugcauaucugggcaggggaagaugggggcgacaagagcaacuuuaguauuugacuuggcaacagccccaccuugagaugggacugaagaacaaaccgcuaagggauugugcuaagggagcauugacuggauguggccccagagccagggguuacugaaaggggcucuggaaggggcugguagaccuaggucugagccuucaccagcacuagacgggguucuggggagggaccauugucaggcuggugggggcagagggugacucagaaggagagagccugauugauuagcaaauguuaaggcucuggauuccaauucauagcagcagaauaaggacacagaacuucuccugcgagcuccgguuggagagggaggaguuucaagccaggaauggaagcagcagaagggacugugccuggcagacauugcacacauccugccacuccucaccuccugaagguucucauuguugucggcuuccuccacccacuucuccagcaggggccgcagcuuacacauguucuuaaggcugagcugcaaggccucgaagcgacagaugguggucuggcugaacaccuuuccugaaaggccgaucaaacagagugagugaggcagcaagaagggagcccaagcccccaccucugacaguucaagcuacaagcgucuaauccucccuuaccuguggagaagcagcuccuaagaugccccacccccuugcgccuacauuaagagccgugagaucagaacaugcugggggagacccaccaaagagaacgcccagggugagccccacgucggccuggguguaccccaaggugauccucuucugcuucagcagcuuggcaaacuguucuagcuccuucugcagggcuuucauguccugggacuguagugagaaaggcagacuugucagagucacaccagcugggacugugacccuagggugccccaugaaaagaucucagccuccucaagggcuggucugauuauauaaauguuauucacucuauuccuaggugacauagauggcucuuuccccccccagaaccuagccaucuacaguaccacacuacccagaguucugugcaguaccccagcaaguuccuaucugcucacagauuacucaaaaccgccccacugaggacaaaaugucacccuauucugaagaaguuuuaaggcugcagaauugaccagacgaacgagcauguaaucccuuuacucaagaaacacauggcucagcaguuaagcucuagcucuugcuccuucgccugcuugcugcgugagacuaaguaacugcuagauccuuggacuuccauucacagcugcgacugaaccauuguugggaauugggcugccgacuguaagucaucaauaaauuccuuuacuaucuagagacuguccauaaguucugugacucuagagaacccugacuaauacagaaguugguauacggacuucucuuccggagauccggaguucaauucccagcaaccacaagguggcucacaaccuucuguaguaggaucugaugcccucuucuggugugugucugaagacagguacacuguacucauauaaaaaaaaaaaaaaucaaaagaaagaaaggaagaaagaaagucccaaaguaugacacaguauuagugaagauauugaaacagggacucacuaggaagcucuccugccucagugucucaagggcugggguaauaagauccaucccucuguucagcucuaaaugaaaaccuacacagcacacucuaaguagccaaauguccaugccccaggagcugacaacacuccggagugcgaagaaaacuccugcuguacuagagugcgacagagaaagcaaggcagcaggcuagaagccucuggaggugagaagccuugaggcccaaaccacaggaaaucaucugacucacccuggaugcgguacuggccggagggugcagaggaccaccucugacgcccacagguguacaguagcaggcaugcacacaccacaaaaaaaaaaaaauuuuuuuuuuucaaaguugaaacagggauaucaaucgauguaugagcaauagaacggcaggggcacucgaggguguggcuaaggcugccuucuucucaguaguacacagugaugguugggaccagguggggaggguauaacagauggccaguugagugugcuuucuaaguugcagcgugugaaccggaccccccccccccaaaauggcugucgguuucucaggcuuuucugucucuaacagaagacagaaauggaggcagucaucuggggagaugcaagucagccuugagggcggaagaggagcagguuguuggagcaaagguccaggauggagggcugaggugcuccacaaaggcuggccaacccagggcacagacagaagcagcagccagugaggcacaccucaaugccauuucaauggaaaaggauucucucggcuucagacagacuuucaucuccaacugcuccucaaaagaccaaaacuuguaaucgcccucagcagugucuuuggcuuuucuaaauccuauuuugaggauuugggauuagcuuaacuaagguucaaaucucuugcuucauuaagggccauuuaagaugugagauaaacuauuaaugccuuccuaggggacucccggcggcauacaggaccugagauaacacagaaacuggcacuuagggaggggacuccugcuacaacaaucgcuaagcugucggaacucccggcgggcaucgguauccacucgcaccuuguucuuaaggcuaauugcuuacacuugcuccagagugcuggcuguaggccaucagacacuaagcaaggcccgugcacucacagaaugaucuuaagauggccuggagauaaaacuccccuacccaagggugucccuuucuuguuuacaaggaaagguagaaaggcugaaaucgaucagaucugcaccucaggcacuacaagggucugcucguguaaaggugacucauggagucugaggcuaaaguagacaggccguaaacuugacugaaggugagcccuacuccacacauggcccaaacaagagcuccuaucagcagccagucacacccaaccucuucaguaacaauaacuccaggauaagcaccauuuuuuacccccccagccaugccuaaccuuaaggccaaguuccuggguccgacugugauccaaguccccagaggggcugauauguuuuuuuuuuugggggggggcugauuuucacgcaucacugguguacagacagugauggcaugaagcaagugucgggacacaggccaggccuaggugaccuacaugacaagggccaggccgaaacaauccaggccgguuucugauucuugcaauucuggguucuaguccacacugcgucgugcuucucaggaggcccggcagccaucaccaccuuuggcaggcaggguggcuacccuacauguucccaauucccuucacugcugccucugccagcccagccaagucccuucacuuaccuccucgggaguugguuccaccuucuccaacuucacggcauuggggcggucggcacagggcucagaggagguucccucugaguugcuuuccacucgugcuccugccuggcccucaggcugcaaagucuccacgccaacuugggggacuaggcccaguccaaccugagguccacaguaugccaucccuccgcagaacucguaugcgggcggacauggggagauccccaauaccucugagccugguccgauuccaggcccaccuggaggcccuuggaagcuuagccagguucgaggauccacccagcccggcuccagcccugcugacccaucacccccaccuggugggggugagaaggcgaagucugaagccagguguccagccauggggaaggugggcaccccgagccgggggccugguggaaagacggcucaccuagggacgguuucaccuc

SEQ ID NO: 8560 - RNA, 13918 nt, Mus musculus
cuuccuauuuccgguagggagaaauggagcuguagagcagcccgccgccccgcgcaugcgugaucuggguguggcgucuagacugggugcuagguguaaggggcguggcaagagggcggaucucgcgcuggguaaggggcguucggggagagucaguugggggcgggaagagucugagagggggcgcaaggggggcggaggggauccacagggcaagaggggugcaggagcugggucaaaggauagaugaggaggucaagacagccucagaguucaggguccugacggggauuagcccggggugugugcgggagagaagugggggagacaggacagggagcgaccaagauaauuccaucgaaaaagacucauacuaggucuaggaagagaaacggguaggaaucgcggggguugagugaaaaaaaaaaaaacccaaaaacuugaauucugauggaagugggggaaagaagaugcuguaggacuccgaagagagaugcaucgggaauggaagccgaggggauagagagcaacugaggcccguuacagagaggcccagaugaguugccaggaagcuggcuucccagcaacgggcucccggcugcuccgauuccucagggauccuagggaagacgcuuaaccccacauguggccucauucuucccggaccaggccuugggcuaacucuuuaauaggaaaugacucagaaauccuggcucgauggugccuagaugggcuucccaacggcccuaccauuccauggcaaggacuguggagagugggcuccuuauacuguguccagagaguccugagcugcagggaccguagacacuuaaggaggaagguaaaggcacaccacccacauuccuguaaguagaaggaagccucgucucaguaaauuuaccuuaggguuguugccugguucauucuaucaggagcguaguugggacaagcaagugguuugguuaccgugugccuuagggaaguaggaaaagagaagcguacagcccgauagaccugucaguaacuuaaggauuaugacuuuguuuuuauagggcuuuuucuuuggaagguggccugaaaaauugaauugaaguauccuuguuucuccuauuguccaggggaacauaggugacuggagacaagagcuacaggauucauauaacaggaagauguugccaccgucaggucagugaggcuagucaaggagaccaggaucaucucccucuucccucucccccucucucagaaucugacagucuuuauucuugugacccccucagguuuugcugggcugguuccucccucccacuuccaagcucggccccuuccaacucugccaagaauggccccgaccugggcuucagacguucccuugguccaaucuccggccagccaagaugucuuagagagacggcuagaugcucagaggucgacagugaccacguggggacaggauuucuguggagaugggcaggggcuagggcggagaggcagguagggaucugccaaucaccucuuccucagacugacacaugguccuucauacacgcaugccuucauuucagccccugguucuauaacuugugugguuuuucuauaggccauuguuggccccuacgacgcauagaccacaugcguugggguuagugagaauagauguuuggacuuaaauucucauuacauaaggaauguaaaugucuuaagggaggggauaaguucugcaaaagcuguuuuaaagcaaaaugacgugcagcuuagacaugcugacccaguucuccagaggcauacuggcuccuuuuggaguaguuaagcaggccuuuacaggaaugugcaacuggagcuggcuaugcucugugaaugugguuuuauuuguuuuuuuuuuuuuguuuuuuguugguuuuuuguuuguuuguuuuuucaagacauggugucucuguauaacccuggcuguccuggaacucgcucuguagaccaggcuggucucgaacucagaaaucugccugccucugccucccgaguacugggauuaaaggugugcgccaccacgccuggugucaauguguguuuuaagacuauuaaaaaaaauuuuuuuuaagguuuauuuaguuuuauuuauaggaguacauuguacuccuauacacaccggaagaggguaucagauccuauuacagaugguugugagacaccgugugguugcuaggaauugaacucaggaccuuuggaagagcagucagagcucuuaccugcugagccaucucuccagccccuaaagaacucuuaaccucugcuccaacucuccagcccuaagaauuuuauuuuugagcuuaguauggucugccuuuaaucccagcacuagagagucaaagguaggcagaucccugaguucaaggccccaacccuggucuagagauugaguuucaggacaguuagggcugcauagagaaaaacuugucuggaaaaaacaacaacaaagacuuuauuuauguguguaugauugugugugagcauucauacuuggaggccaaaagagggugaaggauccucuguaguuggagugacaggcagcugucagccuuugaauguggggggcugggaacugaacucagguucuuugcaagaucagcaagcgcucuuagcaccccgagccggcucuccagccccuguggacauucggcucugugugaaugagcauucuuacuucuguuucgucugugucuuucccccaguguccuggggugucauucugucagaggggcauguuaggagacagauuguaaggaacuguggcaagucauugcuagccuccaguuaaaggaaauccugccauucucagggacagagaugccucuggagccuccacauaaccaauucagauaugcagacgccucagacucccugugcaauguaccaaacacucacggaaaaagcccgcaccaaaagagcaggguguaacagugagugccuguaaucccaguuacgccugggaaagagucuuagagaagacagaugccagccugcugacauagugcaagguagggaaguccccuggcaacugagaaaucaggaagggaaguggaagacaccaucgggaaacgugagugacuuugucaucauagucgucuuuuucuucuucuucuccuccuccuccuccuccucccuccuccuucuccuccuccuccucccuccuccuucuccuccuucuccuccuccuccuccuccucccuucuccccuuuccccucccccuccuccuuuuccuucuguugcauuuauauacuuacucauguggauaugcgugcgcacacaugcaugccuuggugcacagggaggaucccaagucuggggcuagccucugcuauguacugggucagccugggcugcaugagacccugucucaaacaagaugaaacaacaaaaguguaaaaaaaaaaaaaaaaucacuuggcuuugccaccaucuugguagcagaagcucuuugcccucaccuagaauucagacauccuccaacucaaaacuugaagcccuccgaugugcuuguuugacguuuaacccaucugccugcuuauguguggaucucuggagagaugguguucuucuucgccugaucucacuagcccuuaggucgacugagcccagaaaguggaugaccacgugugcuuaguagggacuuggugguugauugacaguggugugguagaugaauauauccuccugccucagcucagccccuugcuuccacccucccagcagcucaccuuuuccccuccugucuuugaaggucucuggagcugggguucuccagugcccugagccagcaggccgagcugaucucacggcagcuccaagaguugcggcggcuggaggaggaaguccggucccuacgggagaccucgcugcagcagaagaugagguuggagacucaggccguggagcuggaugcucuggcaguggcagagaaggccggccaagcugaggccgagggccugcgcaccgccuuggccggagcugaaaugguucggaagaaccuggaagaggcgaagcacaaggagcuggaggagauucagagccugcaccaagagcaggugaacacgggggugggaggggcuuagaagcauaucagggcacgccguccaguaaauugcaaggagccucgggagcagcagacccguggaggugggggaagccccccaaaauacuuggguauuuugguuucccucaggcugcaccuguuacuugggagucagugagcucguaaccuucaauacccucagaaguaguauuucuccauauucugugccagguacccuucugggaacgugguggagggaaggauuggggucgggguaggauggggcagugguaugggucccagggaacacugggaaagguagauuuuuuucagucaggcuacccagugcuucucuuugccgucuuugagguaggaucuggcuagggauucaaguugucugagucugcucucaugaauggcgcccauagccugccugcaugggacacacuuaaugcagcuauagccaguugcaacugggaaagugcugaagcauagucuagggacagagagggccaccccaggcugguggagcgcucaggaagagaggcuuuaaagaugagaguaucuucuucguaauauuggagcagggacagccuugcugccugugaguuacccguaggaaggcucucugaaucugucgcuugacuaagcaagcgcccuacucugauguucgauaaccucuauuagugguaccauauucagaagucgacucuagacagacauugugagugagauagacugcuggaaugucaaaagaugcuggagagauggcucagugguuaagagcacuggcugcucuuccagagguccugaaccacaugguggcucacaaccaucuguaaugggauccgaugcccuuuucugguauuucuaaagacagcuacaguguauucauauauauaaaauaaauaauucuuuuuuuguuuuuugguuuuucgagacaggguuucuuuguguagcccuggcuguccuggaacucacucuguagaccaggcuggccucgaacucagaaauccgccugucucugccucccaagugcugggauuaaaggugugcgccaccacacccggcaaaauaaauaauucuuaaaaaaaaaaaaaaaagucagauagccauuggcagguucuaaguaacugaggcuguagcucagcggcagagugccugccugcucucugcgcaaggcuacagguacagcccccccccccccguguccccagaaaaggaaagguuuuuguugucuggcuggcccuggcucuugcuucugccucccacguguugggaucaaaggugugcgacaccacaccaagcuucagaaaaaacaaaacaaaaacagggcaauaacagagucagguuuguacgucuaaaaacaccugugcucgacuuugcaaacuugauacugguaauggagacagggcuggcagggcugaccuacccuguaggaggaagcagggcaugccccuuaccauuggcuccacagcuccaucugcucugcugccccuggcgcuguuuggggucuagugagaaagacccucccuccccagagcauccucaugaucacacagaaguaggguccgaccugcugcuagagcucagaaagcugccagcagggaaagggcagaugaggggucucccugaggguugaacagcgccugagcagggagagccacaggagagagcucggcaagugugcuguuccugcaguaggcuuuguggguguagcaaaucuguuuucuguggguagagggcuauuaagguagggucuugaucuguagcccuggcuggccuugagcuugaggaaguucucccaacucagccucccaaguacuagaauucuauugcucugauaaagcacugacagaaagcaacuuugggaaggaagggaagggcuucuggcuuaucucacccugcuccuaguccauugagggaagcugaggccauggaggggcccugcucacuggcuugcuccucauggcuuggucagccugcuuuccuauguaacucaggaccaccuaucuaggggugguaccauccuacugugggccgggguccuugcaaaucaaucacgcaucagagagaauaucucauaggcuugccuacaggaugaucuaauggaugcaugaucuaauggaugcauuuucucaacugaguuacccuucucaaauaacuccagcucaugucagauugaccaaagaggagccagcacgugggguugaagacauuuguucccaccaugcacugaggaguguguguacauucaggcgugggucugugggugagggugugagggugccuggcacaugugugggggucagaggacaaacucgggugugggucucaagcuccuuucacucaagacaaggucuuuuuuuaaauuaauuaauuaauuaauuaauuuauuuauuuauuuuugguuuuucgagacaggguuuuucuguguagcccuggcuguccugggacucacucuguagaccaggcuggccucgaacucagaaauuugccugccucugucucccaaugguggcacauaacuuuaaucccagcacucgggaggcaaaggcagauggauuucugaguuccaggccagccugaucuacaaagugaguuccaggacagccagggcuacacagagaaacccugucucaaaacaacaacaacaacaacaaaaaagugcugggauuaaaggugugcgccaccaugccagacugacagggucuuuuauugacccgcaacuuuaucauguaggccagaccaggagcuucagggaucugcccgugucuccuuccaucccacagagcaggggugauuacagguguaugcuggccugucuagguuuuucacaaagguuuuggggcuccuaacucaagucucuacagccugaaagacucaggcaugaggugggguccuuuacucucgcuguuagcaugaacacggagagaccgggaagugaacuggcaggagcugauguuuaaaacuaacuguggagaaccagaggccaagauuuccuccauugcuuacagcagcaugaucaguuagauggcucucugagagacaaggccccaagguggggugagccgcccugcccccugaagauuuauuuaugcuugugaguguguguugugucagugaguguauaccacaugugugagggccucagaggccagaagaggacauuggauccucugaacugcgcguugggugcugggaacugagcuugggucugcccugcugagcucuccagccccucaggcuggcccucucugagcaugcuccuccuccacagcuguccucccugacacaggcucaccagaaggcucucgacagucuggccagcaaggccgagggcuuggagaagucucugaauagccuggaaacgaaacgggcaggggaagccaagcagcuggcuauggcccagaaggaggcggacaugcucaggaaccagcugaggucagugggcugcgcagggcuguuagugaggggugcggcauugccaggcuguucuaccgaggacugguccauuucuguuucaaucuuagcaagacccaagaagagcuggaagcucaggugaccuugguggagagucugaggaaguaugugggggaacaaguucuuccugaguuuccuagccaggaaugggagcuggaacgaaaggagcuucuagacaccuugaaggugagagaaaagacuccagggaucagggcaugaccugggaggagagagcacagugcccuagaggggaagccaugcugcccuugagacggcucacagccugagguagcauggagauccugacugguggaguuccuucucccagcacuugaaggaggaucgggcugaccuucaggccaccguggaguuacugcagguacgaguacagagccucacacacaugcucgcccugcaggaagaggagcugaccaggaagguaggacccucccucaucuuccagacccugcccugcugcaggccuucccuuucuggggguagugggugguaugccaccaagaccccuaaacuccucacuguggacggcaggacaggcaggacaaagguccccacuuucuuagaacauccaucucccuucuucccccguacagauucagccuuuagaucccuuggaacccgaguuuccuaagaagugccgcucgcugcugcgcaacuggcgggagaagguauuugcccucauggugcagcucaaagcccaggaccugcagcacagggacuccacgucgcagcugaggauccaggucaggggcugcgucucugucacugucaucccgcaccccgugucucucacagugaugacaguuagucucggggugacugccacgugcagggcacagagccccgagccgaggaguccccguucucacggagcuugaguucuagaaggauacguaaaaagauggguaggcgucacauugucauaagugcugcggaaaagcaguggugacagacugagguggauggauaggauggucagggacggccucugaggccacaacguccaccagggcauggccacgggcacggucaggggaaggcuugggucaggaggguuucccaaagugugggcuugugcauccugagucggagagaagguucaagacagaguuucuauguucuguggcugcccuggaacucacucuguagacuguucugaccuauaagugauugccugucucucccucaugcuggaauuaaagacacgccccaccacaccggguuuuuuauuuucuuuuuguuuuuuuaguacuuauuaauuuaguuggguguggugauacacuucaauuccagcacuuaggaggcagaggccgaggcaggaggaucucugaaucuguggccagccuggucuacauagucaguuccaggacagccagggcuacauagugaaacccugucuuagaaagaaauaaaaggugugcuuauuuuguuuuguguguauaaauguuuugccugcguguauguauguguaccaugugcccacggaagucagaagguguuugcucuccgagaacuggaguuacagaugguuaugagcuaucaugugggaaaggggaauggaacucugcaggaacaaccagcguucuuagccacugggccgucucugcagcccgacuccggagacucccgcccugucuccuucauuccccucccacccguguucccauagcuuuggcucuccauuuccuugcuuagcuccuucugcuuccguagguagcagagcuccaggagcaagugaccucccaaagccaggagcaggccaucuugcagcgugcccugcaagacaaaacugcacagguggagguggagcggaugagcaccaaggucugagggugcucccuaagggaggagggugaagaagacccuagcccgggugugugggccacgugccagggagggaggucuacaagaaaaaguacacacaaagcugcauccuucccagagccugcagauggagcuggaucaggcucaggaggccaggcggaggcaggaacagcagauagccucugcugaagagcaguugaaguucguggucggugcuaugaacagguaucuguugccuggaagagccucggggaagaggggcaggagggugcaggguggaggggugucaccucuguaucacaccagcaucacccgcagugaacugagcugugguugggccacagcagaggauccugcuuccugcacuucagucuagugcgcucugaagcuaaguaggacagcuaggcggggcuguggcuucagagcucagggaugggaacuggagccaugugcaguccuuccucccucucuuccuccuuccuuccuuugcacacucgccuggucuggcugggggaggcacccuaauuguacagcuggucuggucuguagcucaguaguagagcgcuugccuagcauucagguaucucugcuuucaaucccuggcaccagaauaaaaagaugaaacuuuuuaacuugcacagagucagacuaguuuggaagaaccaacuaguuuggaagauucaaagcacugcaugugccugccuccaggaggguguugggguguugcuuaugggguaccugccuccagcaggauguugggguaugguguauggggugccugccuccaggaggguguuggaguguuguauauggggugccugccuccaggagggcguugggguguggugcauggguuuuaccuucugccaggucacagacaugguuuuuaauaaaagucaccagaaagcccuucuaggcucugaacaccguaugccccaggugaggcagauagugucaggucccaagugcccggagccugagugguagccuacagguacaggucucagaguuuagucagccucugguacccgcuguuguagaauuguugcugagcccuuuccugggcuacagaauguagauccagguaggaguugagcccauggacuuuaaugguuccucacugcagguuauuauauacauugcaggccaagcaugauggugaaguucuagccacccugucuuaacccuaaucgucucccauccucuuccacccauacaaaaagacuguaagggaccaaauuagacacuguagguuuuguggcaggaguucauuuucagcuggauguuuuuaaccugacaguuaccaagcuuaagcacuuagauucucuuuagguuugcuaaggagcuugacuaaccugcagggucugccaaggcacugccucuccuggugacuuccguuucuccuuugcuugcuacuuaacaacccaccuccccgcucauguaacaggacaggacagauguguccucugcaccagacccugcagggccuucaggacagauguguccucugcaucagacccugcaggucuugaagggaugaggggagggaggacagugagcagccuacaucuucuucagcacucaggccaaacuccaaagcaccaugaccaggauggaucaggcuguagcccggauucccagccucagcaaccgacucagcuaugcuguccggaagguccacaccauuaaggguacguagagcaacugugggguuuccggccuggcccucuugcucuuagcccuggaucuaaccucacauuuauccucuguugccuugguaacugccacucaguccugugcucccaccacccucuguccauguauacucaucucccuguccucucuucucagguuugauggcucgaaagguggcucuugcucaguugcgcguggagagguaaaguccagacuaguugagguaaaggggggguauggauguugggggcaaucuauuggcugcuaggacccagagggaccaaggagggguggaggcaccaagcagguagcugcugggggaauuuucucugacucuugucauugcuaucccagcucucccccaucggaagccgcacccccacuggacacagaccugagcguugagcuggaacagcuacgggaagaacggaaccgccuggaugcagagcugcagcugagugcccaccugauccagcaggaggugggccgggcacgggagcaagguaugccugcguggggcuggaggagacucucuaccaucugaggcucaggugccagcaagaggucuugugugaccacgguuuccuuuuaggggaggucgagcgccgacgguugauagagguggcccagcagcuggagcaggagcugcagcgugcccaggaaucccuggccagcguugggcagcaguuggaggcagcacgucggggccagcaggagagcacggaggaagcugccagccuccgucaggagcugacacagcagcaggaaaucuacgggcaaggugugggggcguggcggugugugcgacccugugggaugggcagcucucccugacacugucucguacccucaccugcagcccugcaagagaagguggccgagguggaaacucggcuucgggaacagcucucagacacaaagaggaggcugaacgaggcccgaagggagcaggccaaggcuggugagaugugccaggaagaaggcagcacugagacacagggcugguaaccccuccccagcccacuuaccuuuuuugguuuuuuuguuuuuguuuuuuuguuuguuuguuuguuuguuuucgagacaggguuucucuguuucuccugguuguccuggaacucacucuguagaccaggcuggccucgaacucagaaauccuccugccucugccucccgagugcugggauuaaaggcgugcgccaccacacccggcacaccuaccuuuuuugaagcuuuuuguugacaaguguauguagcgaaguaacguaggacugacaugaaugaguucuuaugcagugaacacacagcagccagcaccggaucaggaacaacucuggcuccaggccugcaucacugccccucaacggacgccacugcuguguccccacuucuggcgacugcccuccccagaaacuuaacacuuggaugaguuagaggagcaggaugaauguccaugucuucccugaguagaacacagucaacaccccugcuggcucgccugugcucccaugguuacacgaguaggcauucgaguuguguaaguugcagcagacaugaugguuuagcugcacaccccacagccagaaaauuaucuaaucgugauaccuagcgucguaagaacaugagcccuagccacacaugguggcacuugccugucacuccagcacuugaaaauaagaggcaggauagauuagggcuagccuggacaacauagggaaaccugucucaaaacaacaucaacaggucacaugagcacuaacuauaggagaugugacuccggcgccccuguccacaucuugccuaaggagcuugcaucagggauggagauaguacuuagggcucagagagcucaggaucccaugacaucagcccacccgugguguggaagagucccugagagacagaguugagagcucaagucucauuuuggggcucugggcuaacccccucccaucuccuuagugguuuccuugcgccagauccagcacaaagccacucaggaaaaggagcgcaaccaggagcucaggcgccugcaggaugaagcccggaaggaagagggucagcggcugacgaggcgugugcaggagcuggagagggacaagaaccugaugcugguaggggacagcagggagcuagucacgguagcuggugggugaguaaggugugcaggggcggguggcuggccugggccggccggcucacccucuccuccccaggccaccuugaagcaggagggucuccucuucuguuacaagcagcagcgccuguuagcagugcuucccucgggagugaauaagaagugcagcccccggucuguggaguccucauccucugagucuccggcagcugcuucgugcaaggaaucugugaaagguagaauacacuggccuuuaaucugugcugccagugcccaggaaucucccucagggccuccuagccagugcagccccgugcccugggcaacaugcagccugcucucaccccggugugcaccccaugaugucucuucuaucaggcucccugaccguccugcuugauaaccugcaaggccugagcgaggccauuuccagagaugaagauauuuguguggaagauaaccagaacaccaagaaaaccaagaacccuccuucagauccacugcugagcuagagcugccagggggaagaaugaagccagccugaagcuggacccccaggaggguugggucggaggaaauggggugggggccagccuagcccugccccccagcaagccuuggaaccccagcuucuaccaaauucaaacucugcaaugaauaaagauggcaauaguguugccuggagauguuugag

SEQ ID NO: 8561 - RNA, 1449 nt, Mus musculus
uagacucggagcaccccgccuugggggccaguagacagccaugaugcucaccuggaagcugcuaggccugcugguccuuugccugugugcaggaggugagucgucagaauaggccaggagcacagcuggggugauggagauggucgaaaugacccacccuuagggaggggacgcccccaggaggaaaggaguaagaggaacgcagagcagaagggauucuuggaguguccuuaguggggaagcucaggggauugcaggcaggggcaccuugauucugaauauguugcugggucagguggagggaugcgauagaguuguguggagucaccaggccuagggagucacugggacugagggcugguuauuacagagauggcgccugagugacagguggggccaagaccacuuccagugcagaccacccugggggagguuccaguggaguaucccaaccaagguugaacagagaaccauuuggaaguaugaucgugucagugguccggaugagccuagggcuuucacaccgugugaagauggccucaguguuugggaaauguauggagagcacuuugggggucacucugagaucuguuuuggggcucaggcugugcuagucuaagugaggcucaaccuuuggguaugaagcugggugggaaguguucugcgacuguaucucuuauucuccuuccuccucuacaggcauuucaggcaauggcgacccuucucccggaucuacagacacccacgaagaggaggacuccccaccauugccucugggacccccaaucccuggugaucccuggccuggggcgccuccuuuguuugaugaaccuccgccuccaggcuccaaccgucccuggagagaucuuccugacaguggugccuggcccccaaagcccccaagcacugaucccccuaaaccuccucugccugaugaccccuggccagcaggaacccagcccccagaaaaccccuggccuccugccccugagauggaccaugaaucucaggaggagccagaccuugacccaccccaggaagaguauagauaggggacccuagggaacgugagccuccacagagcacaccaaagcccaccuuuuucauuggcugcccgcuuagaaucucaauuuucccuaaucccuuaguucccuuccucagucucuguuugaauuguguucuauguuggaagugucuaugcucugcaacccccccucccuccacuuuguggucccuguucagucauuauguugucccuucgcuucucuugaucagcagaaagcacacuccuaccucacucagccuguucuugcuugucuagaccuggacuucuaggcagagccugagcucugugcucucugcugcccccugguuuucuuagcugggaacugacagucgaucaggauggugcuuccaauggaaaaauaaaagccacguuuucuucugaau

SEQ ID NO: 8562 - RNA, 5061 nt, Mus musculus
ucgguugucagcucaaucaauauuuauuguuuuccuucucugugggaggagggguaauauaggaaacacugagccaaguuaugaauggaaaugggagacgugagcccucuagaggcacgggagguguacuaccagacccucuagaggcacgggagguguacuaccaggcccucuagaggcacgggagguguacuaccaggcccucuagaagcacaggaggucuacuacccaggaacuaagaagagaccuuggaccccaagaaggcaaauagucugcacaaaguccacaaaguuuauugagcccugucuaggauccagagggaacugggagucugugccagauucuguggcugcccuggggcacacacacacacagaguaacaucugugcuguggaugaagcacaaccaggcagaaaccgacauggagagcuggggaaggagaggcacaggugugcuggaaaugggucugguaggguguggugaaacucaugaugaauggugggaacccaacaauuuagagggcugacugaacggauggugggggggggggggucgcugagacaugcaguuugguucucaggcgauggauuggacuuugccuuauuuggcaaacgggcagaagcaugcuugacuuauccaggcacccaagguugaggugugcguucgaggacuucccagucaaaaaaguguguuuuaaggcagguaaucggacagagagaacaccccagcagcauggugcagaagcaccaggaaaagacgaggaggauggaguccaccauuuggaguguugaauaaagucaagagcaucauccggcuaaccgcagcaugugaggcagcucucccggggggagggcaggaaacugggccccuggacgucuuccaguugggaggugacuggcaauuggaaaauagcuggcaugcgugacuuaagacuucucaaguggcucucccuguggcucucccuguggcagagaaacuuugggauccauuaacuggggucccaaaggcuucacuugggucagaauguugcggauggaacggcagggcacucuuccagggcuguugaggccacagagcuugacacccacggaggggacaggcugaggagagccauucagaccaccauucaacggggaggagggaacagaaaggcagggguaacccgaagagguagauuugcugccgcagggcugaaggacgauuuugccagaggagagggaggagcuucccccacugauggagccggugccuggugaggagcaaggacccugggaaggaccaccgcugcaggggugguaggagguacuggagcugcuggaggugaucugaauucucguacccgagcaagggcccuuagagcugacagagccagugccacagggcugaaccccgccagagcccacgggcuggaacgcaacgcccacuggguagccacuggaacuggaagagccacggcuggggaugaugggguugcuagagaaguacuugcccucagagacugggggcccagcugcaaaggagggggccccuggcgagccccugauaggguuguccuuggugaaguagcccacgggguagauuuuacccccacuguaggucaugccugggaccagauaacuguuggcagagccacccaccaccucauagccgccauaggguuucuggacagaggugaugggagggcagggcuuaccugcggggccuccauugcuacagggcaugccuugaaacccagggccaccagagccauguugcuccaccaccaccacuacaggucucuggccaccggauacagugugggugccagagauguagggccccgagugugugaugacaggccccccgcugcagggagagucgggcacguuggagcuacagggccgcagguuggagcugcugcucugggaaguggacgagccuccagacugagacaugccugaugucuugucaccgguugguagagcagagccacuuccgggucugucgcgacugcuuccugaacuuccggacugagaacugcugcuuacccauugagaacugcugcuuacccaucuuccugacugagagccgcugcuuccugacugggagccacugcuuccugacugagagccacugcuuccugacugggagccacugcuuccugacugggagccgcugcuuccugacugagagccgcugcuuccugacugagagccgcugcuuccugacugagagccgcugcuuccugacugagagccacugccuccuggccgggagccgccagagccauaagaguagcuacucugggaauacccuguuccugguuuauauaucaaggauccugaagaacuucccugggagcugcuggauccaccauggcugcugaaacugcuggauccaccuuggcugcugaagcugcuggauccaccuuggcugcugaugcuguuggagccagucuuuccaaugagacaagggucauucggggaggugauccucgugggguccuuacaggggucugagagggucccaaugcucuuagccaagauuccuggggaugagagcagugaucuguaaauaucucucaucagccaucagccccauccccgucaucugcccaauaucucccaagaggaacccaggcaaguuuggagggagagaaaggaaaaccuggcuauugucuuugaagguggaaggaucagggacguuucauuguccaagcaagugagggggugagcuuuucuaagagcucaaacuuuuccaagaaaaacagaugcugaaacucugagaagguaggcauugaaggaguacccuucauaguaggcaagggagcgaauaagucagaaacgagacagaguguggaggcugaagcuauggggcagggcagucugaggccaucgugggucagaccauagaaccaaacguaagaacagagagguugagcaggguuugggggcacuggcuuagcauaggcaagacccuagaugugauggggaagggugcugagccaggaaaagauaaugaugcuaaugcagaggugccagcucccagaggaggagcacacuuacuuagcugauacuccaccaccagcucccuagugagaguccagacugcaugagggguggcaucccugcuuccugucccaaguguggccauuccaguaaaucagggugggggccaggaugugggggcacucaccuguugcuucagaaccugccaguaccagugugacaggacacugcacccugagccacccauguucucacugucccaacccagggacagaagcaugaaaccuccuccaaaacacaugaccacuaucaaucuccccccccccccgcccccugccccccacccgguauucauacugcagugccugcugcccucauuucccuccacauugaagacucuugcuacuuuggaucaucuuuagggcuauccuccacuaacucucugcucccagccacauguuccucuucccucagucugucuacacagcucucaucucagugucuucugcccaccccaaccccuucagagcuacacauuagcaagugacuagccuuuucagguuuauauauucaguaaggcaaagucggccacaccuuccuacaggccacagugaagaccaugugacaucucucuggaccauauaugaaaacagcaaacuagacaucgcgcaguucauaaucaauacucaugcaagagcaguccaccagcagccagacggcuaccaccggccacuuccucaaccccaucucaaaaagaaaagcucugaaugcuggacagugguagcacaagccuuuaaucccagcacuugggacucagaggcagagucuuggaucucuggucucugaguucaaggccagccuggucuacagagaaaguuucagaauaaucagaacuacacacaagaggaggaggagaagagaagaaaagaaagaaaggaaagcaggcaggcccugguuuacccucacaacaaacccuucccuugccucugucccucuaaccuuaacacaggccacaagccacccaaccugggcucagauuccuggauacccugccucuacaugcaaucuaaagccaguuuccuuccagauccucagcugcagaguggaaacagccagggaucuaccaugcauaucucaaaaugcuaauguauuuagagugccagcuacagugucccauuuaaaaggcucugggcuaagggugcuacaugccugcaauccuagcucucaggaggcugaguuggaggcgaggcuggccuacaaagcaagaccuugugucaaaaaaagaagaaaaagaaagaaagaaaagaaaaaggaaaagaaagaaagaaagaaaacaaaaaggaccaaagauccuagaucacuuagcaagcaugaggccuggggcuucacuuccagaaccucaguaaaaaauaaacacagaagaaaauaaauaaauacaugcaaguugaucuaacuaaaaugcguguaaaggagagcucugaaaaugguagcaauuguuacuucuguaaaaugggcugacuguaucuucagguggucauauauagccaccuagaacuucuuuggcugugucacaugcaucauuugcgucagaaacugaagcuagaugauauuaacccccucucuagguuucagaaacaagcucagaauggcuuggaggauggccuggcugcagaacacccaccugcucagccacuguggagcaaagaacaaaagaauuugccugcagugaccauagagagggagccagcauagaugagggguagucccagauagaaaggucagagucuagaccccugccuaugcccuuguuagggccucuccuggacccugugcuccagacauuggaucccccuagcaucccugccccauggucuguaucccauacugucccccucccaaggccccagacuccuaccuggcagaauaagaccggccaucagcaaugccaucagcccgugcccucccacacuccccauccggggugcccgagaggaacccauugugcacagcguggccuccugacugacagaagcucaugggcaccgggaccuuuaugccgggcuggacauucucu

SEQ ID NO: 8563 - RNA, 8542 nt, Mus musculus
uggaaucggggugggaugggcagcagggccuggaggccucaggcacuagggcuccagccgcgcacuucccucuuuugucuccagacccugacguccuggacacuugguucucuucggcucuuuuccccuuuucugcccuggguuggccgcgagaggugacguggguuggaaggugggcaugacacaggugggcagcgacuggauguggcagaccugccccuuacugcuuaucucauccuagacgccagaccuugcucacuucuacccccucacccucuuggaaacggguagugaccugcugauguucugggugggccgcauggucaugcuggggacccagcucacugggcagcuccccuucagcaagguaauguacucagacgccugucccagagucacccuagcucacugagcgcagaagccgcaggccuaaguccuucccgcugacgccuccgugucugcaggugcuucuucacuccaugguucgggacaggcagggccggaagaugagcaagucccuggggaacgugcuagacccacgggacaucauuagcgggcaggagcugcagguaagaacagaggcuuuagcuggagaugacaaggucuguggagagcacagggagggagucugacccgucucuuguccaggugcugcaggccaagcugagagacgguaacuuggacccuggagagcucgccguugcagccgcagcacaggugagaccuguggccuuuguccuggccucuugacuugacugccagcuuccuccucagccuccauggcacuggccacaccucucuuccuuuggcugcagaaaaaggacuuuccuuacgggaucccugagugugggacggaugcccugagauuugcacugugcucccauggaauccuggguaagccucgguguguggcguggcagaggguaucuguggacagcuccacugacugaggauggacuccuuguucucuccccccaagggggcgaccugcaccugucugucucugagguccugaacuaccgccauuucugcaacaagcucuggaaugcccugcgcuuuguccuccgugcccugggggauaacuucgugccccaaccagcagaggaggugugaggacagcagcaagcccggagggguggcagggacaggggguccagcuauccagguccucaugcccuccugcuggcagguaacccccuccucucccauggaugccuggauucuaagccgccuggccuuugcagccagcgaaugugagagaggcuuccugagucgggagcuuucgcuugucacccacacccuguaucauuucuggcuccacaaucucugugaugucuaccuggugagugguggggcccagccgggugguguguccuggaacugaguggugguggugguccagagcucuguggguacacccagugcccccucaucagggaaagcauguuccucccucccugacuggggcucuguaguauauagcccagagcuguugccagccuguccuagugaggaagaaagcuggaagagucuagaaaccugucagggaaugagggcagugggguuuccucagccccaaucgcugcugcauuuaaaaugaguagcuauacacuggggguagggguggggggugggggaucaguguggugguuucaggcgagggucuuuaagcaguguccgugacagucacuaaccugacuuguccaccucaguuucccacucagggucauucaggauaggcaggggcagcuguggcgcugauaccccacgucucagcguuguuccagggcagcgagcauggcuccuugguggaccugucugggcagggugcucaaaggcucuggguucugucccuggcacugcagacaaaaacacugcccccuuccucucccacuguuuggggaucacugggccuguucacacgcggguccggggcuagcauggugucuagcacggugucaguaacuuagcauguaccccaacucaggauguaguguggcuguuguguuaucugccagcucucuccuuaggaagcagugaagccaguguugucgagcgugccccgucccccaggacccccucagguccuguuuuccugugcagacgugggucuacgccuccuugccccgcugaugcccuuccuggccgaggagcuguggcagaggcugccccccaggccaggcggcccccuugcccccagcaucuguguggcccccuaccccagcacccgcagccuggugagucaugggcagggguccgggaagcagggcggccuccugagggcugagguggugacuauguuagcuguggagcuuucacacgggaucccagcucagguggcccugcuugccaggugaguauccacccgcugagccgcuuccccauccccacuuugcuguguaacccuggcuguccuggacccaucccaccuacucugccucccaaguaagugcuaggauuaaggccugugucaccgugcccagcccuacuguuuuugaugcugugucacugaauugcuguuuucagccccaagaauuauugugaguuugaggucacccauaguccacauauuaaaguuccaggacagccaaggacugcauagagagaccggucucaaaaagagaaaagaagaaagucuagggcuggaaaaguggcucagcaguuaagaaaauuucuucuggguucgaguuccauacugguggcucauagcugucuguaaccccaauuccagggaaucuggcagacacguguguuacauaugaauacauguuuacagaauauccauacaaaguaaaauuguucuagauuuugggcuuuguguuuugauagcguuuauauuucuagcucaguugggauugguugguaccuucaggaugaguacagacauuagccacugguuguauaaacccuuaggcaacaccucccaugcugcccugcuccuggagguggagcagugugcacacugcugaggagaugauggagguggagagaggguagagccaggagcaucaaugcccaguuucucugcugacucugcguuucuucaucaggaguucuggcgccagccagagcuggagcgcugcuucuccagaguccaagagguuguacaggcauugcgggcgcuccgagccaccuaccagcucacaaaagcccgaccccaaggugaggcugguccuggguggaugcgagcacggcaagagcugaugcucacacugacuguuucacugucccugucucuguuagugcugcugcagugcucggacccaggagaacaaggccuaguccagcccuuucuggagccucugggcauccugagccacugcggggcuguaggauuccuguccccaggggcagcagcucccucagggugggcccugaccccacugggugacaccaugaagaucuacauggagcugcaggugaccagaggggguuggaggaaccgaggaggaggaggagggguagaggcuggccaggcugcaggugucugacuucuccccuguucuguagggccugguggacccccagagccagcugccccggcucacugcccgaaggcagaaguuacagaagcagcuugaugaccuguugaaccggaccaugucagagggucuugcagagaggcagcagaggguaaggcugaggacgccugaguuccuggcagggcgugggcugggaggccagcucacccuuucucaucuuuucuccuuguccagauuuccucccuccaucuggaauugucaaagcuggaccaggcagccuccuaccuacagcaacugauggaugaggcucccagugccagggagcucugagccccacucacagcccagcgagcauuccuccucagaccugcuugcuauuggugcaaugggaccucagaggugacauggaccaccuuccucauucuguaggagggagcaggucggaaagugccacgauucgagaaugaggaggagauggagauaaaaggauaaaccccaagcacgcaagugugagccuuuacugcccugugccccgcucgacugucucgccucuccauugccuaacaacacacgcacaauuuagcuucauuuuggacacaaagaagaauggaaguaauuuucccaacuuaucaaaaggaguuuagccuagcugaucaacaacucaggcugcagcgccuuucuguuacaguagcaaaguuucaaaccuggugacuuugacaagugcuccuguuucgggcagaaguacaggguuugggcuccgugucucuccuccuuucagccuuuuuuucccugccacccugacacacugaccacauccaagguccacuugagcugcccccaugugucugcacucuuccugaagagaaggcuuccugauuuccucccucuggggucagugggcaagacggccaguuucaaagccaucaaaugcaagggagaaaaggauaaaagggagccaugcugugcugggguagcaaaggggccaggucaaucuuagaaagauucagugaagcaaagacuucggggaggggcaagaaaaugucccaccuagaaggaacgcucagaaaagcugacauagcacauucuuggcacuccggguaccaaggaggcuauugggggcggagagcaugcaaggggaggcccagagaugaagagcgagugguauggugaacugugcugguuacuggcugccugccacucgagccugcaguaauaaagacgucugugauuacagagguuagcauugaaagaaacauggggucucgugaagcguuggacuucccuaacacuaacuacuucugucuuguuggaaagcaucaucacauggccagcauagcugcaaaggcaggcaggcauucuuuagaagccagguuuccagcuaagaugugcauagcucuuaaccaggccuaugaaacuuuacaagccuggccuaccaccccaguaucagcaagagcugaccgccauccucuguccugcagggucaccucuggugcccguuuccuguuugguccccagaagagcagguuuggagaccuuuugggggagacaacugauuauucaagcuccacaccugagacuaguguugguaaagcagauuacacacaguucgugggucuuuuuagacucugccaggcaagguuccagacacaugcuggacuugcauccagccuaguacguuugccgcccgcucugcccacuuagcaagagaaacuggcuguugccaugagaccaaggcuuuaagacagaaaacuaaggaguggacccuuaaaaaggccuuguaccugguggggcagaguuaacugggaggaguagucaacagccucuaggcuagcaggauguuauggacacuguaaggacacacucuuggccacuaggauaguaacaucucccaaccccaaagcugcccugaccauagugaccaggccagaggcaggcugaagggucugucugagguagaaaaguaguggugaauaggguagucacacuaacaacuacaucccuacuuuaaccacuggaagcuggacugggacccaggaagaccaugaugcaugugcacaaccaucagacuucaaagcccaagcgcuaaccccuuguucucccgacccugcaggagugaguagucccugcuaccccaagaugcccuauugcuucugggggcugcccugaaagugccuucuuuauugacaagcccuagcagaaacagaagugcuugguaaaccugcaacaguucauccaacuucaccaacaaggaaucagcccaccuaccucucaacucaugccaagaucugcucagccucugacuagcuuguuuguuuuuacguacugauacuucccaccagggggucccuuuuuuuuugggggggggggcucucugccaguuuauauugaaaucagguccuuaugcagaagacaccagguguuccuuucuuagacccacgaucagagagaucuccaugaguaaggacacaguguagaggagccucugccaaugaugcccaucuguaaacaagauacuggagcuccagagcacccuuggagaucuuacugcccugguauggguaccugugucuucuccuuucuuauuaggaccaagaaagaaaggggggggggaguuauucagauuaaugaauucccuugccuauauaaaauccaccacucaaaaaccaaaacgggaguagagguuccauuuaaacucccccccccccccuagaauuuauaaucugaaagcaagccagcacucagggugaauuauuuaccacaggugccugugauccagaggauguagaaggcucuuuucuccucugcuuauuugugucauagcaacuggcaacuaaaaacaauggggcagaaaugaaaccacacagcaaagaugaaaaaaaaaaagagagagaaaaauaggcauggagaugcugaguggaaagagcugugaagacccaguggaccacucaacuccagccccucccuccgaaagcagggagccuaaaagcuacuggcaucagcuuguccagcacuuaacccagggcuccugcaaacucaggcugcagauagaacccagggccuuguacaggucuagacaagccuucaacccuggagccccaccauagccccacccacagucccauaugcucuuuuaugcuuccucagccaagccaggggagaacuccgcacacacaagaggguagggguaggagugccuggagucuggagauccugaguuagaggaagggcuaugggaggagaggucauuuguccacugacccugcucgccucuagcagccuccaauagacuuuucaggcuccuuccaccuccaacucaaagcaagcuuggcagcacuucccuccauaucagaaaacuucgagacuacuuuggauuuuccuaagcuacaguagcuuaggaaccagcaacgaggggcugaagagauggcucagcucuucagagaacccaaguuccaguuccagucccagcacccaggucagguggcucacaauugccauaacuagggcugaugccucuggcugcaggugaauggaagcacacaugcgcacauaaagcuaagcaacucuucccugcccccacacagcccaccuucagcugccuacccucagcaguucauagcuccagggcagagaaccagacaaaggaagcuaagaaccugcuccaaggcccuuucuuggguguagugagugagucugcuucucccacccuuccuccccagugcuuugguugucugguuuguucuuucugcuugggacugguggcuuaaugcuccacucugguucucaagagagaaaccucaguccggucacaagagcuccuuacuccuagugggaguggaacugacuggggcucccaucagcuaaacuugaucaggguguccccuugcucggaaggggcuguuggagagccaaaagagcgcuacuucugaguccuucugccaauuuuucaguuaaguauauuuccuuggauagaagucucaaaucguggacaagaagucccauaaaauauaaugggguguugcuggucaccuaaggacugcugaauguguccccuggagaacggaacauccgggagaaaagaccaaacuguagaaccagaaaaggaacagccccaaggaggaugucccuaacaggaagcuggcuuggguauuacacagggucccugggucuuccuuguucaccuauuggccuguuuagaagccccgccccuacaccuuccugcuauuucuagaaaugucuucugcgaacaaggcgcaccuaucucaggcagacggcuuucuauuuuccuugucuacgaugucucucuaacucucucccugucucucacacagagcuauggugaacaccaaggcauucacuccaaauuaaccacuguacuacacuaggaaauuagccuggaaacugcacccugauaaccccauaaagccauucaagcugggcugaagcaaaaacccucaagccucggccuccagcacaucuguggucugcacaccugacccauggggccccucccugcugguacaggccaaggacaagcaauagagugcugggguccacugaggaccuguggucacuuaccucucccugaugcuccgugcuccaggacaguuagaaagaagagagaggcaaggcaaacuucuccuucugcuucccucuuuucuaugcuuucucaucuucagagaagcucccugcuggaguggcaugaacuuccaagggagucggcucuuauaugggggugaugauaucuggguggggacugggaaggacaagaacacucaucucaacauucccaaggggucugucaggucuagcuuacaagauuuacucaaugagaagccaagauaauuugcuuuuugacacugggucucacugucuuagucaggguuucuauuccugcacaaacaucaugaccaagaaacaaguuggggaggaaaggguuuauucggcuuacacuuccauacugcuguucaucaccaaggaagucaggacuggaacucaagcaggucaggaagcaggagcugaugcagaggccauggagggauguucuuuacuggcuugcuucc

SEQ ID NO: 8564 - RNA, 11973 nt, Mus musculus
cgcgcaccucgccaugcaccuaucggcucugaguucgccgggacguucgaguuagaggcgcauggccgagguugcggggguggggguggucccaggcuuccgaaccccaaccuucguguccgcgucagugcccggugacgggcagagcucccgccuucucuggacgcccugguuucagugauuccagagugcuguccacaccgugcgcuccgccccuaggcggaaggacguagagugagagaggguccugcggaugggagugaaggguugcgaccuccugcaucccauggccucguagugagcagaccuccaucccuucccaaacacucccgaugccucauuugccucuggccucuuuccggccaccgcucugggggcugaggcccucauggggucuuuccaggccccaggcacuuuguacacagccggagccccacggcuccccugucucucggaggaaccgugaagccaaacagaagcgccugcgcgagaaacaggcggcccuggaggcugggcuagcugagaagagcaaggucaggggucaguccuugggucucccaagacuugggaaggggcugaaagagacuggcgcagggauccagaugacugugguguauuggggauugcagccuccacccccacuccgcaacacacacacacacccuguuuccucccugcagauaccugcagugcccacuaaggccuggagucacaaggagguaguauuguaugaaauccccaccgggccaggugaaaagaaagguaaaguguaggguguguuuugcgauguuguugcucuuuggucugcuaacaugcaguucaguaguggaucucuguucugcuuccacagauguuucugggccccugccuccugcuuacaguccccaguauguugaagcggccugguaccaguggugggugcgagagggcuucuucaaaccagaguaucaggucagugcgcggcagagggcuucuaugagguccuuaagacagagugaguggcccuugaacuuggugggcacaggcuaacuucacaguugauguuuauuucuuucggccccugguuuucuuuuugccucccccguguuggauuucaauaauaauaauaauaauaauaauaauaauaauaaauuugagacacuguuucuccacguaguccuggccguccuggaacucuguagacgaggcuggccucaaacucagagaucugccuuccucugccuuuucacacgugugccacuacaccuggccuucuugaaguucuuuuugccccaaggcaccagagggugcuguuccccuaggcaacagcaacaacuaguucucccucgccucugacuuccucauuccuuccaggcaaggcugccccaagcuacaggggagaccuuuuccauguguaucccaccucccaaugucaccggcucccugcacauuggccaugcacucacaguggcgauccaggacgcacuugugcgcuggugagaggcgguggggccacugcaguucccgaagggaaggcuggaagugaggaucagugagcucagaguccccaugguguuucuguggcaggcaccggaugcguggggaucgcgugcuguggauccccgggucugaucacgcaggaauugcuacacaggugggucuugugccccccucugcuugguugaaagugccgucuuuaugugaagccugacuagcuuucauuuacaccugaucccauuucaggccaugguggagaagcagcuauggaaggagcagagggugcggagacaugagcugagccgggaagacuuccucagggccguguggcaguggaaacaugaguacgagggcagggccagugggauugucagcacuacuucugacuuguagcauuugguuuuucuggccuugugcuucacugucucggagcagagggaaugaugucugagccaagagugugugugugugcgugugugucacaaugugcacauuugucuguauacugugcucauguuagaaugcacacacguguguacuaugcuuguguugggaugcacacuuguguguccuaugcucauguuaggaugcacacauuuauguguauauggauggauauauacaaaugugugguuuauuuaaccuccuugucuuauuuuccuuuggacuucaucaccucucccaugccccugggccuuccuaugucugugguggucaugugcuucucucucucuuucucucucauuuucucucucucuuucucucucucucacacacacacacauuuuucacaaaguggcugcucccgauagguguguacaggccuuggcccaugggccucuugcaucccaguguagcugugaauuguaaacuuaaaaccuuuugaggacuuuuugcuuuacuacauaauucucaaauguaaacuuuguacauggcaaugaccuguuacgguguuaugcaaaacgaaugcauguauguaugugcauguaugugccuccaaccagugggcuacagcuuagacacuacugguuguagccuaaaauagccauccauccugugugucucagagaagccaaagguuuagauaacccugcagagaccuuucuguaucuuuuaaagccauaggacgccccaccccaggugugugguucuaucuccaucagcggggucagcucuaugcgcacuuuauuuccuccgguaccuggcauuggcgagcaccuaugguuagugcugggaggugcucuggucauauuuacugauagaaaucucuggugcaggaaaggaggggagaucuaugaacagcugugugcucugggugccucucuggacugggaucgagaguguuucaccauggaugccgugaguucaugccacagacccuguggguuugggcggguggggggguguaugugugcuaaagaccagugugggaaguguugguagagggaugagggaaucccugaguucagcagagggagggaggacgucagguauggacauucagaucguuccagggcuccucagcagcugugacggaagcuuucgugcgacucuacaacucgggauuguuguaccggaaccgccagcuugucaacuggucauguacuuugcgaucggccaucucagacauugaggugagggagaggaagaaagacagauugacggagugagguccuugcggccgccacaggugucuguauuugauuuuucucaagcuccaaucacucugcuucuccacgugccaaucagaggguggcaugugaccuguggggacaguggaagagccacagaguucccgcugugcucagcagagcggucugccaugggagugagcuccgugacuuuacugugggugggagggcacggaagcaggguggagagcuguaaggagcccuggaugugagcaccacagagagacuucucuuuccugccuccucaacccuccagguggaaagccggccucugccuggccgcacggugcugcagcugcccggaugcccaaccccugugucuuuugggcuccuugcuucuguugcuuucccuguggauggagagccuggugagugugguccugaaaguugcccucuuccccuugcuucccguuuucucaagucugugagguuuccggggccccugguagguuugcacuguuguggguacuuauucuggaggggaagaaaagguacgagguccucuucauugggaaccuagugugacucugugaggucuuccacuaagagaucaguucugagcuagugacaaguguaccugagaucacagccuuugggggcagaagugggaggauuccaaguucaaggcucgccuggucuacauaguaaguuccaagccagccacagcuacaugaggcccugucuuaguaaaacaaugcagaagauuaguucuaaaguguaguuuguuaguuaccugcacuccugauaguucagagcagagaaggaggcaggcugcucccccuccccccuccccuccuccuuccugcuccagcucuuacuuacuuccccugugugggagagagggcaaggggugauggcugaccucagugcuugaaugcuugucuccagacacagagauuguggugggaaccaccaggccagagacccugccuggagauguggcuguggccguucauccagaugacccgagauacacggugaguagggugugccugcaccaggcccucccacccuacagugcccccuuucuuguuagacgcuccuucugagacccccccucagcucugcggcggcucucacuaaccauggccuccagaccaaaugcagcugcugcccuucuggguaucagccacacuaauuggcuuaugcuuccuauggcugccuucacagugauagcagugagggauuguccagggacugcuucuuggcucacucagaagucugaugcuaggucuugcucuaacuccugccuugugaucucuacccucuugcucuaggguucucauggcccaaacccucuguccuauacuccugccuguuccuaauggcucaccuucccucuagcauuuacaugggcgacagcuccgucauccuuugacaggacagcuucucccccucaucacagacaccacuguucagccacaugugggcacagguguguggaagucggguccagggagggagggaaaggaacaggaggagaacaugagagcuggggguggggaugauggaggcaggaggggaugagggugggauguggggaugauggaggcaggaggggaugagggugggauguggggaugauggaggcaagaggggaugagggugggauguggggaugauggaggcaggaggggaugagggugggauguggggaugauggaggcaggaggggaugagggugggauguggggaugauggaggcaggaggggaugagggugggauguggggaugauggaggcaggaggggaugagggugggauguggggaugauggaggcaagaggggaugagggugggauguggggaugauggaggcaggaggggaugagggugggauguggggaugauggaggcaggaggggaugagggugggauguggggaugauggaggcaggaggggaugagggugggauguggggaugauggaggcaggaggggaugagggugggauguggggaugauggaggcaggagggcaugagggugggauguggggaugauggagguaggaggggaugagggugggauguggggaugauggaggcaggaggggaugagggugggauguggggaugauggaggcaagaggggaugagggugggauguggggaugauggaggcaggaggagaugaggcaugagauguaguguuucuuaaaucccaaagccaagguuagugccagucucagagcagcuguuucccccaggggcagugaaggugacuccugcucacaguccaauagaugcugagauagggacccggcauggccugaccccacugagugucauugcagaggaugggaccaugacaucccucuguggagacuggcugcagguagguggagccuuggugguacccugucuccuauaggugcccucugcccugccuccccaucuagucugaagccucugauauugucacguucccccagggccuucaucgauuuguggcccgggaaaagaucaugugcacacugagggagcagggccuauuccggggccuacaggagcaccccaugguacugcccaucugcagguauccccaucuuaauccuuccuuaggcucaucccaagagaaauggacgaagcuuacgagggacagcaggaugggcucaguacccugaccagaguguaggcucuguuugaguugggguccugugacccacccuggccugucaagugugggaucauaauauaaagggugccaccaggcugggcuucugugagacuuuguccagcuguuccuaagugcacagggccucucacuugcuguccuugcagccguuccggggacgugguggaguaccugcugaagagccagugguuuguccgcugccaggaaaugggggaccuagcugccaaggcaaggccccguauggggagggacugggccucgagugggagcuucugagaagugugauacagcucagagaggagagcuccugucauaagggcucugguagcgacgggcuaggggccuggagggcuggccucuucccuuguucuagcccagaaucuucuugcacagcaugcaaggucccuucugagguuuuugauguuuuggggggagaaaaggagauggcuuagcaggugaaggcacuagcugcuaagcuuagccuugggacaucccccaaacccgaauggugggaggagagagccaaguccccaaguuguccuaugaccuccauacuugugugugcauacaucauauguguacacaaauaguauacauacaugcagaaguuuuaaaacuuuaaaacuauuuaauugugugugugcuaugugaagacaagaugaacucaggcugucacugugugagccaagcucuuugcuugcuaggcugucucacuggccacccuucugagguuuuuuguuugguugguuuugagacagggccucacuguguaguccuggcugaccuggaacucacagggcuccucccaccucugucugggauuaagggcauccaccaccuuuuuuaacaggcuguggagucaggggcucuggagcucuggcccuccuuccaccagaagagcuggcaacacugguuugcccacauuggguaaggaggccuuccaugaaggugggagggggacccugcggucaggucgaggugucagcgguguccucuuugacagggacuggugugucucccggcagcugugguggggccaucagauuccagccuaccgggucaucggggagaaugcagaggucagugagaaccaacugaaugugguagagagagccucagucagggucagauagagaccuggcagggggcucuguguggaaccuagugugugacaguucccaugagugucauuuucuuuccucuagaggagucugcuacucaucacucaggagacagugugaaaaccgagagucucacacccguccucugcuucucucuccucaauuuuuucaggaugacaggaaggaauguuggguggucggacggucagaggcugaggccagagcgguagcagcaaaacggacagggagaccagaggcagagcugacccuggagaggggugagaagccggcagggcagaucuuugggggcugcuggaaucggggugggaugggcagcagggccuggaggccucaggcacuagggcuccagccgcgcacuucccucuuuugucuccagacccugacguccuggacacuugguucucuucggcucuuuuccccuuuucugcccuggguuggccgcgagaggugacguggguuggaaggugggcaugacacaggugggcagcgacuggauguggcagaccugccccuuacugcuuaucucauccuagacgccagaccuugcucacuucuacccccucacccucuuggaaacggguagugaccugcugauguucugggugggccgcauggucaugcuggggacccagcucacugggcagcuccccuucagcaagguaauguacucagacgccugucccagagucacccuagcucacugagcgcagaagccgcaggccuaaguccuucccgcugacgccuccgugucugcaggugcuucuucacuccaugguucgggacaggcagggccggaagaugagcaagucccuggggaacgugcuagacccacgggacaucauuagcgggcaggagcugcagguaagaacagaggcuuuagcuggagaugacaaggucuguggagagcacagggagggagucugacccgucucuuguccaggugcugcaggccaagcugagagacgguaacuuggacccuggagagcucgccguugcagccgcagcacaggugagaccuguggccuuuguccuggccucuugacuugacugccagcuuccuccucagccuccauggcacuggccacaccucucuuccuuuggcugcagaaaaaggacuuuccuuacgggaucccugagugugggacggaugcccugagauuugcacugugcucccauggaauccuggguaagccucgguguguggcguggcagaggguaucuguggacagcuccacugacugaggauggacuccuuguucucuccccccaagggggcgaccugcaccugucugucucugagguccugaacuaccgccauuucugcaacaagcucuggaaugcccugcgcuuuguccuccgugcccugggggauaacuucgugccccaaccagcagaggaggugugaggacagcagcaagcccggagggguggcagggacaggggguccagcuauccagguccucaugcccuccugcuggcagguaacccccuccucucccauggaugccuggauucuaagccgccuggccuuugcagccagcgaaugugagagaggcuuccugagucgggagcuuucgcuugucacccacacccuguaucauuucuggcuccacaaucucugugaugucuaccuggugagugguggggcccagccgggugguguguccuggaacugaguggugguggugguccagagcucuguggguacacccagugcccccucaucagggaaagcauguuccucccucccugacuggggcucuguaguauauagcccagagcuguugccagccuguccuagugaggaagaaagcuggaagagucuagaaaccugucagggaaugagggcagugggguuuccucagccccaaucgcugcugcauuuaaaaugaguagcuauacacuggggguagggguggggggugggggaucaguguggugguuucaggcgagggucuuuaagcaguguccgugacagucacuaaccugacuuguccaccucaguuucccacucagggucauucaggauaggcaggggcagcuguggcgcugauaccccacgucucagcguuguuccagggcagcgagcauggcuccuugguggaccugucugggcagggugcucaaaggcucuggguucugucccuggcacugcagacaaaaacacugcccccuuccucucccacuguuuggggaucacugggccuguucacacgcggguccggggcuagcauggugucuagcacggugucaguaacuuagcauguaccccaacucaggauguaguguggcuguuguguuaucugccagcucucuccuuaggaagcagugaagccaguguugucgagcgugccccgucccccaggacccccucagguccuguuuuccugugcagacgugggucuacgccuccuugccccgcugaugcccuuccuggccgaggagcuguggcagaggcugccccccaggccaggcggcccccuugcccccagcaucuguguggcccccuaccccagcacccgcagccuggugagucaugggcagggguccgggaagcagggcggccuccugagggcugagguggugacuauguuagcuguggagcuuucacacgggaucccagcucagguggcccugcuugccaggugaguauccacccgcugagccgcuuccccauccccacuuugcuguguaacccuggcuguccuggacccaucccaccuacucugccucccaaguaagugcuaggauuaaggccugugucaccgugcccagcccuacuguuuuugaugcugugucacugaauugcuguuuucagccccaagaauuauugugaguuugaggucacccauaguccacauauuaaaguuccaggacagccaaggacugcauagagagaccggucucaaaaagagaaaagaagaaagucuagggcuggaaaaguggcucagcaguuaagaaaauuucuucuggguucgaguuccauacugguggcucauagcugucuguaaccccaauuccagggaaucuggcagacacguguguuacauaugaauacauguuuacagaauauccauacaaaguaaaauuguucuagauuuugggcuuuguguuuugauagcguuuauauuucuagcucaguugggauugguugguaccuucaggaugaguacagacauuagccacugguuguauaaacccuuaggcaacaccucccaugcugcccugcuccuggagguggagcagugugcacacugcugaggagaugauggagguggagagaggguagagccaggagcaucaaugcccaguuucucugcugacucugcguuucuucaucaggaguucuggcgccagccagagcuggagcgcugcuucuccagaguccaagagguuguacaggcauugcgggcgcuccgagccaccuaccagcucacaaaagcccgaccccaaggugaggcugguccuggguggaugcgagcacggcaagagcugaugcucacacugacuguuucacugucccugucucuguuagugcugcugcagugcucggacccaggagaacaaggccuaguccagcccuuucuggagccucugggcauccugagccacugcggggcuguaggauuccuguccccaggggcagcagcucccucagggugggcccugaccccacugggugacaccaugaagaucuacauggagcugcaggugaccagaggggguuggaggaaccgaggaggaggaggagggguagaggcuggccaggcugcaggugucugacuucuccccuguucuguagggccugguggacccccagagccagcugccccggcucacugcccgaaggcagaaguuacagaagcagcuugaugaccuguugaaccggaccaugucagagggucuugcagagaggcagcagaggguaaggcugaggacgccugaguuccuggcagggcgugggcugggaggccagcucacccuuucucaucuuuucuccuuguccagauuuccucccuccaucuggaauugucaaagcuggaccaggcagccuccuaccuacagcaacugauggaugaggcucccagugccagggagcucugagccccacucacagcccagcgagcauuccuccucagaccugcuugcuauuggugcaaugggaccucagaggugacauggaccaccuuccucauucuguaggagggagcaggucggaaagugccacgauucgagaaugaggaggagauggagauaaaaggauaaaccccaagcacgcaagugugagccuuuacugcccugugccccgcucgacugucucgccucuccauugccuaacaacacacgcacaauuuagcuucauuuuggacacaaagaagaauggaaguaauuuucccaacuuaucaaaaggaguuuagccuagcugaucaacaacucaggcugcagcgccuuucuguuacaguagcaaaguuucaaaccuggugacuuugacaagugcuccuguuucgggcagaaguacaggguuugggcuccgugucucuccuccuuucagccuuuuuuucccugccacccugacacacugaccacauccaagguccacuugagcugcccccaugugucugcacucuuccugaagagaaggcuuccugauuuccucccucuggggucagugggcaagacggccaguuucaaagccaucaaaugcaagggagaaaaggauaaaagggagccaugcugugcugggguagcaaaggggccaggucaaucuuagaaagauucagugaagcaaagacuucggggaggggcaagaaaaugucccaccuagaaggaacgcucagaaaagcugacauagcacauucuuggcacuccggguaccaaggaggcuauugggggcggagagcaugcaaggggaggcccagagaugaagagcgagugguauggugaacugugcugguuacuggcugccugccacucgagccugcaguaauaaagacgucugugauuacagagguuagcauugaaagaaac

SEQ ID NO: 8565 - RNA, 2501 nt, Mus musculus
acucuugacacauuucucugcucucccuucucuuuggacugcuuauugacuggguccugucugugaaguucuucgugguucucccaccuuuuagaauucucauccuuuauuuccaggagccaaugcgagacauuagcacugauuaggcgacggcuggugacccggggugcgcgagggggagccgaguggugaggggguuugagaaggguaagggagagaguugagcgagaagcggagugaaaggaaagucggggagaugugaggagcucagaggcgugggucucagugagagggguaaggcuggcuggagggaaagggauagaaagggauuuagguugguaagcaugaggcaguuuauagccguguccccagaugagagcuaaggauuugacccauuuggacugaucugaccaggaggguggacaagagagagaagccugggcucaaauaaguaucuuugucaaugcuuaggugaacuugagaugucauugauaugcaaaacacucgcaaguaugaaacgauaaguaauucaguccacaccggugaggaucuggauuugauccucaggaccauacacaaaaaugagacuaauuccaccuccuggagacugaacaaaggcugaacuucaagggcagauaugggaugaaaagccugguggccacuugggaaguaaaggcagauggaucagggguucaaauccauccuuggcuccauagcaaauucaaggccauugugagcugcauaaugaagaaaagaagcaggacacgagggguuugggaggaauaggugauaaguggcaucagacaggaaaguacagaaagugaaccuaauagaucuggagucagugauauaggccugggucaugugggaguucugacauuugucccucucaggugauggagaucaccccggcgagggguggacugaaccgagcacaccuacaaugcaggaaucuccaggaguucuuaggaggccugagcccuggggugcuggaccgauuguaugggcacccugccacuugucuggcugucuucaggugaggagccuucagagcaaaggggauguuuggagaauguaauggggccugcagacugaaauuaguuagcacggggagaggcuuauuagcccagcgugaguaccaggguguuagacauuacuccaaagugugucaguccaaaccagaaagagguuguggggacagugggacugcuaaggacgugggagauggcaugagacguuugagagacagagguugcaggguauuugaucacauagugaacuccaagauuaugaaccagaaaaaccuuguuauuguggcucagcccuaagcacacaccuuuuuuuuagccaagggcuaaugucaaccguaggucaagagauggagcaaccaaguaaacagaaauuagcaacguugaguugaagggaauuuaagacaguguggagaauucucggagagggagcuuuuucuuucugggaugucauuggagaaaaaaaggucagcugggugcuuucucugccucucugagcaguugggauguuuguuuuuuuuaaaccacaggcagaugagggcagagaugcaggugugagguggcuucugauaacauuuggccucugaaccuuacagggagcuccccucuuuggcuaagaacugggucaugaggaugcucuuucuggagcagccgcuaccacaggcugcgguggcccugugggugaagaaggaguucagcaagugagucccgggcgggcgcagcugcuucgagcuucccaacagccacauuucucaaaggacuuuuguuuggaacacuugcagggugcacacacagaggagcuaggggaaucagaugugggccuuucaacagagccugcccuacacaaggaaaacccuccagaauacaccugcagagguuuccacuguggagaguugugucucuuuagcuguaugcuaacuagaacaaaacaaacaaacaaacaaaaagacaaaggggaaaaagccgcccccgcacucccccaaccccaaguugauagguagagauagggaaccagagauucaaggauuauaucguaaguuugauguauuguaaguuugaggcugucccaggcuucauaggacccuuccugaaacaaaacaaaugaaaaggaaaaaaaaaaaaaaaagaauugacuuagaaaacaaaacagagaaaccaacaacaaucaaaacgaacuagguucuccuuagcauugcagugcagguaucugaggugagaaacacagcuucgcccugcgacacuguuccaagggccucccguucagaggagauagaugaagcucccuggaggucuccuugcuauuggugauaccccacucaacucugcuucuguccagggcucaggaggaaaguacggggcugcugaguggccuccguaucuggcauacccagcugcucccugguggacuccaaggccucaucuugaaccccgucuuccgccagaaccuccgaauugcccuucuggguggguacg

SEQ ID NO: 8566 - RNA, 23057 nt, Mus musculus
ucaacguccuuugaaagcuuugggguucgagguuuucagaccacagacuggagaguguccuuuaaagacgcucuuuggcuucaggugccucgguaaggcauugcuacugcugggggaacucagauuuauacuguagagauagccaguuuaaaaacuggauucuucucagggaacaaaaucaaagccccaggaaaggggaugcauuauuugggacgcagaaggagguccccaaaggaccacccucauucaguucuaaaccccucugcuuucaacuuuaguccacauagcccaccuuguccucuguuaggcaggaugaacucaucucuaagcucuuggcagcagccagcgaacgcugcuuucgaccgggccuccuccucaguggcuuuugucuggggggucucuuugucuggggucucuuuguuugggagaccccuuuggucccguuccauaguucucagccuccccucccuuucucuggguuaggcuguccccucccucucugcgggggcugagaggcucagcgaggggagcagagcuggguugccauggucaccuugaagccagccgcagcuggccagggcagcugcucuugggcccccgaggcuggagcuuggacaaagccgggaggcuucaucggccucagaccuggauccccaaaggcgugugccuagggagacugaaacucaggagaaccuggaggugagcggaaguuagauagagcucaccugggagagccggagcaggccuggggcugggcugcuuuuguggggagggaccagguaggccuuguggugggaggagaguaggauggaggccccguguggaaacagguugaccagaaugagggcggggccuugguggccuggagacagguuuaauucuaucucuggcccuuccauccgucucgaaguuguccuuccuuccuaagucugcccacccagcccccgugucucucucucucucucucucucucucucucucccucucccucucccucucccucucccucucccucucccucucccucucccucucccucucccucucccucucccucucccucucccucucccucucccucucccucucccucucccucccucccuuccuuccuuccuuccuuccuuccuuccuuucuauggcuccaugucucagucuguaucuuucugccuccauaucacuuucauuccaaccuucucucucucucucucuuuuuucuauuccaguugccuucucugccuuuaauuccuuccauguuggaucagcaacccucccuccauccaguccuuuccuccccuccccaaacuccucucuccuccagagccccuuuaucucccacccuuucuuuacuuggcaccaucucccuuaacucuccuccccucucugugcuccggacgugugcccccucccagguccugucucuaugugaccaucagccucccucugggagacucuugguacccugguccucauuccuuccccagacuaugcacagcuaaucagucucaccuuuucuuuucucuuuccuuuccuuuccuuuccuuuccuuuccuuuccuuuccuuuccuuuccuuuccuuuccuuuuuucuuucuuuuaucgguuccagauuuaagccaucucuuccuuggccaucauaccccaggccucauuuuccuauuugaucucggugguuuuaaaguaugaccuauagccagggucuuuuccagcuccuuacccugcccccccccccccacaccagaggcuuuccacucuccccagcugcugacccaaccugcuccccuagaggcagcugcaucucgaggcagggacuguagcuaguguguguuggggguguugagggugggcccaucuaguccacucuccucucacugguuuuguccugcuuuccuacaauggucggguggucugcaggccuugagcugagcucuuauuucuccuacgugccucuuuucacaucccccuuccccucaguuguuuuguuguuguuuuuguuuguuuguuuuuguuuuuugcuucuucuuccugugcuugcagaaaaggguccagcaugggagagugugcaugagggaaaaguagagagaacuucccagguucuaggguacaacagggggcccuggagaggagcagagggcuggggagccacagauggcuggguucuuggcucagcuauguaggccccaggauggcugggauuucccucucuggccccugggaaucugggcuccgaguagcacauuccagccggcuccagcuccuuuucugcugucacuugacuccgcugggccccagcccugcgucccuccuacuccuccggcccuggucuggagcgaggugggcaucaccgacuaggaauuuuuccugggagagugauaaaggggccaaggcuucaagauucuaccucccaugggcccuucacugggcagugugagucacgggcgugaggggcugaagcauugcuaguccugucccgggcuuccccagagcggcccuccugggaggaggggcugccgccagcgcaggugagguuacugggaaaccuuggccccacccccagccaagcuccacaccccgcccagucucugcaggacccagauuuccaaucgcugucugcagagggguaggugauuuggggagucgggguggguguccccuaaggucuaggugaaaaggucguaggcaguucucccaguggccaugggagccauuagcagguccuucagcagcuggaacgucccuggguuuguaaacuggagacccagccugccuuggcuucucccuaggggcagcuuaucuuccugguagguuuuuuguguguacuugucuugguuuguuuggacuucgugucuuucuugagacucuuuggaaaugcuuuuugggugugaguuuugagucaguugggauguguuuguaaccggguggugagaccggagacuuuacugugaccugacauuauccggggacuuggcagguauggggggggggguggcguuggagagagguaggaaugacagguggugcugaaugggacggaacaccucccacacucccacacuagcucuguuguccucccugccucuaucucuccgguccauggcucagcagcucucuccguucauugucuccuuguaucccugggucaugcguuccugugcuuugggcagugucuuuauuuuucagggcgccuaucuaucuuccucccccacccccaccucgucuuggcuccauuuugcccuucuccuugccagaagccagacucugcggcuuccaccagggaccgagcugacugacugggacugagggaggcuugccugagaaagacugcagaguuagccuggaugaagcagggaucccagggggauccggagcuuggggguuugaaucucagggauccugagaagacaggagggagcugccaagcuggggagagguucuggaagaagggaacagaaaaaaguugagacuaaaagagugugaccggcucucagacuuggggcgcgcggggauggggggagugauuuagguugggauccggaggaggggugugugccaaauggugacaaaugggguggagugugaaccuagagggucuggcuagacaggugagcccggcucccuucccccagccgggcugcagcucucgcuccggugcugggccugugggaacccguuccuuccugcgugcccuggggccgcuucuccgugcuucucucccucucuccaggaaccgagcccagaaaaaggggaggagggacggcgccaacucuccccacccccgagccaccgcgcggggucccuagggggcuuagcgggccccugauggugcugcuguaccccagcaucgggguggcgggggaugggcgugcggaucaccuaguggaggcuacgcgcuggggagcacuugcagggcggguaccgcacuaggagaggagcgaggggcggcgccgggcgugggagcgcgggcgccggggcgggaguaccggcgggggacgggcgcggggaggcggcgccugggcgcgauccggccccgcgcuggcuccucuccccggaacaggcccccgacagcugcucgcgggagccgccucccgacacccgagccccgccggcgccugcgcuccccucccgcgccccgccgccgaggaggccccaagccggggccugacgcccggguccgccccggagagccaugagagguagggacugaggcggggacgagcaagaggcaaggggagcggguuggggaaccccaguuauguuugcugccccgggauuuugacucuccauccaaagcagaggguccugacuuuccgagaaacuauuccgaaaagagagcgaggaccucucuuuucuugggugaggggagaaccuaacuccaagaggacaggugcgcgcauauguagcccacugagucauccuaucggugccuaccccucaaccuccggugccaugcuuacggacaugcucgguuaagcugcccaggccagagggagccagccugacgcccaaccuaccagaccagccacgcuccgugguugccggguugugccaagagacgaggucaccgcccaaugagcaacgcucccaggcucccuuucuggccaggcaauucuuuucagcacccccucucccagccaccgcccggcuggccuacaacugaguggcugagaaggauggagguguguccagacucguguggcacucacuguagggacaggucacacacaguagaaugcuugagaacagggagagaugguccuuguuuuucuugcuguucuucccaccugagucccaccuguuccugccugcucuuggcuucccucuggcucagucacucuggauguuuggggguggguggcuccguucucugaggauccuguaccucagggccugcguguggcucacuuugucuucugauuauaggagcuugugucugccguuuaguauucgcuaaauggugagaucugacuuuauagauuaccucgggguuuguggcacacaccuguaauuagccucuggugauaaagaacugaaggucagccuuccuuggcaucguaguugaacuugagaccuugucucaaacaaaacaaaacaaacaaacaaaaaccccaaccaacuaucuugcuguuaggaguacaggucuuuaguuccagcacucgaguggcagaggcaggagaaucucucugaguuccaggcuagccagggcuacacagugagacaacaaaacccaagcaacuaaccaguccuucuccccgccccaaagcaacacaaagaaaucaaacgcacacacagaagaugucaagaucuguguggaguggugcuggcuucggcaacacauauacuaaaauuggaaagauacagagaagacuaaugcggccccuauacaagcaugacacggaaauucaugaacgguccuuaauuuuuaaaugauggaagauggaauuuaauggaggaguugucuuuaaagcuacuugagguccagguaauacuuaauaaaauuagacaggcgugguggugcacgccuuuaaucccagcacuugggaggcagaggcaggcggauuucugaguucaaggccaguguggucuacaaagugaguuccaggacagccagggcuauacagagaaacccuaucucgaaaaaaacaacaacaaauaaauaaauaaauaaaaauuaaaaagaccccagggaagaaugcaggguccaggaacaacaacaaaauccuggagacuguagagucucucauguagacuauuuaucucucuuuuugcagaaaacggggguggggguggggcucaaggugcugaagugaguugaaacagccuuuccaggauaugaacgucuuggugcaaaacugaacuccauucuuugaaucuaaacaggauagcggcauacaagaaaaaacaaaaaagaucuguacagaguggauaggaauugugugagcuggucuuggugggacacaggccaauagggugugcugaagaggcaggagggucaggagcuaaaaggaaaagaaaugaagaaaggaaaaggaaaaugucugugagaggcaguaaggcgcuagugguaugugagcaggauacauuuagcguucacaguggguuuaaguccccuguguguauguaugugucuagagcugggauugggcgauggguuuaggagagaaggaagggcccagggcgcaguguccugauccuugguuuguaauugguugaagaagggccaggugggguaccauugagguggcucuccugagccggucugauugauugugggauucaagaccuaggagacaaugggaaagggguugccccagaccuugugagcaugucucugcagcuccugcacuuggcccugugucccguucucugccugcucuauuuaccucuggcuuuguguucugcucugucucuccccccgcccccuccccuuccacgccuccugucccugccuggcuuuguaucucagccccaggcuccucucagcacugucugucucugaugacucaucugggauaggcaugaagguuacucaggggaacaagggcccugcuguuucuacugcgguggggguggagaguagcacccaggaauucccggccagacuucccagucccggcggcuugcuccccugcaucaugcggcuguaucccccacggacuggucgugaugccucucgguucuaggcucuccuuugauagccaggugcccucuggcaacccagucagccccucagcugccgcuucggugauggggggugggggggucucagcugccucuuacauuccugccccagaggauugugggagcagcuggaggaggacaaagggcugggggagucuacccccaacuccuccuaccuccuggggugaccuggcuucccucauaguuuaagccugcccucaucuccaaggcaacucagccuucucagcccucaacuccucugcuaccuucaguaaguuggaacuuggguaaggggaugggguguuagaggcagggcaaggagagcugggcagaccuggugguggcaggggugugagaggggcagugucccucaggauucugggacuuuaggauucagcacagaccucaggcacugccaggugucaggagagucuuucuguucccaggauagaggccagcagaccacugcguuuauauggagacuucagcuggggugguuuuagggaggguaaacugcuugcaccccagaagaaacagagaaagcauccuaaucuucagggggacaacuaccuggggagucugacccaguggguccagguaggguucccauucucaaccaaguucugagaagauagaugcccagcuggcuggucuggcuaccacaguggaaccacagaggacagaggucggagacugauggaggcuuguccuuagguuguaggcuuugaggucugaggggcucgggcuuagcugaugcucuuguguuuuccuuagcaaaccaacucaacuucucuaggacaccuuuauguuuuggaaaccagggcagguuuuuauguugguuuauaugucacaaggcugcacauaaaugcaugguucuguuccaugaguuuuauagaacuaaggcagcuaacccaucuuucucuuuuugugugugcccuccccucucuugcccucccuguuguguccguugcacagucucccuaggugugcccaugagagugugagcagacguggguuuguuuacccuuugcucucacgggguggaauaguucucauacuucucgguuuucuuguuuggcagugguaugaccagcacaugccaagucagauucguacgcucuuuaagauguaaagcaauuuuuuuauuuguauauuuuguguucuauguuuaugaguguuuugccugcaugugugucuguguagugugugugugugugugugugugugugugugugugugugugugccugguacccauggagcuuagaagaagucauuguauuucuuagaacuggaguuguggguaguuguaagccaugguguagaugcuaggaacugaaccuggguccucuguaagagcaauuaauguuccuaacugugagccaacuuuccagcccucauuuuccucuuucuucuuuuuucuuuuucuuuucucuucucuucuuucuuuucuuuuucuuucuuucuuucuuucuuucuuucuuucuuucuuucuuuuuuaaacuuuuguuggcuuuggguuucuggguaccauguaucccaggcugucuucaacuuuagaauggggccguggcuggccuugaacaccugauccuucaccucugaaguguuagaacuacuaguguaugccaccauaccccaccuuucuuucaaauuuaugcauuauuauuauuguuguuauuguuauuauuguuauuauuaauuguauauguaugaguguuuuggccuauguguaugucugugucacacaagcaugcauggugcccuuggaggccagaagaaugggacccccuaggaccugaguuauagaugguugugaacagccauguuagugcugggaaucuaacuugaguccucuggaagagcagucagugcucuuaacugcugacccaucuccccaguguguguguguguguguguguguguguguguguguguguaggucagaggauggcuuuugagagccaauucuugcaggaguggugguacacaucuuuaaucccagcauucaggagucagaagaaggugaaucucugugaguucaaggcugaccuggucuacacaguuccaggacagcuagggcuaugucaagagacaugucucaaaaacaaacaaacaaacaaacaaaaaagaguugauuuucaccuccaacccugauucuuuccuuccacccaugagucccagggauagaacucaggucaucaaccuuagaggcgagugucuuguacccacuggggcaucucucugacacuguacuguuuuucuuuucauagcuacguagaagcuuuccaccucacccugcaugguggcuucccuuuugccccucuucccaugaagauagaaccuuuaaaaaacacuuugugggagcuggagagauggcccagugguuaagagagcacuuccugcugcucuugcaagggaaggacccagcccccacuuggcucacaaccaucaguaacucaaguucuaggaguucuugcucccucuucuggccuccucaggaacugcaugcacgugaugcacaaacauacaugcaggaaaaaaauuaauauaaauaaaaauuaaaaaagacaaaucuugaugguuacuuuuuauuuuuauaugcacugguguuuuucuuguauguaugcaugugugaggguguuggaucuccuggaaauggaguuaaagacaguugugagcugccaugugaguauugggaauugaacuagggguacucuagaagaacagcuaaugcuccuaaccucugacccaucucuccagacccaguuaaaaaaaaucuuagagccgggcgugguggcguacaccuuuaaucccagcacuugggaggcagaggcaggcggccucuucgaggccagccuugucuacaaagugaguuccaggacagccaggacuacacagagaaacccugucuugaaaaaaauguuagggcuggagagauggcucagugguuaagagcacugacugcucuuccagaaguccugaguucaauucccagcaaccacaugguggcucacaaccaucuguaaugggaucugacgcccucuucuggugugucugaagacagcuacaguguacucauauuaaaaaaaacaaaaaacaaaaaaacucgccgggcggugguggcgcacgccuuuaaucccagcacucggaaggcagaggcagacggauuucugaauucgaggccagccuggucuacaaagugaguuccagacagccagggcuauacagagaaacccugucucgaaaaacuaaagaaaaaaaaaaaaaacucuuaaaaaggaaaaaaaccuuugucaaguucagcauuugggauacugaagauacugagcugcuaaguucaagaccaaccuaggcugcauaguaaguuugagaucagcuugggcuucacaguaagcauugucucaaaaaaaaaaauuuccuauaucauucugauuuguauuuuuucugauucuaaggaucuugacuauuuuuuaaaaaugcguauuuuaaacaaguuggcuuuguucuucuguggaauguauauuccgagucuuaggccauuucuguaucagauuguuuauaucguuucuuuugcccauuaugugcacucuuaguuuauuaugacuauuaggcccuuugccuguucuguguguugucuacauucuuuugaagucauuguuuuguuuuguuuuuucauuuauuuuuguuuguauuuuauugguugaagggggagggagggcuguuaggcauguaauuuaacaaacggcucucuaucugguuucucugugcguuaaauauggaucauaacaucuaccuuacaaaguggccgacgauagaguuacgcugucuuguuugaggacucagccagugccugguguguaggaggcaguuuaaaauagagccugucuccaaacacugacuucuuauuuuuaucuuuggccauuuuacuguucuuauccccaaagcagcccuccuguuuaucucuugcuguuggcuguaccuugaccccuuucuuggugagcugacucucuuguuuguccccugcagagaugcuguccccuccuccauagaccagagggauccagagcgauggggacagggacccucucaucucuacugcugcugcuacucuuggugacaauuggagaugcugacaugaagggacauuuugacccuggugaggagucugaaucuuggguuccugaggaauagagcuugggagucagaaaguuggggggaugcugacccauccugugccugugcccuucagccaagugccgcuaugcccugggcaugcaggaccgcaccauuccugacagcgauaucucuguguccagcuccuggucggacucuaccgcugcccgccacagcagguacaggacacugggggucaccuugagggagcuuuuuuauguacccuucugugcccuucuuugagaaggcccagaccagugagacauacccagcauggugagagcagguuuuagauagacccaccauccaggcuggccauggggcccaguuaggguacucaccaagugugaagcucuguauucaauucccagcaccccauaaaugggugggauggcuauaacccugucacucaggaguuagaggcaggaaaaauagaaguucaagguuauacaguuaggcuagcaugagcuacaagguuacacagugaggcaagccugaguuacaagauuacacagcgagggccagccuuagcuacaagguuacacagugaggccagccugaguuacaaaguuacacagugaggccagccuuagcuacaagguuacucagugaggccagccugagcuacaagugacauguaagguucagugccgcccugaccuccuuugguucccccacccccccaggcuggaaagcagugauggagauggggcuuggugcccugcagggccuguguuccccaaagaagaggaguacuugcagguggaccuucguaggcuacaccugguggcucuggugggcacccagggccgccaugcugggggucugggcaaagaguucucccgaagcuaucgguugcguuacucccgagauggccgccgcuggauggacuggaaggaccgcuggggacaggaggugaggcuggaaggggaggcacuugggaauguaagucaucuugccauauucuauacagcaucugucauugccugagcgccagcaucucgagauugucuuaaccuggcugccucucaucuuccugugggguucucagacuuacccuugaccucuccagagaaccucaguucccacuccugccccaaaucuguuccuuuuucuuguucucaacuuggggaaacguacuuccccacccucauguuuaguaacucagaccacaaacuaagauguauagggggggucucacucucucggauccucucuguacccaccauugugguguugccuccccuuccacuucugcuuuaagccucgugcucuuucauccagcugagaugaagucuaaaccauucagcaaguucuccugcagagcaaaccuuuccucagcacacauuagcugaaguaaucugacggccauacccagcugucagccuagcacuggcuuuggcuguaucagaaaaaaaaaaaaaaaaaaaaaaaccaaaaaacccaauugcugagugcaaugcccuucaaggagucugguuccaaugccagcagaucuuuuaccuuccucuggucucugcaggcccugcauuugaguguacaaaucuacacacauguacauacaguggccuuaaugcuuuucuugguguuugugggaacaaaccaaggucccucuggcaagcccuucccucagacaccugcagccccccucccccccauccaguucuccuuggagauaucaccuccugcagaugucgcucuggacauccaccucacuccucugccccacacacugccucuuguucccucacagcuguccuguggcggugggaggggcugacuucaucacugagaucaugucugguccagagugggcaccgggucagcuguugaaugaagagagggaguggggugaagcaggugggggugcugagacaggauccugggugccgagagucuggguaagggucuggcauguauauggaaccagacaggggguagggggaugggagcugaggucagaccuccagagcuuugagaggcaccaguggucacugcuacagaacacucuuuuaaaaauccccaucugcacucugcaauacuguaugcucagugucaccuucgccagccucccagugaccccaauagguugagccagggagcagcugaaagagaggagguuggcucugaccuagagcccuaccuacccauucauguuuuuuuccuugacccacaggugauuucggguaacgaggaucccgggggaguagugcugaaggaccuugggccccccaugguggcccggcugguccgcuucuaccccagggcugaccgggucaugagugucugucuucggguggagcucuauggcugccucuggcggggugaguaggucagccucugaagagucccuuccaguccuggaagcuaggcuagagggugugaggaagggcaucagagcaccuuuccagucagcaaggugucagggagagggaagaggggagagggcacuaaacugcauagccuucuccacacuaguggagaagggcugaaaucacucaggccugauggcuguagcuccccucuuuccacccucccagauggacuccugucauauacagcccccguggggcagaccaugcaguuaucugaggugaugguacaucucaaugauuccacuuacgauggauauacugcuggaggguaagagggauggcccugccgaacaugggagcuugggaugggagaaggcuagugagugugugcauguauguguaugugcaugaguguauguguauugugcauauguauguguguguauuuacaugugcauacaugugugcaucuauguguguaugugcauaugcauguauguguaugugcauguguaugugccugugugcaugugugugugcucgaauauacaucuaguguguguccaucuggugcauauaugccuguauauauaugugcacacucauauguacaugucuacacguguaugugcacguguuuguguguacgugugcaugugagaugagguagagcaauggguagccugggcaguaaaggauaaggacuggggaaaugccaguuagguaggaccugaaaggacaggccaggacugaaggauagugagcucaccuuuagcccaaaggauacuuugugugaaucagaaagaggucccccguggucagacaaggaccaccucguaagaaaaccuucaggcuauccagaacuccuguaauccuaauacuugagaagcagaggcaguaacaucagggacaguaguuaauuuuugccacacagugaguucuaggccagccgggacucccuaagacacgaucuaaaacaauacaaggcuccaccccagcuaagaaugucuauggggacgagcacaauaaaacacguugcagacugaacggugccuuagugguuguacuucaguguggugugcgacccaccgauagcuugugauaguuuaggcuauggugcacagagagagagcauugcauggcacuggggugggcugggaaggaagagucagugagaaucgggcuuccaggccgcugcuggaugugugagugcagaaaacaugcauggucccuaccaccuucccucaacauuccuuucccauucccucccuucaggcugcaguauggcggucugggccagcuggcagauggcguggugggccuggaugauuucaggcagagccaggagcugcgggucuggccaggcuaugacuaugugggauggagcaaucagagcuuccccacgggcuacguggagauggaguuugaguuugaucgguugaggaccuuccagaccaugcaggugagugagcucugccuucugggagggggcggggcucuuggguucuccuggccuugacucagugucucucuuccccucagguccacuguaacaacaugcacacucugggagcccgccuaccaggcgggguggaaugccgguuuaaaaggggucccgccauggccugggaaggagagccuguccgccaugcucugggaggcagccuuggagaccccagagcccgggccaucucagugccccuggguggccacgugggccgcuuucugcagugcagauuccucuuugcagguccuugguuacucuucagugagaucucuuucaucucagguaagccucugagugugccagcccuagcccuacuuagguuugccugucaucucacaguuaacccuggggugagcugguauucuguuaccuacgagauucucaaacuaaggcagaauaaucagaccccaguccuuuguagagccuuuguuuuguuuuaguuugggugguuuuauguauguauguauguauguauguauguuuuauagacucuuuuauuuuauuguguuuugagacaaggucucacuauguggcccuggcuggccuguaacucacagacauacgccugccucugccuucugagugcugagaucaaaagcaugcaugugccaccacacccaggcagauuauucuuaaauauaauuuaaaaaguuuaaguuauucuauuguuuugagacgagucccguuaccuaaccuggaccagccuaaaauucaaugauuuccugugucucagccuccuaacauuaggacuauagguguguaggguccccuuuuaccaaaucgcucugugguuccuguauaagucccucauuccugauucauccugagugagggaagucugguuaagccuaaaagccuuccauucugccuagaugaggaacagccucuuuucuaagccugcgcaucaccaaggccccgccccgauuucuccacuuccgguuggccagggacucauguuguaccagugggauugcucuagguaguuagguacuaaccgccucaguucccuaggucucacacagcuguguccccuuggguucccguucucacuaccucuucucuuucuucuuucuucccagauguggugaacgacuccucugacaccuucccaccagcccccugguggccaccuggcccgccucccaccaacuucagcagcuugggugagcuguccuuguccuugguuccuccugccuccccaccccccaccgccggugggguaggaucugcuguggugcugaccauucucucccaucagagcuggagccccggggucaacagccaguggccaaggcggaggggagcccaacugccauccucauuggcugccugguggccaucauccugcugcugcuucucaucaucgcgcugaugcucuggaggcugcacuggcgccggcugcucagcaaggugggcggggcuguguguguaugugugugugugcgcgugcgcaugugcgugcguguaugugcaugcacgugcaugaguguguauaugacuauauacgagugugagaguguguauguguaugaguguguuguaucuaugcaugugugagugacugcuuagcaaggugggcagggcaguguguauguguauauggggggcgcacacaugggagcaacacauugugugugugugugcaugugagugugugcacauguguuugaauguguguaagacuauauacaagugugagagggcaugaguggcuguucagcaaggugggcagggcaguguguguguguguguguguguguguguuugcaugugugugagugugugucugacuguguauaugagugugagagugugcauguguguguguuguauauaugagugucuguaugugagaauguguguguguuguauauaugaauguauacaugcaugugugugcauguguaugugcacauguguaugugaguguuguuuuugugugugcauguguguaugaaugugcaugaguguuguauguaugagugaauguguuuguguguauaugugugugcaugcgugcacgcacgcaugcacucucacgcagaaucaggggcccguacaaucuauaggguguagacuaaucucagaaacagaccauucucaagagugagcauucgugugacaguaauaccacgugagucagcucccaccacugugggucucauugcgugagagaacguugcaguuugggagccagagaagagcaagagccagagcguccuuaccgugccuucaaagagucagggccuuccguccgguauaggauguagcagguggccaggcagcucucccucagggacaagccuggaggacagaucuuccccucacauuccgucccucagccagcucugucuuccuccccaugguucuccucuaaccaaagccagccagccuauugggagcaaaagcuggagaggaguggggcaaaggggacagcaucgggucgccugcucuucauaugcccuggacuuccacauguccauugugguugaucauuaggguuggguccuguggggugaccucagggaaguggggcuguaggagcuacagcugcaaggcugccgagaggagagaacagaguggcucagggagcugugcugagugguggcuuagacaguaucgucuaaucccgagcuaggcugagcgccgcguguuggaggaggagcugacgguucaccuuucugucccuggggacaccauccucaucaacaaccgcccaggaccccgagagccacccccuuaccaggagccccggccucgggggacuccaccccauucugcacccugcguccccaacggcucugguaaggccugccuuguuccagugccaccauaucuguccuuaccguagcccuccucccauacugucuauaccagcuccaauucacuuuucucauuucuguccaucuccauauggucucccccaaggcuuuccugucuguuauccagaaugccaaugggcccauccugucacugugugguagauuucuguugugccccuuuccuuguuucuccacccuccauguuuauucuuuccaucugccauccauccaucuuucucugucaauccagccacuuacuuaaccaccucucacccuacccaaccauccaucuagauucauaaacccaucugucuauccagcagucagacaucagcuccagcacccauccgucaucugcccgucaucugccccuccauucagcuuuccauuacuccagaggggccuugcuuuuucugucucugucucccagacuuccauuccugagugcccagucuugccuuauuccaggucucccaguccaucuagccuugagucucaucccuuccccgugucuccccccuccuucucccgacagcguugcugcucuccaauccggccuaccgccuccuucuggccacuuacgcccgucccccucgaggcccgggcccccccacacccgccugggccaaacccaccaacacccaggguaagccccucuaccacugggcucugcggggcuucccucaggcagggcaaagcccucacaccuugcgcucucugcuucccccugcucuggcucuucugaucuccugagcuccccaucuggaagcucugccaccccuggaggcaaggggaaggcugcuggucuuagcucugucccuagcucuguucccuccucucaugcugcucuccagagcuagagaggccgcucugcacucugcgcugcguggugcuggcucuuccguaacucuuccuuuauucuccccuuucucuagagcugcgaggaggagggccucacccugggcgcuuguccucucccccccuguguccucucuccgcaguccgagaggugaaggcucaugccgccccuccuguccuuccuccuuccucuguguugcuuucuccuuguggccccucccccaagggcccagaggcgacaaccucugccucccuccugucuaucaacaucuugucuuggggggccugugaagaccugucacccccucucuuuucucuguguacccugucucugccugucuucgagcuugguguguuugggauugggaggaacuggcagggaggagcuggguugacagcaggugcuucuggucagugggacaaggguuuggaacauuguggagacucuugggaugcaccuccuucagaugcuggguggaggaguccuucuuaaagccuagacauaccuaguguuuggaguugagccaggagaccucagaggguaaaauuuucuggcuuaacucucuguguugccucgaaagccuuugggugcagagcacuguucucgagcuugccuuuucugguuugaggcuggcagcugggacacaggggacauagggaccucuggaagauguggugcucagggcucauccugucuucucucccuuuaccccuccagccugcaguggggacuauauggagcccgagaagccgggugccccgcuucuacccccaccuccccagaacagcgucccccauuaugccgaagcugacauugucacccugcagggcgucacugggggcaacaccuacgcugugccugcacugcccccaggggcgguuggggaugggccccccagaguggauuucccucggucacggcuccgcuucaaggagaagcuuggcgagggccaauuuggggagguaaggaggaugccugcccagcuuugauggugucuggccacaguagagcucuguugccaugaugacuguugccaugacgacugcaugcauccuuggcugacagcuugccauuugugcugauaauccauuugacacuaugaccuuggaggucuuugugaccuagugaugaccuucauucuccagguacaccugugugaaguagaggacccgcaagaucuggucaguagugacuucccuaucagugugcacaagggacaccccuugcugguagcagugaagauccuccggccagaugccaccaaaaaugccaggugagacacagggcagcaauauugauaacacaugcugggugaaugggggagaucacuccuagauugagagcuauugccaauuaacaaccacugagagagggagaauuaaucuugucuacagagcagcucccuggaugguuauccaguccuaaagccuuaaaaccuauacauaaagcaacgcuaaagggacggggcagagugcagucauggauuuauucaugcauauauauguaacgguaauaacuaaaaaaugagaggccacgaggauuugaaagagagcaagccaccucgaggggacacgagagggguuggagggaggagagggaaaugauguaauuauacuuuaauuaaauaaaaaaauaauuaaaaaaaaaaagcuaaguaaggaccagagaugaugacuagaaaaggggggaggggaaccuugaagaugggggaggggccucgaagauggaaggggaaccuugaagaugggagagccuugaagaucagggugggaagucuugaagauggggaggagccuugaagauggagggggcaccuuaaagauggggagccuugaagaugggggagccuugaagaucaaggaauagagccuagugucugggggggggggggcuugggguagggaaggagaauauaccaccauggcaccucuccagccuucuccugcuucuccaggaaugauuuccugaaggagguaaagaucaugucacggcugaaggacccaaacaucauccggcuccugggugugugugugcaggaugacccccucugcaugaucacagacuacauggagaacggcgaucugaaccaguuccucagugcccgccagcuggagaacaaggccacucaggggcucucuggggacacagagucugaccaggggcccacaaucagguacccacucccugaggcaaggccuuccuaagagcaccccaagugggucugcugacccucacucaagcuaggaaggagggaggggacugugggguggaggagaacagcgaaaggucccagagggaccuaggaugaaggacauguguccaugauaauucaagaacuaggccagaauggcugagaccuuaugaggagcaggugcagaggcucggagacucugaguucucuccuguccuauaacaaaacaugagcuccuugggauugggugggagaguaggaccugagccacucugagcucuucccucuccugagcaggaguggccuaaccaguaguugagguguggacucccuuccaucucccagacaggaauauguaaagugggaggggucuggacugaccgucacuucucucccuguacucagcuacccuaugcuguuacacgugggggcccagaucgccucuggcaugcguuaucucgccacgcugaacuuugugcaucgggaccuggccacccggaacugcuugguuggggaaaauuucaccaucaaaaucgccgacuuuggcaugagccggaaucucuacgcuggggauuauuaccguguccagggccgggcggugcugcccaucagguggauggcuugggagugcauucucaugguaagcugccaaaagaggcaggcugggaggggagagcggggacacaggcugcugcucugcuccucagccucuugccuuucuggggcuacacacuccuuauuuggaagucgagggucccucuggaucaagaaacugggaaggagggcuggagagauggcucagcaguuaaaaagcacccacugcuuuuccagggguccugaguucaaaucccagcaaccacauggugguggcucacaaccaucuguaaugggaucugaugcccucuucuggugugucugaagacagcuacaguguacuuagauauaauaauaaauaaaucuaaaaagaaagaaagagagagagagagagacagagagagagagagagagagagagagagaaacuaggaaggaacaguaguggauggggaaagugguccaggagccaagggugugggugcuaggauggagggguaagaguuaggaugggacuggggggguuagguuaggauggaggcucaguaccagcaugaggaagggaggaagaagaagaggaggagagggccagaguauggggcagcgggaggcaggaacagaggagcaacucaaggggugcagucaggagaggggauaaaucuacucccacugagauuuuucucugcuuuucuugccuuuuugugugccaggggaaguucacaacagccagugacguuugggccuucggagugacccugugggaggugcugaugcucugcaggucccagcccuuugggcagcuuacagaugagcagguuaucgagaaugccggcgaguucuucagggaccagggccggcaggucagagccgaggggagggauguggcccaggugggcagagcaugcuguuacaggaacuaaaggucaucugucccugccuaucuaucauucacauuucccucgcaggucuacuuguccaggccacccgccugcccacagacccuguaugagcugaugcuccgguguuggagccgggagcccgagcagcggccgcccuucgcccagcuucaucgguuccuggcggaugaugcgcucaacacgguguaaacucaggacccggcagcccuuucccaaugggagccauccaggggaagcuggacucgaaaaccagagaagccuauggcaccgcaccccaccgucuccauacuugcccauucccaagaggcagugucucugcgggugggcugggccugcccgaggagcagauacacacacucccuuccguuucuuccuuccaucugccaagugccacccucccagcuggcccugugguugggauccugccugacuucuuccagcuauccccuuggggaagaacgggggcaaaugcugggcguacacuggacaaggcccacuggacaacacugguuccugggaggugacggugccccccagcuuucuucuugucacacacuggacgccgccagcugagaauuagaggggugagggggacaaggacggccaaccccuacagcgguccucagcccuggcuuccuucuguuccgcccccugacacacuggaccugggggcgaucccugccguugauccucagucacacaccccuccuucucaccugccaugcugcagcuagaacuucgcaaagccucuauguuucuguggaguaaauauuaggauggggaacagagggagcaauagcuugaggcuggggguggggauuucuauuguagcuaccacauugguuuuucuauaaucacgcgggguuuguacauuuuuuggggggagagaaacacagauuuuuacacuaauauauggaccuagcuuaaggcgauuuuaauccccuguccuaggcagguaauaauaaaaguugaguuguuuuuuguuuuuuguuuuuccacag

SEQ ID NO: 8567 - RNA, 8990 nt, Mus musculus
cuagcacacagaggcccuguguucagugucuaguacccaguaaauugcgacuaaucccagcaguucaagguccuucucagcuacuuagagaguucaaggccauggugaguuucaugagucugccucucucucuagagacagaggucucucugucucacucucugucucucugucucuguguguguguguguguguguguguguguguguguguguguguaggcauucaugccacagucugugaauggaaaucagaggacagcuugugggaguuggccuucuccuccugcuguguggauccugggcauagagcuuaagguauuuuaggcucuuuaggcuugauggcaggcaucuuugccacaagagccaucucaacagccagagacauuaucuaaaacaaacaaacaaacaaacaaacaaaaaacaggcagugccuuuaauccuaacacuugggaggcagaggcaggcggauuucugaguucgaggccagccuggacuacaaagugaguuccaggacagccagggcuacacagauacacagaaaaacccugucucaaaaaaccaaaaaaaaaaaaaaaaaaaaaaaaaaaagaaagaaagaaaaaugaaaaaaguucuagaccuuggaaaauuggaaacagcguccuacaagaugaacaagucagccuucauagaauuacaaucuggcaagaaggaaaccgaagccaaagagaagcccuauucucugcuuccugaaaucuagucuaggaagccugcguuggugcagcuggacaaagcugggcugagccagaccgagcugcauuacagggcagguagaccuguuacugcugcagcuuguccagcugcuccaggcacauuugcccugcuuuugcgucauaggaaaauugccagaagcugguggaagcuaaacaaucgacuucaggggucauugauuaacugccuaagacauaccuccguguucuacuccuaucaauggaggccucuggcuagauuuguuccagcuaaaccgugugucagccaagagcaagggugaguguguaaaauucacuugcauuggccaaagaggaaguaggaacacagaaaucucuccuuucuccaugaugaacaaagaacugcaaaagcugccugagagagcccgggaaggaaauggaaaagaaacugcagauugcagcuccuguaaucuuacuguuaggggccugcucuccugcugggaccaucuuuacuucaaugaaacuccuguccacagacucauaguaauggcuccuacccaaguaacauggacugcaggccaggaagugucuuaaguauuuguuuauuuauuuauuuaauuauuaauuauucuggcucuuuuuuugaagggggacauguucauuauccuccuuccucaguucuguuuauuuuauuuuauuuuuccuuuguaagucagggucucuuuauguagaucuggcuguccagggacuugcuaggucaaccaagcugguuccaacucacagagaucaccugccucugugccccuggugaugacauuaaaggcauguaucccugugucauaccgcgcucaguuuauuuuuuccuaaaauuuacuuuauuuuuaauuaugugucuguauuguggggauggggaagggucugugcauaugagugcaggugcccuugauggcuagaaauggccacuggaucccuggagcuggagcuauaagcuacuauggagcugcuggaugugggugcuagagcccucuggaagagcagccagugcacuuaaccacugagccacagccccuugguuauuuuuaaauuaguguccacucacuguaaaaaaugaagggcuuugcuuuaucaugguguuauauauaguacgccuugaucagccucucccuccuccccuugucuucccaccagcucucagucucucagugagccucuguuucuccuuucauggcuuuuuauguuuuaugacuuagauugcagaucugagaggaagccugggaugaguccuguuacaugacgacacuccuguauuuaaucucugcauaacugagaggccagugugcccacuugucaauugagggaacagauuagcauugcaugguuaauaaguaauaaaacucgacuuuacgcggucuuuccucgaugccacuagcuuauauaauacguuccuuuuaucucccuugguuuccauuccaacucaaacgugucucagccagcaacaugguuaggugcccuacauaugaggagcuuuuuguucuuagcccccaaacaucuggcugcaucccuccauccugccucccuuucucaaaaucacacuuucaaaccucuacuguucugaucugugugugagagcucgcagggcagugggggccggggcagagaagccggagccacagacaguuuuuccgacuucugcuuugaggaaaugaaggcaggguucuaaagggagaaagcugaaugaacacugggauggaguucagcuccucaggagacauagguuaaaaaccauguauuaaggggcugaagcaauggcuccauagauaacucuucauuagacccacagcagcucacaaccuucuguaauuccaaucccagggguccuaccggccucugaggugcgcagacaaacauaaaggaaaaacauccauccauacaaaacaaguguuaagcuaaaacguugucuuaaaacccaacuaggccccaggccaccuacugaggauaccauagggguguuuacaaauacagugguaaagagcccacgggggcggggagggggggggaagcuguacgcuccugaaacccauccauccgcugaggguuucgucagacucggggugugguucagagaugaagcccagaguuagcauucaagagguucuggguucaaucuccagcaccaaaaaaguauuaaaaggcuaaacaaauagauaaaaugaugauuuugcaacuacuacagaguaaacaaacaagaggccgagaaaggggugagggugggagcccagaggacgccaggucaagggaagggaaggaaaggaaagaaugcgcugcucuggaagaggaagggaaggagagcugggacgggggcaguagcggggggggggagcgggggggauggcgugguggcguggggggggggggguuagagcagcuaaaggccuguuucuccagaaugagaacccagcuggugggaucagcccuuguuacuucccagcuuuaacucgucgcucagcccccacucucacacccccuccauauuccauauuuuccuagcuuccuggguggcagacccugcaguccccagagacacugggaaauggggugagacaucgugagaaagaacgacaacaaacuggauccucugugucaucgcucggucccauucuagcauggccacaagaaaggucccugaucggagaggacagugaggcuaacugggcccagcuggaagucaggauuccagauguaggaguuagugcugaaaccugaaccugaggucucuuuauuuucccucccugacccaagcccuggggaaauuuuccaucacaaacaaguuaugcauuccuaacuaugggggccuccugcccucucccuccaguuuccuuucauccucaguacccuccucccaucugugcguaagggucugugugcacacucgcacacucgugagggucugugcgcaacucggggaguccgugcucucucacuggccccgguuuaagugugugcguucuuuggaaagagagcgugagcaggugugagguagucucagcucagguguagaugugaagaugcuggcaagaccguacguaaggcagauaugagaaaacggauguuuguuuaugccuacaggaagcgguguaugaaagguggaaacagugaagcaucuaagccaaguaugaggcuuauuuguuuuccuaagcauccuugguugaaaaaaaugagagcucuucuagggcugacaaauaggaaaaaguguuugcuaccaagccugaggaccugaguucaaucccagagcccacgugguaggagagaacugacucccacaaguuguccuuugagccacacaucaccaaacaaauguaauaauaauuuuaaauguuuucagguugaacugagggagguguuggcccacgucuuuauccagacacucaggaggcagaggcagguggaucucugugacuucaaggacagccuggucuacagagugaguuucaggacuuccagggcuacacaaagaaacccugucuugaaaaacaaaaaaacaaaaacaaaauaaauaaauaaauaaaauaaaaauaaauaaaauaaaacuuuuggguugaauauagcucagugguagaacauaaggcuagcauacacgaggcucuauuuaaaguccccauuuaaaaagaagaaaagaagucccauuuuuuuuaaauuaaauguauucauuuuauuuuauuugugagcaguuuugccugcagguaugucugggcacccaucuguguaucuguuuccaggggagauuggaagaagccauuagaaccccugggacuagccaggcgugguggcacaugccuuuaaucccagcacuugggaggcagaggcaggcggauuucugaguuugaggccagccuggucuacaaagugaguuccaggacagccagggcuacacagagaaacccugucucgaaaaaacaaaacaaaaacaaaaacaagaaccccugggacuggaguuauggaugauggugagccaccauggggacacugggauucuaagucaggcccucugcaggagcagagacacucguauccuccgagccaccucuccagcuccccagccuuucuuaggacauuguuuaucugagaagucuagaggaauuuauuaauguucagaagcuugcaggacccagcuggucuaaggauacugugugugcaugguucugcauauaguucuuuauuuucuuuuucuuuuuuuuuuuaaagauuuauuuauuuauuuauuauauguaaguacacuguagcugucuucagacacuccagaagagggcgucagaucuuguuacagaugguugugagccaccaugugguugcugggauuugaacuccagaccuucagaagagcagucgggugcucuuacccacugagccaucucaccagcccuaguucuuuauuuucaucuucacuuaauaagauuauggagggacuggagagaagccucagcagucaggagaaccugcugcuccugcaaaggcccuaauuugguucuuagcacccaaaucaggcagcuuauaccccaccuguaaauccuguuccagggguuccagcaccuucuuauggcucuuuugguccuugcacauguggggugcacauauaugcauguacacacacacacacacacacacacacacacacacacacacguuuuuaaggaugauugagcaagaacugcuugcaaggcccugugcuggguucuaugaaggacagggugugugaaccacagcgucugacugaaugauggggaaaaucauauauacucaccaggcucacaugagauaaaguuccgacccagguacagcccagagcccuggagccccugaauguccuuucuccaaugacacucaauggauuaccuaaaucaagugaucucaugcuaguccuggagccucauuucagucagguugcuguuagucccugcccgaggucccuacaguagcuuguugccccucauauucuuccccucgggggcaugguccucaucccaggcagcuuccaguuuagacugcucuuauuccuggccugugcucuaugaucuggggucaaacguggguuuucagccugucuggugagcucuccucucugcccagcuccucucccaccaucccacuguuagcacuuuccaugacuccuacacaggaaacuuacugugagguggcuuuucuugagauucccccaaaucaauccuguacuuuuccagcuuugagccucugcugauuuuuuucuuuuuuuucuuuuuucuuuuuuuacagucacccuuuacaucugcaugugucauaucccaccuaacgggucaucucaaaugucaccccugacugaagccucccuuacuaugagucagaugugaacacuaacuccucaggguccccaucagaagagucuggucaugguucccuccuaaguccaggggauaaaaucuuucagaccaaagugacagauuuaccuggcuugcuuuccucucauggaacugagcucggagcucucaagagugcacauauauucauauauaauucaauugcuuauucgggaguguguaugugugggcauaugugaccacguaugggagucagagggugacuuucuaagaauuaguuaucuucuuugaccacguggaucccagggaucaaacucaggacaucagacugagccaucucacccaaauuguuuguuuuaagauaucucucuuacucucucucucuuuuuuuuuucuuuuuuuucuuuuuuaguuuuucgagacaggguuucucuguauagcccuggcuguccuggaacucacucuguagaccaggcuggccucaaacucagaaauccaccugccucugccucacaagugcugggauuaaaggcaugcaccaccacgcccagcgauaugucucauuuuuacuuuaugcauaugagucuuuugucuuugaguauguauguguaccacaugcauguagaugccuacagagaucaaaaagggaaaagggcaucagaucuccugggacuggaugcgagaugccacuugaguucuggaaacugauuccagguccucugcaaaagcagcaguguucuuaagaacugugccaccagugucucccccccccccccuucuauguuaugguuuugguuuguuuguuuguuugucguuugaaacuggagcuugcuuugcugugucuuccugccuccgcuuggcaggcugggaagagggcugaaguuucauguugugauggguaguuuccaccacacuuucacucggacuguuagaggugcucagaaauguugacuucuguguucagggaaagcggucucucaagcauuacggggaucccguggguuccuaauggugcuauugacgacgggcacaaagucucauaauuuuagaaacuucacuuauuuugugacccaccuaguauggggcaaaggcaggagcuucggacuuccugucuucccucuaucccuuugaauagcgucucgggagugucccuaaguaaccauugcaguuuuguguccgugugcucuguugaaaucucugugauguguguaugguuuucacgugaacggaggcaggcagagcccggucuguggguucuaguguguucuuuaucuucuuggaaguuugugcaaugacuucccuccuguuuccugcgcauaccuccaaguaaguacgugaauguguuuucuguggucccuugaucuugcuggacuucacuaaggaggguggcuggaccaucugcuacgugucugagagccccucucuagcuaccucauguccggacgugagcuuacucccaauguuuuuacccacaagcauucacuacucccaggaaagaacgugcacuggggcaccuagagaauaaccaaucaaggcuccgccuacauuuugcuuccuccuuggaauuuccagccccuugcagccaacugcuccccagcugcgaagggcggaguuccccccggcccggccccuucuuuggcucuauaaguagcucugcuuugcgggggauuugcacuccucuacacucucugcacaacgucuaaauuaugugccacucgcgcaaccaucuccacaccaugacuggccugagggccccuucuccagcucccuccaccggcccggaacuccggcggggcucuggucccgaaauuuucaccuucgacccucucccggagcgggccgugguguccaccgcgcguuugaacacuucucgcgggcaccgaaaacgcagccgaagggugcucuacccucgaguggugaguaucgcccgagugggcaucaggaggucgcgucgcccuggaacuuguagguaacaacuaggcgcagggaccuucgaucugacguuucccucuuuuaucugcucagguccggcgccagcuaccaaccgaggaacccaacauugccaagaggguccucuuucuccuguucgccaucaucuucugccagauuuugauggcugaagagggugugucgcagccccuggcuccggaggaugcuaccagcgccgugacaccugagcccauuucugcgcccauuacugcgcccccgguccucgagccuuugaaccugaccucggaguccucggacuaugcgcuggaucuuaaagcuuuucuccagcaacauccggcggccuucuaaacgcgaugggucacaguccgaagaaacaaaggcaccauggauggguaccuggugcgagagaacguaucccaaacugggauuucuaaggcaacgcuaacucagaacacuaccgccaagagacaccgcggguccuggcuaggcccacuggggacggacagagacuuucuccgugucuaauuaauauuuauguauuuauguauauccuccuaggugaaggagggguguauguaauauuuauucuaacuuaugcaggggugcgagauaugccucccugcuguaacacagauauuuauuacgauuuauagggucgguaagacagaguugugggagggaggacccgggugguaggacucccagcuuggggauuagucugggggggguguaauaagauuagggguaacacuccgucuuccagcacuucaacucuguagucuguuguaaggcuuuggaagacccuugggaauccggccuuugaugucuucugguugcuucucaggggcagcugcaggagucuuggguccauggauugucagagggcggcugucuggggucgccuaguauguauguucugugaacacgaauaaacuugauuugccugucauuauuaucugcaguucucgaaguguaucauucaa

SEQ ID NO: 8568 - RNA, 4391 nt, Mus musculus
agccuuuuuccaauucccauuuauuuuuggcucuggggcgaugucaacuuuucaauaugaaaaaaaaaaaaaaagcagguacaacacgaaauagaaagguaggaaaugaccaagccaagggcaggaggagcauggggcagagguggugacagcccaucugggcagugucugaaagacccagguggaaacauacuuucccaaguguggaguuucagcgggaauugggaguguucagagaccaagaccaagaccuugccgcacccccaacccccaucucuccgagaaaggagaaccaauacagggaagacacuuccaauggcagauuuggcucaggacagcugggaggauauaaauggagauaauacuguuaauaccucuccugaggcugagagaugaggcaggagaaaaacaaaacaaagcccugcugacugaaagcauagguggauucuaaauggcccugacuggaaaaccccacccccuucucuuccugguggucucuaccuagcaucccugauccacuacuuugcuuuaagaugaugguuacuauccgaguucuuagaauugggcuggguucuacacaggaucuggagcagaccucagguuucuggagaauauucuggaauauuaacuggacagucaaauaauaauuuaaaaaaauggauacuuguugggugauaguggcacacgccuuuaaucccaacacuugggaggcagaggcaggcggauuucugaguuccaggacagccugggcuauauauacagagaaacccugucuggaaaaaccaaaaaaaaaaaaaaaaaaaaaaaaaagauaccaguaggaagcacaggguaacaaccagaaugucagaaaucuaaguuugucagaguggaaagagaaaggagacauuccacaaacaaauauuuauugagugccugccaugugccaggcaccauuuacccccaaugagaaaacagaacaaaacaaauacaagacagaggcagcagaaagaaacuggaggacaaagggcaguuggagaaagcugagggaucuaagcagccugagcugaugcagggcucucugccuuaggccuccucuucugccuccucuccgaaauccucuuccucuuccgcgguggcauccugguacugcugguacucagagacgaggucguucauguugcucucagcuucggugaacuccaucucguccaugcccucacccguauaccaguggaggaaagccuuccggcggaacauagccguaaacugcucagagaugcgcuugaagagcuccuggauggcugugcuguuuccaaugaaggugacugccaucuugaggccacgcggugggaugucacagacagcugucuugacauuguuggggauccauuccacgaaguagcugcuauucuuguucugcacguugagcaucugcucauccaccuccuucauggacauccguccacggaagacggcggcaacugugagguaccggccguggcgcgggucgcaggcggccaucauguucuuggcaucgaagaccugcuggguaaguucaggcacagugagggcccgguacugcuggcuuccacggcuggugagaggggcaaagccaggcaugaagaaguggagacgugggaauggcaccauguugacagccagcuuucgaaggucagcauuaagcuggcccgggaaacggaggcagguggugacgccgcucaugguggccgagacgagaugguucaggucuccguagguuggcguggugagcuugaggguacggaagcagaugucguagagggccucguugucgaugcaguaggucucauccguguucucaaccaacugauggacagacaggguggcauuguagggcucgaccacgguaucagacacuuugggcgagggcaccacacugaagguauucaugauacggucaggauauucuucccggaucuugcugaugagcagggugcccaugccagagccagugccuccacccagugagugggucagcugaaagccuugcaggcaaucacagcucuccgccuccuuccgcaccacauccaagacagagucaaccaacucagcucccucuguguaguggccuuuagcccaguuguugccugccccagacugaccuggaaugcaguaagggaaaagguuuaaucacuaagauaugagagaaacacaaauacuucuuaaucuuucaacgacuggaauaauucaguugagcaaauagaaaucgauuccaccuaacucaccgaaaacgaaguugucuggucugaagaucuggccaaaaggaccugagcgaacggaguccauagucccagguucuagauccaccaagauagcucgagggacauacuugccaccugcaggaauucaagucaauguuugacggaucagcaaugcauuaccucugggugggagaucagccacaaagcacuaaaguugucauuccaggcacuaccaccugguggcaguagagcuaaucuuuagucccuuagggugugagucuagggaaaaaaaaaugggaaccaugcagagggguaauagauacuuagaaguguggaaaaacagggcguggugaugcucuccuuaaacccagcacuugagagguagacgaucuaugggaguuccagggcagccagugaugcauucaucugggcucacuguccaauacaggggacagggaauaaauguuaaguggggauuucugcccucaccuguggcuucauuauaguacacagagauucgguccagcugcaggucgcugucaccgugguagguaccgguggggucgaugccauguucaucgcuuaucaccucccagaacugcacagggaagagcaacgaggccucaaugucucaaguccuaaggcaugccucccgccccucauuucaauuccagacacgcugaaacgaggcugaggugaagacacugcaauuccguuaucugcuugcggaagucccauggaggaaccuacgcgauggaaggcuaaaaccuuucggcauaggaccggugaugggugggucaggcgcuauaaaccucuaugugggcggauuggagcccaccuauuuggcuuugcacccagguuggcuccugaagccaggaaccgcccuuccaggccagcacaaaagaguugggggagaaaggugcggccacugcagucgcccaccccuuacgugcuccacgugacugcgguggcgggccgcuccuccagcaaaccacaaaggcgggagcagcgcgggcggggccuagcucgaggggcggggccagugcgcccccgcggguaggggccgcauugucccugcgcgccaggggcuccaaccccgcccccaaagggucccacccuucggcuacaauuuagcggccgcacuuccucccuccccucccccgcuacauuguuaauugcuagcaaaaaagggggaaaaaucuuuaaaaagccccauugccuaucuuuauucccuuccuucccucuccuuagucucccagacagucucacauauuugaaaagcucacuuucauaccgcucacacccuaaagggcaaugaaaaguaaaaguaggccccuauacagagucauuaccuaaaaaaagcauugggauggcggguucgauggaguguccaagccuuuguugagagguaaugcgcaccgggcaccucugcagcugcccgccaaaccucgccccuuccccccuccauucuguuccaguagagcccuccaggcuggguggggguggcgcaaggggaaaaccucgccucggcuuugucucggaucguuuccgcaucccuccaguccucgaaccguuagaaaaccccuuuuaagaccagcucuucacagucccucagccucuccuuuucccuaaacucgaaaggcucuuuuauuagcuuuccgaaaaugugccaagaaaaacauuuccucauuuuucaauaucagaacgcuagcuacaaauauggguuauauuuauacgugaaaaacuuugaggggccaaaucugacggguggagaaugcaagaacuccgugaacaaugcucacaauuaacacagaauucucaucuuuacauauuucagcuaaaauuuuaaaguccuuaccuuagcaccgaucugguugccacacuguccggccuggaugugcacgauuucccucauggcuacgguuuacugaaauaauuguuuuugaugguuccaauguagguaccgaacaagaaagaaaauuaagguuuuugggguuuuuuucuucugggccggucucagacugaaaggauggaccggagcccgggaggcugcagcagcgagaugcaagcacgaccgcaggaagguucuaagaggcagaagaggccggcgagcgcaggagggaaggcgcgcagggcggggcucgcguucgcgcggccgggggcgggaga

SEQ ID NO: 8569 - RNA, 1859 nt, Mus musculus
uguucuuggcaucgaagaccugcuggguaaguucaggcacagugagggcccgguacugcuggcuuccacggcuggugagaggggcaaagccaggcaugaagaaguggagacgugggaauggcaccauguugacagccagcuuucgaaggucagcauuaagcuggcccgggaaacggaggcagguggugacgccgcucaugguggccgagacgagaugguucaggucuccguagguuggcguggugagcuugaggguacggaagcagaugucguagagggccucguugucgaugcaguaggucucauccguguucucaaccaacugauggacagacaggguggcauuguagggcucgaccacgguaucagacacuuugggcgagggcaccacacugaagguauucaugauacggucaggauauucuucccggaucuugcugaugagcagggugcccaugccagagccagugccuccacccagugagugggucagcugaaagccuugcaggcaaucacagcucuccgccuccuuccgcaccacauccaagacagagucaaccaacucagcucccucuguguaguggccuuuagcccaguuguugccugccccagacugaccuggaaugcaguaagggaaaagguuuaaucacuaagauaugagagaaacacaaauacuucuuaaucuuucaacgacuggaauaauucaguugagcaaauagaaaucgauuccaccuaacucaccgaaaacgaaguugucuggucugaagaucuggccaaaaggaccugagcgaacggaguccauagucccagguucuagauccaccaagauagcucgagggacauacuugccaccugcaggaauucaagucaauguuugacggaucagcaaugcauuaccucugggugggagaucagccacaaagcacuaaaguugucauuccaggcacuaccaccugguggcaguagagcuaaucuuuagucccuuagggugugagucuagggaaaaaaaaaugggaaccaugcagagggguaauagauacuuagaaguguggaaaaacagggcguggugaugcucuccuuaaacccagcacuugagagguagacgaucuaugggaguuccagggcagccagugaugcauucaucugggcucacuguccaauacaggggacagggaauaaauguuaaguggggauuucugcccucaccuguggcuucauuauaguacacagagauucgguccagcugcaggucgcugucaccgugguagguaccgguggggucgaugccauguucaucgcuuaucaccucccagaacugcacagggaagagcaacgaggccucaaugucucaaguccuaaggcaugccucccgccccucauuucaauuccagacacgcugaaacgaggcugaggugaagacacugcaauuccguuaucugcuugcggaagucccauggaggaaccuacgcgauggaaggcuaaaaccuuucggcauaggaccggugaugggugggucaggcgcuauaaaccucuaugugggcggauuggagcccaccuauuuggcuuugcacccagguuggcuccugaagccaggaaccgcccuuccaggccagcacaaaagaguugggggagaaaggugcggccacugcagucgcccaccccuuacgugcuccacgugacugcgguggcgggccgcuccuccagcaaaccacaaaggcgggagcagcgcgggcggggccuagcucgaggggcggggccagugcgcccccgcggguaggggccgcauugucccugcgcgccaggggcuccaaccccgcccccaaagggucccacccuucggcuacaauuuagcggccgca

SEQ ID NO: 8570 - RNA, 1859 nt, Mus musculus
ugcggccgcuaaauuguagccgaagggugggacccuuugggggcgggguuggagccccuggcgcgcagggacaaugcggccccuacccgcgggggcgcacuggccccgccccucgagcuaggccccgcccgcgcugcucccgccuuugugguuugcuggaggagcggcccgccaccgcagucacguggagcacguaaggggugggcgacugcaguggccgcaccuuucucccccaacucuuuugugcuggccuggaagggcgguuccuggcuucaggagccaaccugggugcaaagccaaauaggugggcuccaauccgcccacauagagguuuauagcgccugacccacccaucaccgguccuaugccgaaagguuuuagccuuccaucgcguagguuccuccaugggacuuccgcaagcagauaacggaauugcagugucuucaccucagccucguuucagcgugucuggaauugaaaugaggggcgggaggcaugccuuaggacuugagacauugaggccucguugcucuucccugugcaguucugggaggugauaagcgaugaacauggcaucgaccccaccgguaccuaccacggugacagcgaccugcagcuggaccgaaucucuguguacuauaaugaagccacaggugagggcagaaauccccacuuaacauuuauucccuguccccuguauuggacagugagcccagaugaaugcaucacuggcugcccuggaacucccauagaucgucuaccucucaagugcuggguuuaaggagagcaucaccacgcccuguuuuuccacacuucuaaguaucuauuaccccucugcaugguucccauuuuuuuuucccuagacucacacccuaagggacuaaagauuagcucuacugccaccaggugguagugccuggaaugacaacuuuagugcuuuguggcugaucucccacccagagguaaugcauugcugauccgucaaacauugacuugaauuccugcagguggcaaguaugucccucgagcuaucuugguggaucuagaaccugggacuauggacuccguucgcucagguccuuuuggccagaucuucagaccagacaacuucguuuucggugaguuagguggaaucgauuucuauuugcucaacugaauuauuccagucguugaaagauuaagaaguauuuguguuucucucauaucuuagugauuaaaccuuuucccuuacugcauuccaggucagucuggggcaggcaacaacugggcuaaaggccacuacacagagggagcugaguugguugacucugucuuggauguggugcggaaggaggcggagagcugugauugccugcaaggcuuucagcugacccacucacuggguggaggcacuggcucuggcaugggcacccugcucaucagcaagauccgggaagaauauccugaccguaucaugaauaccuucaguguggugcccucgcccaaagugucugauaccguggucgagcccuacaaugccacccugucuguccaucaguugguugagaacacggaugagaccuacugcaucgacaacgaggcccucuacgacaucugcuuccguacccucaagcucaccacgccaaccuacggagaccugaaccaucucgucucggccaccaugagcggcgucaccaccugccuccguuucccgggccagcuuaaugcugaccuucgaaagcuggcugucaacauggugccauucccacgucuccacuucuucaugccuggcuuugccccucucaccagccguggaagccagcaguaccgggcccucacugugccugaacuuacccagcaggucuucgaugccaagaaca

SEQ ID NO: 8571 - RNA, 5971 nt, Mus musculus
ucggaaccggucuccauaugcaguccaagcuaacuucaaauucuccugccucacccuuccgaguacuggaauuacaggcacgagccaccacacccagcucuaaaacggucacuauacaaaaaucuauguugggcgggguggcgccguuuguaaccccagcacaucagggauugaggcuggagaauaaggagugauuaucuuuaaaaacaagauguucuuuauguuuccacgcaagggaggcucugucuucacuuuccucgagaacacugacagcgcugagauucgacccacaaggguagccgcagaccagcugcccugacgacgccugggauuccaacuccgcgcugugacgcgccgcucgcgguccccgccuugccgccagcacccccaaggaggcgggaccugggcagggccagcagucgcgggaacccugagcccgccuucuccucaggcuccgcgcugcucgccauggcaccggcgcugcugcugguuccugcggcccucgccuccuucauccuggccuuuggcaccggaguggaauucgugcguuucaccucccugaggccgcugcuuggagggaucccggagucuggcggucccggugagccgcagggauccagggcgagcugaagcggagaggaggagccgaagcagcguggcgagggcggggcauggaaacaaaugacagggaaaccgccaaagcugggaggcgcugcugggaagggagcggaggcuaaaucagaaacuccaagauuagucuugugcagaaagcugcgagugaagacugacagaguacggcccggggugggggugggguuuugugaggagagccaggggaaggagaaagauaaaaaaggggaaacgcugcuagaaaaccccagacagcgagaugugguagcucacaccuuuaacccuauuauuggagggggcagaggcaaacggaucucuugauugaaggucuaucauuacugauuucaaggccugaucuauugagugaggacuauguauguagagauacccugucuuggaaaagcaaacaagaaaaccacaccaaagaccacuucccuagucuccuugcuugcuugugugugugugugugugugugugaaugaauauaauuguggaaugugugcuugugcuccugugugugcagugcaaacggcugcugaaggacaaccuugaguuguuuguuuguuuguuuuuggguuuuuuuuuucaggguauuucuauguauccccagcuggcuuggaauucagaggccuauguauucuuuuuuuuuuuuuuuuuuuaagauuuauuuauuuauuuugguguuuugagacaggguuucucuguauagcucuggcuguccuggaacucacucuguagaccaggcuggccucaaacucagaaauccgccugccucugccucccgaguacugggauuaaaggugugggccaccaugccuuucuuucuuucuuucuuucuuucuuucuuucuuucuuucuuucuuaagauuuauuuauuuuauguauaugaguaaaccuuagcugucuucagacacaccagaagagggcauaagauccuauuacagaugguuguaagccaccaugugguagcuaggaauugaacucaggaccucuggaagagcagccagagcagccagugcuuauugaggggggaggggggagacaggguuucucugcauagcccuggcuguccuggaacucacuguagaccaggcuggccucgaauuuaaaaauccaccugccucugccuccuagccaaugcacucucucucuuucucucucucucucucucucucuuuuuuuuuuuuuuugguuuuccaagacaugguuucucuguguagcccuggcuguccuggaacucacucuguagaccaggcuggccuccaacucagaaauccaccugccucugccucccaaguccugggauuaaagauaugcaccaccacuucccugcucuagccagugcucuuaaccgaugagccaucucuccagcccuaucucccacauauucuugggacauaguuguuuuuuuuuuacagagaccugaggcaaaccaagagguucgauggcucaccuggaacugggguuauagauagcugugagcugccauguagaugcugagaaccaagcuggguccucacagcaaguguuguuaaccacuaagacucucuggggauucuucugucccugccuucccagcacuaaaauuacuggcacacaccaccaugcugggcuugaauucagguccucgggcuuauacaacacuacauagacugagccaucuccccagcccucccaccuuguuuuuaaaggugacccuaccuaaaaaccuuccccaggaggaggccuagagaagauggaagauugaaggaacagcagagugaacugggaauggccuugacaagaucuugaaagcaucaggggcuugacauagagcuuccaaagaugugguuaggggaauguccuagccaucuuaacuggccuuuugucccuuuccuucccaacucccucagaugcccgccacgggugguuggcugcccugcaggaccggagcauucuugccuccuuggcuugggaucuaugucugcugcuacuguuugugguacagcacagccuuauggcgacugaggcagugaaggcguggacaucccgguacuuuggcguccuucagaggucgcucuauguggcgugcacagcccuggccuugcagguaugaggccuggccaagggagacugguggaaccgaaagaacaugcagagcucagccuccaucccuccugggcauauucuccuaucagcaaagcuguauauauuugacauuccccagcacacuaagagagucucaccuuugcaacauuguucauguuuuauugcuucagcucugaauuccucccggguucuuauccuacaaccucccuaggccucacaauagcacuugucuuccaguugguauucucauggauguuuggcauaggcuaguugagugauuauuauccaccagcccccaucccguccagucuccaaaaaauccuguguagggaugggccaucuucauguccuugguaccccucccagaacccuccacaugguaaauauuuacuguuuauaccugucggaaagaguccucguagguuauuguggggcaagggagaccacuggugugcccagucucucaucuuuccccaguuggugaugcgguacugggagacuacacccagaggcccaguguuaugggaggcucgggcugaaccaugggccaccuggguaccucuccucugcuuugugcuccacguuguuuccuggcuccucaucuuuagcauccuucuggucuuugacuacgcugaacugaugggccucaagcaggugagaaucccacaccccuacgugagaucugcgucugcaagucucucccuccugaacucuucugacuucucucggcuuuguagugccucuguuuuccuccagcuugccuuaaaggagagugacuguaggucuccugggcuuugaggguggaugcugggaagaggacggaggcaacugagauagagggcuugacuuugaguuccgugauguucucucuuccagguuuauuaccaugugcugggacugggcgagccccugucccugaagucuccucgggcucugagacucuuuucccaccuucgacacccaguguguguggagcugcugacugugcugugggugguccccaccuugggcaccgaucggcuccuccuggcucuucucuuuacccucuaccugggcuuggcucaugggcuugaccagcaagaucuccgcuaccuucggucucagcuacaaagaaaacuccaccuucucuccagaccucaggauggggaagcagagugaggagcuaguucuaagcccugaauuuacuucccaccucaaaaucaaaucccuuaguauccagacggaguuugcuucagaccgcggaggagguuggaagucaugcccugaaggggcugugcccucuccugcuggagaacucaguuccugaaucuugauccugaauucuuauucaaaguuuccuccacuggucuucaagauccgccucucaccagccaagaaugguuacaaaacucaugagucuccuuuucucuuagagcaugaccuccacacacacugggucaguucacacaggggagcaccucagcucacacuggggagcacucacuccccuggcacuguuauuggcucugcaccucagggauucccuuccauguuuccaccucagggagcuaugucagggccuaucugaaaguuuauaaguaguggcucuuuuguaccgcggcugugcuuccuccccacuccugccuuaguuucuccuuaggucuuucccuacagcucuguguggucuccuaaggcgacgucucccgauuuuaacucggguugacucagggcucccugcucucccaaaggauaugcgcugcagaaaaaauaaaauuuuauacauaugauauccacuugucuguccaugacucucaagccgcagaaccaauugugggaaggaagaugagaccuaguuuuugcggugauagccgagcacucuaaaacgaucgcaaggcuggggccacaccccauggacccgccccaucucucagucguccaguccuguucccuccaaauauuaguuucuccgcguauaaaucagggaacccacgggagacagaauaacucucugggaggagagcgaacucccaaagccauuuugccucagaccccagggccuggcagccgccuucucugccacgguaacaaagacuggcuagggaaagaaaaagcguggggaggagcggcgagagaugggaagggcggguccgacuccaagcagcugccgcuuccuccccaugucccucagggggccugagucacgggccgccgccccgggucggccagcuggagaagugggucuggacaccccgcuucuucggggcugcaaggaaggaagcgggugaaggucucuggagacagacaacggagagcgaggggauagccacagcaagagagaagucccaccagaguccacgcgggaaggagggcagcgaagccccgcccuucgccgggcuccucccugcgcccccuucccucgccccauuguccguagacaaagcggucgccgcccccgccuggcccccagucugcgucuccgucccuccucuuaggcucccucuucccuccuccucuguuucccucccucccuccggaucucccuucgccucucuccuccucuuccucucucccgacgccugacuccacugcaccuccuccuagggaccccgaggcguguaaguugacuauguggcucccacuuuaagagaagugccuccuggcuccagaucuucccuggagugucuccccuuuugcauagauugucccuucaguucccucuggugcacaacccuuugggucaagguccccugagagccggcucccugguuggggaagacagcagaggcgugauguggguccucgucgcgcccgaguucuggagcguauccgguggggaggccggcgagauuguagggacugaacgcggcuggacgccaggguucugggaauguacggggcugcacacuugcucggguaccaaaaguccccaaggaggguauuuccccugacccgccucgggggcgggaaagacagugggguaggggccggacugaggggcggggccgagcgcagccgggaaggcagccgggagcugcgggggccccgugcgaagaggcgccggcgcccuugccuguuucccggucuccccuucuacccuggaccucugcccucuacaucuguccucaccuccucaccuccugcccgaucuccucgcccuucgccgucugguucccuguucuucccguuuaucucccccugcguaccgggggaggcagucuugacugaauccgcucacuucucagccccggcuccuccggcuccucucucucuccug

SEQ ID NO: 8572 - RNA, 12483 nt, Mus musculus
gugacguuguguggggcgugucuggucccgcacaaugggccauggaguucccguucgauguggaugcgcuguucccggagcggaucaccgugcuggaccagcaccugcggccuccggcccgccgacccggaaccacaacgccggcccggugacauuucaaacccgacccauggcccuucugucccgguuccucuccaaaccugauccaggaaccacgcccccuucucacugacuacuggccauuucuccugcggucuuacuuguguuuuggugaccuuugacccuggaucuagccggguuaauagaccuacaucuguaaccuuucaccaucuggccuaauguggccucaacaagaggcuauaguugacccgcccuuccuaccgcgucacaguaaccuuaacacgggagcugugaaaccaaagcuugggaucuggaggggugaggugaggugggaggugaggaagaguuccaagcaaagucagagacccuguggaggagccugggugggagccaagcaggcugccaggaaugacuuacacgaugcuguaaccuagcgagugucugaccgggccccucucucuguaguguggaucugcagcagcaaaucaugacuauuguagaugagcugggcaaggcuucugccaagguacggggcgccucuaggaggaggaaagggagauggguggcagauaaggagccaaacaaaguagaucuucaucucugcaggcgcagcaccucccugcacccaucaccagcgcuuugaggaugcaaagcaaccggcacguuauuuacauacugaaggacaccucagcccgaccgugagucuuacugucauuauucccugugaaucaaacucuucuuaccucccuuuuacaaucucucccagacaguugcuccugccugguucauuauuucccccaucccacagggcagggaaaggagccauuauugguuuccucaaaguuggauacaagaagcucuuuguacuggugagugucacugcaaacuagccauuuguaagcacuggugucagagaagaaaugggggcggggugggagacaaugaagaagaugcauggcuccuaaugaguauguguucuugaccucuuaggaugaccgggaggcucacaaugagguagaaccccuuugcauucuggacuuuuacauccacgagucggugcaacggcauggccacgggcgagaacuuuuucagcauauguuacagguacccaacaaccuuuaccgauuagucagaauagaucuaaaaggcucuucaccccgaagcucuaggaggcccugcuccauggcccacaguugguccccuuuucucuguauucccuuaccaggcucccaguauccugcuagcaugcuccuccuacaaccccugcccccaaguuuuccguuuuccugcagaaagagcgaguggagccccaccaacuggccauugaccgaccaucgccgaagcugcucaaguuccugaauaagcacuacaaccuggagaccacagucccacagguuagaggcucugcaccaacccuggagacgccuggcuaaguucuaccucggguuguuuccauguuguuuuagacuuaccucauuuucguguguuugaaugcuuugcucacauguauauacaugcaccauguucaugccuguacacacaaguuagaagggggugucagaacgugggaacuggaguuacagauguuuaugagccaccaugugggggcugggggauuugaaucuuaguccucaagagcaaccaagcgcucuaagcuucugagccaccucuccagucccuauuuuuguuuuuucaaauaaggucucagugggucacccuggcugugccguacucaccuuguauaccagguuggccuugaacacacagauccaucuauuucucgcuccagagugcuaggauugaagggaugcuccaccaccucagcuauacuuuuuaugaggacuuuaugccugagcucuguauugacagcacuccuaucccucuuucucccccuccagccccucccgugucccccucucccacuauugucucucauuauuguugcauguacaugugcacagguauauagauaggcuaaaugcauauauaaaacccucugagucccucuaguuuuguuuauaugcacccaucuccagggcuccaccguggguuuuguuguuguuuugguuuuugguuuuggguuuuuuuuuuuuaaagauuuauuuuauauaugaguacucuaucugcauguacaccugcaugccagaagagggcaucaaaucacaucauauagauagcuaaugagucaccaugugguugcugggaauugaacucgggaccucuggaaaaacagugcucuuagccacugagccaucucuccagccugcauuguggguuuuuaaaacuggaucucacuaaauaucucaggcuggccuugaacucacagugacacuccuucucuaccuccugaguaauggggucacagguaugccuugaugcccagcuguucuguguuugaaagacgcuugcuauauacacaccaaaccucacucuccucaaauggaugauccuccugccucagcuugccaagagcuaggauuaagucaugauguccagugugauuuauuuuugcaacuaaaucuuuuuucuccuuacucauuacauauucuagaagcauucauccugucuuuuggggagcuuugcuugcuuguuugcuugcuugcuugcuugcuugcaggcuuuuugaggcacagucucccucuggagcucuagcuauccugaaacucacuauauagaucagcuagcuucagacucuugagagauccgccugccuuugcucagagugcugggacuaaaggcaagcaccacaaaggucacccugccucuaccuccagaguucaucaccacaccuggacauuggcuguuuacuagaccuuauuuuauccccaaacacaacagcuuguuucuaccuuguucucccacaaguccauuacauuagucaucauuuauggaagauccagaauaauagacauuccaggccucaggaagcuugguuuaucaugggacagugauucugugaguuuagaaacacauuacuaaugcguucaacaacuguuuauuguguaucugacacuguugugggcacuaggaauacuuuacacaaccaaacaaaagaauccaaauguggaaccagacaaacaacuuauucuagggccaggcaaggguggugcaugccuuugacuccagcacugggaaggcagagcucugugaguucauggccagcccggucuaaauauuguuuucuggggcuucuaggacccccuggagaggcccugucucaaacaaacaaacaaaaaaccaaaaggcaugcuuuacuguugauaaguguucugagaaaaugaaaccagugcuggugagggaggggcuuacaggugcgagcgagucagauauuggcagagcucucaacagagcucucaacugagaggauagcucauuugugcgagagcaugaaggaaguguguggaggcacagugucccagaggagugauggccaguauaaaaggcugugcagugagaauaugcccacagcagugugaccgaaggaaaguaguaggugagagcuaaagccaaaggaagggagcacacggguagggccacacaggucaccugucuccuucacuuugcuugcugugccaaacaaacaagccauagagggagccaggguggaaguucagaagacggauaggaaagcagaaauuccugaugaaagggagucagggacagacccaggggcagcaguagagguaggaaacgguggcaucugaggguaaaacaaacauaauuuccuuauggaauagaugugggaaaaauagaguuaugauuggacccaaaacaauaggaauaggaagggugacauugcaugauauagguagauuggcuuucgggaaaacauuuaggagucuuuuuuuuuuuuucuuuuagauuuuauuuauuuauuuuauguauaugagugcagguaguugugagccaucaugugguggcugggauuugaacucaggaccuucaaaagagcagucagugcucuuaacuguuaagaaaucucuccaaccccaggagucuuguuuugacugguuuggaaguacaggcuagcuuugaacuuacaagaaaucuucguaccucagccucuuuaauccuaagguuauuaggagugaaucacuaugcccaguguuggaguugauuuuuaaaguagucaggaguuugagacuagccuggguuaccugaaaugcugagucaguuaaaaaaaaaaaaaaaaaaggcaguauuaaucucagcacuccugaagcugaggcagacagauaucugugaguucaaggucagccuggucuacaaaaugaguuccaguccagagaaagauucagagugagaccugucucaaauaaaaauaguagagaauggugggagaggcacauucuucacacuggacagguuagcccaauuacauggacauguggagcagcuggcccguaaguaguaccagcagauggccuguaaaauauuaacauuggcagguauccugugaacucuguuuaagauguguauguauguaugaguaccuacauguauguaugugcaccaugugcgugcaaugucugcagaggugggaagagggcccuagagccccuagaauaaagacaguugugagcagccgugagggugcggggaacagaggugaucagaagcacagcauuucuuuuuuguuguuuguuuuuccgaggcaggguuucucuguguagcccuggcuguccuggaacucacucuguagaccaggcuggccucaaaacucagaaauccgccugccucugccucccaagugcugggauuaaaggcgugggccaccaccacccggcuuauaucuauauguauuauaaagagguagugugguccaugccuuuauuagucucagcacuuggaggcagaggcaggcagaucucuguuguaaguucaaggccagccagucuacaggcagaucuacacagagaaacccagucucaaaaacaaacauauauguguguguguguguguguguguguguguguguguguguguguauacguauauauacacacacauauacauacauauacguauauauguauacauauguuauauuuauauaauguauacauacacaugugugugugacaccaccaccuggcuagauuuauuuuaucuuaugaguauaaauauuuugccugcaugaacauauaugcacuacggguaugccuggguauccaugaaggucagaaaaggguguuggauccucugggacugggguuacagguggucaaucaugagccaucuugugaguauuuggaguuaaaucagagucuucugcgagagcagcauugguucugaaccacugaagcaucucuccagccccauguuuuaaccuuggggcagggucucauguagcccagcuggccucuggcucucuguguagcuggggauguccuugaacucauccuccuaccuuuccccuccaaguguugggauuucgggcguaugucgcuguacccaguuguguguggugcugaggcuugaccccagcgcuccaugcaugguaggcaagcauuucauuagcuuagccacaccgagacgcaccucaugggcuuugugguccagguucuauacccacugugugaugagaagagacaguaugcucuguuugcuucaucuuccaggugaacaacuuugucaucuuugaaggcuucuuugcccaucagcaccguaagucuccuuaccuugugucagccuaguaguuguggaaagggaaaggaaagaggugggcucuuaguuccacagguccccacugagggccaccaccucuuccuuccucacagggccccccacuuccucucugagagcaacucgacacucucgugcugcuguggccgaucccauaccugcugguaaagccugcaaagacuggguggaauuaaagggcaguaaggcccaguuccucaggagguuccaggguggcagugcuaucugcuggcaauucagaacacccuaaagccacacauccauccagcagcgcuguuugcccuggcccugcugggagcauuuuacacaugggaagaaaucagauccugcuaacgcucaagcucacacacuaaccacacugcccuacuccaaagcacacccagcccuguucucugcaacgguucuuacuaagcaagcccuucaagagcuuggcuggccuccagugucagcagagccucugcgcuaggucagcucccucaaaacaggccacagucaaauugcuguaaauuccucaggcucugucagccagggagggacaggcaagugagcccagugguccuuucauuucuauucaugggauaguaaugugaauagucaagucuauauacuuguuuuaaaagcgaaugcucaaaauguguaacauuuuuaccuggcauggugacacaugccguugauuccagcacucaagaagccaacguagguggagcucuaugagucugaagccagccuagucugccuagcaagcauuacgccagccaaggcugcauaugagaucuugccuuaaaagaauuuuuuucaagaauaaucaaaccuauuuugacugaacucacaggcuggcugggugugguauccagcacuugaagcgggaauugcugaguuugaggccagcauggucuacagagugaguuucagucuugaaaaccaaaaaaaaaaaaaaaaaaagaaaaaaaagaaagaaaagaaaagacaagaagaaagccucacaggcugccaucuaccuuucccccucccuccccucuccccaguacauccucagggagagaggcauagccuuaagcagcuguguggugcuggcugguacagagugguuagccuuggggcugguuaccuugccauuggccaagaaaaguaguaauaguugcccaaagaacaacucauugcgccuuaugagcaucagccuaggcucccagaggcccaccaugaccaugacccaugaugguuaccgaaguucugaggcuaccauccaguaggcagugaggccaugccaccaucugggauggaugacaauccacagagggcugaucggguucuucuggucugugauggaaaaccuaagaggaagggaggaaacccacccuugcuacacaguagcucccauuugcugaagcccuuuuguagauucacacuuugggaggaaggaauugagacaggaucucuguagcucugacugucuuagaacuugauacaacagggugcccuugaacuuccugaggucagccugccucuucuucucaagugcugggauuaaaggccuaugucacuaugccuggcuccuuguucuuuugagacagggucucacuauguaacucuguccucgaacuugcuauguugaucaggccugcccauaccuuuccaaugcagagacuaaaggugugugccaccacuuugaacuucaucauuucuauuaguauuuuaaaaccuaauuaaaacucagaauuuccauaucuuuuuguacaggaaggagagguucugcaacuccucuccccucccccaaacaauucccaauuaaccaagggcuuuguccaucucaucuagagggacccaggguccucacuggcccagcugggacuauuccacugccccagaaccccaggggggccugacaacacccauggacaguaagagcucgccuccccuuggccauccuuuccugcaucucccaggccccggucuccccuggaucuuucuccugaaacucuguguuuggccuacuccuucuggcucuccccaaaagugcuccaacacuccccccaaauuccccuuggugugcuggcuuugccacagcacggcuucuguacuggcauucccaggaggagcuguggugucagggagcaaaagcuugggacuaugggaaaguggcagggaggagggauggauagagcaacuccuaaaacuuccuuguguccccacuaccaccagcuccagcacggaagcugccaccaaaaagagcagagggagacauuaagccauacucuuccagugacagagaauguaaggaacuugaggguggcuggggggcaggguggucaggggaggguagcugggcauaaggacccagggaaagugguuaagggaagguaguaaccaagggacaguaaugaaaggcuacaguugcuuucugccuaaucuuuauuuauuuuuguuuguuuuguuuuucgagacaggguuuguguaguccuggcuguccuggaacucacucuguagaccaggcuggccucgaacucagaaauccgccugccucugccucccgagugcugggauuaaaggcgugcgccaccaccguccgaccugccuaaucuuuauuacugugucucuuuucccuuucuucucucucuuacucucuuuguuccuccucuucccaguccugaagguagcuguggagccuccuuggccccugaacagggccccucggcgugccacaccuccagcccacccaccuccacguucuagcagccugggcaacucaccggaucgggguccccuucggcccuuuguuccagagcaggagcugcuucgcucccugcgucucugucccccacacccuacugcacgccuucugcuggccacugacccuggaggcagcccagcccagcgcagacgcaccagguaauaaagccugcaaguuugggagccucuggaugugaugaaguuagcagugguaaagaauaaggugaaucuccaaccaacgugaaauaaugaaaucuuuaccaaaacaaauuucugcagcacuggucuggaaagauugaaggagcuggggguggggugggggugggggcuuuauauggagccauggaccagaguuauauuucgagggucauuggaagaguaggaagauuuagagauccauuggugggggcuuugaaucuuucaagacucuaggaauguugguuaacauugcuggggauaggcaugugucucacagauugggagccaguagguuccagggccacggcauguaugccaggagcccuuccaggcaggcaaggagugggugucuccuuuauuucuccucuuagcuuccucuucaccucugacuucucuguuuuucucucuccccugccuucccucuccccuucuccuguccauaacaucccccuacagcucccuuccccgaucugaugagagucgauacugacaggaaacuugggagggcagauacacucccuccugcaacuugcaacccacucuuccaucaagauuuuuucuuccucuuucuugaacaacuggguugccaggguucuaacuagccuaacacuuuguagcuuuucuuaccacagaagacaccccuguacucccaaccugugcuaugaauacucucccacagacaggcuguucuguucccagaucucuugggcuaaauggcuccuacugacucccuagagaagcacacucugcuuacggucagacuccagaccaccagagguccaagggccuccucugccagggaaaccuuuaaggaguguccugccaauggauuaauucccuucacagugcccacuaguagcucuaauccugcauccuccugccaaaccugcccuuuuagucugauaacuccauccccugagcaagcucugcuucagagcaguucuugcugguaggaccaggguguggcuucccaaccggguccucccaauauugccaaacucuuacuuuccaaguguuauguagauaugucagacuaauguugcucugggggucucugcaggagacacacagacuccaccacuuucuucagauaagcugucugucucuuggcaguagaacccaggaaacagucuaggaccauuuagcugugucucugauaagccugguccauuagauccuggaauccccccguccuccuuaguaaauacacuugugagauugucuugagaugagauggggaucacccuugugcuaccccgacuucuuuuuccuucauagcaagagcuuccuucccugcuuccaugcccaggguguagaaggacccuucuccuggcccccuauucccccauuagaucaggugccucaauguguccccuaaaguccuugggagcaggaccucccuccucccucccuccuuccagauuccuuuucccucucaguguugucucaauaaaguguggguucuucuguguuuucuaaauugacauuuucagcgaaaaacaucuuaagguuucagcuucguuugugcuucaugcucuuccuggggucucagugcucuuugucccucuuagauucagcucugagaucuguagcagagcucaaagccuccagccuccuucugagucucugccuuuccccauacuuacugcugguucuauucuagaguugcaguaacuguagaccucucuacuaacuuggaagccauagguccccuacccccaguaacauauaccuccuucccuggccagccuugguaagauguggauuugcuaggagcuugggcucacuagccucaggacuguuucuggaucccucuccuacucuuugaccucaucaugucugcaccacaaaccccacagugcucucugaagacaaguccugccuaagaucaagaauccucacagggagcccgaugguggugguggcgcacaccuuuaaucccagcacuugggaggcagaggcaggcggauuucuaaauucaaggccagccuggucuacagagugaauuccaggacaaccaaggacuauacagagaaacccugucucgaaaauccaaaaaaaaaagaaagaauucucacaggguacugggcaugguggcacaagccuuuaaucccagcccuugggaggcagagguaggcggauccugguaagaguuugaagccagccuacauagcaaguugcaguccagccaaggcuacagagugaaagccugucaauaauaauaauaauaauaauaauaauaauaguccaacagggucaaccaucucuaaaaacuacccuuucuuccuugcuacuguggccugaaaguucuuuuauuuauuugcuuauuuauuuauuuuuaaagauuuauuuauuguuauauguaaguacacuguagcuguccucagacacaccagaagagggcaucagaucucauuacagauguuugugagccaccaugugguugcugggauuugaacucaggaccuucagaagagcagucggugcucuuaaccgcucgcugagcuaucucgccagccccgaguucuuauauuuaaaagaaucauuuuaagggaguucacacauucaggcaccaugguucagcaagcuccuuccugcaugcccaaguguuuuugacauaauuagaucacaucacacaccaucccaguuagagcaaagcaacagugcaggaugguacaggaaaucuugaaguauaaaauaagcccuccccuaccuuugcuagaagucuuagacaagaauccuuuagggagguagcugcccaucgucuuuguucccacgcuaucccuccuuucuccucugaccccuccaugccaccuuuucauccugagccucuuccccuucaucucccguuucuucuacagggggacucccugggggcugguagcccaaagcugccacuacagccgccaugggggauucaauaccucauuccuggguacagguaaguagccacuuuuucuuauucuccaaccaaauaggucacacacacauacgacuacagucucccuagaugccugguauuuccacaggcaaccaagaacggaagcagggggaacaggaagcggaggauaggugaggucuacaccucccccuuaacagcugccagcaccuucugacacugccuaacacuacuccuccugcuuccuccuaagucugugugaacuggauaccaguuucccccacacaucuuucuaccuaacgucguauaagccuucuuccuuguggcuugaauucugguguuuuuccccucugucgugcucugaguacuuaaguuuggacaccgugguaacugucccagccuuaaaacccaacaggugucuguacauuacccugcacccacaaccuugaagaauugucucagcguaauuccccguuagcagcucuaacacacgcuucaucucccugcccaccaggucggccagugaggaucgggucuuguuacuggaugggucuggggaggagccuacacagacaggugcuccaagggcccaggcgccacccccccaguccuggacgguggguggggacauaaugaacgccagggucauucgaaaccugcaggaacgccgcagcaccaggccuugguaaccauggccaaagcuuaguccucaguauggaugcauucauucacucauucauucaacaggccugucagccucagauccuuuguaucguuauuuuuaaccagagcaauaaaaguauuuauuuguuaucacuauagcuaccgacaaaaag

SEQ ID NO: 8573 - RNA, 571 nt, Mus musculus
caaagugagcuggugcgcaggcgcaguggucacacgacagacuguguguuuccaaaauggcggcggcgauggauguggauacccccagcggcaccaacagcggcgcgggcaagaagcgcuuugaaguuaaaaaguggaaugcuguggcccucugggccuggaacauugugguugauaacugugccaucugcaggaaccacauuauggaucuuuguaucgaaugucaggccaaccaggcgucagcuacuuccgaagaguguacgguugcauggggagucugcaaccaugcuuuucauuuccacugcaucucucgauggcucaaaaagaggcagguguguccguuggacaacagagagugggaguuccagaaguaugggcauuaggaaagacucuccugcaaggcguacccaucuguuacucgucuagugacuuccuguuaauuauacauuagauagaaccaugguccuuuuucguuccuuuguuuuuggaauuugguguucccgcagccauauuguauuuugugucaaauaaagccuuuaaguuggggaaagaaaagcaaagcaaagcaaag

SEQ ID NO: 8574 - RNA, 13168 nt, Mus musculus
ucuaucccagcaugcucuguagaucuuacaucagcagacuggguucccgagcaaaggguggagugccauuucauucacaggguuggucuggugucuuucccaaccaugagggcacagggaggacaagcacuggcuggggagggacacaaaaagcccaggaagcaccccacaggcacauggugucagcaccccacuacuuuauuuccuccccuguaaaggagacuucaguucuagaguucuccuuuccugcccucaaguccccacgagacaagggaccacaggcaccagaucuuuggugaaacaguccaggucucagacacuugccuccagcccugagguucuggcuguuugugucagugagucaguaguacccuuccaaaaggagggaccagggucaguucugaguggcaaaggucuugagacaagaggccaccuuaacuaggccugaggggaacccagcacagcaaaggucaccucuuucugaagagacugagccagugugggcaagccagcucaguuaccucaaggggaacacaguccuucauugagaaggacacaauccacacggauggaugcucucacacacaucaaggcaacacgccaccuucauggccuauguggcugcugcagcuggcagcagccauggcaggcuucuagguggaugaggggagacggccuagacuccagccguaggagcugguugcagcaggcuucuagguggaugaggggagacggccuagacuccagccauaggagcugguugcagcagcuuccaggagggagcucaaucccgaggacgguugaccaugaccucacccagggccuccaacaccucucgcuuguagucaucaaagucgccgucgaucugacugacacccugcuccuccaccacccacaacuggcaguugguuucugugaugaggcgcgcaucguggcugacaacgaucacagcuuuggaggaagaacaaaucaagagagggagucaggaguggaagaggaagaggcccagcagcuccagcugccucugucugagcacuuaccccccuuguagucguugauggccucccccagggcaucgauggacucuauguccaaguuauugguugguucauccuguggagaaggaagaggccuauggcagagcacugcagcagcugcauuuccagcucugacccgaaaacccuucucugauugcccacucaccaagaugaggacaucaggcucccgacaggccagcuccgcaaacacaacucgggcuuucugcccaccugucacaaaaggaaccguacugagacuccugucacccaccuugcagaaggccaacccuauggauguacuugggacauggaggcuccccaucugugcuguaaaccccuucagcuuccaggaacagcugaugaggucaccuccucaagcaccccagaaugacaguaccggagaguuugcagaucuggauggugugggcguggcucuccaggccaaagcggcccaagcacuuccgggcauccugguagggcagauugaagcuccgcugcagguacucagugggcgucuccuccaugugcagcugcucugcguacugcugguuaaagaagccgauuuucugcccaagaggagaggggaguggucagucaagaguccugcuuccugccugaccuccagccucgguucccaaggccagcuuaccagccgaugguucuuccucaucuccccguuggucugcaaggacaagcaagagugagagcaggauggagguagaggcccaaagcccagcuucucuuuucuuuguuuggacacagucucacucugcagcccaggcuggccuugaauucacagccauccuccugucucagccuccccaguccugaguuuaugagugguugcuacuaggccuaucucaaaauuuucaaagagaaccaaauacuagaguuucucagagagaaacaaacaucagaacugggcugggaauaaaugggugcaagaaagagaaacgggugccuagggacggaagacucugaagugggagggacggaggauaaaagcuucccuuacagggccugcgaaugaagcuggguggguggcacaggccugucaucucagcuauuuaaguaacuaagaaaggaaagaggguggcaaauuugaggucacucuggguaaguuagcaaggccuuaucuuaaaguaaaacaagagggaugauacagcguguuaaagguucaaucccuagaacuacaaacaacaaaagcacaagccuacacuggggugugagcgcgagagcggcauaggaaaacccagggcuuccgaggcugccagaaacaagcgcaccuuugugacagaugcacgugcccuccagcuuacacacagucuacaaggacacacuguccccugggccacaccuggcccucuccucuccuguucacuuuaggacucaccggugucagcuugccagucagcagcaggaguagugugcucuuccccacaccauugggacccacgaugcaaacuggaaggaggagacuagugguuagaggaacagcuuacguccugggauucaugcuccacacccaagucacccagggccaaccgacuuacuccgggaguccaugucgaugccgaaaucuagauucuuaaagaguggcuucugccccucguagccaaacgucacaccugagaaaaaccagccauucacaauuuucuugguuaccccaaaugccuggccucccaggaaagggcuacagccuuggcagaguguaggguacccagggcacugcugugcacuggcagcaagccgucacucaccgugcaggcccagcacaggugggcugagaggcggggggucugggaaggugaagcgcacgguguacuccuugggacgcuucaggagcucagggggcuccugagacucuucauccugguuuuuccgucggcacuucugcuguuuucgagucaggacuuccuuuguuugcuuuuccgcuugcuugguggacuugcccccagccuucagcuccuucaguuucuucuccugcuucucguacugcuuuagcagcucuuucugcuucugcugguacaucuucuugaaggucacugggguggaacaaccagggacagaugaguugggaagagaagcccugcauggaggucuuggacagagagcucaccaccaugcccagggccggcuacucuggcuccaccuuuggguccugucuccaacccguaaaagagcaugcuuacuguaauugccccuguaguaauggagccgcuggguguccagguggaugauaucagugcaaacgucauccagaaagcccuggucgugggagacaaucagcaacgucuuccuccagcccugaagguagcugccguggagagagggggugcgcgagugagugucacaaggccagggaagaugagucuaggaaguagauaaugggauggggacagggaaaaaggcagagcgggagaccacgggcagcgcacuuauugagccagaugacggcguugagguccaggugguuagugggcucauccaacaucagcagcguuggcuccaugaacagugcccuaaaggaguggauggaguguaagguuagggaaggaagaugccuguucagcaaacccagagcucagugacaacagucuguuagagaggggucaaaacggagaaugacccaaguucucacagugcacacagcaaaggagguuuaaaguuggccucaaggggcuggagagauggcucagcaguuaagagcacugacuguucuuccagagguccugaguucaauucccagcaaccacaugguggcucacaaccaucuguaaugggaucugauacccucuucuggugugucuggaaacaacuacaaugaccucaaaccugcucacuaugcaggccuuggaagagugggaagaaaggggcuggucagaagcugggaggcagggccuaccuggccagggagacacgcauucuccaacccccagagaacuucugugugggccgauucugcaucucagggucgaagcccaagccagccaggauccgccgugccuuggccucugcagcugcugccccgguagcucgcaguuccucauacaccugggaggagggagaagaggacacauguccaaggguccacagacccgcaaggccuaccuuguguccccugcgccaucuccucuaccuuuucuaguuucucagcagcagugucaucccccugcuccagcugucccugaagccgucucuccuccucuagcaaccucagucgcuugguaucugcucgaaggacagcuugcacggcugguguuucaucagccaccaccucugcaggagggggaaggcugggcgucaaugccagucccaccuguccucggucauccucccagcuugcuuucccacuccccagccucacccugcucgcacagcagcacgucaauguuaggggggaugcucagggcacgguuggcaaugugcuucagaagcgugguuuugccuuugccguugggucccaccagcccauagcggcggccggcuacuauguacaggucagcauugacgaauagcuccuugccgugggcggagaugcugaacuuuuccaacugcagccaaaagaaaggaugaacacggggcacacaaacacaugagaagucuucccucccgccccgugugcugcagcagggguccugcuguuucuaccggcuuuucuguuacuuuguucagucuggcugaaccauuucuuuuucuuuuuuccuuuuagauuuauuucuuuauuuuauguaugugaguacacuauagcuguagagaauugaauuuuaggaccucugcuugcucuggucgaccccgcucacuguagcugucuucagacacaccagaagagggcgucagaucucauuaugagugguugugagucaccaugugguugcugggauuugaacucaggaccuuuggaagagcagucagugcucuuacccguugagccauuucgccagcccgcugaacuuuuucuuuaggcauucaucccucacaggccuacucaagugcuaaguggggcaagggcccucagaucucaccuuaaugucagaugcauuuucuaacauugccuggcgggaagacaccucugccugggacacagagaagucguuuucugcagcauuagcugcuuucaaugacuccaccugucguucauaauccaucugaggagggaaaggacacucagugucguaacacaguagcuucagaaugucagcgcugaaggucgaacguaaaucccugucuuuccacuacuccacuucaagcagcccccaaagcucuucucagagccuggggccacaggagcuggaagagcuguggcuuaccuguuucuuuagcuuuuucuuuuccuuuuugcuaagguuggcauagggaucguuugccuucaaguccccuucuuucucuuccuucucuuccccugagcccugugagaacaaguggcgguaagcaaacaaaagcagcagcgagaacaggacuacagacuuaagucuacagacugacuuccaagucagccagggacauacagagaaaucuugacucugacccucuaccccauguuucucuguguaacaguccuggcuggccucaaacuaacaaagaucuaccugccucugacuucuaagugcuaggaugagaaaugucuugaaaaaccaaacaaaaaacaccaaaacaaucaaacaccaaaacaaaaacaguaacaacaacaacaaaaaaaacaaaccaaaaccuaaccaccaccaccaccaccaccaccaccaccaccacugucagauuccuagcaucccacuaaggcaggaagcugucuuccccacccaaucuggagauggcuuaucccaaggcacugguguacaugcagcccuuaaucgaucucugccaucaggaaccacuggugugaaauguucggcagguuaacgaaaggaaaagcuuguaacuucuaagacaguguaagcgaaaggaagcaacugaguuucuucugucacuaaugugcaaaaaaccaaaccaaaccaaaccaaaucaaaaagauggucuagcgugcagacugaaguagccagcaagaacuaagacuagaaaugcuugaaauguugagaaacagagagagacugaagaccaggaacaucguuaagauuguucuagaccacagugccagugaauagugaauggucacagccagcaccaacaccaucaggaugaacuccauccaagccccaccucuuccaucugccauggugguuccagggaccugacuucauguggcucaugagauaagauguuauaguuccaaagaguuguaaaacauaagacagagacaugaagcucauagcccuggaacucaguaguagauagaucaggcuggcuuugagcucagagauccccuucauuuguccccacuaugcugggugugugauucuugcuccagucagcagggagcuuccccugccccgcccgccccagcagugugcacacaccugcucagccuccuuuuugucucuguccuucccuugcugaggaggcuccuuuucuuuagcuguguccuccuccuccucuuccccuucacugucugcagcagcagguuuacucugaggcagcaaggagaagacaggccugauggagggcuggcucccugaggagcagucagcaccaccugcagggcccccucucaccuuggcuuucccuuuugauuucuccuccuuucccuuuuuacuccugagcccaggagguuccucagccacggccugcaggagacacagacagaugguuuggauuuggaguuuaaaucucuggagagcacugagucagaaggcuuuagagaggugcgggcugcuggcaugaacaggagaguuaggacaggcgguuuaggagccggagagcgguaccccgugaggaggcaguguggcgagccaccacucacuuuauugaugcgauucuucucuggcuuggcgggcuugagaacacgguuuucuuccuccucuuccuccuccucacugucauccugaaucagggcuucaaaaacauuuccacccuacaggaaaaggcccugcaagucagugggguggcucugguugccucuggggucuuugcuuccuugcugauagcucaccuuggccuucuuccguccucgggguaugggggcaggcacugaaaugacagggggagaggaggggggucaagaaaacaccuggcuccuucacuggcagcuggaggccuuccuccccacugaccgugggcugcagcugcccuuggcccucaguucccuuacccucaucuuccucaucacuggcuggcacagacaguugcuuaagucgcuccaugagcacucucucaucacuaucaucguccacauccuuuuuccgacggccuuuccuggugucucgcuuuuucuucuguugcugaaacaacagugcgagugaagacaagggcugagaggggcugagaggggcugagaggggcugagaggggcugagaggggcugagaggggcugagaggggcugagaggggcugagaggggcugagaggggcugagaggggcugagaggggcugagaggggcugaggucuaggauuccugggauugggcgcccacagggauaccauaccugcuguugcuguugcugcuccuucuccuucugcaauuuuuccucuuccccagcuuguuuguccucuacugccagcucuucaaagaacuauaaaggguaucgauaagauacaggugaggggcuccaaggcugucagccaucugcacacagcugucacugccccauuuccucucuuuuaaaaaguggcuguggucauuuuauuauuucauuuucuacucguggauccugcucaaagaaauagcucccaggaaccacuggcuuccacuuucacacacuggaugacugacauaugcaugccugucccuccacagcugugagccagcccauggcuacuucucaaccuccaaguuguaagaaagcacuauuuggcugggcgguggaggcgcaugccuuuaaucccagcacuuaggaggcagaggcaggcagauuucugaguucgaggccagccuagucuacaaagugaguuccaggacagccaggcuauacagagaaacccugucucacaaaacuaaaaaaaaaaaaaguucucacucuauaauuuuuuuuucuucgagacaggguuucucugcguagcucaggcugacccaggacucagauaugccuugccucugccuccugagugaaugcugagauuaaagguucacaugacagcuuggcucucugaauuuuuaccuuuguuaauucuuugacaccuagugccacacauaguacaccccacaagcccccucuccuagcaaggucuccccucuucaggucucacuuguccauuuacacugccugggaacacccagggguguuacucuucccggacucauuuucucaccgucuuuuuggucuucuuguccuuuuuuccuuucuucacuacuuugucuggaagguuaaacagacaucacaacauuagcuucuuacaaauguccaagccgggcgguggugguauaugccuuuaaucccagcacuugggaggcagaggcaggcggauuucuaaguucgaggccagccuggucuacagagugaguuccaggacagccagggcuacacagagaaacccugccucgaaaacaaacaaacaaacaaagaaacaaaaaaguccagcagcccgagcuuccugcagagcuccaguuggcucuaccaggaagagcuauucuucaucaccacugacuggucuuucagagaucauuauuuuuucuuccaucuguucaucuacacaccuauuuuuuuucuuucuuuuuguauuuucaacuguguagucuuggcuguccuagaaccaucucuauagaccuggauggccuagaacucagagaucugccuccacuggagugcagacauguaaccaccuggcuccaaaugccuauuuacuuaaaacauuuuuuuagauauauuuauuuuauaagcgugagagugcuuugccuguagguguauauguauauuaugugucugccauccugccuaaauggacuuacagauaagcuaucaggugggugcucaaguugaacuugguccucugcaagaauagcaagugcuguuaccacugagcugucucucugggcccugcggacaccuauuuacuaaccagacacuuggugucagaaaauguuugcacuggggaugcaaacagcuaagaacugugguuuccucuggugcuuguaggaagacagaucuuuacagagcaaaggccucaaacuucaccuaagggaagaaaaggcagauuugguggggagggaagaagccggccucaagccuagugcuuuguggaggugccaguuaggggacaguaagucuguugguaugaucugaucuuuuguacccuccagucuugcauccauuuagaguggagcaaggguaagaaggacaacaguggaaagucuuauaagagauuguuacaauguuucuaugguggcaagaggaggggcaacagcagaacccaaguacacuguagucuucagacacaccagaaaagggcaucagaucucauuacagaugguugugagccaccaugggauuugaacucaggaccuccggaagagcagucuuaaccagcucuuaaccacugagcuaucucuccagcccggaaggcgcauucuaaagagacagucaguauuucucuauaggaauugaacuagggcucuaauaucuauuuuggaaacaaaacaaaacaaaaggaaguaacccaccaccaccaaaaaaccaaaaacaaacaaaagucaccuguguaccauucuccacaaucuucaugaaaagcacaaccagcacacacgucucauuugugcuuuucagggcuucacacagcaggcagccagccagucucagcugaacccacacccucaguccuuuaucuucaccuuucauuuugaggcaaucucucuaaguugcccaagcuggccuugaacuuguaauccuuccugcuuuagccucccauacuuggaauccaggucugagcuaccaggucugacugauauucaggucagcuguucucugggcaacucacuguggaggucaggcuggcuuugaauucagagauauaccugccucugccagccgaagcuuggaauuaaaggcccaagccaucauggcugaccucauaccuccaucccuuaaauuccuucugucaaauccucugauccaccugacccugagguaaggaaaugccugagcacaagucaguugugagacgugucaucaugggguuagcaggaccagagcuauguugcuuggcuccucuuccaaucuccuuuagcaccuuccugaagcuguccugaguggcaaagacaacacuuuaacauuaccacuccucacccauauuuguaaucuggauaacaaggaggccgaaggagaaaagaguuugaacccggccugggcaguuuaaugaaaccuugucucaaaauaaacagccaaggaugagucuacauggaccaguucaaagccauucuccacuuuauauaacugggcauuguggcucaagucuguaaugccaacacuuuaaggcucaggcuaaagcaauacauguucaaggccaucccuagcuauacauggguucaaagccagccuggacuacauuggaccuuguauuaaauaaaacaaaaaaaccucuaagcuguguuuauaagguguauaugaagcaaaaguguauuuuauguuuagacuugcaucccaucgcuuaggcagcuuacugcauacaugcaaaaccugaacacuuaggagguccagcaaucuggucugcauauaacuuaacaaacaaaggagcaaacaaacaacucagucagcacucucuagaacuuuguaucuccaaccacacuuaucuacaucuuuaugucaagucucuucucucaccagagacaguuaacaauguguccuugucacaccuccaacucagccuucaagacacacugggcuggaaagagaacuggcuacaaaguugucuacugacuucccauccacaccugcuccaaggcaugcuccucccucaagaaagcacaggggcuggagagauggcucaucacuuuagagcaucacuugcugcucucucaaagggcccgggcuugauuccaagcacucacaugacagcuuacaaccacuugugacuccauugucagggggucagaugcccucuaccgacaaggcacacacaugguacaguuauauacaugcaggcaauacauucauacacauaaaaaaaauaauuuuugcauguuuuccaccuuacaguccaacacuacucucucucucucucucuuuuuuuuuuuauuuucaggguuggagagauggcucaguaguuaagagcacuggcugggggcuggugagauggcucaguggguaagagcacccgacugcucuucugaaggucaaguucaaaucccagcaaccacaugguggcucacaaccaucccuaacaagaucugacucccucuucuggugugucugaagacaacuacaguguacuuacauauaauaauaaauaaaucuuuaaaaaagaagaagaaaaaaaaaaaagagcacuggcugcucuuccagaggaccuggguucuaagccuagcuaacaagccucccugaaacuccagguccaggauacccaacgcccucuucugacuuucaaaggcacugaaugugugcaguacaaaggcaaagcacccauacacauaaaauacuaauuuuuuguuuguuuguuuucuuuccagcuaggaauguuggugcacaucuguaacaccaacauucaauuggcagacucacauggaucuuuaugaguuccaggccagccugaucuacauagugagucccagacuagucaggcugcauagugaaaucccaccucaaagaacaaaacaccuuuuaauuaaagguauuucucaagcacuacuaccuacuaaugguccacuacccacucucuuauuuuguuuuguuuucuuuuucgagauagggugucucuguguagcccuggcuguccuggaacucagaaaucugccugccucugccuuccaagugcuuggauuaaaggcgugcgugcaccaccacugcccagcucacuacccacuccuuaaacugcacuuugauuaauagagugacauccuucuguacccuuuuaucugcccagucuuuaguucugcaccaggcacuugauugacagcaacucuucagucuucacuuccuuacuauuucuuugacacuucuuacaaaagucacugccagagccuaguguuccuaaaucuauccuggcacacaccuuuaaucccagcaccugggaagcagaagcaagcagauuucugugccuuggaggguagcauggucuacugagugaguucugggacagcuagggcuauguagagugaucuuguuuucuucgaggcagggcuucucuguguaggccucgcugucagggaacucgccuuguagaccaggcuggccucgaacucacuuagauccgccuuccucggcuuccugaugcugggaucaaaggcguguucccccaaggcuuggcugagagaacgucuuaaaaaaaagagaccuuuauaccacgcacaaagcacaucgcaugaguauuaaaguaaaccuugauccuagcccuugacauaaagacagcaccuagugcaguccagcgggaccgagccuuuggaguccacgaaggagcuguuguucucugggagggaggcaagugcaguugggagcgcaccacacgauucaaggcacgcucccucaccgcgguaggaaagaagucaacaauucuaguuccuguccugccgucccucccucggugacauauggucuucccgucucccguccgccucucugggcucuaggacggcccggggcacgcggccucugccccggcgcacaugcgcaggacccacgcuccauggaggccgccgccguccccgccacuccugccuccuuccccacucacccgcggggcucgugcccucgccguccccgauccacucgggcucgggcggcuguugcuugggacccuucggcaucgcggcggcaguuaagaguccuccagcggcgcccggcgccguuuccgcuuccggcgaugugggccggccagugggcgggcucuccaug

SEQ ID NO: 8575 - RNA, 8245 nt, Mus musculus
auaccgguuuccacuguguuuauuacuaauauaaaaaaaaguuaaaaagaaaaaaaaaucauucuuaguucuccaacagcucucucuccucuugugugcacaccuccugacccacuuccguagggccuguucaaaacccaccauguucacugcuguuuucacagaaaacacgcagugccggggaaggaagagggucagagaugacagcacuguucagguuccauccaaagacagguggaguuucacaaagucaaaccaaagggucgguggccucacaaugacagagccgaacuaaaacgggccaggcaggagcuguuuggggaggcccgccugaggcuuuccaagacaccacuggccagucagacccagaaugcccgacaccaggagagggcacgauggggaggcagucugaagaagucucacguccucccauguugggagguaggugaacuccagagggcaccaagagccucacuugauuuggcagaaaaacuuacucuaguguugggaagucacacacacacacacacaaaaaaaaaccgccacggacaccgaggaaggcuacaaagggcguacaguuucacaaagcacagugaccacaggccuuagcggugggguucaugcuacggacagaaacuaggacguccaaaagcagguagaggccguucaaggagcaagucuauaccagucacucaaacucgaccucaaggccagacaaccuggugcacuuccuggcagcugcaaacacugggguuuuacgugaaaggacuuaaaacaagcagcuagaggauaagagacugcuccagggcucuugggaacugagggcaauaccgagggacagguggacaaaugcacaagaaacagcaccaaagguuuccuguugagcagucuuuuggcagaggggaagauccaggaggcaguggaaaaguagcaagauggggucccgaaggucucuacagccuggaucagaagacagugugcacugugcacuagugacaaucacagcucuggaccucaaauaggagagaugaugaaagggguggaugugucagugcuugaaggugacagaagagccuucaaguagcuaagauggagccacagagagugcauggccacuaggucagagggcuccuuccagccugggugggaaggcacagucucacagaggagguccguugacgccuggaugguagaaggcacaauggucuucauaucgacaguggcccuucuuagaaaagugucggcagacagggcggucagacuugucugugaauaagggaaaacagcagcuuaaaaccucguaagccgggcagugguggugcacgccuuuaaucucagcacuugggaggcagaggcugguagaucucugaguucaaggccagccuggucuacagagugaguuccaggacagccgggcuacacagagaaacgcugucucgaaaauaagaaaaaaccuaguaagagcugggcgagguggcucacaccuguggcucuagcauucagaaggccaagacagaagacugccacaaguuugaggucaacuuguccacccacccccaaucaaacacaacucuuccuuucugacccccucaaaaauccuaaaauguaauagaaugcagagcaaaagccaagguuucuacuauauacuguuuacaaguauuuuggcuuuccuuucuauuuguggugcuaggaauagaacacagggccucagcaugauccacaccuugcucaaucacugagcaagucucccagaccaccaaauauuuuagaaagacuguuuuucugagggaagaaaagcguucaggacuauuuguaccucuuaaggcagcuaggaagcugguaguccagugcuaggacuccucaacacggagaaggcccugcauaaauucccagugcuucucagugagagcccagaggaggagcuuccccaggccugcuggcacacaggccacggcacaaacguaacagagagggccuggccuuaccuuccaucaucugggggcuguccuuggguggguagguauucuugacaagagaccagcuucugagccuucguggguuucucgccucuuuguaaaagcuuucccuagagggacccccauggccuggcccaggaaaaggagguucggcauugauaccccaccaaccacgaccauacgggcuagaucgaggaccgaggccuccccgaauguagccucuaccccggggaggaggcgggagacucagcagugggggaaucauccguccccuugauccuggaggaccccuguggaaagcuacagagagagagacagggaggugauugcugggcagcuuaguccugacaaaagccccgccccugcuuacaacagcaaagcacggacacaggacuuuuaaaaguacacaaauuaaguaucacaucuucaccuggauuuccacuaccguguuaaaaauuaugcuuucuaagcgcuuuuuagccccugguguggggaacugaacccaggacccuguguaugcuaggcaacugauuacucucauuacugagcuaacucuccagccucaaaaaagccauccaucuguauacauccuuucgucuucuggaagguugccaccauccuaacuucugaugugacagguuguagaucuaccuggcucugaacucugggcucuucuguucaucaugagagucagguugucuggguuggugguugauuuucuuuuuuuuuuuuuuuuuugguuuuucgagacaggguuucucuguguagcccuggcugucuuggaacccacucuguagaccaggcuggccucgaacucagaaauccaccugccucugccucccgaguucugggauuaaaggugugugccaccacaccugguggugguugauuuuuuuaaguguagcauccuauuacauggacuaaugugaucuacugaugauuuaauggacauguggguauuaacuggccacaauaaacaaugcuaugaacauuuuuuuaaaaauguuuuuuauuagguauuuuccucauuuacauuuccaaugcuaucccaaaagucccccauacccucccccccacuccucugcuaugaacauuucuauguguaguauaaguuucuguucagacuaaauguggcagaggaauugcucaguaagaaaauccccccaccccaaaaaaagcgugccaggcguggaggugcacaccuuuaaucucagcacuugggaggcagaggcaggcggauuuaugaguucgaggccagccuggucuaaaaaguguguuccaggacaaccagagcuacacagagaaacccugucucgaaaaacuaaacaaaaaaacaaacaaaccaaaaaaagaaaauauuauuaaacaguuucugagugguuaucaacuauaugcugcucuccccccacccccggcccucaagguggcuuuacagcuuccaagcauuggauggcucagacuuugucacuugguugauuuguugugugugaaacaaaaauaauauacguaauaauaugcucacguaucacaugugugucuugugucccugcaggccaaaaaaaggguguugaaacuagaccugugagcugccuaguucuacuagaccauguggugguaaaaaugaaucucagguucucucuaauagcaagcucuuuagccuaaaaaaauagauuucuaaaauuacagauuaaaacagauuucuaaaauuuauguguguguguguuggggguguguacacagauaucaugcugcaugugugacagagagacaacguguggaauuugguuccucuacuacuuggagcccaaggauugaagucagucugucaggcuugguggcaaguacuuugaccugcagagccaucuugucagccugacacaccucagcuauuaaguaaaugguuuaauacugucgggaaauagaauccgagaacccuacacuguaaacccgagaccaaaacagaaaccuuuaacaaaccccuucccuuacaucuccaacagucccaguaacccacauucuaaugguuucuaugagucugacuucagacagcucauguguuuaucuuuaugggcccacuuucuuaauacuguguugagguucuaccaacauuuucuucuuuuuucaaaaaaaaaauauuccacugaaugcauauauauacuuuuagcuugauggcagccggggcuacauaacaacugucucaaaaaaaaaaaaaaaauacaaaaagacaagccuggugaugccugacuuuaauccaaaaaguuggggagcagaggcaggcagauuuucucugcauucaagucuaguguggucuguacagugagcuccaaacagccaaggcuacacagugagaccucacugcaaauaaauaacacaacaaaccaaaacaaacaaaaacucaaauccccaaagacuaugcuuucaauucuuguaaauauaaacccagaagcggaacuguacuuauuuaauuuguuaaauagggucucuauguagcccaugcuagcuucauagcgcaaaaguucuccugccucacccuucaaaauuguagacaugugcuaccaggcuuggcuuauuuuuaguuuuguaacaaagcuccauacuauacauaguaguuaugugguuccaugucuaucuaguuagcaguguuaucugauuaguauaagucuguguuauugauuuaguucauucauaaauacuuccuuuaugauuaacauaugugugugugcuuuuugucugugugugccaggggcugaaaggucucacugaaccuggaacacucugauucaacuacacuugcuagccagcaaguccuagagucugucuaccucugccuuaucacuguugggcccagguuuuugcuuuuuacaugguugcuaagaucugaaaucaggacuucaugcuuuugaaguaaauacuucaucaacuggaccaccucccacaguaccacuccuccuguucuuccucauuuuacuuuuagauuuuguuuuguuuguuuuuuuuucaagacaggguuucucuguauagcccggacuaggcuggccuugaacucagaaauucgccugccucugccucccaagugcugggaucaaagacgugcaccaccacagccuggcuacuuuuaaauuuuauagacagugucuuauauaggccaggguaacacugaacucugagcuuuccugcugccaguaugccuggucugugugcuguuuacaaacgcuuaccuacucuaagaccaugagacaugguuaacuuuuuauaagaauguuuauuuuacaaucugcuuagaauugguguuuuuauuugguacgacuauuacaaagucaaaguucauaguuuuacacacaaaaaaaguccaauugagacaacuuuguuuacugacagaaccacuucguugauuucaucuuuacacagaauucuguguucauauaucuacaggccuccgauugcacucagauagggucucauguagccuaggcuagccggucucaaauuugcuauugcaggagaggcuggccaggaacuccugauccuuccacauguuaagaacuuauguugacauucugugaaaaccacaaugucauagcuacugcagcuuuucacuaaaucuugcuaugcccucucacuuuggucuugguagugucccauuuagagccucuauaauggagaacauuuauuucuacacacaaauaaagacagaccuaggaguuaaucuggaaggaaaguaacauuuugacaacaccguauuuccaaacgguuaauauaugaucccucauuuagguacacacaaucccugggcuuuuguuuaagucuuuagggguccaucccuucuccagggcuuaaaacaugaaucagggcccaauuucuccucaccugacuugggaucaccaggcuucccguuagccauggggggagggcccagaaggcugggugguccuaagagcagacgugagaaaacagccaucagaacggugcaaaggacugaucaccucguccuuacguggucuuauaacacucaguuuuuaaccagguaagucauauauccacucagcagugccgcaaacucucaccccguccaucugcccgucccucugcagaguuguuugagaguccaucagaggguaacagaggucucuaacagcucuuuccucacagugcugcauccacaacaugccagugauuccacguaccccaaucccucaccuuaacuguuggcccaucauaguuuuuuucuccucuccuucccucgggggaguaguucacagaagguugaccuaaccaguggaaguguggucacaaauugucuucccgaucaucacaaucuguaacaucgcugccaccccucuccccccgccauucugcgguugcgcaagccagauguuuagccgagccgccaccuccccugccuucuccagaaaggauuaggagccagauugagguugaggguucaagcaagcgaagcccucaauccagguuccaccagcaucccucccccaccacgucccaccccaccuccacgcgugcgcccuuccuccuuccguuggcaccuccucccccgcauuucauucuauccuagcccccuggccggcugacaggcgugugcacgcccugccccucacccauggggcgcucauccuccucaucuccaggcucgucccgcucagacagugcgagauguugcugcugcugcggcagcggcggcggcugguccugcuucuuucguuucggcauagcggcugcggcaauggcugcagcaagauuuggagggcagugaggaaggggcacacuagcuuuccuuccgcuuccgggugggcgaugggccgggugaccgaggcgcccaccaugccacuuccgggaggucguggaugugccgcggccguucgcuccuacaaggugccucgcucaccccgccgcgcgcguggggaagcuuugcucccccuugugcaguuccucuccacgugggaaagcaccaccccauuccagugagacaccggacaggcuucgggacucuggcggcacgcgagaggccugucgcauccuaaggucgccacauccgggccccaguuaccauggcaacaacuacagccacaacuccgugcucucugaccucucuccaaaaguccuugucccgcucgcuuuuccuccucacccgcgcucgcacguguggccagugaaccugccucuuccgcaaucuccuuaccgaguccuguugccgcaggccaguccacggggcagccaguccaccgggcagccagcgcagucccggcucucccgccaggggccauccucuccaggcggccgcgcgguggggcguguccucgccccgucgcccggcccccgccaggugaguggcagcucccgggagcgccgggcggcggugacacgcguccccccucccgcgacugccacuugguagcgcccgugacggagucggcucgggccucccacgcgcgucucccgcucgccgcaccgugcaucccggacccgcggacucucacgugccgccgcuugcauccccgccgccccgcuccccgcuccccgccgcucgcugcugacgucaccgcggccccgccuccccagggccccgggccgccggcgggggcugccccggggagucaguugcggcggcggggagcucggcggagggcgggccggggcuccggggccaugccgaggaagaagcccuucagcgugaagcagaagaagaagcagcugcaggacaagcgggagcggaagcgaggucagggagggggcggggccgcugcgcagcucuggaggagggcugugccgcggcaccgcgggcggggggugggugggugggcucucgcgaucccgcgugggcugccacgguggggguuucccgcagcggcgggacggggagggguggagggugggggaugggaaacucugcuucugcuucugcugcugcugccacagggcgcugugacgaccuccaggcccauccgggacgggguuggggcgcgcgguugggaagauggagccucuggagaaguugggucggcugaagaagagcuuguccuaccggcucggggggcuuuagguccccuaagaaccggucuacaccggcgucaccggccccuccccucagggcuccaagaugggcugcgcuccaguuccaacagccgcagcgguagccgggagcggcgggaggagcagacggacacgucggauggggaauccgugacccaucauauccgcaggcucaaccagcaaccuucccagggccuggggcccagaggcuacgaccccaaccg

SEQ ID NO: 8576 - RNA, 8245 nt, Mus musculus
cgguuggggucguagccucugggccccaggcccugggaagguugcugguugagccugcggauaugaugggucacggauuccccauccgacguguccgucugcuccucccgccgcucccggcuaccgcugcggcuguuggaacuggagcgcagcccaucuuggagcccugaggggaggggccggugacgccgguguagaccgguucuuaggggaccuaaagccccccgagccgguaggacaagcucuucuucagccgacccaacuucuccagaggcuccaucuucccaaccgcgcgccccaaccccgucccggaugggccuggaggucgucacagcgcccuguggcagcagcagcagaagcagaagcagaguuucccaucccccacccuccaccccuccccgucccgccgcugcgggaaacccccaccguggcagcccacgcgggaucgcgagagcccacccacccaccccccgcccgcggugccgcggcacagcccuccuccagagcugcgcagcggccccgcccccucccugaccucgcuuccgcucccgcuuguccugcagcugcuucuucuucugcuucacgcugaagggcuucuuccucggcauggccccggagccccggcccgcccuccgccgagcuccccgccgccgcaacugacuccccggggcagcccccgccggcggcccggggcccuggggaggcggggccgcggugacgucagcagcgagcggcggggagcggggagcggggcggcggggaugcaagcggcggcacgugagaguccgcggguccgggaugcacggugcggcgagcgggagacgcgcgugggaggcccgagccgacuccgucacgggcgcuaccaaguggcagucgcgggaggggggacgcgugucaccgccgcccggcgcucccgggagcugccacucaccuggcgggggccgggcgacggggcgaggacacgccccaccgcgcggccgccuggagaggauggccccuggcgggagagccgggacugcgcuggcugcccgguggacuggcugccccguggacuggccugcggcaacaggacucgguaaggagauugcggaagaggcagguucacuggccacacgugcgagcgcgggugaggaggaaaagcgagcgggacaaggacuuuuggagagaggucagagagcacggaguuguggcuguaguuguugccaugguaacuggggcccggauguggcgaccuuaggaugcgacaggccucucgcgugccgccagagucccgaagccuguccggugucucacuggaaugggguggugcuuucccacguggagaggaacugcacaagggggagcaaagcuuccccacgcgcgcggcggggugagcgaggcaccuuguaggagcgaacggccgcggcacauccacgaccucccggaaguggcauggugggcgccucggucacccggcccaucgcccacccggaagcggaaggaaagcuagugugccccuuccucacugcccuccaaaucuugcugcagccauugccgcagccgcuaugccgaaacgaaagaagcaggaccagccgccgccgcugccgcagcagcagcaacaucucgcacugucugagcgggacgagccuggagaugaggaggaugagcgccccaugggugaggggcagggcgugcacacgccugucagccggccagggggcuaggauagaaugaaaugcgggggaggaggugccaacggaaggaggaagggcgcacgcguggagguggggugggacguggugggggagggaugcugguggaaccuggauugagggcuucgcuugcuugaacccucaaccucaaucuggcuccuaauccuuucuggagaaggcaggggagguggcggcucggcuaaacaucuggcuugcgcaaccgcagaauggcggggggagagggguggcagcgauguuacagauugugaugaucgggaagacaauuugugaccacacuuccacugguuaggucaaccuucugugaacuacucccccgagggaaggagaggagaaaaaaacuaugaugggccaacaguuaaggugagggauugggguacguggaaucacuggcauguuguggaugcagcacugugaggaaagagcuguuagagaccucuguuacccucugauggacucucaaacaacucugcagagggacgggcagauggacggggugagaguuugcggcacugcugaguggauauaugacuuaccugguuaaaaacugaguguuauaagaccacguaaggacgaggugaucaguccuuugcaccguucugauggcuguuuucucacgucugcucuuaggaccacccagccuucugggcccuccccccauggcuaacgggaagccuggugaucccaagucaggugaggagaaauugggcccugauucauguuuuaagcccuggagaagggauggaccccuaaagacuuaaacaaaagcccagggauuguguguaccuaaaugagggaucauauauuaaccguuuggaaauacgguguugucaaaauguuacuuuccuuccagauuaacuccuaggucugucuuuauuuguguguagaaauaaauguucuccauuauagaggcucuaaaugggacacuaccaagaccaaagugagagggcauagcaagauuuagugaaaagcugcaguagcuaugacauugugguuuucacagaaugucaacauaaguucuuaacauguggaaggaucaggaguuccuggccagccucuccugcaauagcaaauuugagaccggcuagccuaggcuacaugagacccuaucugagugcaaucggaggccuguagauauaugaacacagaauucuguguaaagaugaaaucaacgaagugguucugucaguaaacaaaguugucucaauuggacuuuuuuuguguguaaaacuaugaacuuugacuuuguaauagucguaccaaauaaaaacaccaauucuaagcagauuguaaaauaaacauucuuauaaaaaguuaaccaugucucauggucuuagaguagguaagcguuuguaaacagcacacagaccaggcauacuggcagcaggaaagcucagaguucaguguuacccuggccuauauaagacacugucuauaaaauuuaaaaguagccaggcugugguggugcacgucuuugaucccagcacuugggaggcagaggcaggcgaauuucugaguucaaggccagccuaguccgggcuauacagagaaacccugucuugaaaaaaaaacaaacaaaacaaaaucuaaaaguaaaaugaggaagaacaggaggagugguacugugggaggugguccaguugaugaaguauuuacuucaaaagcaugaaguccugauuucagaucuuagcaaccauguaaaaagcaaaaaccugggcccaacagugauaaggcagagguagacagacucuaggacuugcuggcuagcaaguguaguugaaucagaguguuccagguucagugagaccuuucagccccuggcacacacagacaaaaagcacacacacauauguuaaucauaaaggaaguauuuaugaaugaacuaaaucaauaacacagacuuauacuaaucagauaacacugcuaacuagauagacauggaaccacauaacuacuauguauaguauggagcuuuguuacaaaacuaaaaauaagccaagccugguagcacaugucuacaauuuugaagggugaggcaggagaacuuuugcgcuaugaagcuagcaugggcuacauagagacccuauuuaacaaauuaaauaaguacaguuccgcuucuggguuuauauuuacaagaauugaaagcauagucuuuggggauuugaguuuuuguuuguuuugguuuguuguguuauuuauuugcagugaggucucacuguguagccuuggcuguuuggagcucacuguacagaccacacuagacuugaaugcagagaaaaucugccugccucugcuccccaacuuuuuggauuaaagucaggcaucaccaggcuugucuuuuuguauuuuuuuuuuuuuuuugagacaguuguuauguagccccggcugccaucaagcuaaaaguauauauaugcauucaguggaauauuuuuuuuuugaaaaaagaagaaaauguugguagaaccucaacacaguauuaagaaagugggcccauaaagauaaacacaugagcugucugaagucagacucauagaaaccauuagaauguggguuacugggacuguuggagauguaagggaagggguuuguuaaagguuucuguuuuggucucggguuuacaguguaggguucucggauucuauuucccgacaguauuaaaccauuuacuuaauagcugaggugugucaggcugacaagauggcucugcaggucaaaguacuugccaccaagccugacagacugacuucaauccuugggcuccaaguaguagaggaaccaaauuccacacguugucucucugucacacaugcagcaugauaucuguguacacacccccaacacacacacacauaaauuuuagaaaucuguuuuaaucuguaauuuuagaaaucuauuuuuuuaggcuaaagagcuugcuauuagagagaaccugagauucauuuuuaccaccacauggucuaguagaacuaggcagcucacaggucuaguuucaacacccuuuuuuuggccugcagggacacaagacacacaugugauacgugagcauauuauuacguauauuauuuuuguuucacacacaacaaaucaaccaagugacaaagucugagccauccaaugcuuggaagcuguaaagccaccuugagggccggggguggggggagagcagcauauaguugauaaccacucagaaacuguuuaauaauauuuucuuuuuuugguuuguuuguuuuuuuguuuaguuuuucgagacaggguuucucuguguagcucugguuguccuggaacacacuuuuuagaccaggcuggccucgaacucauaaauccgccugccucugccucccaagugcugagauuaaaggugugcaccuccacgccuggcacgcuuuuuuugggguggggggauuuucuuacugagcaauuccucugccacauuuagucugaacagaaacuuauacuacacauagaaauguucauagcagaggagugggggggaggguaugggggacuuuugggauagcauuggaaauguaaaugaggaaaauaccuaauaaaaaacauuuuuaaaaaaauguucauagcauuguuuauuguggccaguuaauacccacauguccauuaaaucaucaguagaucacauuaguccauguaauaggaugcuacacuuaaaaaaaucaaccaccaccaggugugguggcacacaccuuuaaucccagaacucgggaggcagaggcagguggauuucugaguucgaggccagccuggucuacagaguggguuccaagacagccagggcuacacagagaaacccugucucgaaaaaccaaaaaaaaaaaaaaaaaagaaaaucaaccaccaacccagacaaccugacucucaugaugaacagaagagcccagaguucagagccagguagaucuacaaccugucacaucagaaguuaggaugguggcaaccuuccagaagacgaaaggauguauacagauggauggcuuuuuugaggcuggagaguuagcucaguaaugagaguaaucaguugccuagcauacacaggguccuggguucaguuccccacaccaggggcuaaaaagcgcuuagaaagcauaauuuuuaacacgguaguggaaauccaggugaagaugugauacuuaauuuguguacuuuuaaaaguccuguguccgugcuuugcuguuguaagcaggggcggggcuuuugucaggacuaagcugcccagcaaucaccucccugucucucucucuguagcuuuccacagggguccuccaggaucaaggggacggaugauucccccacugcugagucucccgccuccuccccgggguagaggcuacauucggggaggccucgguccucgaucuagcccguauggucgugguuggugggguaucaaugccgaaccuccuuuuccugggccaggccaugggggucccucuagggaaagcuuuuacaaagaggcgagaaacccacgaaggcucagaagcuggucucuugucaagaauaccuacccacccaaggacagcccccagaugauggaagguaaggccaggcccucucuguuacguuugugccguggccugugugccagcaggccuggggaagcuccuccucugggcucucacugagaagcacugggaauuuaugcagggccuucuccguguugaggaguccuagcacuggacuaccagcuuccuagcugccuuaagagguacaaauaguccugaacgcuuuucuucccucagaaaaacagucuuucuaaaauauuugguggucugggagacuugcucagugauugagcaagguguggaucaugcugaggcccuguguucuauuccuagcaccacaaauagaaaggaaagccaaaauacuuguaaacaguauauaguagaaaccuuggcuuuugcucugcauucuauuacauuuuaggauuuuugagggggucagaaaggaagaguuguguuugauuggggguggguggacaaguugaccucaaacuuguggcagucuucugucuuggccuucugaaugcuagagccacaggugugagccaccucgcccagcucuuacuagguuuuuucuuauuuucgagacagcguuucucuguguagcccggcuguccuggaacucacucuguagaccaggcuggccuugaacucagagaucuaccagccucugccucccaagugcugagauuaaaggcgugcaccaccacugcccggcuuacgagguuuuaagcugcuguuuucccuuauucacagacaagucugaccgcccugucugccgacacuuuucuaagaagggccacugucgauaugaagaccauugugccuucuaccauccaggcgucaacggaccuccucugugagacugugccuucccacccaggcuggaaggagcccucugaccuaguggccaugcacucucuguggcuccaucuuagcuacuugaaggcucuucugucaccuucaagcacugacacauccaccccuuucaucaucucuccuauuugagguccagagcugugauugucacuagugcacagugcacacugucuucugauccaggcuguagagaccuucgggaccccaucuugcuacuuuuccacugccuccuggaucuuccccucugccaaaagacugcucaacaggaaaccuuuggugcuguuucuugugcauuuguccaccugucccucgguauugcccucaguucccaagagcccuggagcagucucuuauccucuagcugcuuguuuuaaguccuuucacguaaaaccccaguguuugcagcugccaggaagugcaccagguugucuggccuugaggucgaguuugagugacugguauagacuugcuccuugaacggccucuaccugcuuuuggacguccuaguuucuguccguagcaugaaccccaccgcuaaggccuguggucacugugcuuugugaaacuguacgcccuuuguagccuuccucgguguccguggcgguuuuuuuuugugugugugugugugugacuucccaacacuagaguaaguuuuucugccaaaucaagugaggcucuuggugcccucuggaguucaccuaccucccaacaugggaggacgugagacuucuucagacugccuccccaucgugcccucuccuggugucgggcauucugggucugacuggccaguggugucuuggaaagccucaggcgggccuccccaaacagcuccugccuggcccguuuuaguucggcucugucauugugaggccaccgacccuuugguuugacuuugugaaacuccaccugucuuuggauggaaccugaacagugcugucaucucugacccucuuccuuccccggcacugcguguuuucugugaaaacagcagugaacaugguggguuuugaacaggcccuacggaagugggucaggaggugugcacacaagaggagagagagcuguuggagaacuaagaaugauuuuuuuuucuuuuuaacuuuuuuuuauauuaguaauaaacacaguggaaaccgguau

SEQ ID NO: 8577 - RNA, 1874 nt, Mus musculus
gcuacucauuacuuacuaccuacugauacauaauauuucaacauaaagaugagcuguagccgcacagcuaucugaacgucaccaccaguuauaggcuguugugagcugcugggugugaaugcuagaaacccuggaagagaaucaagugcuccuaaauugcugagccuucucuccaccccauagccaaauuacuugacaauuacauccuuauuccaaugccugcaccucuauccgcuauauggggccuucaagcucaucucuucaauggguccacugcaccacaauguucaaugccacccugacccugcccaccccccacccccaacccaauuaccuucaaccuccaucgucuuccucugggccuucucuccucccuccccuuuacauuccugguuuucucuaacuggcuuacuccucuucccagacaagaaguaagacgccugcaaauucuccucucuuccuacacagguucucagcuuacacuacacucugaagaugaccuauuccucuccucccaccucuaugcugauggugcccaaugucuccagccagcaucucuuccccaagcugugcuugcauauacugucugcauauauugucucuggagaucgcccauaacaaacaugccaaacuagagccaugcuacacucuguucccuuacucuacaacuccaucaccaacacacacacacacacacacacacacacacacacacacacacacgagagagagagagagagagagagagagagagaagcaauccaacagccuguccaucuaucaaacagucaaacagucuuucccccacuguuucugguucauuuuccuucuaggauggcuauaaaacccucuggucacuuuccccuuccaaauaaauguccaaguugcaaacacaguggucuacagccaauuauuucccugccuuuuaguccuaggguuaaauuuuuauuauuuuuuuuuuccaacagggucucaugguggagcucuggcuggacugaaacucagagaucugccugugccuuccaagcucuggaauuaaaggugugccccaccacacccagcucuauggguuuucuguuuuguuuccagacaggauuucuguuuaacagcccuggcuguucugaaacucacucuguaagauaaggcuggccucaaauucacagagauucaacugccuuugccucccgagugcuggaauuaaaggugugucccaccaugccuaccuucacggauucguucuuuaaaauggggacugaagagcuggcucaaugguuaagagcugaguucaauucccagcaaccgcgugguggcucacaaccaucuguaaugggaccugaugcccucuucugcugucucuaaagacagcuacaguguacucauauaaacaaacuaaauaaauauuacuaacguggccggagaccucuacaaccucuccuaacuccuugcacucguugccccagaacgcgucuuuacaccaccaaugcacacacugcguucccucucacuuccaccuaccuuuuguauguucuccucuuucuucggugcccaggguuacuguccaugguacaccguuucucuccacccuccuguaugguagaaacagccccucagcuagaacacacuuccuggacccgcaucuguggaaccccucuagcccaguguuuaguuuggccugcgcgaaccucucugcuccucuaggcuguugagucagacucgaggagacuggcuuccccgucaggguucccauagcaccagaaacagcuguucuuucucagccuugcacaaccucgcgaagauccagcguccagagcugugaagauggcuuacaggccugaguugggaccaccagcacuuaaaaagccagcuguuuguuc

SEQ ID NO: 8578 - RNA, 939 nt, Mus musculus
agccggcuuggcuugggagcaguagcugaagaguuggauccagggccguccuugcugccgcgucugcuuuuggucucuggcccuuccgcgggauggcgcgcggggcgacacugaagcggcccauggaguucgaggcggcgcugcugagccccgguucccggaagcggcgacgcugcgccccucugccggggccccacuccgggccucagguccccggacgccgagccgccacagcuucagauccagacgccgccggcgagccuccagcagccugccccgccuggcagcgagcgucgccuuccaacucccgagcaaauuuuucagaacauaaaacaagaauauaaucauuaccagagauggagacauuuagaaguacuucagaaagucagccuuccuccucggcacuuaccgcaccaaguucuccaggugcuuucuggaugaagaaggaccagcccacuuuacccuucgacaaguggggauaauaugugagcggcucuuaaaagacuaugaagauaaaguccgagaggaguaugagcagauccucaguaccaaacucgcagaacaguaugaaucguuugugaaauucacgcaugaucagaucaugcggcaauacgggacaaggccaacaagcuauguaucccgaagccuucuugccuaucuagguaccaggugugaccucaagagauggcugcuguacacuuuuugcaacugguuugacaucacauuucagcuccaacuuugcacccugagaacacuuaaauguuucugcagguccguuuuauacaacuugaaagaccuuaaaacuuucugguugccacaagcauaucuuucuuuucugcucaucuacuaaacagcugugcccuacugcgauagguuuuccagacaaaguaucuggaacagcagucuagcaaagaaugccuucaguggcacucaacacgu

SEQ ID NO: 8579 - RNA, 440 nt, Mus musculus
aaaaaaugaucuuggggauucuggcugugaauuugaugcacgacaauuaugguuaaaaacauuuucuuggucuacagaagaucauuaauguuuggugaccauauagguuguaacaguggguugcuuauuuguagguauuaucguuaaauacagggacaguuuccaggcacagaauuugaauuguaaguuaggaugggcauuagaugugauuaugaugaucuagggaaggucugcaguccugaaucugcaaauacguggugagaaauuagaacaaacuggagacaggcuaucaguacauggacucugccuagcugugcuggaaaaauacuuugacuccaagccuuaaaauauccuguggagucugagcucaccucauucauacagucacggagcucccugaacgcugaacuucuacagggaaaagaucuccccuggagcgg

SEQ ID NO: 8580 - RNA, 440 nt, Mus musculus
ccgcuccaggggagaucuuuucccuguagaaguucagcguucagggagcuccgugacuguaugaaugaggugagcucagacuccacaggauauuuuaaggcuuggagucaaaguauuuuuccagcacagcuaggcagaguccauguacugauagccugucuccaguuuguucuaauuucucaccacguauuugcagauucaggacugcagaccuucccuagaucaucauaaucacaucuaaugcccauccuaacuuacaauucaaauucugugccuggaaacugucccuguauuuaacgauaauaccuacaaauaagcaacccacuguuacaaccuauauggucaccaaacauuaaugaucuucuguagaccaagaaaauguuuuuaaccauaauugucgugcaucaaauucacagccagaauccccaagaucauuuuuu

SEQ ID NO: 8581 - RNA, 493 nt, Mus musculus
agacuuccgccguggccaugguggcuaacgcgaccacgaaccgucccaacuccugccacuagaacuuguggacaaauguauagggucaagaauucacauugugaugaagagugauaaagaaauugucgggacacuucuaggauuugaugacuuugucaauaugguguuggaagaugucacagaauuugaaauuacaccagaaggaagacgaauuacaaaauuagaucaaauucuacuaaauggaaauaauauaacaaugcugguucccggaggagaagggccugaaguaugaauggauuuccucgacuuuguuuucaaaucuuuaacauuuagagucuauaaaugaaguuuccguuaaagggaaacucuuugaagauauacauccauuuuucuaagcuaaucaugguuauuuugggaaaagaagaguuuuguuuugucuuccuuuuuuuuuaaagacuaaaaaaaaauaaagauguuuuugguuaaaaaaaug

SEQ ID NO: 8582 - RNA, 493 nt, Mus musculus
cauuuuuuuaaccaaaaacaucuuuauuuuuuuuuagucuuuaaaaaaaaaggaagacaaaacaaaacucuucuuuucccaaaauaaccaugauuagcuuagaaaaauggauguauaucuucaaagaguuucccuuuaacggaaacuucauuuauagacucuaaauguuaaagauuugaaaacaaagucgaggaaauccauucauacuucaggcccuucuccuccgggaaccagcauuguuauauuauuuccauuuaguagaauuugaucuaauuuuguaauucgucuuccuucugguguaauuucaaauucugugacaucuuccaacaccauauugacaaagucaucaaauccuagaagugucccgacaauuucuuuaucacucuucaucacaaugugaauucuugacccuauacauuuguccacaaguucuaguggcaggaguugggacgguucguggucgcguuagccaccauggccacggcggaagucu

SEQ ID NO: 8583 - RNA, 3124 nt, Mus musculus
cacauuuuaauacacuccccucauuugucucugaaggcccauacaaaacacccaggguaaguuucaacgaauugccuaacucugagccagcagucugguuccccacagauccugcaggggccuggaucccucugcuucugaccuuagccaguaacugggaaucagaaguaaacaccaagccagguugaauaaaugagaaaaggucagaggaaggagggugaaguagauacuaauaaauagccgaggagaccggccaugcuguugucugguuauuugugcuguucauguagcuacuagcccuuggaacagcaagugccuuuaauaagaagugggagaaaggcaagaagcucuuugcuuagggauguuuuguccuguuaacuuauuuccucccuugugaucugaucuuucacacuuucagguccaugggcacuaaugcuuuuuauuuuugagacagggucuggcaauguagcccauaauucauauccuguaauuuaugguaguccuaccucaaccucuccaguggugagauagccagaauauaacaccaguuauucugggcauugacuguuuuguuauguuacauccguucauagaagucccaagcaucuacccucggcuucagaagaguaagacaaaaucuaacccaauguccaccgcaaacaacccucuuuccaaccauaaaagacaggacuucgguccuguuauguuuauguacuuuaagauccuuuaccuguuccacgucuaccuaauacgugagggauaccaaacuagggcugccugcacacagaagaccugugggguccucugguuucugacagaagcuggugcggggcugagggccccccccccucccgcacuacaguucccagcagacguugcgcacugcgcacgucuggggcgggacauccgcaaggaggggcagacacucauggcgggcccagugaaggaccgggaagccuuccagagacucagcuuccuguaccaggugagacgcgcucgggguggguggcagcccgguguugcggccgcagaguaaccuggauggccguccuuguucccaggcugcacacugcguccucucucagaaccccgagaaccaggcgcuggcuagguuuuacugccacacagagaaaaccaucgcgaagcggcugguccuccggcaguaaggcacaggguggcgggcaggacccggggcgcgggcuggcaggcaggcagacagcgaccuccucucuuccucacccagggaccccucugugaagaggacgcucugucgcagcugcuccucucuccucauuccgggccucaccugcacgcagcgccagagacgugagugcugccccagagacauuugugagguggggacacuagaggacagggcagggcucagcagcuccaccuagagauggagacuuucugcagcugacuuagucccuaaaacuaucuuggacuacaugacacuccuuaguuuaaaaaaaaaacaaaaacaaaaaaaacaaagcgauuucguuauuauuucauuccuagggugcauuaagcacuacuuacuagcugaguggguuguggagguucacgccuuuuaucccagcacuugggagguagaagcagguggauuucaugaguuuaagccuauccugaucuacauaauccggacuggccaggucugcauaaagaaacccugucucacacaaaaacacauacugucucuuugcuuuugguuuugauuuuguuuuguuuuguuuuuuggcacaagugucacaguagcccagacuggccuccaauucccugcagucuccugcccccacaucccuagcuaggauuacaagcaugagacaacacacccagcuacuggagucguaauuuuaaaugcuucaguugguagggguagagugcugaguccuaccaguggcagggagguagguauaacaugauaaacaagagucaaacacucuagacgcugggauucccacacgagagaaugugugcuuuguaggggcuugggagaugguuccgugguuacugugcccgauaagcuuaagugugagggccugacuucagaucuccaacaccuguguacaagcagguuguaagcccagccagccuuggggagcaggugaagacguacagauccuccagagcacucucuggccaggcagucuagcugaaaacaucuagucccagguucagugagagacccuguuccaaaaagacaugguggaaugugguaaaggaagacagacacccaaacuagauuucuguccuccacauauauaucuagaugaguguuccugugugcauacacacacacacacacacaaacacacguacucaugcauauaacaguaacacauauguguauauacaauaugaauguauaaauaaaaauaggaauuuuuaaaaaagaaucugugcuauaagaaaaggaaugcucaggaggcuggaguuugaggugggcaagauggagagaggugaaacuggacaggaagcuaggcuguguuaaagaguuugaacuucacuuuagaguuccaagggauugauauguaugcaggccucccacacacaucagaucuacaaaccaagugcagaugggauggauuuucuauugaugguggaaggaagacugcagacauacaaaaaaaaaaagagcaaaaccuuuaugucagaagccuaggcacuuccuucuuucccguuuaugccccaggccgaaagggacagcgcuggacaguacagaccugucugacaugccagcggagccagagauuccucaacgacccuaagcaucugcucuggggugaccggccugaagcccagcuggaaaaucaggcaggugagcagugguaaggaaagauaaaggagccuccaagagaugggacaguagagagccaagaguaggaaagggggugagccugguuaauauaagguguguuggaaucuuaggaaauuaauucuucucugauucuccuccuauguagacaucaauccaucagagccccugccaaacauagcugaccuccccaaagagaacauucagacucaggcuuugaacaccagugaaugacuucacuccacuugccagauaaauaaaguugaguuguuugacuuuguguucugugguaucucaacuggu

SEQ ID NO: 8584 - RNA, 13378 nt, Mus musculus
aucacauuaguggauccuuuguuccauauuuucaccaaccaauuaucuugccacaaagaaccacagucaaggcacaaagguaagaguagaguggacaaaguccuguugaggugguaggaggaacugaaugcccucacugcaguuucuugucucagucuugugugaagauuacccaggcagcagauaauccagguuguuugguuuggcaugcaucugguaccuuuugugacaaaauauguacccuauggguuguuuauuuuggccuaaaauuaaaauaauuuacauucucugaaaaggggaaugucaaagggugaaggauagaaauagaagcuuagcugucuucuggcccuuugcuacacaaaccacccucuucuacccuguucucaugggugagaaagacuccaucaccuucccuucuuuccuuaggucuuugagccagggggcaagguggacaaguugggaauaaccacuuaggaacauuccuuaaggccaaggcuuuagcuacaccuuucucucuccucuaauaucugacuccucuccaaguugccuugggaaacaauggaaggaccgauguaugucuuuuucuuuuugaguuuuuugagacaggguuucucuguauagcuguggcuguccuggaacucacuuuguagaccaggcuggccuugaacucagaaauccgccugucucugccucccggguaugccaccacgcccggcucagauguaugucuugcaggauugcuuccaucucaccuuuagaaggaagcaagaggagccuacuuuuuagagacagccaacugcaggaaacaggaauaacgcaagccuuugggacauggagucuccuuuuuccccauccuuuccuucuccccaaaucugaaccucuggcuaauccuauggguaaugauagcauuacccuaagaagaaaagagaccaaagaaaacccccuucccuucauucauccuagaaacauuccuucagccucuucccugauccuucuccuaacuuuaaugcucaagcucuggccccggaaaagccccucgacuucuagacucaugacagcaacugccacucaucuuuccgacaccgagguauacagaccccugugcgcucccacaaggaacaaggcuauucugcgucacagaagccuuuuaaagguuucuguuuccugcauuuuaagcaaguuaagacccuuuccuauagacuuuguuucuggaaagcuuuugcuuucucaaccuguccccgugcacuaggaaaccugcgggacaccagaguacaauccccugggaguccacucucccacuacaguaaggagggacacucaucugugcuuggucaugcagcccaguccuaucuuuacuccucacacaaaccaucccagaugcgaggugguuucucaagauggcucaagacuggaaccacggagacaccaagauauucuagcaggccaguuaggaaggcccaccgcucuugaccuugccucaccccaauuaaacugcaucucuugucauucccaaucuguugggggccuaaugguaaguggugcagcauucuuccgaccggcccggaucccuggguagaagaggggccaaaguuuuucaguaaaaguaucagugaagguguagauaugugaacggucugugacguuguaaaaggacagugugccagccucauagucuaggaauaugccuacccgcuugggcuucaccuugaugugcaaagggguaaaaggcguggugguggcugcauacuuguccccauuccacagccgcacucgccaguagccagucucaggaaguggagucaguucgcccuuucugcucacagagucccggcauacuccuacugcccagugggucuugucacccaccuccaccucccaguagugucgaccugaggugaagccuucaguagcuaagacacaaggguagaaagugaaacgcugcggugugucagggaggucucggagucuugucuccacaaacuugacgcuuuuccgauccucugacaggacgagguuagggugagcagucucgggguccagagucacauccgcuggcggaagaagccagaguggagcuagaugaggaugggaauagcuaaacgucccugccucacuuucccagccucccugugcacagccugcaaggcucccagaacacugugggcugguugaccucaaaucaugcuugcuuuugcugaauggaauagugaaagguacugucugagugagggccagagagaaggauccauaucgagugggcaguaggggcuggggagaggauaaacaggaacucgcauccugaaauaguccugcuuugugacucuucuucuaugcacaaauauuaacaaugauguucccuuucauuuuccuggcuaagaugguaaaugcgguccaugcucacuccuccuaaugaguuaggaacccuuuacuguguuuaggucccuauuuagagcagaugacaccuaaggcuucuucucugaacucuacgauucaaggugagacagaaagcugguaauggggcagguggggugggccuaagaagagugaagcucacuggaaggaucugaacuuuccauuccucuacaugcccucugccaguauccucuugggaacaacucaccaauuagcuguuuaagaauuuuccuuagggcaaaguacugccgggggaaauugcugaaguucuuuuccagcucuauggauacugaagucaccuccauggucuucaccuucucacaucuaggaaggaugggagauaaagaaagaacagggucaggggagcuaaagccaacggaauauguaagugguauuaucuuuacugaaaagaagaaccagaccucuccaacuucccuuccuccuugaagauagcuguuuuauucuuuuauacucagagagcuaugugguucccuugacagaucuguaucuuaagaaugagucuuacauuucaugcaaauggacaguuaccccuccccuacucauacuccugugcugccaccuugucugaccacagcuccggguacacagcuguguacuacaaguacacagccaccuauagacauaagcagaacguggcucucgcugcucucaaaagggaggugaagauuuaucacucccaauggcgcauccuuccccguauccaauuccgcguacacuguaugacuuccccuuucuuacuuccuccaagucauuacuaaacccagucucuaagccaugacccaacccagagagacagagucacuuacuuuucuaggguacuuuucacauccuagagagaaagagaaaagaaaguaagauugguccuagaauucauggaacacgauggcaaaaagguucucccucuucucuacaguucuagaucugcaaacuaggccccaggcaaacugaggaucccaguccgagggaccuagugcaugucucucauggaaugccauaacugcuggucauaucaaagcgugguaauaucacuucaaaaugguuuccuguguuugacuuuguuccucaaagacacugcaggcuccuugcaaggaagagguggugucugcuuuuucuuuguccuccaaauccaaccacacaccuuugcaucaugaggaucaguacagacaauuccagccucguggcacaggacauucccacugugauccagacucccuugucuagagcacugguuaaugaacacuaauuuauaccaguccugauuugagacuccuugggauccagaugacaaacacaaugaaucucacccugaagaauuuccaguuuaaugcgguuagcaaagcacacacaaaugaagacacagggauagauucuaagcaacauaaauguacauguaaaugugcagugauaccucacugacucaaaugccagugaucucuucugagauaagagauccgcuuaccauaguaagacgauuuuaagcguuuuagagguagcaacagacugacuacaacauaaacacauuuugaguauccuuuauauuauaagcccacccccuuugggcacuagguacaguaaguucuaggacugcaaaguaaugguaacugcauuuacaaaauuuugagugcacaguguaucucuaaguagaacagacuucuauuuucugaaaagaaugaucuuuuuuuugaguguaaauuauauacauuaaaaaaaaagauuuauguguaugagugucuugcuugcauguauauauuguauguaugugcaccaggugcgagcaaugucugaagaggccagagacgguguaaggacccuggagcuguaguuagagguuugugagcugccaugcgggugucgagaacuaagccuggucuucuucaagagaagcaagugcucuugaccacugagccaucucucuagcuucaagcacauaauuucugaaaagacagaaggauauuaaggauguaaaaaaaaauuaggcuugguguggugguauaugccuuuaauaccagcccucagaagacagaggcagguggaucucugugagugaggcuagccuggucuacaaggugaguccaggacagccagggcuguuauaauagaacagccccgucuagaaaaaccaaaaaagaaaaacuaacaaacaacacccccccaaaaggggaaaaaacccaacuaacuaccccaaaaucaaaaaaaaaaaaaaaagcaaaaaaaaaaaaaaaaaaaaacccaaacaaaacaaauggaagggaugauagaaaccugagcugccccgcucuagaaaaaugcccuuagcacauaccuggaagaaaaccuuggauuacagaaauagaguaagagagggugcacuccauacugacagcacggccugcacauagcuagauuguauuugaccugaggaacuauacaggagcaaaggucgaaccuuaagcaucucgaagccugacuguaagcacuugcccuccaccucagcagcuaagugggcaaggucccggcgccuguccccaaggugagcagcauuuucucgaagucgcuguagaauguccuguucuucuuccuccagucgugaaagcagugucugcugcucuucguccagucgccugugcagcuccucaaacuccuuuaagaucugcugccggcggcucuccaccagucucugagaacaagggaggaggcuaucaggaccagaaggcacgagggggucucccagauccaccaggcucaggacagacuucuuugucacugggaagacuuuaacagcacacuugcuucucuuccuguaagggacacuguuaccugcaugaccccaacagacaacucacagggcaaaucaguggauagauuuaaaucaaucaguacuuagcuuuauaaaaucugaaacgugcuuuugcuaacgguacauacuuuuacuucuaacaaacauccuugaagcuugagaguuuaggacucaaacagcaguuggaucacuuucugaggguuaucagcaugcccuccccuaggccuuccugcaagugaccuuccccaguauagcagucucaagucuuuugacugaaagggaagcaucaacucagaagaguagcagaguggacugaaagaugcagacagagagagagguugggcucaggcucaagaauagugggugacacaccaaagccuguaggccucagaacgcagccauggaucugaaacuaugccaagcagauggcagacuagcuuucauuacagggucacuaguugcugucucaggcaggcaauggcacgaugcauucucacuuuuguccugaacagauucucaacaugugugguauuaugagcacucuaaugaauuauauuccuuagcaguauguuuuuggggccagagagaagacucagugguuaaaaaugcuugcuuccugggcuggguguggaggcccaugccuuuaauccccggaggcaaauuccugaguuggaaucucugaguucaaggacaauuuggucuacaaggaguccagauagucagggcucuguaacacagagaaacccugucacuaaaaaaacaaacaaacaacaaacaaacaaacacuuacuucucuucuagaaguccugagcuugguuuccaacacucauacuagauaguacauaacugccaguaucccuauuuccaggggaccccauuugucaacuucuggucucugagagaauguacacacacacacaccggaacacuguauguugccucucuuagacuucacauugucaucaagagcauggcugcuugugguguugggcucaccucugcucaggagccaguacuuggugaacucauagugucacauaagcuguaagcagggaggggcuuuuagggaagucagaaucaaauagccacauacuggauuaguaauuaaaaucacuuuuaacugggagugguguguauaacuuuaaucucaguauuuaggaggcagaggcagacagaucucugagucccaggcuagccagacccacauaaugaaacuaucacaaaaaaaaaaauuuaaaaauuacucucugauguuauuagauauugcaaucacuuuagaauuauauagauaggcuaucuuaucuggacuuuuacuuaaaaaauguugauuucuguauagcuaauuagaaacuccauccccacccaggauguacaaucucacaagcccauacuggccugugcuggcugugaauuugugauuuggauauugggguuccagccccagccuccucugguuacaggugugaacugucaugccuaguucacaaacuuguguuucugucugcuguguuggggaacggacgcuauacccucagccucuacacaguuuaaaacugugcauuuuauuuuugagacagggucuucugaagucuuggcuauccucacuuguaacccuccugucuuaagucuccggacuauugggauuagauguccucaucaccaagccuugcuccuacaaacuauuuuaaaagaacaaggggguaagaaggggaggaagaugaauucaaacagucgugaaaggaauguuuugaauuacacucuuaaagaucacugaauaaaaaugaauaauugaaaacaacaacuguacuuugguuaaaacauuaucauggugaaugcccuccauauguucccguauuucaccacuugguucacaguugguagcccuugggaucuuugcaaagguuauagaaccuuguggagguagagcuuugcaggaggaaguaugucacuagggggcaggcuuugcggguuuacccuacuuccuguuugcucuacuuccuauguaggguaaaaaucugaucagccgaucagcaggcuucuuguuccuacagguauacccugccuucccggccauuacagacaccuccaaaagagagcgcuucucccuuagguuuccuuuuuuugcccugauauuuuaucagaaccugcacagguggaggcugaggaggggacagacauucuggcaaugaaucggcauuacauuagcucacuuaauuauaaggauguacuucugagccaaguguuauggugcauguguuuagucucagcaucugggaggcagaggcagguggauauuugugaguuuggagucaacuuggucuacauauugaguucugggccagugaaggugagacuccaucucaaaaugugguucucuggggcuggaaaauuacaaagcauuggguguuugcucuucuagaggaccugaguuugaaucccagcauccacaugguacuugcaaccauugguaaccaugggaaaauauccauacacacacacacacacacacacacagaauaauuaaaaccaaccaaacaaaauguuacugagcaguucugcgagcucuugcucagcucucccuguaucuccugugaacucucuuuccuucagcaccucuaaguucccagcacugcacucuuaggagauccccuuuccuugcuugggaguaggaagagaauagcgggcaaggacuccguggacuuaacaggaauagcauguuucaucuguuaauuuaaaaaguaccucuucuuguauaucuaauguguguaagagugggugagcacguggggcacagcgcacauguggaagucagauguuaacucuguggagucauucaucucuuucuacccccacguaggcuucaggucuugaugcgcacacagcaagcaccucuauccagugagccaucuccucagaacuuuacucagagaaaguagaaucccuccaguguuuccuggcaagccugacgagauagcacugugagagacaggcagcuuuccccuggcugucagaugaacugaagggaaacgggcagccaagcuuuaccuugagcucccccggcuucuucucuucggaggcuuugcagcaggugaucuccugcagcuucuguuccaggggcuccaggcacuucugaaguuucuccugagggucgggagcaagcaggagacgugauaguugguacauccauuacucaagagguuaaccuuuugcuguugauauagauucuucuuuuuagucacgugaauguguuugcuugagugugugcguaugugugugucacugcccagggaagccagaagagugcaucagaugcccuggaacugaaguuauaggcuagggaacaaacucaggugaucugccugaguggcccacuuaccugcuaagccauuucucuaccccugauuauucuucccuugaagcacuuaggucaaacccaugcccccagcaugcugggcgggcgcucuaccacugagacgcauucuccacuccaccgucauucacugucugcccuugcaucacuucuucauccaacucccuuccuugucagagcuagagaugucauguggauguuucauagaucccccuuucucuggcacuagucaccaucaugcuuguggcuuaccugauuuuccuccccugaaccuagucgucuggcugucaucgacugggucugcucccaugcuguucucuuauggacaacugaaguuaccuggguuuucguuugcuuguucugggggugcuggggauccaugaaagguguguaugauagaacagucucuaguaccaggcuacaccuuccuccugccagaagcugccuucugcacuuuuauuauuguuauuuuaugaucagguuuccagcaguccugacauggagucacgaauaaccaacuucugauccuucugccuccuccaucugaguguugggauuacaaguguguuguaucaccacgccugucuugauacccuuuuaaacccgugccucuauucaaaucuaacuacuuagaaacaaaauaaaucuugauuguaaauaaccuuaaauauuuuucaagacuuuguuaagcagaauguuaagcagaauccuaggcaguaccaucuuugauuuuuauuaguaaaauauuuaccaugugcccucacuagugauuuaaauguuaaaugcuguuacccauucuaugggaagaugcagacuggcucagcacaguuugcuggauaucagucucaagugguuuuagcuaccuccaacaaauggggaaaagaacuacuuccuaaguaaaaaggcuuaaaucaaaaucuuuuuuaguucuucuaaaauauuuuucagaucaugugguuccacucauuuauuuaaaaucugauauauuuggaagacucaauauuauugcaguaaguuacagaaauuuuaggguacuccucacuguucucaauggaggacaacugaccagauguauacagucaggaagggacuacucagaguauauucucagcugcccuccccaacccccaacccuagcaucaugggccuggcugccuaccuuguauuccuguguagcaucauccaucggcacgacgguguggggccgguggguaugagaaauugcacauaucagacagacagccuccuggucuucauagcagaaaaggcuaagagguucguggugcugggagcagaggcuuucaucucugaucuuccgcuugaccgucuggagcugcuuggcgauuuccaccauacugccuagcugucgguuaggccggagacuccgguaucgggaugucuuccgacagacagggcaagggaagucccgcucuaggucuucccaccagcggguaaugcacgcuuugcagaaguugugcccacauucaauaauaacuggcuccuucagauacucuaggcauacagaacagcuugcuuccaccugcagguucuccagagcagcggcuguggaggcugcagagguuccagccucuaacagacuugucucugccauuauaacuuggaggcagggagagaggaaagaaguguuaguuggaggguuauuuuguuuccugacauuagcucccaguaagccauaggucuagaugaagccccaucuugguauucucccauuuccaccuuuucaucuguuggucuauuuacagugugugugaccucuccccaucacuguuauuauuauuuuauuauuauuuugagucagcaaauaucagcagugcccagaauuucuuuaccucugcuuuuucaauaccagcaaugaaaaggagccugauauggcgacugaaacccauuucccuagccauuuuugaggucaagguagggggacugucauuagcugaaggccaacguaggcuacacaaugaguucuagguuagcuugaauuacacagaucuuauuucuacagggagggaaccaugggaaaugagauaugucacauaagccaaaguauuaagauuuuagcugggcaugguggcucacugugaggcaggaggaucaauacaagaauaaggcuagccugggcuguagaguaagauuuguaaaacaaauaauauaucuacauaucuauuaaaacugacuaucagcccuagaacucauuacuacuuuaaagaacuucauauauaauuacugcaucgauuucaaagaaccccaagcuacuucuucuaacgucauaggaaguuuauuguuuuagagucuagccuugauugucugcuguuccucuuaaugaguuacacuacaguaacacacuguuucagggaaagcaugacaugguucuuccuuuccccaaacuagcccaaaggaagaacgcucucuucuugaagaugcuccugucacucaccgcauuucuauuugugugcagcugggauggcugcaaagcaacaaauacauaucagcucuaaggaagcaccauugagugcauugagggcagcagcuucuuggagagagagcuggcaaguacauucuaaacauucaguggugacugcagucuuucaacgucacuacugauaacuaacuccuuagauagucagugauuaggaaggaaauuagccagguaugguuaauacuagguagguagcgcauguaccgaggaggcaaaggcaggagccucaggaacucgaggccagccuaaauuaaauauaaccaauaaauaguuauuggucucaauaaaugaauaaguguauggaaagagacaaccaaagcucuccauucuuaagaugucaauacauaaguaagcuaauuuaucuggucccauaacccccuacuuuccuucugucccaaaaggggccccccaaaaaggaaggaaauuugauaggucuacccaucgacagaaaagugcccauguaaugaauuggggcaacaaugauuauuucuguauacuggugguacaaauggaaggauuuuaaguaggaguugguaacuuauccucuuuuaauggagaaaagaauugauccagauaaguacaguuggaugauuucuuucuucucugcccauuagaauccaguuuugacuagugacuuagccuccuccuccucaauccuacagauaaguggcauccucaccuaaaacugaaccauauucacacuugagagaccugcauguaucuaauuagcaaauagaugguaugagagagaaacgggcucaaggauagugaagaacggagaggauuuggagcuggggguggugugguggugguguagagggcagccauaauauggccuugugcuccucuggcuugauccuuccucccacucuccauuacucgaucucaguguaaguaaucgcgucagagacguccacguuuugccuuuaaucacuauuggguaccaccucaggagccucuuucaagcacuggccacaacucugucccacccguucuccaucuucuccagccauaucgggagcaugaggaccagagugagggagcauacgucgugcuuggcagggaggaacggaugcgugucuaagugagggagaggugugacgugaaggugggaugcccgcugccaugucgcagcccagacccgcgaugacugcgucaguuucacccggggagaccaaaggcagcgggacaggggaacggcgggguagccaagcaacgccggacgcgcugacgucgccggggcggcaaacguccuccgggcccgaggcgggcggaggcagcugugguugcgcgccggccggcugacguacucgccgggcguagggccgcggcgagaggagcccgcucgcuggagccggcugcgggacccuuguggcggcggcgcagcaccuaccuucccggcuccgggucccggagugccgggcgcggagccgccggagcacugccucccuccuuccuccuccccucacccccgccccgcggcgcgacacacaauacucgccggaagcggaagccgcgcugcggcgauggaagacagcugcgcggcgccgagccgccgugccagggccuagucgggcccgcggcggguggcgggcggagagccggaggcgagggccugcgcggcuaguuuaccgggcgagagggaacccgccgcuucccguggcugaggugcuggcgcccaggugaccagagcggucccccggagacugagggccgcgcaugcgcguggcgagacgccgaaccccauggcgggcagcgcgccguggcugggcuggcagagcugcgcggucagcgagcccgcagaggcucaagcugguccucgguggggcugggaaccgcagaggccugggcggcuacggguugugggcguugggccacacuuucccggucuccgggucaauucugggggaggguugcuguuuaaggcggcgguguauuacguggccgaccugagagucuaugcuggcacgucacuuccgacuggcugagguuuggcaauuuaaccggcaagcuguaguaggugaguuaucuuggcugcagaccgaggugcgucuuuuccccuccuccgguugggugauguauuagccagggguucucuagagcuacagaaccuagugaauguuucucucucuauaauuaaucgugaugacuuacaggcuaacccaacaaugggcagcuguggaugggaaguccaagaaucuaguaguugcgcagucccacguggcuaguucuuucagcuggucuucuguagaaguagguuccgacagaugugcuggcaaguaagugcaagcccgugaagaagaga

SEQ ID NO: 8585 - RNA, 46152 nt, Mus musculus
aggugaguuaucuuggcugcagaccgaggugcgucuuuuccccuccuccgguugggugauguauuagccagggguucucuagagcuacagaaccuagugaauguuucucucucuauaauuaaucgugaugacuuacaggcuaacccaacaaugggcagcuguggaugggaaguccaagaaucuaguaguugcgcagucccacguggcuaguucuuucagcuggucuucuguagaaguagguuccgacagaugugcuggcaaguaagugcaagcccgugaagaagagaaucuuccuucuuccuauguccuuauguagacuuccagcagaaggcguggcccagauuaaggugugcaccaccuuguuuggauuugggacuugcuuucucccgggcugacuuugaacucagagaacuccuugccccagucugggauugaagucguguacugccuugccugguccuaaacuuaauggccacuguaccucaagaucuccaugucaagauccaggucagaaacuugugucuuccagccucaagaucuggaucacaggugagcccuccaauucuggguuguaauuccuuccagauagucaaguugaccaccaggaguagccaccacagcugacauuagcgaaacgcuuucccuggcuggagcuggaguguagaaaaccggucuaguucggugcuuugcugccccugcaucuaggaugccaggaggaccaaauccugugcucaggaaacacugggugggaaccaaagccugcuucuuucucuuugaagaccuugcuuaaguuucucugggagagcagauggagcuuauggauagacuccagacuugcacauuggccuccuuguuguguuuuauaaaaagauaaggagagaaggaguguguuugguggagguguagucaggugugggaggaggggugccucugcaggcccaugcugccgcaucccuccccccugagggaccagccacacgaugacgauggcauaguauagaauagaguuuauucagggaauggggaggggauuugagaggguaguagagacggagaaagguggggggggggggggagaagagagcagagaagagaagaaagagaaguagaggccagccgugagugccaugagcacguggggagagaggaggaggcgaguggugagagagggggaagaggcaggacaggacagaguaagagcaagaaggcaagagagguaacuggggcagagccuagacaaaaugcuaacgcuuguuguuuuuggaagugucauaaaccugucauggugaagauuuuuguggaggggaugaguugauguggagggaucgucugcugguacagauguaauggacucaggaggagucagugcuaggaugcacauugacacuacuggaugcauagguagcuugucccucuguugugagacagaccuuuucuggggagauaaacacgugucugcucaucucaacaaacugacacggaccaaaguaugcguaccacugaaguccgauguggugaagcaugaguuuuacugggguuauuuagaggaauaugggugaggaguuacuuacaggaacagaaauaacucaaagacaacacggugucaccaaaguccacccccguguaguugacagcucacauagcuggaaaccuggagcacacugcacagaugaagaggcugagggucucuuuccggcuagugugcgcaucuuccaggcugcuuguucuuauuucuuccagucgucaucugcuucugcugggcucaccugagaguggcucucggcagugucuacuguuaaugcccucgggaggaagggauuuuggacuucugaagcugucaggaguuguuucuuaaggugcuucccuguagcacuucacuucucuuuagaaugucuuguugcuuuacaucucuguaaaccccuuguuuuaggaaguuucccuccaugaugcaagguuuuaaucucagaggaagccacuacaaaacacucucucuccuuccugcaacaguuggcauucaacauauuugcguguauuugaaugcgugcccuccuuucagaggaagugguccuucuucuguuuuaguucuucacaaacacggugcaguucuggcuccuuugagguagcauuuuauguagucaaggcucacuaggaagcucgauccuucugcuucaccucaguacuagagaauuacagguguugacuacuacaccugagaugcauauuuaaccccucauacuuaaagaguucaaaacuguuuuaaugucagaaaacaggcagugucugaggucaaagauuuaggaccacaaaugucaaauacaacaaauugacuuuaaaaaaauugucuuuacuguuguuuuuuguucuguuguuuuguuguuuuugcucugcuuucauuguagccagugauuuuaagaguaaauuugauagauaucaauuuuuccuccacuucauuuugucauauuugcccauagggauuauaaacugcagcaguugcuacaguuaauaaacaccuuauuuaaaacagaguagcaugaaacuagucuuuuaucacugucccuuaaaaauaucccaguguggccuuucccauuguauaccuuucuguuaggaggacuuguccccuccccuuuuaaucuuguaucuuugagaauuuucuaucaucugcccccugucccuaucuuucuuuugaguguccuuugaaguguuuggaggaaaaggcaaauagguuugaauuaccauugugucugggguucccagaaguucuuacuguacguaauguagcaguucauaaauacauaauaaguaacacuccaaucaacucaacauguucccuguugcaccgugggcccucccacgagugaugcucacaccuggucccuaggagcucuuuuucugccuugggaaguugggugguggggauuucagucuacuuggacagcucucugaaagguuaaagaguuaggguugucuuggugauucgguuuuucuugucuucaggauagcaacaguguuuugucaagcuuugugcauugccagggaaacuccaaaauaaaaaaccaaaacaacagugugucguacuauauggagcuguuacauuuuucagugaagggcuucauuucauagaaauguuuuccccugaguuugaauguguaucuuuacaucugaagcuugguggccauguggauaucuuaaagugcugccagccuuggcugauucagcgucuucagguuucacuuucaugagcugcauauuucuugacuuucuuucaagauuuccugcaagguuuaugccuuuuaaaauugcccugcuccuuggucuuuggcuaaacagacuuuuacuucugagcuaguuccauguuggaguuugagacauccucccaaggaagggauuucugaugcacuuuuucagcuuucccuagacuuugggcaggggugugccuaacgguaaugccaaccauuguaaugauuuccucauauuuaauguugcuuucaagcccucagauuggugaaccaggucacauuuccacgcuggucucuucuccaaccacagcagcuucucaugguugaaucccuaauugcugagagguuguaaggcuuaguuucugguauaucaugugcaaagcucuuagauuucaguaaguauaugguaggguguguuucagcucuucuggaaagaagaggcaaagccaggugagaucaguggcagggacagcgugaaaugguggugcggaggaagcagagagauaggauauauuugguuaguguccaaacagauaucagguccuggaaucucagcuuuggucccuugauguuccuuucccucuaguuaaauaagggccucucgguaauuucaguggucuuugggcaacacauguuaauauauccuagacaacuuccucuguuuuggccaagaaaguacuucaggaugugugugcauuuuauagggugcuacucuguccuguuuaacaauagcuugcuucuccauccuaauugaccacuuagcugucaguuuuucuagcacuuaauccaucugaaagaaauacaucuaauguaaagacgugaccauguaaauugcuguuuagcagccuuuagugacugcuuuauccaaauaugugcaaauacaggcucuuucaucauucagguuaaugagcugccacguuuccugccauggugaggaguccaggugcagcuuuagauuuuucucguuacacuugauuguugaucucacuggacugccccaugugucugaguaccaggaugcuugugaguuguuaaaaggacccaggucucucccuaaguccagucccaacuguuaggcauuugaauuccagaaugccuguugagcagucuuuagaggagacacuucagggccugggaauccuguucuaugcccuuguuacuguaggagaccaucaggagaccagcaggauccagaccaaccuugucacaaacaugggcucucucacuugacagcugacuuucagcagguuguagugacauccuugugauugcugugcacaggaaagcugugacuccugcuuuccgugccuucuggauguggcacuggaaugaggcagucugcuuuggugugggcucuaaucccaaugcugacacuggagcacagggcucuguccuuguucuuuguaucucuguagccaucacucccuuggugcccuuaucacuuccuuaggucuaauaccuuucauaugugucccacccagauccauuucuccagcccagacauuguuccuaagugucccucugccaaccucccaccuaagcaaaauauuaguggacauuucagcucaguaucuccuaaacugucugccacaucccuuccucacauaugccauuggcagucuuuccuuuuuuccugguggcaucucuaucauuuuucuggcacagucugcaucccuguauaauuccuuccuugugcuuugauagagcucauuaggaagagcucuagguccaucuacagaccagguccacauuauuuccagcaucuccacugcuuuugcugggaggagggacugacauuucuuuuuuuuuuuuuuuaaagguuuauuuauuuauuauauguaaguacacuguagcugucuucagacacuccagaagagggcgccagaucucguuauggaugguugugagccaccaugugguugcugggaauugaacuccagaccuuuggaagagcagucagugcucuuaacugcugagccaucucuccagccccgggacugacauuucuauccuuguggaauuuacugcagugucacaguucucuucuuaggauauaaccaggauaauccuuuauacaguaaaguuguucaggcuagagagauggcucagagguugaauauacugacugugcuuccagggguccugaguucaauucccagcaaccacaugguggccaacagccaucuguaaugugaucuuggugcccucuucuggcgugcaggcagaacacugcacaugauaaauaaauaaauaauuauauuuuuuuaaaagagcuaauagaauuuaaugcuugggaaaaaaaguuguucuguguuuugcucaaaauucccucccucaaaggguuaauucccccccaccccccaagucaggguuucucuguguagcucuggcuguccuggaacuuauucuauagacuaggcuggccucaaacucagaaauucgccugccucugccucccaagugcugggauuaaaggugugccccuucccucaaagaaagaaagcuaguaaccccugucugcccuaugaugucaauaacuaccuccugggcauaauuuauaaucaaaugaauuacacuacuuaucuauuucuuccuguuauacagguugaauauguuguugcuaaaauuuuuuucuuucuuuuuuuuuuuuuuuuuugacucaggaucuuuuuauuucauaaaagaaaaaaaaaaagagaacccagccacaauaauaucgauuauaacuucaaaaucucccuuucuuaaaaaaaugguaauaaauuuagauuuaaagggacauaaauucggagauauauuuaguucaccuucucaccaugaauuucaaauaagauggugaucuuuuuuuuuuuuuuaaauuggguauuuauuucauuuacauuuccaaugcuaucccaaaagucccccacacgcuccccaccauugcuaaaauuucuaaucgccagaggcuuuagugaguuguaaucuuucugguaggaguucuugcuuugauguugauaguugcugaucaaagugugucugcuuaaaguugggguagcuguggccuuugauugaaacugggucucauuuuguagcccaggcuagccucaaguucaggauucuccucuuagacuuuccaaggucuggggcuguacuacugugacaagcuaggugauagaaguagacaagacagaauaauguugcuacauuaacuaagucuucauuucacaaaagauuucuccuuaacagagcuagguaugguggugcauaucuauaaucccagcaaucaagaugcugaggcuggaggguugcugugaagucagcuugggcuacauaacaaggcuuuucuuuuauccccaucacaccccucaccuccaugguguguaaugguguuuaguguccuuuuacccacagccuuacucauucuggaggcagugauggaguucuccagagauucauaauugguuaggucccugagaacauuuuuguuuguuuguuuuugaaacaggguuucucuguguagcccuggcuguccuggaacucacuuuguagaccaggcuggccucaaacucagaaauccaccugccucugccucccaagugcugggauuaaagguguggaccaccacgccuggcucugagaacaauuuuauuguggcaucacaaugcuuagccauagagcauugaaguugcauaucuaucacacccaaggcuuagagacaucacccagcuugcacaaagagaaggaaagagccagauggaguaggguuuuguauagguauggaacguucucuucuggagagaggccacuagaagcucuugaaacugucaagauuuacaaaagacuuccccaaagauuacauaagcugucagacuugcuggggagaagagaaucuccagccagccacauugccgguuguuugggugggaaugauaaggauucggcuugugcugggguggaguuuucagggaugcuuuugccuuugagccauccaugguucuguaaguaacccucaacaauacugugaacacccaagcaaacucacugguucagugcgcugcauuuccaaucgaaagcgguuggcugcacuguaacacugagcugauauugcaccaaugggaucaucuuuugucuuucuugaacgaauagaugcccaaucuagaacgaauagaugucuguuccucuuuucucaagacacacaacaguucgauuucuuucuccucuucuuucuacucuucuucacuucuagucuuuuuuuuuuguuuuuguuuguuuguuuguuuguuuuuuagacaggauuucucuguguagcccugccuguccuggaacucacucuguagaucaggcuggccucgaacucagaaaucugccugccuuugccucucaagugcuaggauuaccaaacuuuucuuuuuuacucuuucauauuuuucuuuguuuuccuuucccuuucucauuucuuuuuccaugcuguuauuucccuuugauuucccuccucuaaccuauaccuucuccucaucgaaagauggcuuucauguuucuugugcaacuccuguuguuuuugcugucguuggcaugacaccagaauggugcagccaccucugaucuaaucagaccacuuguuuuggagcacagagcucagucagcacuguuuuucucuccuguaaccaacauuuuauuuagcuuucaugaauugaaauggcuuuaagugucauuaauuugaugccacuccuugcagcucucuaguuucaucuucaguauuuuuagaccaucaaccuggccaccucauuuaauuuuuuucuuuaauuuuucucuuauuuauuuguagcucgagucuauaaccgaguuuggacuugaauagcugaagcuccugccucaguguguaugugucccgucacaucugucuccuuccuucauuguuccucuuuuuccucuuggagauggggcucuuuuuauauagguugagcuaaguuucugagcuuaagugauccucccauucaguccccaaacaaaugucagaaucucaggccuguaccaucacuccagaccccaugcuucccuugggcaucucugaucaaucacgucuacagcaagcaccugccauuuccucugugcacaugaggcccuuccagacucuggaagggagaugccuagggagacggugucucucaauuacaccaugacgucagugucuucuguuccucucuguuuguaccauagaaccaaugcacugauaaauacuguaaggccuaucuucaaacuguguagagaauucagucccuuuugcuguuucacuugcucacuugccaguugaaguggcugucauguccagccugaaaggccagacugugcccuacacuuuucccuuccaccucacucaaaugcccuugcuuuaagcaaggaugcuuuuauuaucuuccagacccauaagaccugacuauaccucacaucucuccauaagacuaccuaacacaugccuggagccacuuucucccuagaacauagaggccgguguccugugguguaagcacuggaagauccucuugcuuauuaacaacauaucaauagccacaaauaacaaacacagcaacaacuuccugaagacaccugacagauuccuccacauccuucagaucuuuacaguccaccuucccaguggggccuaugcugagcaccccaguaaaauaauaacauuccuuguuccacauuuuguaguacccaucaccuagcacuucacauguccuguaggaacacuuucugugcuugagugucuucuguccuccucuagaacauugcuagccauacuggccuuuuagaccuuugguguauccugcuauaaaaguuguuugccauguagaugaugagcagcuguggcacaaaguucucauagacugggcacucaucuugggcuacucuaacaagugcuguaaaccagcacccucauggaggucugaggacaacuuugggaacuguuucucuguccaccaucaaaugauugaaugcagcagacccuuaggcuuggcaacaagcaccuuuacccaccgaaucauuaccccagggacuuuuauuuuccuuagaagagaugauccuugauuaauggacuguaccuuccaaucaaauaaaaaccuaagucacauuaucguuuuugguuucaucuuuuucugcaugaauaugugugugcugugugcaugugcauggguauguguguucagaugugugugugaguaauguguacguggggaccagaguugacacugagugucuuccucaaucagaauucccauuauuugugaggcauggccucucauuuuauccagagcucacugacuauccagucuauccagccaguuugcccuuggauuuccucaaccuccaaucccagaggaccaugauugcuguuggggauccagcugugcccacuggcuuuuauauggguucuggagaucuaaauuauccucaugcuugcucagugaauguuuuaucugcugaaccaucuuccuaggccuuuguuuuggcuuuuugagacagagccuuaugugacucaguguugugcagucauauccucuaaggaagugcucccugugaguggaggagggagacucauaagacucaggaagcuaauggaguuuacaagcucaggaggcuccuaaagcacauaggguucaguagccucuuucccuguucauaaaaacaguaagcaauugcugggagaggagacuuucuggcuggcuaagcugccuauaaguugggcuuuuggugcugaagcugcccuggaaucauucacguuuuuguauugaaccuucacccaggcuucuguaagugacccuguuguacaggacuauuuucccagccaaacugucuucaugaguuaaugaauaucgaggagcauagcugcauccucacaaaccaaccagcucauuugugccuccucacaaacgagcacgcagcuggguuuguugacuguugacauuaccucauagauggagguggccauugguuccucagcugaguauccagccacuucucucagccaguaguaugcaauugugaagucuuaguuauuguccuguuauugugaagagacaccaugaccacagcaacguuuaaacaagaaaucauuuaacugggggcuugcuuacaguuucauaggcuuggucuauuaucaugguucagaguacacuggcacacauggugcugaagaaguagcugagagcuacaugcuaaccugcaggcaacaggcagaaagagaccaggccuggcauggucuuuugaaaccucaacagucuccccuucucccccccuccccccccccaauaacacacuuccuccagcaagaccaugccuuuuaauccuucuaauccuuucaaagagucccacugccuggugacuaagcauucaaauauauaaaccuauggggguccauucugauucagagcuccacaucugcuuuuauuacacagccuugggggucucaggaggggcugcaguauauaggcuggggaauauagaggauggggaaaggaauccaucucuggaagguagagaccauccagucuauacauuagauuuaccuacacuccugucagcaaccucucauacaagcucuguaaauaagcucaagaaaaauauuaauuccucacagagauucaaucuuugauuugucauugacacucuuugagaacagggguaggcauugcuuagucccccaccaggagaaaguuuucccaacagauguccaguuuacaggaguaaauaaaacuguguucacaggagacuuaagacagaugucucucaacagaggaauagauacagaaaaugugguacaucuaugcaauggaauacuacucagcuauuaaaaacaaugacuucaugaaauucauaggcaaauggauggaaauagaaaauaucuugagugagguaacccaaucacaaaagaauacacaugguaugcacucugauaaguggauaguagcccagaagcucaauacccaagauacaauucgcagaccacaugaagcucaagaagaaggaagaccaaaguauggauacuucuguccuccuuagaagcagggacaaaauacacauguucaacaaggaagaacaaauuuacagcauauuggagccuaaaggucagucucugauggaggucagccagaccugcaccuccuggaucaggagagaugacuggggaagacauacaggucagcauggagagucugggcugaacucacuuccuuagucauacugacaggaaacagagaccuggacauagaugccagccauugaaagaaaagucaggacccuuugaagucacagaaggcagguauaucacacuauagaaggaaauaaugaagaacaaauucugauuggugauuguuaaaccaugauaccaaacaagcaucuauacuaacaauaauuccagucuagcaagugaccccagcgcaggaauauguucucugaguacuuccuauccuacugggagagaugcauaagaucucugggcacuguccauucguauggcaguacagcauaagaccuguuaagggcccacagcaauagggcccagagagaaaaugugugagcacacacaaugguuaccugucuucccuauugcaaggggcucaggaaccaacuuccauuuaauuacuggcagcugaaauauaggugccucuuucccaccugugggaagaacacagccaaugagagacucuggaagcaguaauauugugggaguggaaaaaucccuuggucaagccccagggaaguuucuugaacugugacugcaccuccauagauguaggaggaaacacaauggaagauuguauguaaagaggacuuaauggccuucuguaggucuggucucagcagggaccuucucuguggcaucucucugucugugaggaaucagaaucaggucuccaucaccuccaucaagaggcagugaaucuauauuuccuuuaugauuuaugauagaguuaaugucagcacacaagccccagugccuuaguggauacaucuuuccucuaaugaggcaggcuacuuuuauauuuuggccuugagaucacuagggagacaagaaauuagacccuuccccuuucuuaccuuuauuucuuccacaccagaaaaaccaccacaguuccuaccaggaaaguuccaagaaccaggccgaugagaauugcuaugauggggaugguuuguggaggcucugaggagagaaaggaaggaagagugaggagucugacccuagcucucaacccugauccugcucuaguucaucaaagagcucacacaauuccugacagcagugugugugcucacacccacuccuuaccccauuuuagagugagaggcucagguaacccuucauggugcacaugacauguguaucucagcucuucuccagagggaaccaccacagcugcccacuucuggaagguuccauccccugcaggccuggugucuggcagcuccauguccuggguguaguuuuucccaucucucuuccaggucagggugaugucagcuggguagaagcccagggcccagcaccucagggugacauucccuucaggucuuacauggugggucacauguguucggggggcaucugaggggaacaauuggaaaauucagguauuuugcacuccucugggggccugagcagugcucaugggaccaucccuggaaaggaugggagacuuggaugagggagggagcagaguccacacagaagccuacacucaggaucuggaugaucuauuccuuggauuauuuuacaauaaccaugagccaacacagaacaggaaauucuagacaaauagacuucucuuuuugauuggggagggggucuagggacucagcaacccuggagucagacuuuaaaugucauugugcaaggacagugauccggccugagagaggccaugauacacagugcagauggaagggaacugcuguuaauggacacacugaacuguccugggagaaggcugaauccucuggagagucccucucucacguugagucaggacacgaggagcucucuuuccccuuugaugcaagacaguguaagcauuccagcugcucccugcugaggaggaggccucagggaggcaggagcuccaaugucagaaagcagaagggguugucaagggccucucaccagagcgcagcaaggucuccuuuccgagguccaggcaucuaagaagccuuucugugcacuccccuagcagguagguccuccagccuuccgcugcgccuacauucaccaagucugucuucaggaacccagcugccucucccugugcuguccaggaacucagguccucauucagguugaugaacucauagccguaguaggugagccgguagagaccgccgaggaagcucccaucauuauccacauugcagccaaacacuuccugcagggugugauauucugccccacccccauuaagucucuggucacugugaggcuucucuuccaucccgggauuuguccccaacuaaaccccuaaccagaucacagucugugguucucucaggucaaggucuccaggggucccuuugacuauggcugaaucuaugauuuggggaccuagaguggagcuuauugggccaaaccagggggacauugagggcuuaugaccucagcccugagaugacuuacccucauugcucuguucauuguagaucaucauguaccuaagaagucuuucguuugucagugacaagcgcaggacuugugcugucuccuucucccaauauucagguggcuccugcuccauccaugcagcccgagguugcauccuugcagucgguucuuugcugucaaaucccugauacuguauggagucuacauagccgaccuggaugauccggggcuccaacgugccaugcuucaaaaucacaguauugaaagucugcagccagugugagccuguggguggggcacauugagacccugccucuucagcuuagacccagagcagguugguagggagcagagcggggugguggugugugucuguggaccugagaugcaggagagggucagggugauccagcucggggaucagggagggucugguuaugcaagggagaaagugcagagaugaggauuucaagugcuguguucugcucccccaaaguccaguucccuccaugcccggcacccaccugcacaauacugggucagguccaaggccaccaagaggaggaggaaguugcaggguccaggguucaucuuucaagaugaguggagucucaauggggacugguaucucuuuauaacccugauguggcagaugccgauuggcuucucuuagauuucccaaggguagugacauagaccugauggagugggacuucaagagauuaauuccugguggucagugauuucuagaguccugcuuccccaucuugcacccacuucugcaaucugguauucuggcaucugugucuaagcacaagucuaucuuucugguucgggucacaacauccuugaguccuugacuagaggccaguaagucagcaguugucaaauguuucaaugucagaaucucaauacaugcuuagacuuuguuuacccuucuguggugacugugcauguguggauuauagcaauccaugucuaucaugauaggaaccggagguuuugagaguuuugauucaauguauauauugauaacuaauugcauguaaggugaaugagaagagaaagaacaauuuuccgaaacgaaaugaugcugccagaagaacuuuuuggauauuuaauauuuuuuuggaguccuuauuuucagcuuccccacuguagaucauaggauuuuguaucuuccuucuagaauuuuuuuuaauauuugaaacagagaaaaaugcaguuucacagauauauuuuaggagaaacaaucuuaagauuccguuuuauuuguauguauuuuggugagucucuuugugugugcaaagaacucauagguuccagaagagguagucagaaacccuggaucuggaguuaaggaacaugugaccuuccagacucaagugcugggaaaucagcucugguccucugcaagagcagcaagggccuuucauguuaguuuucuuuugaaacagcaucucaguaugcagccuggcuggucugggaaguggcuauguagaccaggcuggccuagcacucagaaaucuaugcuacuggcuccaaaaugcucggaauaaaaggacuuugccaaccaaguggguaauuguuaauuuuucacauugauaagucacuaaaugggcacaggugguacuuccuuaagguuguucacgcugaggacagcaaacaucauugaauccuuuauuauuggcugcauucacauccacaggagaaucuugcacacugaauggaugccaaguuaaugaauguuacuuugaaguaggacauucuuugacaaaguccuuucaguaaaauuuucaaaaccucagucaucggccgggcgugguggcgcacgccuuuaaucccaccacuugggaggcagaggcaggcggauuucugaauucgaggccagccuggucuacaaagugaguuccaggacagccagagcuauacagagaaacccugucucgaaaaaccaaaaacaaccaaaaaccaaaaaccaaaaccaaaaaaaaaaaaaaccaaccaaccaaacaaaaaaacaaaaccccccaacaacaacaaaaaacaaaccacccuuaaguugucagugaagaagucacaagucaaguguccaaaaucacugauguuauuuugggagcuuagauauuaucuuuguuguagucaacuagguaagggaucaguugcugaugaauggaauuuuuuuguuuguuuuuaugcugugggaggaacaauacauuucuaaucauauugccaaggaguucaggcugggcaggaagaagagcuccaccagccccguguggcugcagaugcagguuccacacuuuggagaaauaguuguuccuuaggcagguccuuuauucagcuaucuggaaugagacccacuaccuauaaaugagggaugucuagacuggcugcuguacaguucugugcaguuuacaagcaccucuauuaaugucacuuguaagcaccucuguccaugccacuuccagugaugugacucugaguucaguccuggcuggucacaauucaguccugguuggaggaucugggcucagggcuggaaaugcugcucugagaugucagcuuccaguauucugcagccuaugauuugccuggaggggaggauuuccuuuugggagucuuggaacaagcuugagcgauucccuagugaucaccuguuuuguuuucugaucucuuauuaauggccuucccacugcugcuggcauaugugacucagugcauuauccaaagcagugcuucucacccuuccuaaugcuggaacacuuuaauacaguuccuugugggaagccgcaaaagccauuacaagauggcgcugguuucuuuaugccgacgcccaugaauuuggguaaacaaccaaugugcgcaugugcauaagaguuuuuuacugagucacugcuuggccugaugcauauuaaugagguacugguagcauaaucaaucagguauggacacgucacuccuaggccuauauaagcagcgccauuucugggcuuggggucuuucgccuauguaguccaugcucucccaauaaacguguugcagaaggauccuguuguggcgucucacuugcuggcaagucgggcaucccacaguuccucacguuguggugaccccaaccaucaaauugccuuuuuugcuacuucauaacugucauuuguauuuuaaucucaauguaagaauuuuuggauacacagguuugccaaugagguagcaacgcacauguuuagaaccacugauuuaaagugcuaugguuaggucauuguugagaacuacgucauaauuaaguguguaagucuauggaauccuuauuucucugauucuguuaaauugaccuggauuucaugaacaugagacuauuacagugacucuuuauagcaauaaaaauccuaagacaguguaaaauacuauuuaauacuaaaaauauucucuaauagaauucuucuaauguagaaggcaaugguggugcaugccuguaacacuugucauugggaagcagaggaguucaaaccuuccugaacuagaggggauucauuucuuuucuuuuuuuuuuuucucuugguuuuucgagacaggguuucucuguguagcccuggcuguccuggaacucacuuuguagaccaggcuggccucuaacucagagauccgccugccucugccucccaaguggugggauuaaaggcgugcgccaccacacccagcaggauucauuucuuaaagagcaaaagcauugacaaaaauucacauagcaauuaaauacuuccugucuacaaaucucaucugaaacauuacugcaauuuuuucccccacacacauaaguggacacaguucagauugucuccggagagcuaggugucaaggcacacccaagcaaacccagcauuuggaagguucaggcaggaggaucaggaguucaagaccaugauggaggggaagacacagucucuuucugauggagucuccagagaaugaacuggggaaaguuagucaacagcugucagaggaggcgagcaaugacaggaaaucucuagcuuauuuacaaagaaauacaggaaauaauacagagcagaccagggaagaguccuguccuguacuuaagucuaacccucaugguaggauccugcagaugaacuugguggguaggcagcagucacagaccuccauuuuucuccccuguucugagaacaggagaguggcaccucccuucucugcagcacugaguacacgucuaacacucuguagaaacauuaaacaaaaccggauagggcugggacacucggguauaacacauggaaacaucugccaggaguaagugaggguggcuuggauaaaaacuaucagaagcagugugugauggcaagaaucauguaccuuauuagcaaaguagaaaaggaaacauuagaaagcagaagggaaaaguccagaauucauaaaggggguacugugggccuagcgagcacccacaccgaauagaagugaucagagcuaugguaaagacagaaggauccuuaaaaaaaaaauccauugugcucccaguaacagauauuuuaauucuagagagagggagcaagauagacaagaauguuacaagcagacauagcaggagagauaguggaaaacacucuccacucaguucucaaccagagcaguuuuguuuuuuuuuguuuuuuguuuuucaaagaccucuacugagcuggugguuuguuagccccagccccuccaguaaccacucucucaggacagucagagcauuggaauauaugcugacaccuggccagauggaaaacacaggaaggaagaggcuuuaaaucagugcagauuucagugugguagaauacuugucagacccagagucugcacagaccauugacacggguuccauccaguuuaagugugugcucacaagaugacaggaagauccuuauagagguccagucauguuucaaaaugagacuguagaagacauguccagagugucagcagcauaugagaacugacucauggggggugccuagugguggaaccucuaccuucuguggugucaaacugugaaggauugcccaggggcacaguauacucccaaaggcaucaaggcugcaagcagcaagcaggugagacuucauuuugucuuuauauccuacaggacugccugucgccccagcucaucuaacccuccucaauuuaugauacauuugguucgacaaggcugcugucuugucacagcaggcaaugcauucagcccaggguaagccaguuauacaaggacaucacacuucauuuuuuuguaccagguuuuacucauguuucguacaugaaucaaccaccuaccaugguaagagauaucaaaacacuagacaaaugcauaucuucaguaaggaagugugacuuuguaguucagugaaaagaaaaguuuagucagugauggagauuucuaagccagccucugcuaagagagggagagaugacagggaagcagacacaugucaguguagggagggcucagugcugugggcuguccuggagacauucccuccagcaugucccagagccuccucuguaucuggaacacagcaacaagccucuggcaaaaaagauuuaaucuaggcaacagcugucuucacacccauuguguucugcagggagggagcaacugagguacaggaagucuuucucauucuguaugaccauugcuuuccauuucacgcccugccaugcaacagcuacagagcugggaagcuaccccaugccacagaugcaaacuguggcaccaagauaagaucacccuaauagaagaugcuccugugaacacaguugugggaaaaggaugcugcaacuacauaggacccaagaaauggguaaggguaaaaagccuggguccuuaaucucugagauauuaaaugguggcaauaaugugggugcuugaaaaauuuaaaagguucccagguacaggaagguacagaauuuuggcugcauauuugugccuugaggaucuuuggaaggucaauguggugucacagagggacacaggauaaauuuugaguggaguucauaagagaucugucaguagugcauuaucuuuuucacuucuugccauuguacacuuggcauucuaugaacauggccacugacaaagaagccaacuccauccuaaaguucuugauccucuuaggaucuguuuggucucugauaaccagaaagcugcacauuagugcaauuggacucagcacaccagucaaaaaccgugaugugacuagacaaugaaaccauagaucagcaacagagauggauaugucagggagauagguaggccuuuguuuucuuuuccuuccuugauucugucaaccagaucagcaucugggcuaggacucagauggauguugucagcaggacagguauggugaucaggguaaacaacuugucccaagacacugcuccuaggauauaugggacuagaacugaaucuguggucaggaagccaggcuauggagguuuguccccaauaauuaaucuuuucaugaccccucaggucucaguaucucccacuguguacuguaagagaagccaaucagccucuuccagaagcucagaaauguauugugaauggaaaucauucuggacuaaaccuguaccaucauuuaggcggaagacucuguuaccugaaguccuccucuugcugcuggcagcuaugcuggccugaacucugagauauuaaaugguggcaucugaguauuggaacugagagaaagaaucucauucugaagccacaaggaugcugugcaucacugcagacaugggaagccuagcuuuggcccugcuugucccagcaacuccaggcuuccccuuuaggcuccccuugccuggcuuccuauaucauccagguccagagcugggcucccuguucaccccccagccuagugaacuuucucaggugccaggaggagggcagggucccauugcauguugguuuuaggcuccuaugagcuguguuauuucuaugcccuuucuccugaggcugcccuccuggagcccugggucucauucauucuugaguuguguuucaggcaugcagauugugggaagcaauagagaucuuggacuugcucuucuacuacaggcugagcagagauggugagugucaucagcuggauuacgauagaccagcuaaacaggaguaucugaaaaauggcuuuggcccuugaucuggcugaguccuuaagggagaauauuuuccauaaucucuccuguugugguuauuuucaauguuucuaccuuuuuuucccuucccuucuccauuaauuaauaaauauuauucauuuuuauuaugugugugacuuuuuccuccuguauauaugucuaagcaccaugaugguaucugaugguuguggagaucagaaaacggcuucacauucccuguguuuugaauuagaugguuguagguugaugugcaggugcuaggaauugaaugcgagucuccuggaagagcagucagugcucuuuauuacugggacaucuguccagccccuaauuauuauuauuuauuauuauuaucuaauuauuuagauccccaaauaauucuuccugaaaaccuauagcaguauucuggaauucuuugucuuaaacaggcuucugaccauuacuucucacaggauggauauuuuauagacgcacugaucuccauucaugaaaugaacacuuccuuuuguucugguucaugcacuuuccuucuuaacuuuacuaauauauuuagagaugucuguagaucauuucuaauucacacagcuauuacugaaguugcagagacuuuucuauugcacauuuuacuggacuauccuugaguguuauguuguccuccauccuuaggaaguggguaucccugccuccucuuuuuuuguuuucuguaucuacaugcuaugagacccagcaucaguacugaauaugauucuguggucuuuauucucaggaugucucuaguuccugacagcaacaggagugugucuuugauggaccucaaagcccuggacacuugagcacauacaacuuaagggugauacuaucaucagaagguuuagugucagagcuugguuucugacaacaguaaugagaaaagaucugacaaaacaaacaaacaaaaaacaaugaaagagauagaugugguaauauuuaggaaaaggaauuuaugagauguggucauaguugaaagagaagugagccaguacugagacucccucagguccuccagguucaucuuuaggauuuugacaugaguuucaagauuauuauuuuuuuuuccauuuuuuauuagguauuucgcucauuuacauuugcaaugcuauaccaaaagucccccauagccacccacccccucuccccuacccacccacuccccuuuuauggcccuggcguuccccuguacuggggcauauaaaguuugccuguccaaugggccucucuuucgagugauggccgacuaggccaucuuuugaugcauaugcagcuagagucaagagcuccgggguacugguuaguucauaauguuguuccaccuauaggguugcagaucccuuuagcuucuuugguacuuucucuagcuccuucauugggggccaugugauccauccaauagccgacugugagcauccacuucuauguuugcuaggcccaggcauacucugacaagagacagcuauaucaggguccuuucagcauaaucuugcuaguguaugcaauggugucagcauuuggaagcugauuaugggauggauccccggauaugcuagugucuacaugguccauccuuuuaucucagcuccaaacuuugucucuguaacuccuuccaaggguguuuuguucccacuucuaaggaggggcauaguguucacacuucagucuucauuuuucuugaguuucauguguuuaggaaauuguaucuuauaucuuggguaucuuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugcccaggagagguauugcuggauccuccgguaguacuauauccaguuuucugaggaaccgccagacugauuuccauagugguuguacaagccugcaaucccaccaacaauggaggaguguuccucuuucuccacauccacgccagcaucugcugucaccugaauuuuugaucuuagccauucugacuggugugagguggaaucucaggguuguuuugauuugcauuucccugaugauuaaggauguugagcauuuuuucaggugcuucucugccauucgguauuccucaggugagaauucuuuguucaguucugagccccauuuuuuaaugggguuauuugacuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagagcaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuagcucccuugucgaagaucaagugaccauagguguguggguucauuucugggucuucaauucuauuccauuggucuacuugucugucucuauaccaguaccaugcaguuuuuaucacaauugcucuguaguaaagcuuuaggucaggcauggugauuccaccagagguucuuuuauccuugagaagaguuuuugcuauccuagguuuuuuguuauuccagaugaauuugcaaauugcuccuucuaauucguugaagaauugaguuggaauuuugauggggauugcauugaaucuguagauugcuuuuggcaagauagccauuuuuacaauguugauccugccaauccaugagcaugggagaucuuuccaucuucugagaucuucuuuaauuucuuucuucagagacuugaaguuuuuaucauacagaucuuuuacuuccuuaguuagagucacgccgagauauuuuauauuauuugugacuauugagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcaaccuugucuagucccugauuuuagugggauugcuuccagcuucucuccauuuacuuugauguuggcuacugguuugcuguagauugcuuuuauuauguuuagguaugggccuugaauuccugaucuuuccaaaacuuuuaucaugaauggguguuggaucucgucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauuucuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuaucuugugaaauaguuugugcagaacuggaauuagaucuucuuugaaggucugauagaacucugcacuaaacccaucugguccugggcuuuuuuuggcugggagacuauuaauaacuacuucuauuucuuuaggggauaugggacuguuuagaaggucaacuugauccugauucaacuuugguaccugguaucuguccagaaauuuguccauuucuuccagguuuuccaguuuuguugaguauaagcuuuuguagaaggaucugaugguguuuuggauuucuucaggaucuguuguuaugucucccuuuucauuucugauuuuguugauuaggauuuugucccuuugcccucuagugagucuagcuaagggcuuaucuaucuuguugauuuucucaaagaaccaacuccucguuugguuaauucuuugaauaguucuucuuguuuccacuugguuaauuucaccccugaguuugauuauuuccugccgucuacuccucuugggugaauuugcuuccuucaagauuaaauauagaaauuaguagauucccuuuuccccauuuuauaguucuucccuuuuaaaaauuuuucuucauucauaaacuggagguuucugggcgucacucaccucuucugcuggcaguuaccuaauuagucccagguuauucuauggagguuccuucacucugugcauauguguccucccauaccauuguuugccgauccuugaacuucugacuuuccuaccucuacuuuucauguguuggcauuacaagugcaugcagugauacaaaagccuucuuugaaguucuauaguauuuccacuuauccaugucuauaaggaauggcaggaauuuagcaaguaauguagucugguaguaaguguauacuuucagugugcaauuuugcuuugguuuuuguuguguugugguuauuguuguauugguuuaggaucuaguguagcuugucauggucuucaucuccugguauuuaugucucuucuuucaaaguguugguuuggaggcaugaagugaccauguguuguuccaaaauaugacuuuuguaaauacaauguuaaaacauuuuucauaaaaaagaaaagauauugaagaauuuuuuugagcagcauuagccuccauuuuauggaauccauucccauguaaaagaaucaauggcaaaacauuagauuuguuuacacugggaaugacaggaacaaggaucaugcuaaccucccaacuuuuggguauaucaccagcucuggacuccuguccacgaggucugaauaacguggcaggaaacuacacacaagaaauucauuaaaacgaggacuucucuaaaauagagaacccuacugccaaugacagucaaagcuucugguucuccuccuacuacccacccugcacuccuuuggaauauaauuauugaauauauuuucuggucucucuaauauacaaugcaaaucaaucaauagcccucugaucccucucuauucagcgaaaacagggauacauuuuuagcccucaaagggauacuuguaauucuggacacuugaauucuucaccauaaauuuaacaacuucuuacacuuaaaaauuuuuaugggaaauuuguggugauauggaaauagguguugaaggaugauuuugugcagugugcuuucaaauucuguuuucuguacccagauaccugguuguagccccaacuuugguauugucacuauuaugaaguuucaccugacucaguauuuuauaaaauguuuuccaucauguucuucauggacaauaaucuuagaacugaacacccaauaguugugcaggaaaggcaaagggcugcaauuucaggcccagagugaguguguggugggggucaaauggggauauagauaaagcagcagggaagagcuuggcuaagaaggcagauaucaggccacauggcugagaaggggucuaguccagaauuccaggauuagaauagcucagaauuugcccaacuauuguaccuaaaguuacuaauaaauauaaaggucuuuaugcaggcuugcaauacugauuuuuuuuacaauuuacaacugacuuacuugaucauuuuuaaauguucgaguacuaaaaccuuuaaggucuuggucauaccuugaccuccuuuaaaaauuacauuuauggacacaguacauaugcgaugugcaaugcucuccaauggauguagaugcaguagacaucaaaugauccagugauguugccaguccacagggaagacaaccuugaagaagugccauauguggcaauuuaguaaaguaucaaaggcaaacucuacaaugugucccguggaguggauccugccauucaucacuaaguuuuaaugacuuugagugcaugggcauuuugucauuaugcaugucucuguaccccaaacucuguaagaaaggaggcuggggucccuguagacuggauggagaguugugagcagccauguguauaguaggaauucaacacaguuucccuggaagaacagccaguccucccucuuaccugcugaucugucucucuagcccauaucuauuaagcucagcauagagaaggcagaugcaaagggaucuugguguuccagaccagcuugagcuucauagcaaagcccaggccagggcaguuuauauaacuauaccccaucuccaaagaguauccugcugguaguaacaaaaacauuuaauuaguuuauaaaauuauuuaaauuucuuaaaauaauuuuuauuccaauuauuuaauacuuguaaaaauauucugugucugcugagauggcucagcaaugaaaagcacuugcuguucuugcaaaaaucuagaacugaauuucuugcauauacaugcaagucacaaccaucucuaacuacacuuccaguauuuguggugacucuuuuucuucccuuuuuuucuuuuuuuuucuuucuuucuuuuuuuuuuuuuuuugugucuuugagacaggguuucucuguauagcccuggcuguccuggaacucacuuuguagaccaggcuggccuugaacucagaaaucugccugccucugccuccugagugcugggauuaaaggcguguaccaccacgcccggugacucuuuuuccuauuacacacucauaaacauacacagaaacagagacacagaaauaggcagagacagugacaaacauauaaacacacacacacagauauagcuacagauacagacacacacagacacacacacacauaaaaauauguacagcuuacauguuucugcuaagcaugguucuguuaauuuucugaaauuaaguagaaagcuguuuuaaaugaauaaacacccuauuaauugauggaaaaguuaaaguuccuugccaaaauguaaauuucaaaaauauuaucuauucuauccaccaucauuaugccuugaaaauguguaauuuucuuuuaaaauaucauucuuacaugcaaguaguuacaauaucuucaauaagccuaaugucucaaacucucaguucauggcauggucaguaugacuuaguaaaauccaccuaggaagaauuaccuugaggcccauucacuuuguaagugagaagagauccugucaugaaaaugauugggcauugcugacuuacccucccccaagcuggacucagaaggauguugucaacaggaccagcacaagcuuugggguaagcaucagguccccagacacugcuuccaggauaauaguccacagaggugggucugaggugggaaacaggacucuagagaugcggcacccaggaguucaucuuuccauuacccacccaccugucccugucacuuccauagacaagucuaggaagggcaagcagccucccugaugucagguguaugaaaugaaaugggaaauguucacagucagccucuacucaucauccaaguugagucucaaccaaagagucucuguauuggauuggagugguggguggugcauccuugacuguaucagaguggagaaguugagcucaggacaagcaaggaaacaugcagucaucucucuaugguuuuuccuuuuacugaaaauagauuuuuuucuuccauaguauauucugauaaggguguccccuuucucuacuccucccaguuucuucccaucucuccaaccaucuggaucugcccaccuuuuguaccuuuuuagaaaacaaacaggcuucuuagggauaaugauacgguaaauaaaauauuauuguuguggucuccgaguccaccacggucagcggagugaugaucugugggaggcaagcagguaguuugguuuaacaagucuaagaacauaaaguauugguugaaacuuaaggagucugaccccaauaguuuauuucaggcauauuuaaacaaaacacaauuuggugaaaaauuuuccuggugacaauugagccaaucaucucugcacaauaagcuuaagaugugacuguuggguuuguggguucaggaguugcccacaaaccacauggagaccaaucucaguaagacagcgaugauuuauggaauauacacccuaauucugaucgaucagagccacagcucaguaucugggugcugagcuaugaugcugaacaucucucagggccggcuuaugaaggaaaagccacagcgagcucaugcacaggugcaggaugugcugccugguggucggcucugacgcaagcuguuuucccuaauagacagaacaggucuaacugaccauuauucugauugguccucaguggagcuuacagacguggcaauucuuuuuuuuuuuuaauuuauuuuuuuaauuagguauuuucuucauuuacauuucaaaugcuaucccaaaaguccucccuccccuccccucccccucccacuuuuuggcccuggcauuucccuguacugaggcauauaaaguuugcaagaccaagggccucucuucccaaugauggccaucuucugcuacauaugcagcuagagacacgagcuccggggguacugauuaguucauauuguuguuccaccuauaggguugcagaccccuucagcuccuuggguacuuucucuagcuccuccauuaaaauuaacaaauaucaggaauauaaugacagaacauaacaagcuagguugaguucagcaaaacccugaucuaugucaaguuauuuuucugggucaaugacagggaggcauauuacagcaacaauaugagauagcuagcagucaugggacaaaaugucuacaguuauucuagaggggcggaccuuacagugacgacaucaaaacucuugguaaacuacauaugauaucuuccauaaagauuguuuuuauagauugacucugugugacaccuugccugcagucaguuguguaggcauuuucuucaucaaugugggccuuacagucaguuuguggagaacaauccauacucuuggcaacagccuggguuguuugagggauucccuugggaccuuuuuggcuaacaacucaauuagacaaauucccauaccagaagcuucauuugaugacaagaaaugugaacuugggccucugucuuccccacuguuuggugauuucauuuuuauuucccucauauauguaaacauuuuaagaaucuuauguguuagguuuccauacuaccccaaaauagccuuuaguuuuagcugucucuccaugaauucccucccuuauccuccucuccuucuacuuccccacuagauucuccaguuccagcuccccauccauccaugacuguuuauucugcuuccacuaacuauuugcucccaccccuacuucuuuauucugucgaaguagaaauuuuaggguucuuuggaaagucaguugugucugaugguguuuuucuggggcaaacaugugaagaacauuucucugaagcaaucacagaugaaaggauauuuugcuaaagcaaacaugggaaagaacacaugauggauucuuugcuaaugacaugcaugcuuuggucugccucacauugucuaauugaguuccuuuugucaugacucaaugucaugucaugaccauaagagagaaauucacaagaaaacuuguggugguauguugacagcuucuugacgauuggcauacucaugcugauuggcagaauacuaucaacugagugugauucacugcugaagcaagacaggcggucagggaagacccauggaggauaugugauuuuuggagugaguauaaauaaggaucaauggucugugagaagagauuagcuugcuugcagagugcuguucaacucuugucagucuccaguuuucacugaucuuucugauguuguuguugcagaaaacauuuccucgaauuccuguuuguccuuguccagcuuacuugugacauuucagcugaggccuggcacuucugcuauguugugucacuucugcugauuguguuugcuaucccuacucuacugaacuguauugcugggauuuccaugaaguguuggugaguguaucgagcugucacuggugagcugugaacugaacugcuguuuuccugacaauaaauggauuugcccaaugaaccauuucuaaacucgucuucuucccccgcccgccauauccuuucucuuccacuaugucacguggauugugugcuagaagggagauuaaagcauguaagaaccaucauuaaaaguaggcauugaaaaaaauuaaauuuggggaggaaaaauaaaagaaaaaaauuaaauuuucacucuaucacuuguuuuauagauuguucuaaacagugcgagaugcaaucucaacguaguuuugauuuacauuucucugaugacuaagaauguugaacauuucuuuaaacaaucauuuucuuuccucuuuugagaauucucuggacuccauuuuaaaauucaguuuuuucuuuaaaucucauuuuuugaguuuaauuuugucuauuagcccucuaucagauguguagaugguaaauaucuuucacauuuuguaggccaacacuuugucugaaugauaguguccuuugucuuauagaagcuuuuguguuucaugaggucccaguuauuaauuguugaucuuaguuccuguguuauugguguuguuuagaaagucaucuccuaugccaguacauucaaggcuauugcccacuuucacuuuuaucagguuaaguguguguagcugguguuugcuacuuuguguguucuucuuucucccgcucucucaauuagggauuuccugcuguggagagacaccaugaccaaagcuacucguauaaaggacauuauuuaauuggggcuggcuuucagguuuagagguucaguccauuaucaucaaggugugagcauggcaguguccagguagaugugggccuggaggagcugagaguucuauauauucauccaaagguagagaggagaagagaauucauuuuaggaaagauuccugcgauuaauaaguguuucuguuacuauuaaacauuuaucaaucacuagauauuagcucacccuuuuugagcauaucucugcagaucuacaaagagguacugucuuguagugaugcuauacggccaaauagauuauuucuuaauucauaaugauauguuaaguucauuugguuuauaacacaaguuagcugcagcauuucucugcuuaguuuuugucuggaugaccugucuguugguaagagucaaguagggaaguaucucacugucaguguuugguacaauaugugauuuaagcuguacuaauguucuuuuaugaauuugaguugcaauauacuugggccauaugcaucaaaaauugcaaugugcucuaaguggacauuucacuugaugaguauauauaccuuuuaauuaguuuuguguugaagucuaguuugucagauauuaaaauggcuauaccagcuuucuucuuaggucuauuugcuuagaauaucauuuuucacccuuuuuacccugauguccauccuugaugucaagauguguuucuguuucuuggaugcauuggaagguugcauacuguuuuuauauccauauuguugagaccauugauauugagagaugauaaugagcgguguuuuugauuccuguuauuucauugaugguagugauuguuguugucgguguguguauuuguuucuuauuuauuuauuuauuuauuuauuuauuuauuaguuuuucgggacaggguuucucuguauagccccggcuguccuggaacucacucuguagaccaggcuggccucaaacucagaaauccgcuugccucugccuccugagugcugggauuaaaggugugugccaccacgcccagcuguguuucuccuuuauugauuugcugguuuggcauuauuuauuuuugugugugguucuuuauuuccuguguguggauuauuuauuucuuaggugugguuggcucaaguuuuccuuaucuuauuuucuuuagagguugauuuuuagcuagauauugcuuaacuuuuuuugugguuucuugagauaggguuucucuguauagcccuggcaggccuggaacucauucuguugaucaggcuggccuugaacucacaauuucaccugccucuuccucccaaguuaaacuuugguuuuaucauggaauguucuucuuuuccccaaaugcugugauuguuauuugauugauacuuuuuucuuaguaguagucuuagacuggcacuuguggugucuucaaguuuuagaacaucuguccaggccauucuggguuuuaggaucuucauuggcaaugcagguguuaucuaauaggucggccucuguauguaacuuggucuuuuucccauccuccuuuuaauguuuuucuuuguucuguuauguuuauuguuuugaugguuaugugacaaagggacuuucuuuucuagcccagucuauuugguguucaggaugccuuuugcaccuuuauaggcaucaccuucuucagguuaggaaaauuuccuucuaugauuuuguuggaaauauuuucugugacuuugaccuguguuuucuuuugguuuuuggagucacaaucccucuguguauugcuggcuguccuggaacccacugugcagaccaggcuugucuggaacucagagagccacuuguuucugccucccuaguacuggaccugaaggugugagccacucccaccagcuugaccuguguuucuuccccuuuuaaaauuucuauuauucuuagauuugucuuuucaugguguccuggauuaccugaauguuuugugccaggauauuuucagauuuaacguuuucuuuacugaaggaccuauucugucuaugauuuugcugaaaccccuuagauucucucuuccauucuugcuauucgguuagugaggcuugccucucagguuccuguuagaauuccuaaauuauuuacuuccauauuucccucaguuugggguuccuuuauugauucuguuucuacuuucagguuuugaacgguuuuauccauuuccuuccaccauuuguguuuucauauauuucguuaagggauuuuaaaaaauuauuuuccuguuaagaaccucuauucuacaaauaaagggaauaaaggcuaucuuaagauccuguguguguguguguguguuuguguguuugggcacacauacuuuagcuguguuguaacacuuagugucugcugugcuagagcuguuaggcucuguuggauuuacaucccccgggcuguuacugauuugucuuuaugcuggcauauggguaucuggguuuggaaagaucauauuuuagguaccuauaucuggucuuuguuguuugaguauuuuguuuauguuaauauuucuguuucaugugagacauagugacuguguaucaccugauagggauuacuucuagaauccagauagauguagccacuggggauucuagguaaaauguauuucuagguauugggagcugacacuuaggaguaaggaagggcuaggagggggugggcugugugugugggguccacaggagggaggaaaguaggguguuucauugggaucugcuuauccccugguaauagauguagaaagugaggagaggccacagagaagaagaucugcaacagagguggagaugagaaugaugggucagacuuggaguaauagaggaguuacguagaucugaaauuagccuccaugcuuuccuggugaaaguggccugcagauucccaaggaaugccuguugacuuuggggacugggauaagccaugagugggagagaaagaaguuuggaguagaagauuugugugguccacuguagaaaggggguagaccaaaaggggagucacaguagaugguuggcuguggaacugggaaugagccuggggaauuggauuuuggggagcugagauagaggugaagaucuguaguuagccuauguguuucccaggcuggauucucucuucuugauguacuagccauuugcagauccuuccuugacuuccuugcaaugauggagggagaccuggaauuguaaccugcacuaauccucuuuauccucuacguugcuuuuuaaaaauuuuuggauuuuuuacuuugagguuauaauauaauuaauugcauuucuccuuucccuuuucucuacaccauaaaacucucccauucauuuccaaguggauguuuuuuaaaauuuacuguuauuaugugccugcuccgugugugugugugucuguguguguauguuccacauucaacacauaacacacacacacacacacacacacacacacacacacacacacacucacacacacaugcucuuauauauuaccugcucagccuauauaacaguauucguauauauguuuucaaccuacgcaugugguauuggauaaccacuugaugcuuuccucuguggaagacuauccccccaacucccagauuuccuuacgugccuguuguucuuuguggaugacugaggccuccuggacuuuucuuuggucacuuugucaugaauauuggcauugucucauucagcccagguuugagcagacauguaguugggauuuauggacacagcuacugauauuccuaagaggugcucuaucacagcaaacucccuuuagcuuccauucuucccaccccuucucuguuugaauauauguucuuacaugcgggagagucuaaggugcucuuuuucuuaaacuuuugucacacccacuagauuagugucuuuauuccaggugccuccaacagcaaaggaaaguccaaucucugcugaauggguagucagauuuccccacucccagugucuugguuauuccaggaauaguaaugugugaaagagugcucacaauauaagugucuagaacucacuaauauuaauaguuauuccagaguuuagcauggccuuaccuguguucaacaccugcucuacgucuagagagagguggguucuucuaauuaaccuaagcauuaaaaaucccuuguuuauuaacucccacagagugaaaagaaauuugcaugcauagguguuccucaugcaugcugcuagcucuuuuaaaccauuugauuuaggccccaaaguaaucauaauuuaaccuuuguaugguagcagauugugaagaacggucauaaucguacauuuaaugucaucauauguucaugucugcguaucagaauuuaaacaaucuuugaaaauuauuaaugucucuuuaauauacugauuacaaagcaaacaaaacaaaacaaaacaaccccaaaacaauccaaagagcuucaugagcacugcagugucgcaauaccauauuuauagguuguaaucucccucugguuuuuguuugcuacaagguucagguauugcucucauugugugagaaaguauuuaugcugcaucucagcuacaaaaaaugauccugagcccuuagugaucuguucuuugccagcugacccugaagcuuguccaguagauggcaguagagcagcaugaagggaaagcauggcauuucugugucuuacuuaggcuccuagccaggugccugcaaaaugagccuccagcaucugcucccauagcacaggaagcagcugcagcacccagugucugcaguacacagcgacucccacaaacagcagcuucacucgggaguggcccgcugugaucagguuuugguuggacucuacuauauuagaaguccuccauugaaguccuuuaaauccucuucuuagcaaggaaaaaaaaaaaaaagaaaaaaucacagauccucuucuuucucauagacuaacuguaaugauuaaucuuuuuugucaaggugaauggauuuaaggucauauaagagacaaaccuuugggcaugccuucaaacgcauuugcagagagguuuaacuaaaggaaggugacacuauaauccuagacuguagcccuagacuaaauacaagggguggggugggcaagaaaaaucaggugaccauugcauuccugguucucagucuccugguuggcugagagcagagccagcagccucacauccugcugccccagagauccuauccugaaguggaaccuuagggauucuuuggaaaguaaguuuuguuggcagaugcuguuuuggagggguaaacacaugaaggaaugcuuuccugcaguagauacuaguaaaaggauguguugaugaagcagacaugugaaggaacguuucaaugaagcagauucaggugaaaggguguuuugcuagagcaaacacuugaaaggacucgugcucauuucuucacucauuuuacgcauguauugauucaccuuacaugcauuguugaucuccuuuucucaggaguccauagagagauauacaccaaaagacuucugguagucuggcaacuucuuguuuuauccucggacuccaaaugauugguagaguaauuucagcugauacaaacucaugugguauuuugcuaagacagacucacgugcugaggcaagauaugugaugguuggugggggagggggaguauaaauaggacuccauggacucucagagggacuugucuguagaacuucuugaucuucgauuuguugagaaaggcacagaugagagcuucuaguguuccugcuuguccuaaucgcucuugcugacucgugucaauuuggcugaguccuggucauuccugcaaguuugugccaccacugcugauugguguuugguaucuggacucuacaaacugaacugcugguagauugcugaauauuugaaaguguacugagcuguuguuguugauuugugaacugaauugcuuaucugacaaugucgaugggauuugcuccaaacaacuaucucuauacaagcccacuuuccugaauccuaauaacauuucuuucccacuaccucugguugguggugggcuagaaaggguauuaaagaauuuaagaaacuauuaaaagucagguugagaaaaauguaagccuacacuaaaucaucuugucaccccuccugugggccuggguaccagagguuuuccauguaugucucuguccaggacuggugcgaggguuccagggaaaggaagugagugcaggcagggagaugaagucucugccuugccuuccaggucccucgguaacugggagccacucugaucugagucagauccggcugggcugaaggaaaaccagcaaggagugcagcgggacccaaguguuacauacagcucuuggaacaaaagacucggaugagggaguaguucuuuuuuaauuuauucuuuuuauuagauauuuucuuuauauacauuucaaaugcuauccugaaaguccccuaugccccuauauguuccacauauagggguugcagaccccuucagcuccuugggugcuuucucuaguuucuccauugggggcccugugauccauccaauagcugauugugagcauccacuucuguguuugccaggcacuggaauagccucacacgagauagcuauaucagggucccuucagcaaaaucuuucuggcauaugcaaugguguucggguuugguggcugauuaugggauggaucccugggugggguuuucuggauaguccauccuuucaucuuaguuccaaacuuugucucuguaacuccuuucauggguauuuuguucauuuuucuaaggaggaaugaaguauccaccuauuggucuucccucuucuugauuuucuuguguuuugcaaauuguaucuuggguguucuauguuucugggcuaaaaucuacuuaucagugagugcauaucuaaugacuucuuuugugauuggguuaccucacucaggaugauauccuccagauacauccauuuguccaagaauuucauaaauccacuguuuuuaauagcugaguaguacuccacuguguaaauguaccauauuuucuguauccauucuucuguugaggggcaucuggguucuuuccagcuucuggcuauuauaaauaaggcugcuaugaacauaguggagcauguguucuuauugccauuggaauuucuucuggguauaugcccaggagagauauugcuggaucuuccgguaguauuauguccaauuuucugaggaaccuccaaacugacuuccugagugguuguacaagcuugcaaucccaccagcaauggaggaguguuccucuuucuccacauccuugccagcaucugcugucaccugaauuuuucaucuuagccauucugacuggugugagguggaaucucaagguuguuuugauuuaaacucagacacuauugcauacaccagcaaaauuuugcugaaaggacccugauauggcugucucgugugaggcuaggccagugucuggcaaauacagaaguggaugcucauagucaucuauuggauggaacacagggcccccaauggaggagcuagagaaagcacccaaggagcugaaggggucugcaacccuauagguggaacaacaauaugagcuaaccaguauccccagagcuugugucucuagcuguauauguagcagaagauggccuaguuggccaucauugggaagagaggucguuuggucuuguaaacuuuauaugccccaguacaggggaaugcuagaaccaagaagugggaguggguggguaggggagcagggcggguggaggguauaggggacuuuugggauagcauuugaaauguaaaugaagaaaauaucuaauaaaaaauugaaagauaaauaaauaaauaaaaagaaucuacuuugaacuuagcucuuuuuucuuuuucuuuuuccuuuuaaaaauuuuuucuguuuuuuaguuuuucuuuuuuuauuagauauuuucuuuauuuauauuucaaauauuauccccuuuccuaguuuccccucugaaaauccccuauccccucccuuuucccccaacucccaaaccaagccacuccuauuccuuccuggcccuggcauuccccuauacuggggcaaagaaaguucacaggaccaagggccucuccucccauugaugacugacuaagccauccucugcuacauaugcagcuagagccacaagucucaccauaugcuuucuuugauugguggucccaaggagcuccagggguacugauuaguucauauugagguuccuccuaugggacugcaaaacccuucagcuccuuggguacuuucucuugcuccuucauuggggacccugugcucuguccacuggaugacugugagcauccacuucuguauuugccaggcacuggcagagccucucaggagacagcuguuaucaggcuccugucagcaagcucuuguuggcaucugccauagugucuggguuuggugguuguuuaugggaugguucaccaagugaggcagucuauggauggucguuccuucagucucugcucugaacuuugucucuguaacuucuuccauggguauuuuguucccccuucuaagaaggauuccgaguuucugggcuaauauucacuuaucacugaguauauaucauguguguucuuuugugauugaguuaccucacuuaggaugauauccuccagaugcauccauacugaaagucuuuaguugugcagaagagauguaggcauuguuucauuugcuuaucuugggucugaggagagaaaacaaggggaaauaggagagagugaaaaagggagaagagacuucuugagguggguagaucaugaaagccuggcucugagugccagccaguuguaguaggagaggcucagauggaacaugggaagucguaucuccagguuauugauagagaaguagauaaaauagcauagaagguugauaucuucccagcucuugugcuuuuaaggcuuaucaugaacauaaguguuuugugucuuuuauuugggagcuaaauaaucaaagguguuuagaauccucccaaucaauuuuaacgacccuacacagccauaccugucuaguuguucuauccaugugaacaccagugaguuuguguggguuuuguagacuaggacaaggucaccccuaucaaggccauauugaaacagcacccugccaagcccuuugcacaagugaugcuauguuagaggcuccauucugaccuaagaauccagcauggagaccccuaacaccugccaaaaugagagcaaaaccaaauccaucauaguccauaggucugggaaagugccugacuauacucauguuacauuuggccuuuguagcuccauucuuugcuaacaguucuugcuaaccgaagggugucaaccaggauuuguaugugugugugugugugugucugugugcauaaaaaccuuuuggcuauaucauuugggccaguucacucuauagcuaugcccagacuuucuuuauacaucugauauccaggcucugauauuacaaacagagagagugucuuagagcccucuguccugaacaaaagccaugaggaucagggcucacagacacugagucugcaaaguaagacaauauuaguuaagguucucuauagaaacagaacauggaauaaauauauguuuguauauguuauguguauauauauguaugcaugugcauuuuugcauauguauauaugaguaugugcauguguguguguauuuauauguagggagugacccuguuuaaauguuaacugccuugucaaccauaagugcuuacuuacaaauuuuuggcccuaguggaaaaguacuagcuuaguugagauuucugugggaaauguugaggccccuguaggaaaguacuauccucaguuaagaacaaauagcuauagaucuuguggacaggaccuagcaacucauucuguucuguuccuccugcugaacuuuuuaccuagccaauauccugcuuuugggaacagguggguucccccagaaucaaagcgauucugcgucaucccccuccccauauccugcuucugugggcauaaaaccugccugggaaaaauaaaauuugucaguuugaucagagggcuuuuuuuuuuuuuuuuuuuuuuuuuugacuugcugucuguucuuuguguuuccuuguucuccagucucuccacagguguuuccccagacccuguucaacuguccugcgggucgggacaaacuggugccugaaccccaggagaucacagaggagagaaugccgcucuucauuggaggguaggccuaccucucaucuugagaaacgccagaaagugacuuugguuccacaugacgccacugagcaaccuaucuugagacagucugggaggaauaaauaaaggggcgcagaucuuaggagaaauacgguaagacaugccacccccccccccuuuuuuuuuuuuuuuuuugaaacggucacuuuuugugauagggcucaaggagucacucaaaacgcaaagaacuaggguuaauaaaaaguauuuaauauaauuuuuagauuuugugugagauauuuguccaugguucccccaaaagggaacaauugaugagaaacacuggcgcagaguuggcgauugcuuuaaagauuauuaugaagcauuuggaucuacaaagauacccguuacugccuuuagcuacugguuccucauuaaugauaguuuuagauucccagcauuuaguguccgagggggagcgauuuguuaaggaauccgccucuccccauccuccaccaccgcagucgcuggaagagcaguuucuuaaaaaacugguccccuguccucugcuaaccuagcgauucauacagugccgccuuccccuuuaagggaaggauccuugcccgcuucacccucuguaagugauguuauggaucuuuccuugccuccacuuauggaggaaauuaggauggcugaccuuuauccuucccucauuaauuuugguaacgagcugcuacccgcugaggaggaggcucucauaggagagguagcuccacccaaacccgccacaaucgcccuggcuccucugcugagaaauguugcuacacucccaucuuucugccacaacccuuugggauuuuagaugcaguuuuugauccgucugccauguccagugcccgccaucaguuaauugcugagguggcauuucugcgcaacaugguagaaaccggaaaugagcaagugcggcugcucagagcucuccagcaauuagaggaugaauggcuugaucuaacaccuccccaccccgccccugcaccugccuuucaugugcaccuacaguugcugcuauccuggagcaaugugucuuccugagauguguucugugcaggcugugucagucgcuccaaaucacaucguauuugaccugacugacauuaauuugaauauuguggauuucuuuucugcugccuuuucugcuggcagugaguuccagggccagcuguguuuccccugcauaggguaauaggaguuacuaaggggaacuguuugcgaagcuaccucggccccuagguauuguuuuuuagaauuuuucuaauuuuuagcagcuguccugagauucuugaguuugaagacauuuaaaaccccugcucuguaagcauccuccuccacagcuaacuggcugagccaauccaaaggucccucccucccuucugcucuguuugcagcugcugcuuaaugauccccuuauacaauuuguuaggaugcauuccuugguuuuccccaaaauuugacuccuugaaggcucauugguguuuacagaugguuccucaauaggcaaagcugccuuuguuguauaagaucggguuacuucaaugcaguccccauauuccucugcccagcugguggaauuguuugcaguccuucagguuuuuaaaauguuaccaaugaccccauuuaauuuguauacugacagugcuuaccuggcucauucuacuccuguuuuagagacaaucccuuauauuaagccugcuuccacugcuuccaaauuauuuguggagauucaaucccuaauuauuaaaaggacaguggcuuuuuuuuuugugggacauuugagagcccauucuggccuggguaguccucugucgcauggaaaugcccugacugacgaggccccuugugcagcauucccugcccuacuugauuccauagauuuggcuaaccaggcucaugcuuugcauuauuuaaaugccucuaccuuaagccaaaugaucaagauuucuagagaucaaacaagagaaauuguuaaguccugugguggaugcaccacucugcugcugguuccucaccugggaguuaacccuuggggacucaucccuaaugaacaauggcagauggaugcuacccauuuucccuccuuuggaagguuaaaauaugugcacguuauaguugauaccuauaguggauuuauacacacaucuccccuuucuggagaggcaucgcaugaugugauaacacauacuuuacagggcaugucugccauaggaaaaucacagaucauuaaaacugacaauggccccaguuauacaggaaccacguuccaacaguuuucuucccaguuugauauuaaacaugucacuggucuucccuauaauccucagggccagggcaucauagaacgagcccaucagacucuaaaaaauaugcuucagugguugacugaaguuacagaugcuuauuucccccuugacaccccgaaaugggcuuaauuaugcucucuuuguucuuaacuucuugucccuggauaaugaagacaggucggcagcucaccuccuguugcauccuaagucacaagauucucacaauggaaagaucccuucacuggacaguggaaaggaccagaucccauccuuauauggggacgagggucuucuugcauuuaugacaaaaaauaaauaaauaaaaaugcuggcccaagauggcuaccagagagacuacuaaaagcuguaaacccgucuguguccagaauggagcaaucaucuccuccugagacaaaucucuuuucuuuuucagaugcugcuccagacgaagauacucaugaucuuguggcugacuagaauaaccaccaaccuucaacugccucccgcccccaaaucuccuaauaauaggcaccuccuuuggaauuacacuuggauggaccucucagagagaaaugauguuguuuggaccccuuguaagaccucuaccaauuugacucauucuuuuuacagcagggaggacugugugcagcucuuaaggaagaguguugcuuuuauguagauaaaacaggaaugguuaaagagagcaugagaaaaguaagagaaggcuuagaaaaaaagacagagagaaagagagagaaaaagaagagagcugguauaaaaauugguuuucaaccucucugugguugucaaucuuauuuccuuccauuuugggaccguuaguuggauuguuuuugcuucuuucuuuuggucccugggcccuuaauggacuuaccaguuuucugaaacaucagauagaugauuuggcagcaaaaccuauccaaguauauuaucauaaguuagcuacugaggaccaagagauuggagacgagguuguuauucccuccaggguguucccaaaggccaucuccacccaaccuaaggaaggcgacuccagccccagcaccaaguagcaaggggccauccagaaccccucugacuggugaucuaaguuuuugcu

SEQ ID NO: 8586 - RNA, 2569 nt, Mus musculus
uuuagaguuugaguauuaaucggauaacguuaucucucacaucagggucacuguagucuguuaagucuuggaguuucuggucaaacucuuuugccucccggaauauggaaauaaguucagauuuagugaacauuuccuuaguaaauaguuuugcccuuuuuuuuaauuggaaauuuauauucucaaauauuucaaugauuugaagaauauuagcuuuugacucauucuugugaaagagagcaaccagugaggacauuacuucagcacugaucaguucucuuauauucacuugauuuuuugaaaaacacaaaaggacucuuaaaaucugaaacuugauuuugacacuuccuuuguuuaacagugagaugaacauaauagauaaccacguggugacaaucaaauuucacauucaagcucacuaacagcuuuaguuccuccacuugcacagagaaguucaaaggacaacagaguaugucccuacaaacuuuauuuacaugugcuucggucucuuucacuucuuugggggugucagggucggcauuuauauuuaaaguucuaggguauuucuuagcauuuggauuauuaacaaaauuuucaaucauaacaguaauaccaacaucaugaacaauaucuuuaguaaauggguaagcagaacugauccccauuaucauuguagcuaucucaugaauaaacggaucccucguuaacuuaaguagggcaacagguuuaucaaacucaacaggcucuaaacuaaagguaugggauuuacaguggcaaguauuuggauuggguccauacuuuucuuuuuccuggauuugguuuuucaaaucagcuaaagucuggaaguaaggucccccauaaggugggaucuuggucaaaggucgaauacccaggagaguuucaauuaagguugcaaccagaguccaguucccaucuggagguaaagauggcugcaguuccucaauggggaccaggauaauaaaccugccccuuaaccaugcugcagcuuuuauuuuuuuuuuuuuuauuuuaaagcauagucgaauguaucuggggguucagguucuuccucaaccuuugguggggacugauaaacuugaagaggaauuucuucuuuaggccagaacuaggacccuacacuaggcucuucuagaguccaaaaccaggagcacacauaaucuucauccucaucagugguguugaugacaauacuagcuuuguccccagcccuggauuugacacagaccucuuucuuuaucucaggcuugugcuuaauacugcaucuaucaguagccuugacagagcccuugacagaugccucaguuccagugucaaccuugacuucagacuugguuacaguaaugaccacagacguaggcagagcaucugacuuggugugaggcacuaaagcaggcucugccaggaguucugucuuagccugagccaugacucuagcauuagucuuaucuuucuuuauuuuuuuuuuacuuuccaggucacagucuugggcucaguagaaauggcuggcuguguccuggccacugcuucaucccuagccucagccugguuucccccauucuucuuuugguuuugccuuaacugcuuuaguggucugaugccgcagacccucugggugccugugucugcguggaaugggucucucgagcaggugggcaaagcguaggauuaaauugacaaacagacacacacaggagagguuguguagaaucugaauguaaugucagguugagccucagacuuuuuauauuucagaaaauuccaggggcuauaugucacaccagacaagguacacugaaauuaaccagaaucaagagaauggaauuugcaggaacuagauaaauguuuacaauagagauuagcagcccugccuaggaucagccuagugccaggcaagaauuucacacuuuaguguuauaagcaccagggggguuuacucuuggcaggccucaagaauaauguagugucucggaccccuaaauuccuaggccuuguuaaauuuuaucuugucuggagaauccccauuuaucaggagaguauauuaacuugcucuuggcauggaauguagccuguacuaaagauuuuuaucucagugagauucccaggcucuuucugcagaccaauugaguuacuggcucuguuuuauuguagugcuuaauuaguuacugaauagguuaaacuccuugcuguuaucugggcucuuggaacacugggggaggcuuuagcuaugucagaauucaaucuuaaaaggcaccuauaguaggguaauacuaaauagagagcacguggauccauacacuagacuaacucgggaguggaaaauuaauuuuauggguuagggggaacgccagacuccaggagggaguuuccuugaaacucuuuuccucaugagauaguuuccaagcuuucgccugucaagcugacuccaccagagugcguggcagccugauucuuggcuuuucuuuuagcauuggcagggcuauugguuccagguuuugaggaagccccugacucuucucuagcuuuccuuuuaguuuuagagccaaacaug

SEQ ID NO: 8587 - RNA, 56976 nt, Mus musculus
aaagaaagaaagaaagaaaguguacacuuacuaccagacuacauuacuugcuaaauuccugccauuccuuauagacauggauaaguggaaauauuauaaaacuucaaagaaggcuuuuguaucagugcauacacuuguaaugccagcacaugaaagguaggaguagaaaagucagaaauucaagaaucugcgaccaaugauaugggaggacacacaugcacagagugaaagaaccuccauaaaauaacccgggacaaguuaggauacugccauuagaagaggugagugacagccagaaaccuccaguuuaugaaugaagaaaaauuuuuaaaaaugaagaacucuaaaagggggaaagcaagacuccuaauuucuauauguaauccugaaacucaugucaaaauccaaaagaugaaucuggauaaccugagggagucucaaaacuggcucacuucucuuucaaauaugaccauguuuuauaaauucuuuuccugaauuuuacuauaucuaucucuuucauuguuuuggcagaucuuugcacauuacaguucauagaaaccaggcucugacacuaaacuuucugaugauaguaucacccuuaaguuguauaugcucaaauguuuagggccuugggguccaucaaagacauacuccuguugcugucaggaauuagagacauccugagaagaaagaccacagacucauauucaguaaugaagaugggucucauaccauauagauacagaaaacaaaaaaaagaggaggcagggaugcccacuuccuaaagauggaggacaacauaacagauaaagauagcccaguaaaugugcaauggaaaggucucugcaacuucaguaauagcugccugaauuagaaaugaucuacaagucgggcaugguggcacaugccuuuaaucucagcacccgggaggcagaggcaggcaaauuucugaguuugggccagccuggucuacaaagugaguuccaggacugccagggcuauacagagaaacccugucucaaaaaaaccaaaaaccaaaaaccaaaaaaacaaacaaacaaaaaagaaugaucuacagacaucucuaaauauauuaguaaagcuaaguaggaaaguacacaauccagaacaaaaaaaaaagugcucuuuuuauaaauggagauuagugugucuauaaaguacccauccugugagaauuaauggccagaggccuuuuuaagacaaagaacuccagaauacugcuauagguuuucaggaagaauuauuuggaggaucugggggcuggacagaugugccagugauaaagagcacugacugcccuuccaggagacucgcauucaauuucuagcaccugcacaucaaccuacaaucaucuaauuccaaacacagggaauuugaagccauuuucugauaucuacagccaccagauaccaucauggugcuuagacauauguacagggagcaaaagucauacacauaauaaaaaugaaucauauuuguuuauuaauggagaaaggaagggacaaaagauagaaauguugaaaauaaccacaacaggagggauuauggaaaauauucucccuuaaggacucagccagaucaagagccaaagccauuuuucagcuacuccuguuuaucuaauuuauuguuguuaucuaacuagugacacucaccaucucugcucagccuguaguagcagagcaaguccaagaucucuauuguuucccacaauuuacauguuuuacauauaacccaaaaaugaaauggacccaggacuccaggagggcagccucagaagaaagggcauagaaauaccacagcucauaggagccugaaacuaacaugcaaugggacccugcccuccugcuggcaccugagaaaguucacuaggcuggggggucaacugggagcccagcucuggaccuggauggugcaggaagccaggaacagggagccuaaaggggaacccuggaguugcuggaagggacagggccaaggcuaugcuccccuugucugcagugaugcugaacagcaucauuguggcuucagaaugaaauucuuucucucaauuccaauacucacuugucagugucagaauccaggccagcauggcugccagcagcaagaggagggcuggagguaacaaagucuuccuccuaaaugaugguauuaauuuaguccagaaugauuuccauugacaauacauuucugagcuucuagaagaggcugaauggcuuuuuuuagagugcccagugggagauacagagaccugaggggucauggaaagauuaauuguaggagaaaaaccuccauaaccuggcuuccugaccucagauucagcucuaguccuagauaucauaggagcagugucuugggacaaguuguuuacccugaucccuguacauguccuguugaaaacauccaucugauuccaagcccagauggcugacagaaucaaggaaagaaaaagauaacaaaguccuacaaaacugccugauaugaucguccucuugcugaucugggguuuccuugccuacucguaugucauggucuugaacugguaagcugaggccuccuucacuaauccauagcuuucuggugaucagagaccagcaugacucccaggaccuuggauagacccaggaucucaggauccgaggaucccagagucacaggaccaccgagacagcuugacuuggaggaguucugacacaaccaggaucacaggaaggacaggcuacaaucagacauagccagugcaaguagcacuagagaaaaccagauggugggaggcaaacauaaaaacauaagcaacagaauacaagauuacuuggcauuaucagaacccaauucucccaccauaacaaguccuagauacgccaacacacuggaaaugcaagguucaaaaugaaaaucacuucucaugaugaugauagaggacauuaagaagaacauaaauaacucccuuaaagaaaaacaggagaauacagguaaacagcuagaagcccuuaaagaaaaaaaaacacaaaaaucccuuaaagaguuacaggaaaacacaucaaacaggugaaggaaaggaacaaaaccauccaggaucuaaaaauggaauuagaaacaauaaagaaaucacaaagagagacaacucuggaguuagaaaaccuaggaaagagaucaggagucauagaugcaagcaucaccaacagaauacaagagauagaagagagaaucucaggugcaaaagauaccauagaaaauauugacauaacagugaaagaaaacacaaaaaagcaaaaaacuccuaacccaaaacauccaggaaauccagaacacaaugaggagacaaagccuaaggauaauagguacauaagagagugaagauucccaacuuaaagggccagugaauaucuucaacaaaacuauagaagaaaacuuccccaaccuaaagaaauagaugcccaugaacauacaagaagccuacagaacuccaaguagacucuaccagaaaagaaauuucucucaucacauaauaaucaaaacaccaaaugcacuaaacaaagaaagaauuuuaaaagcaguaggaaaaaaugucaaguaacauauaaaagcagaccuaucagaauaacaccagacuucucaccggagacuaugaaagcuagaagauacugggcagaugucauacagacccuaaaagaauacaaaugccagcccaggcuacuauacccaggaaacucucaaucaucauagauggagaaagcaagagaauccaugacaaaacuaaauuuacacaauaucuuuccacaaauccagcccuacaaaggauaagaaauggaaaacaccaacacaaggagugaaacuacacccuagaagaagcaagaaaguaaucuuucaacaaacccacacaaacauaucccaccucuaacaagaaaauuaacaagaaguaacaaucacuuuuuauuaauaucucuuacuaugaaaauuaauauuaccaacauauccuaaucgauugaaauucaaaaauaugaggaauuagaaauuugucagcugucaucucuuggucucucuaauuuuguaaugggauaaauagguccaauauuguacaauccauauacacuuucugcuuguuuguacaugacaagauuuugcugugggccacauaauggucuugaaaucaugugucuccuaucuuagccucucuauuauuaggauuguuuauuuaaugucuuuacacuauacuuuggauuucagaacagcugacauauuucaaaauuauuuauacagccaaggaacuauagacaauuaauuugggagguggcuuguaagagaacagcaaagauaagacugaaggcuuugcuugcuauuuguaauuauuguaucaauuuugaagaagaggacuuaauaaguuacucuuauucugagauuaaugcuuuccaaaaucaucacagucgaugaaccauaaucuuacccucaccuaacgucugugccaccauccaaacagaaccauugucuacugaaacaguggaugaaugacuugaugaagagaccaucuuaauacacacaccauuucuuaaauggauguaacuuguucccugcaggcugagaaugaagacaaucacucaaguugaauagcuuugaguauagcaggaaaucuguauccaacuacugugccuacaauucauuccuugaugcagcagaacugucaaugcuuagcuuaucuacuauggagguaaaauccuuuggugaugugagggaaauucaaguacagccuuauuacaaugaauuccaauguccaaaacuguucuuauuuuguguuuguaucacaguaagccaagauuuuuaagcuuuacuaaaaacaaaacaaaaaaaaacaaacaaacaaaaagacuuuaucuauuuauauucauuaaaaauacuaauagugauugugaugguuuguauauccuuggaccagggaguggcaccauuuggagguguggccuuguuggaauaggugugaccuggucagaaugggugugucacugugggugugggcauaagauccucacccuaguugccuggaaguccgucuuccacuagcagccuuuggaugaagauguagaacucucagaucuaccuaugccaugccugccuggauacugccaugcucccaccuugaugauaauggacugaaccucugaaucuguaagccagccccaauuaaauguuguuuuauuaagacuugccuuggccguggugucuguucacagcaguaaaacccuaacuaagacagugauauauuauuuuuaaauaucauacaguuaauauauuuagacuuauuuaaaauuuauauugagaaaaaaguauauauuuucaguauugcuguagacaaacaucuacauaagacuguucaauugauuguuguuuuauaucaaacaccuuuuauaauacucauuuuuauuguuacauguuuuauaaauuuaaagaauauaaaaaaagaaauguauugcagguuuugaaggggggcucuccuggaggaguugggguacaaaagggaaagaagaaugugauguaagucuauuuauucaaacuauguuuuuaaauguuaacaauucagauaaauuggaacuauguaucuuuucucaucacaauucaauaaaacuuaaaucaaaggaaaagaaaaggaaaggaaaggaaaggaaaggaaaggaaaggaaaggaaaggaaaggaaaggaaaggaaagaaaagaaaagaaaagaaaagaaaagaaaagaaaagaaaagaaaagaaaagaaaaugaagugugaugucccgguagacccagccuccccuggucugaaugcauugccugcugugacaagacagcagcuguguugaacaaaauguaucauaaauuguggaggguuagauaugcuggggagacagacaguccugugggauauaaagauagaaugcagucugguugcagccuugaugcccuugggaguccugccugggaucccagaugucuacugcacuccugggcaaucccuuacaguguucacaccacaaaaaguagaggucacaccaugaggcagcacuccaugagucaggucucaaauucugcucacacucuagacaugucuuuggcagucucauuuugaaacaugaccugaccucuauaaggaucauccugucaucuugugagcacacacuuggccaugucaguggucugugcagacucugagucugaccagauuucuaucacacugaauuuugaacggucugauuuaaaguuucuuccuuccaguauaugcgaugcugccagguuuuagcauguauuccaaugaucugacuguccuaauagugugguuccuggaggguuuggggcuaaccacaagcucaguagaaacuuuugagaaaauuacacugauuggguacugagagcugaggguuuuccauuaucucuccugcuguggcugcuugcaauguuugucucccuuucucccucucuccugacuuaaaauaucugauccugagagcacagaggaauuuuucaggggcuuucugucuuuaccauaacucagggcauuucuauucaaugagggugcuggcuaggcccacaguucccccauuauaaacucuggacuuuucccuucugcuuuauguuuccuuuuauacuuugcaaauaacauacgugauucuuaccaucacucacugcuucugauaguuuuuauucaagucacccuggcuuauuccugggagauuuuuccaugugcuccugaguguccuggccccaaccaguuuuguuucuugcuucuacagagcguuagaucugugcuuagugcugcagaugaagaagguucacucuccuguucaaagaacagggaagaagaaaggagaggucugugacugcugccuacccaccaaguucaucugcaggauccuaccaugaggguuaggcuucaguacaggagaggaggacccuucccucaucagcuuuauauaauuuccuauauuucuuugcaaauaaauaauaauauuauuauaauaauagagauuucuggacaucgcucaccuccucugacagcuguugaguaacuuuccccacuucauucucugggcaaucuaucagagugagucugggucuuccucuccaccaaggaucuccaugaucuugaacuccuuaucuuccugccugcaccucccaaaugcuggguuugcccgagugugccacgacagguuagcucaccugagacaaucugaagugugucuacuuaucuguguggagagaagauugcaguaauguuucagaugagauuuuuagacaggaaguaauuacuugccgccugaauucuugucauuguuuuuugcucuuugagaaaugaauccccucuaguucaggaaggucuuagacuccucugcuucccaauuacaaauguuacaggcaugcacuacuaugcccugcuacauuagaagaauucuguaagagaauauuuuuaguauuagauaauauuuuacacugucuuggguuuucuauugcuguaaagacacacuguaauagccucauauucaugaauuccaugccaauuuaaaagaaucaagaagaaaugaagauaccauagguuuacauaauuaacuaggaccuaugucucaacaaugacuuaaccauagccuuuuagaucagugguucuaaacaugugggucgcgaccuccuuggcaaaccucuguauccacaaauaauuacauugugauuaaaauacaaaauuacaaucaugaaguaguaaaaaauaauaauaauuugaugguugggggucaccacagcaugaguaucuauauuaaaugguuccagaauuaagaagguugaaaaccacugcuuuggauaaugcacugagucacauaugccagcagcagugggaaggccauuaauaagagaucagaaaacaaaacaggugaucacuagggaaucgcucaagcuuguuccaagacucccaaaaggaaaaccucaccuccaggcaaaucauaggcugcagaaugcugcaaccugacaucucagagcagcauucccaacccuggccccagagccuccaaccaggauugaauuguuaucauccaggacugaacucagagucacaucacuggaagugacaugaacagagguucuuacacacuucacagaacuguacagcagccagucuagaugauccucauuuauuuguaguggaucucauuccagauagcugaaaaaaggaccugccuaaggaacaacuauuucuccaaaauguugaaccuguaucugcugccacacagggaugauagaguucuucuuccugcccagccugaacuccaugccaauaugguuagaaauguauuguuccucccacaacauaaaacaaaaaguccauucaucaccaauugaucccuucuccaguugacuauaauaaagauaauaucuuagcucccaagauagcauuaggguuuuugaguacuggaauucuucaccaucaacuuagggccugauuaauguuuucaacguuuucuauggaaaauauguggccauauuaauaacugaguuuuugacaauuuguacugaaaggacuuagucaaagaacgucuuacuucaaaaugacauucauuaacauucagugugcaagauucuccuauggauaugaaugcagccaauaaugaagaauucagggauguuugauguccucaguguggacaaccuugaggaaggaaagugccaccugugcccauuuagugacuuaucaaugaggaaaauuuacaauuaauccaaaugguuggcaaauuacuuuuauuccuagcaauuuggagccaguaacagauggaugucuaagcgcuaggccagccuggucuacauaaccacuuccaggucagccagggcuccaaacugagauacuguuuucaaagaaaacugauaugaaggaccuugcugcuuugcagaugaccacaguugauuucccagcauuugaaucuggcaguucuguuccuuaacuccagaugcaggguuucucacuaccucuucuggaaccuucgaguaccuguucuuugcauacacccagaaacacacaaauauacauacaaauaaaagugaguaauaaaauuguuucuccuaaaauauaucugugaaacugaauuuuucuauguuucaaauuaaaaaaaacaaaaacaaaaacaaccugcuaaaaggaagacacaaaauucuaugaucugugggagggaagaugaaaauaaggacucccagaaaugguaaauaucuaaaaggcucugcugacaucuucauuuccuuuuggaaaacaguucuuucuccuuuauucagcuuacaugcaauuaguuaucaauaucugaauggaaucaaaacucucaaaacaucuaauuccuaccaugauagacauggauugacauaauccacacaagcacagucaccacagaaggcuacacgauguguaagcauguacagaguuucuaacauugaaauguuugacaauugcugacuuacaggccucugggcuaggacucaaggauuugaaacuuggaccagaggacagacuuguucuuagacacugaugccagaacacaaagcuguauaacaggugcaaaguggggaagcaguacccuagacaucccccacacccaggaguuggucucuccaagacccaccccaucaggucuaaaucacuaccuuugggaaaucuaugagaagccaaucagcaucagccacagcagguuauaaagugaagagauaccaagccugauugaagcccuacuuaucagagaggaugaggaagccuggacccugggaccuccuccuccuguugauggcaauagaccugacccaguauugugcaggugggugagaggcauggagggaacuggccuuuuagggaacaggacacagcacuugaaauccucaccucuccacuuucuuccuugaauaaucagacccucccugaucucugagcuggaucaccccugacccucuccugcaccccagguccacaaacacacaaucacuccuguucuacucucuaccaaccugcucuggguccaggcugaaaagucagggucucaaugugcaccacccgcaggcucacacuggcugcagauuuucaacauugugauuuuggagccuggcauguuggaggcccgguucauccaggucggauacguagacuccauacaguuucagggauucgacagcaaagaaccaaaugcaaggaugcaaccucgggcugcuuggaugaagcaggagccaccugaauauugggagaaagagacagcaaaagcccugagcuucucacugucaggaagacgaauucuuaaguacaugaugucugcaaauaaagacaagaauaaugguaagugaucucagggcugaggccauaaguccucagugcccuaauggucugacccaauaagcuccacucuagguccccaagucauagauacagccauagccaaagggaccuggugacuuuagagccagagaacuacagacuguuaccugguuagggguuuaguuggggacaaaauccuaggauguaagagaagccucauagugaccaaaggcugaauggggguggggcagguuaucacacccugcaggaaguguauggcugcaacguggcaaaugaugggagcuuccucgaaggucacuaccggcucacauacuauggauaugauuccuuaauccugaaugaggaccugaacucuuggacugcagagggugaaguaggugaaaaauucaagacauaccaggagcaaggaggcaugacagaaaguuggaggacuuaccugcuaggggaaugcguggaaaggcuucuuagaugccuggaccuuggaaagaagaccuugcugcacucugguaagagacacccuugccaaccccuucugguuucugagauuggagauccugccucccugaggccuccuccucagcagggagcagcuggaaugcuuacacugucuugcaucaaaggggaaagagagcuccuugguuuccugacucaacaugagagagggacucuccagaggauucacccuucucccaggacaguucaguguguccauuaacagcaguugccuuccaucucaggccugaucacuguccaugcacgaugacauugaaugucugacuccaggguugcugaguccuuagaccccuuccccagucagaaucagaagucuauuugucuagagggagacccagaguuaccugcgcugaguugguucaugguuauuguaaaauauuccaaacaauagcucacccagaaccugaguuuaggcuucuguguggacucugcucccucccucauccaagucucccauccuuuccagagauggucccaugagcacugcucaggcccccggaggaguacaaaacacaugaauuuuccaauuguuccccucagaugccccccgaacacaugugacccaccauguaagaccugaagggaaugucacccugaggugcugggcccuggguuucuacccagcugacaucaccaugaccuggaagagggauggaaaaaaccacacccaggacauggagcugccagacaccaggccugcaggggauggaaccuuccagaagugggcagcuguggugguuccuccuggagaagagcugagauacacaugucaugucaaccaugaaggguuaccugggccacucacucugaaaugggguaaggagugggugugagcacacacacugcugucaggaauugugugagcucuuugaugaaccagagcaggaucaggguugagagcuagggucagacuccucacucuuccuucuuuuccauccucagagccuccacacaccauccccaucauagcaauucucaucggccugguucuuggagcuuugguggugggaacuguggugauuuuucugguauggaagaauuaaagguaagaaaggggcagugucugaauacuugucucucuacagaucugcagaccaagcuacaaaaguaccuggccauuaaaggaaagauguauccacucacgcacugggacuugugugcugacuuuaacucuaucauaaagcauaaaggaaauauagaaagguccacugcccucuugauagaagggauggagaucugauugugacuccccacagacagaaagaugucacagagaaggucccugcugagaacaaaccuaaagaaggccaguuaguccucuuuacuuacuauguuccauuguguuuucuccucuguccccugagcugcagucccaguucaagaaacuucccugggguuugaccaggagauuuuccacucccacaacauuacugcuuccacagucucucacuggcuguguuuuccccacaggugggaaagaggcaccuauaauucagcugccaguaauuaagucugaguugguuccugagauccuugcaguaggaaacacaaguacccauuguggauccucacacauuuuuuuuuccucugggcccuauugcugugggcuuuuaacaggucuuaugcuguucugccauaggcauggacagugcccagagaucugaugcaucucucucaguaagauagaaaauacucaaagaacauauuccugaccugugugacuugcuagacugaaacuguuguuagcauggaugccuguuugguaugaugguuuaauaaucaccaaucagaauuugugcuucauuauuuccuucuauagugugagauaccugucuugugugacuucaaaggguccugacuuuucuuucaauggcuagcaucuguguccaggucucugucuccuguaaagacaacacaaggaagugaguucagcccagaccugagcaugacuccccuccacacugaccugugugucuucuccagucaucucuccugauccaggagaggcaggccugggagaucuccaucagugacugaccuuugguuccagugaguuguaaauuuauucuuccuacuucaauauuaggguuuuggucauuuuuuugugaauucuucucauuguuuauuuaaugaguaaaccagaucaaagcgugaugaauaauauaguaacucugucuugagaaguugaaauccauuauuuuggucuucucugucuuuuccuaggugccuuucuuucucuucaacuucauauaugcauguguuaauuucucauacuaauaaacuugaacuuugauucauacuuguugucuuuaauuuauuuucuuucaaugucaagagucucaucuucacuuaaguauagguuucuuguaaauuacacuuuuauuuccuccgaugauaagauaagauaacaacuggacacaagcugggguaauacaugguuuuggacugaaaccagagcauguccucuuuucuaaugauugcuaagccuaggccugaaagcuuccagccuccacacaaucuagucucccaugcugacagguucaaucugguuucucucaacuucugacugaauugcuuuguuagccucauucuaacuuuggcaauuuuuuuccuaaucuucuggauccuucucauuuccagggcaguucugucuacacuuguguccuguauguucucucuguaaucuaacuuuguaaaacuguucugguaaaacugcaauacacacaccgcauaccacaccacacuuucucucuugcugauguucucaugagaguugggcguauccuauuucugacuuguucuaucagaucuuucucuaauuaaucauuuugucuggccgucaauaagauauugcuuucaaacaugguuccuuauuucuacaaacauuacuucauuguuagaucuggcaggauuuucccuguccaauucaauuaaaauauuaguacaguaagaggccugugauuaaaugagaaaaauggagguagcagaaagaguugcauggacagagagcaacucaaaggagaggaagaagccaagauagaaguggacagacacauaaauagccacagguaguuaugaauaucauuuaggcauagaauagccggacggugguaguacacgccuuaaaucccagcacuuggguggcagaggcaggcagaauucugaguucaaggccagccuggucuacaaagugaguuccaggacaggcuacacagagaaacccugucaaaaaaaaagcauaaagagauagaauaauugcaugugucugaucuuggugggcagcuuguaucauuaucaauuagcucugaaaauauuguguggguaucuugugcauugagaauuuauuaauauauaaaucugucuuguaaauuauaaacuucuagaguuuguuucuaccggguggauggguguuguagcagcugacuguggggaggaugguuguuguaugggucuccauggcagugaaaggaacucgggagcuccaagcacugcaggagaguuggcaggcagacaguagcuggacggagcacaggaacuuggagguucuacuauauaucccucaacagucauagacaaaagguauguaguaagggugugucugcauucaagcuggauuguaucuuuggauaugaucccuugccacaacagcaauggugcuggauuaaaauuucuaaacagaaguccuuacacaugcagcauggagcagucucuacccuacaucaaacugggucugccacuauuccugcugaccagaaggacucucugaaacaacguuggccagguugcuuggcuaucacugagcugcuccuuugcuuugccugucaccuccaaccuuccgcuucaccaucugaagauccacagaguggauuguuuuauuuuugugguuguuuuaucugaauauaugcuugucucuguaacacucauaugccuaguguccaugagugacagaggagggucucggguccccuggaacugggguuacagacagcuggcuucuaucauggagccauuggaaaccaaacacaguuucccuggaauaacaaccagugcucuuaacaaauaacaaguaccaaguuuuccuaacaacugagcuaucuuucugcccuuuaauuguguuugugugugugugcuuauguguauguuuguguuguauauaugucucccucuguguaugucaguauguauaagggaaaaagagagagagagaagagagagaaaugggagaugaguguuugugcacaacaauauagggcccuuguaggguagaaugcaguggagcccuaggaacuggcaguuuaaacuuccuuauuaagcaugcugagaaccaaacucagauucucaggaacugcucuucaccacugaaccaucucucugacucuuugacucagaacuagacuacauaguuuucuaacacuuccaaauuggagugagaggcacauugguuuuauaagagaauaauuagcuucugggaacuagaaaucacuacaacuugccuucucacccagaccaaauauugggcauagaaucuugggaguaguguuuggguacuaguuuccuuaaccagacccauguccucuuuguccuguucacaaguccuccugaguccuggcacagggggcaauaagucaguaauucuucaucaguucaugggaaaaugcccaaacauacuuagguuuaguuagaucucaaaaauaaauauguucauguguauaguaucuauuuauauuaacuguauuaggaacuggaaguuuuaagauauuuacuucacuaaagacauuaucaaauaacuauaaccugagguuaaaaagugggacucggugacccagggccaucaugauaguuauucuugacugucaaaguuacaucagaaauuaacugaaacccauccucuucuuccucuucuuucuccuccuccuccuccuccuccuucuucuuucuucuucuuucuucuuucucuuccucuucuuccucuucuuccuugucuucuucuucuucuucuucuucuucuucuucuucuucuucuucuucuucuucuccuucuccuucuccuucuccuucuccuucuccuucuccuucuccuucuccuucuccuucuccuucuccuucuccuucuccuucuucuucuucuuuuucuucucuaaaucuuuaguuggaaagacauaguuuuuauuuaacuuuuuauugauucauucugaauuuuacauaaugaaccccaaucucauucaccuccugucccuccauacccacccucuuuccuugcaaacucucacuccuaaaagaaaaaggcagaaagaagcuaauuguggaaacuguaguguaucacaaugugucucaagguauauuugucuacauuucuuuauuuacaauauuucauuggaaugcgucauuagucuaggucaaaggcucugucuucuacuacacuaucaaaacuggaucaucaccaggacuccuguuggaaaccuugugauugacaugugucaagaagauccugcagcuugagaucuguuggccaaccccuucaugugcuucauagaugggacacauguuggagugagccaacucagacccuggaucuuugccuaagugguagcugaguuggugguuaagcuaccagauauucugcacuaucaccauuaggacaggcucuccaucacugcccccagcuagcucucccagggcuaugcccagcaagagacagaguuaccucuccugcucucaugcccuugauuuaccugcacccaugccagcagggcucuauuguauuguccaggcaaggugcacagccuaguuugccaagaguugaagcuagugaggaacagggccagcucuccccaccuaccauagguggcaaaagauaaagggagggccucuuucccucaacuacaccacugcauggcagauguguggcagagccagcuuucccauacuuaugccuauggggcaugcucacccacgaccccuacaaacaaacagccagcaaacugugcuuccugggaaaaguguguggccugaucuccugaguacuguagauggagagauacagggcccgguuuccugcucucaagcauuuaggccagcucucucaugaugcccagguauaaauggagagauccacagggcccucagauaucaacauggccccagguggcagcccagaccaggaauauccacuagcuauugauguuaauauauucccucuccugcagggccacaaaucuggacauggcccuuuacagcaacaugggccaggaccucacuauggucauaggugggcauccccagcuacucacaucaggcuguuccucacuacucuaagucuccaguucugccucucuucauuuuguacacauuguucugcuuuuuuuucucuuccaucucuccaccauguacuucauuaucuuagucacacguggugccuauggguaucugcggucaucucaggagugcuaugcccugucucucuguagcacugagcaggggguaucucgggcuuggucuggcacaccggacauaggauugguggucagggggugauuuuuggcacggggcggggaagacaaacuuguaaucuggaucuccugaauugggcagauacagcuucguauugagccaaaccuuaugcuggcugccccuauaaaacacauggaagaaggaauguuuucugcucuucucugccuccccuccgcacacugacuuaauccauuccuucacuaacauuagcuagugucuaccucaguauucugguguauacagaagacccgcugagucauccagucucaugaacugaaugaacaucuacuggauucuuguacguuccuuaacuagacagugauuguuggacuaguuggaccacagccuguaggccacucuaauaaauccccuuuauacauacacaugcacacacucauacauacauaugcaaaaauacacauacauacacauauacacacauaacauagacaaacauauauuuauuccauaaguacuguuucuauagagaaccuuaacuaauauagcuuacuuugcagacucagugucugugagcccugauccucauggcuuuuguucaggacagaagguucuaagagaugcuuucuguuugaaauaucggagccuggaucugagauauaucaggaaaaucugcacauggccauagagggaacuuguccacaagauauagccaaaggcuuuuuuacacacacacacacacacacacacacacacacacacacacacacaccuaguugacacucuucaauuagcaagaacaguuagcaaauaauagagcuacaaaggccaaaauguaacaugaguauagucagacauuuucccagaccuauggacguauuugguuuuuguucucauuuuugcauuuguuggggucuccaugcugggcucuuaggucagaauggugucucuaacauagcaucacuugugcaaacggcuuagcagggugguuuuucaauauggccuugaugagggugaccuugucuuaguauacaauauccacacaauucacugauuuguauacaugaauagaacagcaagccaggcauguuuguguauggugguuaaaaauauuggagguuucuaaccaccuuuaaccauuuaguucccaaauaagacacgcaaaaccguauuauucauaauaagcccuaacaacacuagagcugggaagauaucaaccuucuaugcuauuuuguuuacuucccuaucaauaaccucgauauaugacuucccauguuccaucugagcugauccuacuccagcugccuggcccucagggccaugcucucaugaucuacccaccucgagaugucuucuucucccuucuucucccucucucucucuuuuauuccuuauauucucucuacagaccaaagcucggcagcugaaacaaugcuuaccucucuucugcacuauuacaagcuuugguuuuauuugguuuuauuugguuuuauuugguuuuauuugguuuuauuugguuuauuuaaccaauaguuuuaaaacgaggaacaacgugacagagcauccugugguguaugugaggauuccuuugucccauggaucuaucaggggagcaaccaaucuugggggccaguacuuagcauuacaauccauagcaaacaaccaaaguucaacagugguaugcuaaucccagcacuugggaggcagagguaggggcaugaggaucccugggauugugacccagccuugacuacagagcaucuaagggugccuagugaggcacugauaaaauuaacaaauuaauaaaauaaauuagagcagcuuuuacaugucaaccauacuucaauaaaaaauuauuuaaaggcuggauuuuauucuaaaggaguccuagaaguucuugguuauaggaagagacccagguucaaaguagauucuuacuuuauaaagugaugcagacuucuccagaaaaaccaugccguggagcccgagcuccaggaaaacucucaauauccagugcauuggugucccuuggauaauuaggucacauuaaucaggacacgggagauacagaguaacugugcuuuauugaauauuccagcauuguuuauaggcaagcagaauaaagauuucccacagacuccaagucucaacagcuucuguuucugaagccauaguuuaucuggguucaaggugacccaaaccuccuugcagacugagaaaugggucagcaguccaaagcuauuacagguuuccuaaauuaacuaaaacaaagugucucaugagaaaauaaucauggaggccacuuccucaggcaugcagcucacuuggcagauauuaggauucucuacuaagaaaguaugcuuucucagugucccauugugcugggauuuacagauaugcuuaagucaccucacagcuaguaggcuugagcagucaccucaugcuauuucuccacagcacaccaugcucaauaucugcuggccauccuuacaggacucuuaaccaaugagcuuuuucgcuaguccaggcuuccucuucauuuuauugaaaauaauacuucugauuaauaaccuaaaaaauuauugugaaacaaccuuuuaaaauauugaauggcuaugaaaacaacuuuuauuacaaugguauuuaucaaauuuuucuaauucacuuugaugauagguuuagagagaauaucguauaucucuuuggguguagcacuugucaauaauaaaucuucugaucuuuggcuuaggcaggaaauaggaaguggaacaucugggaggagagaaaauucuagggcagugucaggcaggaaauuugccuggagaaggugugaggaaacggaugcuugauaccugaguacagguaaccagccauguggcagaauauagauuaaaauaaauagguuacucuaaguuuugaucuaguccgagaagagccuagcuauauggccaagguauguguaaauuuauucugauucugaguuuuauuugugagagccuggggguugggaggaagaacugggaccuaacuuccacagauaagugucauggagccuuccaagugaaaggcuggaacaaacaaauugauaagccuaaaauuaaaguuaaacuuauuccuagauaaaaguuucaguguuaguauguaaaggacacagugcccuuugucaacaaaaauaguugcacucuuugugugagacccaucuuuuuugaauaaccauaguuaccaccccucaucaagaagcaaucugacgccgggcagugguggcgcacgccuuuaaucccagcacucgggaggcagaggcaggcaaauuuuuuaguucaaggccagccuggucuacagagugaguuccaagacagccaggguuacacagagaaacccugucucuaaaaacaaacaagcaaauaaacaaacaaaaaaagaagcaaucugacaccaacacagagaaucacgacugcgcacaaugcagaggagaucaacagaucuuggugaggccaauccccacugauauaucaacauuacagauccugcaucuaugccucuggacagaaggaauggaaagauuacaaaagccagaacagcaggaggucuggugggaaacagucucuccuagaaauaacugcauagacaaggcaggaucaagagcaacaaaacaugacaaagugaaagagggcacuucuguggggccccaccccuagacgaagaauugcaggcaacugaugauugcugagcuagaauuagccucuccagggaugagccucuuauuggauggccaguggagaguggucagcacugaaaccauaaacacacaaacaacaaacacaaacuuggcauguugcauucauauaccuguguguggaaacacaggcacacauacauuguuaccuacacagacauagguaacaaggaugaugaaaaaaaagaacuugggaggaguuggaaggagaguaacugagaagggauagagggaggcaaguggggaugaugcaauucuauuucaaucaaaauauggcugagaaauaaacugggauagguggccuguuuuaaagacaaaauauauucuaguggugugaagguaagauccuuuacagucacugugugaggguuauaaaggugucagguggggcuggagagcugacccagcugaacagcacuggcugauccuccagagaacaguggucuacuuuccagcaccuacauugugacgcacagccuagugggaaucucuggauaaagcacaccaacaccagagcucaagagaggcaugggcacuaguggauggaaaaaccaggaaagcuccuguaaggccuauuucuggcuugcauucucauuuuguacucuaagaccacaagguggggcuaacaagcaauuuuacaauuugagagccagcagguuguuaagggcaaugaggcacuguuucagcuacuucuccaggucauucuguuccagguggcaagugagguuaaucuuaaaacugaguaucacucagugcuuuacauaaacuauuaaauaaaucaauguaucagucaguaucuuaguuuaccccaacagucucuagcuccaguuccaggaugucuguugccaccuucuggucuccaguggcacugcaugcaugugcuacccuggcaaacaugaaggcaaaauauccauacaugcaaaguaaaagcaauaauuugaaaggugucaggcacuuacugaggguuuaucaggauuauacuggggucccacggaagacagguauuuaauucaucuuaugaguuauagaaugagagaaaaaguugugguaaagaagucauauagguuuaaaacagaggcagcaggggagaagauggcugggauguaguucaguuaguauagugcuuuguccaaaacauagaaagcccuggauuucauccccggguaguauaaaccaaaugugguaucaggcuccauugaccucauuuaaccaaaacaaaaccauuggagcuggggagauccucagugaacaagagcacuuucugcucuuccagauuugucaugacaaccagggaauucccaaagaaugcuacaucauccuagacucuauuguacaggucugcaacuaaucuugaauaauguaugaaugaaaaauguacuguagaagauuaauagugaauuuagagcuaauuuauccugacccuggaaauuagacauuaaaaaaaucguuucuuuuagaaaaauuggugauguuucuuguuugugcaacaaaauauuugacaagaacaaccuaagauagaagucuuagggcuggagagauagcucagguguuaagagugcugauugcucuuccagaguuccugaguucaauucccagcaaccacaugguggcucacaaccaucuguaaugggaucugaugcucucuucuggugcaucugaacagagcaacgguguacucauaugcauaaaauaaauacauaaaaggcuuauuuuggcucacaguuugaaggaauagucugucaugggaggagagacgagaugauuugguguaggguaaauuuuucucaaccugacuuuuaauaauguuucuuaaaugcuuuaccauccuuucuagcccaccucccaccagagggagugggaaagaaagguuacuaggauucaggcaaaguggacuuguuuagaaauuguucuuuggagccgggcagugguggcgcauucauguaaucccagcacucgggaggcagaggcaggugaauuucugaguucgaggccagccuggucuacagagugaguuccaggacagccagagcuacacagagaaacccugucucaaaaaacaagaacaaaaacaaaaaacaaaaaaaaaaaaaaaaagaaauuguucuuuggaacaaaucucaucugcauuaucacauaagcaauucaguauagcaucucuguggcaacagcauaugaggcugcuggcucuggucucagccaaucagaacacugagaaccagaaaugcagugcucaccuggcuccccaccccaccccaauagucuaggacuacagucuaggauuauagcgccaccuuccguuaguuaaaccucucugcaaaugccuuugaaggcaugcccaaaaguuugucuuuuagaugacacuaaauccacucaccuugacuaugaagauuaaccaucauaguucgucuaugagaaauaagaggagcugcguuuuuuaucuaucuaucuaucuaucuaucuaucuaucuaucuaucuaucuaucuaucuaucuaucuaucuauuuugccuugcuaagaagaggauaaaaaggaccucaaaggaggacuucuacuacgguagaguccaaccaaaaccuguucacagcgggccacucccgagugaagcugcuguuuguuggagucgcuguguacugcagacacugggugcugcagcugcuuccugugcuaugggagcagaugcuggaggcucauuuugcagucaccuggcaaggagccuacaagacacggagagcucaugcuuucccuucaugcugcucuacugccaucuacuggccaagcuucagugucagcuggcaaagaacagaucacuaagggcucaggaccaauuuuguaguugagaugaaguauaaauaauuuuucacacuaugggagcaauaccuggaccuuuuaucaaacaaaaaaaauugaagaucacaagucuauaaauauagaaauaugaugguauugaugcacugcaaugcucaugaaguacuuuggcucuuuugcuuuguaaucaguauauuaaagagacauucacacauuucagagauuguuuaaauucugacaucuagacuuaauggugacaugaacauauggugacuuuaaauguacaauuaagaccaugcaucauggugauggagagauggcucaguguuuaagagcacugacuacucuuccagaaauccagaguucaauucccagcaaccacauggugguucacaaccaucuguaaugggcucugaugccuucuucuggugugucuaaagacagcuacaguauacucauauacauaaaaaaaauaaauaauuuuuaaaacuuuuuuuaaaaagaccaucacaaucugcaaguguacacguguuaaauuaugauuauuuuggagccuaaaucaaaugauuuaaaauaagcuagcagcaugcauuaggaauaccuuauacaugaaaauuacuuuucccuuucugggaguugauaaacaaggguuuuauaauguugcacugaauuagaagaaccuaccccucucuagacguagggcagguguugaacucggcuaaggcacugcuaaacucugaaaucacuacuaauauuaaugaguucuauauguauagguugugagcacucuuuugcacauuauuuuuccuggaauaaucaagacacugggagugaaaaaaaaucugacuaccuaaucaucaggaauuggacucuccuuugcuggucgaggcaccuggaguaaagccacuauucuaguagaugugauaaaaguuuaacaacaacaacaaaaaaggaaguuaggcacucccguacauaaggaagaauuuuggaagggagaaguggguaggaagaauguaagagacaugagguuuacugugagauugugucucuuuggaauaucagaugcuguacccauaaaguuccaacguggcugcccaaacgugagcugagaggagaacaccaauauucaugccaaaaugaauggagaaaaguccaggaggccacaguccuacacacacacacacauacacacacacacacacacacacacacacacaacuacagucaccuaaggaaaucugggagugggaggaacaguuuuccacagagaagagcuuuauccaauaccacauggucagccuugaaaacauacauacuaguaagguuauacagacugagugugugcaucugugugcaugcaugugugugugugugugugugcauauguguguuguauuguggugcaugugcaggcacacaauaacaguuaauuuaaaaagaagcuggcuacuugggaaagaauaggagagguguaugggguagagaaaagaguaagaagaagucuaauuaauuauauuauaaucucaaaaguuaaaaaaaaaacuaaaaauuuuuaaagagcagcuuggaguaaagaggauuauuucugcuuacaauucuaggucuccauccaucauugcaaggaagucaaggaaggaacaaacgucaaagggcuagcaagucacuaagagagaauccaggcagggaaagagcuaggcuaacugcacaucuugaccucucccucagcuccgugagauucaguccuccagccucauccccagcuccacagccgaccacguccugugaccccccuucugcucugccacuuucuccaguggaccacgcagaucuucuacuccaaaaucccuucucucccacucauggcuuauccuagucuccagugccaaacaggcauucccugagaaucugcaagcugcuuuguccagggaaggagguaggcuagcuucagauuuccaccucucugucauuccuccaaguacuauacaccauucuuaucuccaacucuguagucgaccuuccuguggccucuccucacucucugcacccaugccaggggacuaagcagauccccauggaaaacccuacuuuuccccuccugugaccccucuccagcucauacccucuuggcccuuucucauuccuaaguaugagcuccaguaccuagaaauacauuuuaccuagaaccccuaguggcuacauauaucaagaauguccuacgaggcaacacacagccacugcagucuccuaugaaacagaaauauuaacagaaaccaagaaacaaaauacucacacaacaaaaaccagauuaucaguaccuaaaauguaaucuuucuaaacccagaugccuggaugucagcauaaaaagacaaucaauaauagccaggguuaucugaauccaacagcgcccagugaucuagcacagcaggcacugaguguugcaacacagcuggaacacaaacacacacacacacacaauaaccucacacacacacaucaagcuggguguaguggcucacaccuuuaguuccaguacuagggaggcagaggcagguggagcucuaaguuccaaaggaaggaaggaaggaaggaaggaaggaaggaaggaaggaaggaaggaaggaaggaaggaaaagaagaaaaagaaaaagagaaaaagaaaaagagaaaaagaaaacaagucaaaaaucacagaaaauauuuccaacaaaaucauagaagaaaaauuuccuaaccuaaggugaugccgauaaaggugcaaaaggcauccugaacaccaaauagacugggcuagaaaagagagucccuuugucacauaaccaucaaaacacuaaacauaacagaacaaagaaaaauauuaaaaggcggaagggugaaaagaccaaguuacauacagaggccgaccuauuagaauaacaccugacaucccaauggagacccuaaaagccaaaagggucuggacagauguucuaaagacuugaagauaccacgaaugcuaguccagucaaucacaguacgugaaaaaagaaaaucauuccaugauaaaaccaaaguuaagcaauaucuagcuacaauauccaccucuaaagaaaguaauugaaggaaaacuuuaaccaaaaaaaaaaaaauuaaccacaccaaagaaauaaauaauacaugcacacaauuaauuaauuaauuaauuaacuaguuaauuaauuaauuaaaaccacacacaauaaauaaauaaucucaaauccuuagaggggaaacacacacccuccacacacaacaaaauaacaacaacaacaaucgcaagcaccaacaacaaaauaacaggaaucaaaaaacuacugcagauugccuggaacuggaguuauggguggcuggggacuaacuaccuuacuggugcuaaaaucaaaccuaagucuccugcaagagcaaccagcauucucaacugcugagccaucucuccagccugugaauacaguucuuaccaguucauauacacugcuguugaccaaaaauuacuuacacagauuacugcuuuucuauaaguguccugaggguacuuagugagcguuucuggguuuguccuggcuugaacgugaaacaauaucacauuauaggcucaaguguuugaagacuagguagccaggggucagccuuguuuuaaauaaucucuaggaaauagagauguaccaguagaaauggaucaucuuggcguaggacuuaagguuucauugucaggccuguuuccagucugcuuucugcuacccgacuaccaacaaauugugacuagcuagcugccuuaugcaccuggugcugugucuuccucagccuugauagaccacaucuccuaaaacuaaaauccaaauaaacucuuccuccuuuaacuucuuucucuugagguauuuguccucagcaucaggaaaugucaccaauacaagauauccagagguaaauaaauaucuuacaacaguaauucaaagaaaagacaccaugagauuuagauucuuguguggccccgggggaaauacucugguaucacacagaaaaggacauauagucauuauucuggguauuuauuucuaaauuugagggggccuuuuguuuguguuuguuuuauauuuuucuugauucuauuaacuuuguuuggauuuaaauucuacaacuuggaggcuagagagaagguucaguaguuaagagagcuugcugcucuuccagaggacuuaaguucgauacccaacuguaguacaagcaauauaagcuuauccccgacuagcuuacaaauaaaugagacucagacuaugguuauuuuauuuggcuuugauuauuacugggugguaauaacuaaucuauucuuagcuagccuggcuaccuccccaacuguguagcccaaauacuugcuguuuguccuggccaugugcucacuguccaucucuccucgugguggcuuccucuaucuucuucuucuuccuccuucuccccccaaccaccaccccugucucuccuccuccaaccaggucacuccaggucacaccucuaaucccuccaauaacuggcuguagccaaauuuauuuaagcaauaguuuaaauaaaggagcaagguuguacaacaaaagcuuguaaucaugagaagucauuuuguaggccuagaccuuugggcauagaauuuagcauuauaauacauagcaauaggccaaaucucaacacccaacacccacaccaaguaguucacaacuaccuguaacuccaguuccaggaggcucugacauccucuucugaccuccaugagcacacacauaaacacacacaugcacuaaagggagagaaacauaaauagauuuauuuuauuuuauuuugggcaggggacauuguuggagacaaacucauuaguucuggcuaauagugcuauauaguccuggaaauauguagacuaggcuggccuugaacucacauagauucaucugcuucugccuuugccuuucaagugcugcuauuaaaaaccugugccaauauucccaguuaauuaguuuuuaaaagaauccaggcaauaauaacaggugccuuuaaccccacacucagaagguagaggcuggaagaucuuugugacuuugaagacagucuagucuacagagagaguuccaagacagccagggcuacccagagaaguguacuaucagaaaaacccccaaacaacaacaacagcagcagcaacaacaauaauaauaaauuuuaaaagaaaaaauucugacauuguaccuguaaaaaccucuucaauaagaucagagaauucaaauauaaaguugguauuaaauucuguuaugagauuauugagugauuauaugaauaauuauguguaucuugaucaugguauuuugucacaaaagcuaaguccuuauuagaacagcauauggaaagauuuguagaugauguaaaauacgcuuagcauucuuuuuuagauauucaguuuuucuuagaguaucagauggagaagcaaacagcaaaauuuauuggcaaauggagcagugguucaagccaagugguucaaaauauuuauuuuuauguagguuuaaguuuuucuacaauaaauuaaaaauauuuuucuuuaauucacaauaauucuuaaaauauuaugguuauguucuuuauuuaacauucugggacaacuguaccauuaguaauuuuuaggcuaaauugucuuuguauauuacacaauccauuuucacugacuuuugaacuaaaaggacauuucauauaaaauuugucacauuuggaauacaaaguguuuaaaaggacaaaccgagucacauaagagauuggcucagccuacacagcuuucuguuccaaacccagcaguuaaugucacuuggaugcaaaauguccuuuuuccuuauaaagggggcaguuaaaccuguuauuuuaaagucugcuacucauucuuugcaugaaagcugccaguucauaguagcugaaaaauuguucauuuaaacuucugcuaaaaaauggaaauacacauuuaaaacucaagucaguucaugaagcuuugagagauacuuguucauacacauguaucuuucacaguuucaggcagagccucugcaucuuucucacuggaagcuucuagucuugagcuugguuguuuggggggccucuucuaagcaccccaacauuuuuagaagaauuguguuuuguuuguuuuuuaauuuuuuauuaauaauuuuauuuguuuacauuucaaaugauauuucccuucucaguuacuccuccacaaaccccccauuccguccccaccccccaucccuccucugugagggugcuccuccauuuacucacccaccccugccuccccauucuagcagcccccuauccugaggcaucaagccuucacaggaugaagggccuccccucccauugaagucagauacauguguaucuggagccauggaucccuccauauaaacucucugguuggugguuuagucccugggagcucugggugguccaaucaauugauauuguucuuccuaugggguuucaaucccuucagcucuuucaguccucccccuagcucuuccacugggguccccaggcucagucggauuguuggcuguauuugcaucuguauuggucagguguugguagaacuucucaagcaguacuaggcucugucagcaagcacuucuuggcaucagcaaucguuggugucuuuguuucuaauguuuagaugggguuucauguaucccagguuguuuucuaauucaccaaguaugaccuugaacuucuggcauuccuucuucuagauagcugggaguacaccgccgugcucacauucuacagucgcuagagacugaacuucggcuugguuuaugcuacagaaacauucuaccaaaugaacuacauuuucagcucaaaacuuugagauucucaaaaacuuauuuuaacucaauaagcuuaaaccauguguagagaacaaaauaaauaucauuucuuccccagucacaagguucaugacugagucuacuaaaacaauagacacacuaauaagagaaaaacauuuaaaaaaauguaaaacccacauuuuacacuacauggggaccuuguaguguaaaaaaaugaagaccaagaugccagauaugaugacacaugccuguaauccuagcauucagguacagagguuagaagacaaccugggcuacauauugaauucaaagcugaacugauccugucucaacaacaaaaacaaacaaaagccagaagagaccuacaaggucuuauuauuuugccuuuguuuuguauugagucugggucucaccauagaaggaagguugacuaaaauauccuucaaagugcuaggguaacagguacaauaucugugugaccauacaggcagaauauaacuggaagagaagaggugugguauauuguguacuggggaaggaguauaucaaggucuguuuaguuucuccuugauaugacuuugugauauucuuuccccuucuaguguaggacugggcagugguuacgugagggucuuucagagagacaacaaccuuuuugcaauucccaugagacuucauuaaaugggaggaggacagaaagugcacaugguuacaaagaaaugaacaagaugguuugggggcuggagagaugguucagcauuaaaagcauuugcucuccuggagauaaccuggguucagcucccagcacccauuucauccucuuacaacagccuguaauucuaguuccagagaaucugaugccuucaucuggcauccacuggcacugggcauacacaugaugcacaugcaugcauacacacauaugaaacacuuugguuggcuuuucaacacaagguuugcgaugguuuguauaugcuugucccagugcguggcacuauuaggagguguauccuuguuggaguaggugugucacuaugggcaugggcuuuaagauccccauccuagcugccaagaagucagucuuccacuagcagccuucagaugaagaugcaggacucucagcucugccugcaccaugccucccuggaugcugccaugcucccaccuugauaauaauagacugaaccucugaacuuguaagccagccccaauuaaauguccuuuauuagacuugccuuagucauggugucuguucccagcagaaaaacccuaacuaagacaagguuucucaguucaggcuuagcuauccugauauucaaucuguagaccaugcuaaccucagacucggagaucuaccugccucugccuccagaauguugagguuaaagccuauguacuguaaaaguaacuuuuauucacuugguguaauugucaucucagauggaggcuuacugaacucuggcuggcuggucaacucaacuguucuggcucaaacuccucuccaagcugacagauuagucuggcuucucucucauccucugacuuuuugcucugcuuggccucaaacuaacucagguaaucuguucugaucuucugguuucuucucauucucugaaucguucugucuucaccugugucuagcuuaucucucuucaaccugucucuguaaaacucuccugguaaaacuaccuucucucuuucugcacucucuuaugcggucucacuuuccuuucuguucucaugagagaugggcauauccuacucugucaaaucuuucuuugauucgucacuuugucugucacucaacuagacaucacuuucaaacauaggugcuuccuucgacuaacuugaccuucauuguuugagaaaaaaggugugugccaaggcugagccacaccacaaccagaaacagguuuuuccagugaacaacgcagucucacaggguuaacggugugaucaaacauccugcaacagugugccaccauggcuggcuuauuuguuuauuuuauaugugaguaguucacccgcaugcguguaugggccugaccugucuguaugccuggugcccaaagagaucagagucuagaauccccuggaucugaaauuaaaggcaguugugaauugucuuaugguugcugggcguggaauccagguuuucuacgagaauaauugcccuuaacuucugagccaucucuccacacccacaucuaaaaaaaaaaaccaaaaaaacaaaaaaacaaaaaacaacaacaaaaaacccaaaaacaaaaaacaacaacaaaaaaaaaacccacuaucaguguaugagacaugcauaaauaaaucaaaauagauuaauguaugguggguuacccauuuagacagugaaugaaaaaacaaguguuagucaaccgagagucacccacauuuccaaaaccaagcuccccuauccccugcccuucaauccucaucauuacuaaagaccaaugggaccuggcuuuuuuuucacuuucgccacuguccugcauuuucacuauaugcauguuccauaccccauauuauaaagccugcaccaucacagccugcccugcuucucacuccacuuccaauaaaucuuuuucaugagcucuguuguguaauaugauuuuuuuuuuuuuuggcagcauuccuuggcucugaccaucguugagguacucccugugacuauuccuuaaguauggagaagauuuuuauuguagauauaagggaaacgcaggcagagugggaagaaccgguacugaauaugggcagccuggucuacagagcgaguuccaggacagccagagcuacauagugagacucugucucuaaacaaaacaaaacaaagcucccacccccaauaucaacugaaagagcagguaucuagugauuuuagggugugcugagaucaaaguccagagcacaggcauccagaacuccgcuccacccccuacaacagcucacaggaaacucaaaagcacuccccauauguuggugaaauguuaggacuuaggacucggagcccuccugcagcucggacuacuucuuuggaaguagcaggaacuguggauuuccugcagagcagaaagcugugugcaaaaagggcuuucaggcuagugggcguggucgaguccuuggcuguggagcugcaggaggcucucaaagcuccuguagagggccucaguaccagauauugcagguucuguaguuuuucucaguuuucaacaaauucccccuucguagcccaggcugguauugaacucuaaugccucgguuucccuagcgccaggaucuuuaaauguuuugcauuuauuuauuuagcguagguggagagugcaugugcuuguggagcuuagaggacaaccagaauagauguucucaugucccaucaugugggggauaugggauuugaaagccagucaucugauuugguggcaagcaucuuuacccacugaacuaucacuguggugugggguggaguguggaauguguauguguguuuacuuuguucuguacagcaggaacagcaccugccuuguguaaggaaggcuaguugucaaaaaugguucauccuagccaggagcuucgaaaaugauauuugugauggaucuuggaaaaacuugauagacuggucugaucuuaguuagaggcaggcccugaggaggaaaccccaucuaaaacccagcccuugcagacaccccagcccaccccuaaccgcagggaaucagaaauggggucucgaaagcuaugggggcuucagcacccuaaccuacacgaggccucgcgcgaccucagcagcuggaagacaaccgugacgcacuggccgcuuccgauuucacuuuccuuuucucgggcccggccgcuucaccucuuuggccgcugccuggggauuugcccagugaucagugacgucaagaauccugaaguucccauuggaggauggaguuuggcaagagccaaucccagggcuggucccagagaaaucucggcggagggcccggagcucccggagacugcugggcggggagacuguggugccggcugcuugcucaggaccuaccccgcggagcagcuccagggagaggagugacccggcccggagagcggcgcgggugagugcgguuugcacuggugaggagacgcggaggagcggccgccgugcgacccggguggggacagcgaaggcggccgcgggcccugggcagggcuaaccaggcccgggcgcgcgggacggcgagcucgcgugagcgccgcguccccggcucgccuuugggccuuucgcccugagcucgccguguuccuuccuccucagguccaacccagacuuacuucagucucuuccaguccccagagccagaagugagcgggacccggaugacguuccaccugguggcuuggagcccugcaugaccagaagcaggucuuauauuuauguaucuguuuauuuuuuuuuuauuuauuuauccucagaguaaacugguuuagcuaguuguaccaagagcugugcguucguuaucacugaugauuuuacuaccuaauuagcuuaggaaaagaaaguauaaaccuggcuguggacuggugcacgccuuuacacccagugcuugggaguuagaggccagucugguuuacagacuaaaugaauucuaggauaaccagggcuacaaagagagccccugucuugacccccacccccacccccacccaaaaaaaaaaaaaagaaaagaaaagaaauguaugaauuuaacuuugggaagugaauaggaggagacacuuaacaauuccccguacauuccagauuuugacaacacaaccauuuguguguguuucaaagaagggaagaaugacaugcgcucguucaugcaugccugaaccccuuguuagugagauggauucaugaugccuagaguauuccucccaaguuaaaacaaacaaacaaacaaacccauauuuuucuaaaagaaagcuuucauuaaugccuuuaaaacugcaacuuuuaaauuugauaaugaugacgauggugaugacaacgacagggugucuccauguauccaaaauggucugaaacugaccauggcagcccagguuagccuccugccucgagugcuucgauuacagagauuacaggcaucugcccacacuuuugaauacacuuaauuuuuuuuagaacaguuguacauuuacagaaaaaauugagaaaacagugugugaagugucuauaacucccaacugauuuccuuucauugacaaauaacacauuauuauuggccaaaguccacacacuauauuuauucaccuuuuccuuuucaccuuaucccuccauauucucacccagguugcugcacugcauugguuuuuagauuugguuucagaguuuucagagacacuuauguaauggauaccucagauaaugaacacacgaggagaaagguugauuuugguucacaggcuuagaaguugcagcauaugacccauugguaccuguugaucugggccuaccaugaggcagcaggcacagagagagcagugcgcagaagaacaaaaccacucauguaauaggcaggaagagaggagaaagagauacaucagcaugccacagcccccuucuaugaugcuaucucaguguccuaaagugguacaccucguaaggucugaauugguuuucaguagugcugaugcaaggaacaagccucuguagaccaggcuggccucgaacucagaaauccgccugccucugccuccugagugcugggauuaaaggcgugcgccaccacgcccagcagaacaagccuuuuucacguggacuuuugaagcauauucugauauaaacacuuggauguguguuuguaugguauaucuuacuauuuuuuuuuauuuauuuuucuuauucacuuuacauccuguucacugcccccuuccaggucacccccucccacaguccuuccccuaucccuccuucccuucuccucugggguaggcgaugacucuggguguccccuccaacccccaacauuuuaagucucugagaggccgggugcuuccucuuucacugaggccggcaaggcagccuagcuagaacagauccuacacgugggcuuuugggauagccccagcuccaguugauuaggacccacaugaagcugcacaucugcugcuacauaugagggaggaggccuagguccagcccguguguauguucuuugguugguaguucauacucugagagccacucuuaagauuggguuuguguguuaaagaauacaguuaaguugccauauucagcacagcuuaguaaggauuucaugucaagauuuaggugcagcccuccucacccagcugaguguuugcugguuuucuacauugucaaguuuugcauugcaguuuuuucccuuugcauacaguauuacugggaaggaagucacuuuguucaucuaaggaauuagggaguuacggauuuuaaauuauucccugugggaaauguguccacuucauuaauuuguucaucucuuuauaucaguauggacuugcagguauugauacuugcaagauuggauuacaguccaauagugcuuuuguuguuguuguuguuguugcugcugaaaucagugcagcuuugaguauugaaagcugauugccuccaugucucuccucuuuuaaugaugccuuuugaguaaacacucguguauacgugaccuuccaaacuucagacaacuuggccaaacaauuuccuuugcuaagagauaagaaaaucugggucuggggaguuggcuccaugguuaacaggauuucuuguucuuugagaagaccuagguucaguuuucaguacccacauggcucguaaccaucuauauauaacuccagguccaggauaucuaacacccuccucugaacucugcaggcacugcaugcauguggugagaaaacaccugcacccacaaaauaaaucuaaagacuugagaaggagggggggaggaagaggaaaggaaagggucuugccagacgaaguggugauugccuauacucucagcaccugaaaggcagaggcaggcagauguuugugaguuugaggccccuuugauauacauagagaguagcaagccagccauagucgcauagugagacccugucucagagaggagaaagaagaugcagggggauugguaaggaaacugaaguacaaagguggggaaugacuuguuaguugcuacaagagaaucacaagcaggacugagacugcaucuguuacugcagaacuccgaaaaccucagguaaaaccuuuuaagugaaugcuucugcgagggggauggggggggggggaaauccagcucccaggaucacaauggaaaauacacggggagacauuuguagcaaacaaaggcuuagcuuaagauuggcauuuaaaaugggauaggagagccaggggugugguggcacaugccuuuaaucccagcacucgggaggcagaggcaggcggauuucugaguugaggccagccuggucuacaaagugaguuccaggacagccagggcuacacagagaaacccugccucgaaaacaccaaaaaaaaaaaaaaaaaaaaaaaaaauggccagauugauggaaaugggcuauuagaauacugaccuuccccgagugggugagggaaggaaaucuguguggguguggcagaaaaaaaugucuaaugcccagauccugccacuuaggcgguuuaugaagcugggaucugagggugcugugaaaauugggggcagagaagccaucagggcuccgaauccgggagugguauuuuauagucgcgauuccgugauuugggccaacugcuggagauaaaaaagaucacugaggucugacucuuguuuuagcauucugagaauacccauccaccaaaccagaaaauaaaggcaguuauaaagcagugugagaguguuaucauggaaagacagaacuaacugggaaggagcagagaugggggggcaguuuuauccaaggccaagcugugucugagagaacagaguguacaagaacaaggggaggaguaugucacaugaagggccucucucccuaaauucuuacuauggaguacucaggauuuggggcuggaugcccagccuuguguguuuugaagcaagaaaauagcccagugagacccacuucagaaaugugaucccuucagaacucuguaggagaaaggccaccuguggugacuauucuugcuuggcaaccugacugaaucuggaaugaacaaccauccagaaauggagggcacaccugugacagauuuuucugucugauuugaagaagguuaaucuacuuguagugcauaccuuugagauaggaaggcacacaacuuugauccagguuuuaagucuggaagacacagaccuuucauuuggaucuugaggcaggaaaacguacuuuuaaugugggccauaccuuccgcuggaaguuuauauaaggacauccaaccuugugggauugagcaacucugagauccuuggacuuuccauucacagcuagccauuguuggacuaguuaaacuauggccuguaaaucauuucaguaaauccuuuguguguguuugugucuguguguguguguauguguucugugacacucuagagaagccuaauacaccaccccucaucauauauguaaugcuucaauugcuuuauauauccuuaguuuauguuccacacagaauauuuugccaguuaaaugauacaugucacugauuacauaucagagaugcuaaagauagaaugucauaggugucucaacuuugaugaaaaguagaaauucccuauuagcuugcugagaugccuccauccacuauaugaauagucagaauuuccucaccucauggauggguauugaguucccuggcuccauuuguggauauuuacuuauuuuuuagacagacugccucacucaaccgguguaagcuacaacacuuaaauagaccaagcugaccuagaacucagacauccaccugccucugccccugacccccuacccccaccccugcccagugcugggauuaaaguugugugcuacuguaccauaccuucuguugugauccccacaccccuuucacgugacauaccugguaccguagccugggcugagauguacaugggguagguuuacucugccuccauuuucugacagacagaauacaaccuguuguuaagcaugaggaagccacuguucaugauuuuggaaacacugguuuagcuggguaugcugacgcccacuuggaauccccucacucaagagguagagaaagaagacuaggagucugagucagcuuugacuacauaccaagugugaggcuagccuggaauacaugauaccucauucuucaacaaauccccacuacaucugaugaucugguccuuuccuaccugauagccaguuugucaaaacaccacccacaccuccacccacacuaaugcuucaacaauuucagccaucuuuauucugcuuuggcugcuguuaauaauagcaauggcucuauaccgcccauuaaauaugcugguauguccgcuaaacguuacuuucgguguugugaacagcucuguaacccacaccuuuauuucuucaugauaauacagaagcuccggaaagucgggacucuagccucgugcugaacaacaggguagccgaggcugugugaaaauccagguggcucucuaggugcgggcuuugaucgacugcagagggagguagaagaugaggcucuguuucccuacucagaaugcuaggagccacaggaguugugaugucccagaacaggcuaaaagucuacugugucuggagguuguccucugucugccuguguugcaagaccuguuucagucaguugacugaugguguuuuguuuuguuuuguuuucuguaaauuguguauuucagcccaguaacuucaucuuggugucagucaggucccccuccccuuaaaaaaaaaaaaaaaaaacaguugacagacaaaucccaaccaagcugauggggcagaaaguuaguuuauuggcucauggaacugacagguuuaagguagggcuagcuuugggcacaagauuugaaaaagugcugacaaaauaaugcuucucccccucuccugauuggcuuacgcuuaggccucaggagauuaaccgucuguucaccgggaugauugcuccaggagcuacaaaacaaaugaugucaccucuugaaaguucccaaggauccacaagaauuucuccccuuucccagcuaggucuccuugcgacugguugugacugguugugauggaccuguguuuuuccuuuaaccaaagggcauggguuauuaauauaccuaagauggauacuuuugcuucaccuuggaacugagggagagcuccaccgcacgcaugggcuccccagaaaccagagaaaguuaaaugaaguccuaggcuccuuaaaucaccagugggcaaacuuaagccauuugcuagcggaucaaaaagcacaguuaucuuucccauguuugacugccuugcucugugacugguucucucuccugcugucacuuugucucuucucguguuaugcacacaugcugagauucuguguucuauucaccagcuugucugaguuuguaaagcuggaggaaucagguguuggugagucuguggagcugguuggugggacugcauuaccacggcugcuuuggagacagcucggcucauucuaguaaaagcaagaguucacgugccuguauguguacgugcagggccacagggcaguguucguaauguccaaacuuaacccacagggccaucagaguaggaacagcagugacaugagcaaaacaagcacagucacaugagugaaacucacugccauguuagucuaaaaagaggggaggggauuucauauuaugaucccaugcuucgaaaugaaaaaaaaacagggagugcaggugguggggguucuacccauuguuuauggaugcauaccuaggucuaaaacuaaagaaaaggaagagagaaaucaucgccauuauaauaacuaaauuccuccacagcugucuccucaccuaguuccugaacuuacacggaaugaaccuguauacuaggacuggaugauggagacacacagucugcucuccuguggucaggaguugccagaagggaugguguucagcugagaacuccaacaaggaaagggguuguaaugcagaggaaugauaaugagcaggguuugguuagaggcagaguugaagguaggaguggcaggaaaugagcugggagauaggacuaggcugugguuaacagcuggaggcccuuggggguggggaaggggaaaagucuugacuuuauuccuggggugccagaaagccauuucuggagucuuaaccaguaaccacauuggcacuuauacuaggcugggaaugugugaggaacaaaaaggaagauggcuguaguaacuggagcagugccagcagaggagaaaaguucaagaggagaagcccuuccaggcuuaauaguuccugaugcuaaaucugauugcugcagucacuagacuugugucagugucaaauuucaaggaauguucuuuuguucccccauuuaaccucacuuaaccugaaacauaguaggugcucaguaaaucaugcuuaaacucucaaugguuucccaggucuguugggaugaaauucagaguucuuuaucugguugagcugggccagagaaaacaguacaaggccaugggagaacagugggagggcagggagucauuuuuuuguuacuguuuugagacaguuuugggucuugcaguuuaaccccaaguuaaccuugagugugugccagcccucuugccuaagccucccaagugcugggguuauagaugugugccaccacacuuggcuagaauccaaagugcuugggcggugggacuacagucaccaguauucccaagacagccauacucagccauagccauaacuagggcuacaauauuggggaaugcaaucuuugguagcaagcaagaguguagccauuuuauauagcuagaucacuugcuuuuugcccugaaaauuuguuagaagacucucucuaaguuugcuagugauuacuggcuguucuggaagaauuuacuaauuuuagauugagaaauaggccuuuaucugcaccuuaugaacaauuagguaguggucucaugggacauggagccuuaagcuaaguauucugggauggcagaagaaugaacuccuguugggaggcccaggggcauguuugaggagaugcggggguaacugaaagagcccugagggucaggcuguaaaccuaccugucucucuggguguuagaguccaaaacuggggauucauugacuccuagaauaucucucucuggcuuuaggaguuuaaggaagcaggaaguaaaguacuagauauagggcagaagaagccacaggaguggggagaaaauuuagcaccuagagcaaaaauuguagcuguuaagaagugugggggcagagcuugaauacacagcggugagggcaguagugcaggugucugccucagagguguagaccuucacgacaacauuucagagcauuugcagcuaacagugaaucucacagccaagaaucucgcccaggauccacuguguugccagaaaugacaaugucacccugcccccaacugguuuguuguagguuagguguuuaugagagccucagcuuucuaagggagaggugguuuggagauaaagggagacucagugaagaauagaaaguauccccaauucuaagugucaggauacugcaggccucccugcuccuguggaauuguagcuaguuucuggauuacugcuggaggaccugagaucugcugccaccacacacacacacacacacacacacacacacacacacacacacacaccaucccacccccaugcgugacuucaggcgcaacauaauuaauacucagucauuuccugucuauucaaaauacuauucaggguaaagggaguggugguaaaaggcucuaguuugcuuuucugcugcuguaacaugcugaccaaaaagaacuugaagaggaaaaagaaaaacuuauuucagcuuauauuuccaggucacagcccaucacugagagaugucagcacaggaaugcaagaauuuaaacgaacauaauuuacuggcucaccugcugacuuacacucagcugcacagcccaagacugcguaccuagugaugguacugcccacggugggcagcgcccuccuaccucaacuaacaauuaagacagugccucauggagaugcccaugucuuauuuaggcaguucucccauugagguuccaucuuucaggugacucuagguucuguuagagugccaauaacaagaccuggacugcucacuucugauaaguucauggcagugccugagccaggaacagaggguaggauaaugguuuuauuuuuuaggaacuuguggagaugaucggagagaacaaggucagauauauaugauaagaaauaugagaucaugguuugggaaaguacuuuuagaauucagcagagguacacaccugugaucccaguacucaggaggcaaaggcaggagguuagaauauucaaggccagcuugagcugcuuaguccuggcucugccucaucaaacaaaacacuagcuuuguggagggccugacggaguagguaugggaaagugguguggacugcuuugcccucucuuccccucaacccagcuuuuuuccucuuaauuccgcaagcuugagcugcuuccauccauaaaaagcaaagagugcugucuaacaagagugcuuccuguuaucucuuaguagugaaggcuagagugcuuucaaccaaagcugaagaauacauuccccuuuucucuugucaccucugcucaguuuaccaagccaucuguauagaugagcccaucaggguauugaacagaggagauggucucaagccccauuuuacagugugggaugacuggggcggaaguuugggcacuuagacugauuccuggcucuguguccuacagcaucaugguuaauaggacugucuuagucaggguuuuuuucauuccugcacaaacaucaugaccaagaagcaaauuggggaggaaaggguuuauucagcuuacauuuccacacugcuguucaucacugaaagaagucaggacuggaacucaagcaagucagaagcaggagcugaugcagaggccauggagggauguuacuuacuggcuugcuuccccuggcuugaucagcuugcucucuuauagaaccaagacuaccagcccagagauggucccaccuacaagggaccugaaacccuugaucguuaauugagaaaaugccuuacaguuggaucucauggaggcauuuucucaacugaagcuccuuucucugugauaacuccagcugugucaaguugacacaaaacuagccaguacaaggaccaaaucucaguuuccucggaagaguaucccgagugugaaaucaccugauuauuggagucuagaaccugaacuuugagccugaauuguucaagcuuuugaguuuauaccucuagucuuaaaaauaacauguucaaggugagucuuugcagccaggcagugacugucaaguuacggugacccagaaucaaaagacucuguacaguuaacauuggcuuuaguuuuucuaaacccacucauuauuucaauacgaguguuagacaagguuuuaaauacucugguuucaacaacuugagugguuacagacccuuuuaauguaucagaaaaccauaaccuuuguuuccccaaacuuuucuuuuuguacaguuuucugaaaccauuucaauguaaauuguaguuaugaagaucuaacuaugguggcaucugcugcugaaaagaagguuuucauguagucucaguacgugccauuaagauuaucuccauuuauauuuuucuugauagccucugaaauguuguuauaacuaccuuuuaaaaacagaaucagagccaggcggugguggcacacgccuuuaaucccagcacucgggaggcagaggcaggcggaguucugaguucgaggcuagccuggucuacaaagugaguuccaggacagccagggcuacacagagaagcacugucucgaaaaaccgaaaaaaaaaaaaagaaggaaaaauaaaaacagaaucaggauagauuuuaucuuuggcaccuacuuauuacugugauuuuuuuuuuguuuuauucuugaguucaugugcucugugugugugugugugcaacuugcagaaauugguucucuccuucuaccacaggaguuauagugaucuaacucaaguugucaggcuuggcagcagaugccuugaccccaaggccaucacacucacccuaccuugggguuuuuaaaagaccaauuggucugugacuaugggugccccauauucugaaucugucugauuauuuccccgcucugugguuuaacuuggugcuauuaacacauucucugugauaauauagugugugugugguuuuuuuuuaauugccuguuuuccauaaacugaaagcuaaaucuaaaguuuuugugaaguucaaucaagucaaacauuuuuggaaaauaaacuucauaggugauaguguuuguuuuuauuuuauuuuuuuuauuucuuuguguguaugagggggauuauuuuaaaugccugcacguuugucugugugucacgugucugaagaggccagaagaacuggaguuauagccaguugugggcugcugugugggugcuaggaauauugaaccuggguucucuggaagagcaggcagugcucuuaacuucugggccaucucucuagucucacgugauggugcuuagcucacaugguuccuccucgggagaccugugccagacuggcuggcuugguuacguggucaaggugaacacuggcucucuccuuccuccaggcacauuaggaaauaauccacuguggcauuauagggucuacuccaaaccuuucaccuaauggcucugaugucuguugaugacaauuuuauuguuacguuggcaguugcagaaggcuuauauuuucuccccacugccuugaucccugaggaucuugaugauucuaaacaacacuggucaggugcucucggaggugugccuuagacucuaauccugcuaacucugcuccagguauuagccagggaucuucuguaagcccugaaauguuagcucugauauauguacauguacauaggagcuuuuauucaacuuaaaucuaaagacccaccggacccagcgugagcuuguuuaaugcaggggggggggggguuguggugaaggcgucguacuuuaugagagaggggaauaguagcugagcucuauccuaagaaauuauaaguucugcccuuagaacuacuugcuucucuccagcacgaaaacaaaaacaagaagcuguccuggcuuuuaaacuuccaggcuauucugccagagcuucuggcccacaggcaccccacaguuucauuuccuuuccuauuuucaaacucagcaauguguuaaauugagaacacuggguuuuccuuaagagcaaaccaagagguuagaucagacacccuucaacacuucuuccgacauuccggggacuuguuacuucuucauuugccaguucaauuucauuccaaguugguauaugugcuuuuuauuauuauuauuguucauuacaucuuuugaaaagucacacaugucuaaaccaaggguguuuuugguucauauucucagcaguauaacuccucgccugcagagcacuuuuauauauuuccauaucagaucuuuuaaggaaucagcauuguaugucuuuuccuugugguauauauauauaggcugcaguuuuaugucuauguauuuccuaucaccauuagcagaguccacuaagcuccgcugauggacucccaugguaacugucagugauaguguuacuguuccagcauuacaaaaugcugcaugguuaccuuccuccgugcccauagcacagccaccucccugcccaguguaggcauuguguaccuuaggagguggggcaggacccugcauucuugauacugcuuucaguuucaggucuuggaucucaaccagugguugaggagccagggcuuuggguucucuccuggauugcuuucuaugaaccaggccuaugccuaguguuucuaacagaacucuuuuagaagaauucuguuuagaagccccuguaggcuucucucuuucucccauuuuauggauggauaagcugagacucagaguacucaagugagcuuucugucgucacaggggcaggaagagggccagagcugcaaagauugauaggaacaccuuuuucucagcuaagcuguguaccuagaagggccauaccugcauagcccgggacagccacagaggaaucuucccuuccuggcgucccuuguggucuuagcuugagcaauccacagggguaucacucuuccuccuauugcugagucugcucuugauuucaggucuaaggaacagagacccccaaccuaagggugcaauggcagugucagcccccuugaggagccuggaggaagaggugaccugcuccaucugccuggauuaccugagggacccggugaccaucgacuguggccaugucuucugucgcagcugcacaagugauauccgccccauaucggggaaccggccugucugcccgcucugcaagaagcccuuuaagaaggagaacauccgacccguguggcagcuagcaagucugguggagaacauugaacggcugaagguggacaauggcagacagccaggagagcucgcccgcgagccacaggacaugaaguugugugagcggcaccaggagaagcuacacuacuacugugaagaugauggcaaacuguugugugugaugugcagggagucccgggagcaccgcccccacacugcaguccugguggagaaagccgcccugccucacagaguaaguccucccagggccugcgagggaagguucugucuggugucccuccugccccagcucaggacacucaucucucuccgcugcuuaucuuuccuuaggagaaaauucugaaccacuugaacacccuaaggagagacagagacaaaauccagggcuuucaagccaagggagaagcugauauucuggcugcacugguacgugggaauccaagcugagcguugcucacgcguuggagggaggggcuggccaggugggaaguguuucuaggaguacuuuggaagcaugguuguuagguuggcuuuaggccaacuggggauuaauuaaccaaggagaugguguagguuggccugcccuguccuuuugggccugcuauaugucucaaacuuugggucugauuucucaucugauaggcagguugucuggcagcaguggcuauucugugaggggacugaggaaccugacucugggcucucugaaagugagggaaggugugauuuccuguguagagggcagcaggggguguuugggagggggugcuggcuucaggguaagaggaaaaggacaaggaagggggccugagcagcucugagcaggcucugauugaggcugccuagugagacucgggcccacuauucgaaguaaagaagauugguggcacauuguguacuuuugauuagauaggucaggagggacggcugauaagggaaguccaguucugggggaguguguguguguguguugggaaaaugggcaguggagagauucuggggucacgccuggcagugucuagccagguugugaaagauaaagcuagagagagcucagguccacaaaguaccucuagauccugguguacacgggcacccucacuuaccuagagggauuggggacucaggcaguuccagcuuacaggacaggauguguucccugaguacacacauuccagccucaccaaagaagcagaguggagucccacuuggguacacagaguaauggggguauugaagaggggcugacugagugcucguauuaucauugagaagggugacauuauguuaguaaugggauacacaggcucccuuucuuugucccaagacuuacuggucaccuagaacgaauagugacagagcagucaggccgagucagcuuugaggacagugaagggaauagacucugacaagucucaaggagaagagggugaagcaggagcaucccagugccaacuccuaccgaaggucuaggauucacaagccagaguccccagaggaucgagcggguaucaaucacaguuccuagagguaucacagacaagcacccuguccccuaccuuacagacaaagcugcaggagcagaggcaguacauuguggcggaauuuaagcagggccaccaguuucuaaagaagcgggagcagcaccugcuagaccagcuggccaccuuggagcagcuccucaccgagggcagggagaaguucaagacccggggcgucagugagcuugaccgguugacucuggucaucuccgagcuggagggcaaggcacgacagccagcugcagagcugaugcaggugagagucgucuuggcccaagugggagacagguaccacuguuauauggccuuugaagaaauucuuccucccaggcucucaguuuaacuguguaaaauauggguaugugggucuuacccuccuuguuuaucccagaguccacaugagcuuagacauugacauggcauggcuuuagaacaauaaucaucaucuacagaaagcaucuagaaaugauuaaagggccguagaacugaaggucuuuguugcuguccuuccucggcaugagaccuccauugagcccucuagguaacaaggcagauauuuguuguuuuugagacaggcuuacugugccaucccaucuguccucagauuaaaggcauuccugucucaaccuucugagugcugggguucuaggugugcacccccacgcccgacuaaggcaggccgcuuauuugauaggugccuuauaugguucuagagaugggcugagcuguggcugucaggauccaaggugcaugggaggcaagugaagauagauagaugagagguuuccucuggaccauagagcaucaucaaccuggagaacggugaccgggggguaccucaggacacaaagcgagagcaggcuguuccguuccacugacaagccucuucacccuuagcauucuacccaaaaggggagggccggaccuucccuccauauaaaccaggagaagggucauaugcugguuuccucugaccccccccugguuugacgucagaaaugaaccuuucugccaucagaagacacacaaaggucucuagggguuccagaccaguggcagggcacagugauagccaggagagaagagaugucugugcgagucccaagcacaggcugcaucaucaggaggccucucuuugcagcagagugagccacguguaagaggcacccuggggcagauuagaacucaaagcugguaucuaaccccccaggcuuuggacuuuucucucuuguccaaugucccucaggggcucccuccuuagcuccaggcauugccucuucucuagauuuuuuuuuuaucagccucugggucacuugucuccucucccucaccccguuucuuucuuccccuucaaggggcgcaucagacuuucccagcagccagcccuuccacaugugcaugugaguugugaguggagcagcugagagugcuaggguuugucagcagugugucuguccccugaucaacccugggaguagcuacuauacagaggccccugucugugccugagagcucugccucggaagcugccaugaugaggagugcugaggagagagauccacuuaaaaccacuacccagaaugcuggcgucagcagauuuugucuguauucagguuucccuggagcaaagcgccggaagcuucuggaauaguccuuaacagccaugguuugacaauugugcuuguuuuccaaauuguaccucucugcgaagccagccugcccucugccccaacccccuccacccuacugacuaauguagugcccaucacuuacuaacaugcuguggugauaguaaucauuuucauauugauuuuuuuuuacucucuugucugcuucccucugcuaggaugucugcacuacacagguagggguuuuucuucuuuuuuauugcuaccucuagcuucuagaccagucccugccuggcacaaggaaucacuaagcaaagguuuguggaaugagugaaaagaagcagcaaaucggucaacacagaacuguggagguuucagucucuccaaagaauccucucacaagauaugcccguccucucugaccugggcacuugucuuccuuucauguagacagcaccacugucuuccuucugcacaagggguuuuuuucuccgugauccuugcugcaaagcagucaugggaugcucggguucucucuugugcuccuuguugccauuuccauaccccaggucgacgagcgaccuccaggaugaccuuccucccuguuccuauugccuccugccaccauuccccaaggagcagcccggugggugacuggguugcaacuaguugcagcuuagagcuuaguaguccauacagagcagaaguuccuuucugucucugcagcaggucagaggugaggaucucgaggucauccaggagcuggcuuguuucuagcuggcugucuagucuugggaaaauuguucucuuccgugcacuuugaguugggcucaucgcuguauucaaacgucagccaaugagaagaaaggaacuagaaagcauuuuuuuuuuuuuuaaagaacaagacugagaagucuuggguuugguugguugguugguugguugguugguuuguuuguuuuuuccuuccugcaucccauuguaauuuggucacgugaccagacuuguagggaaugugggaaaugugauuucuugacuaguugcaugucagacuagagcuuagguaguuuaguauaaagaaggggaagccgggcauggugguguacgccuuuaaucccagcacuugggaggcagaggcaggcggauuucugaguucaaggccagccuggucuacagagugaguuccaggacagccagggcuauacagagaaauccugucucgaaaaaacaaaaaaaaggggggggggaguugcccuuugaucuucacauacauuauguuauaccacacauaugcacacacaaauguuuaaaaaguggggaguaaggguggguacggggaauacuugcuuuuuauuccacuguguguggauuacaaaucaccguuacccuguccugccugguauaagcuggcccugacucaucucuaagcccuuccccaguucuuacccaucuauaccagcuagggcuuucucauucuucaaaccugaacuuaaguguuuccuuggacauuaagugucaccucuggucauuucugaccuuauauuaauuauguuguuuauuuuauauguauggauguuucuaccugaauguauguccguacaccacuugcaugcuggugccuuuggaagccagaagguggcacuggguuuccuggaaccggaguuauagauagaugguagugagcugccauguggaugccuguaaucaaaccuagguccucuggaagagcagccagugcucuuaaccacugagccaucucucuagcccguuguuuuuuauuuuauuuaauguuccacuagacugucaguucucuaagggagggagccaugagugcuuuguuuguuuuugugugccugucuguuacaugguacuaauuguguagacucaguguguaccugccucuuauaugguacugacuguguagacuguaugugccugccuguuauauagucuugaccacagaugcagugugugccugccuguuaauaugguacuaacuguguaggcuguguguaccugccuauuaauacgguacuaacuguagacacugugugugccugccuguugcaugguacugacuguguagaugcaguuuuacuuaauucacuuuggugccucuguuuucuucccuugcaggacaccaaggacuucgccaacaaguaagaguucacuugcucgucuucaucauucuucuucccucccacuuguauggcuaugguccacguaguaguaggaguguagggugccaacugcacagcagcccuugcuucaucccauggcuuucaagaaagaggucaaucuuugaugauuagauauuguugucucccaacacgaucuccagaguccaacugggcucacagccuucaccugagcacagcaagagaguaaaagccugacuuggcagagaguccgcucacuugugaaaucuucuggcagucuuauauccugguucacauagugccuuugccaguuuuucuuuccuugauuagggauaaugagaccuucccugcuugccuuguaauugucaugaacacuggcagaaaagcaagaagagccaagugacagguguuugugucuaucacucuuucagguacccacggaagaaguucuggauugggaaagccaucccucacaugguuaaaagaaaggcaggagaauucucagauaaacuucuuucucugcagcgaggccugaggcaguuccaggguaagcauugggaaaagcaccagaucgggggucaggcucggccacacugggagguuuccuggcuucuccccaccuuauucucccaucucagccuuccaaggagcucuggcuucuguaucuuuuauccuugggaucuccaguagagcccuguuccaaguaagaaaugaguucucugggucuacaagucauuucuaucguuuucauuuuuccuccauaggcaagcugcugagagacuuggaguauaagacagguacgugaacagaagguuguucccauuuuacccuguggaauccucacuggaacugcccauaggcggccccacccccuuacauuauuucagaucagucucccguguagucugcaguacugcugagccuuugaggucacaggucacacaccauaaggugcuucuuaugagaccuuaugagagcaaacagcaguggcagcccgaggccagagaucaucuaugcuguguguaccaaguaccucagggacacaguucacagagaccaugauauaaagagugcucgggaauauauagaacugcgcagugaggcagauacuauggagacuagucacuccuucccagcccaccacugacacuguuacuuccucccuuguccaauaguaagcgucacccuggacccacagucggccaguggauaccuacaucuuucagaggacuggaagugugugaccuauacuggccaauaccagagugacugucugcucccccagcaguuugacugugagccaggaguguugggcagcaagggcuucacauggggaaagguauacugggaaguagaguuggagagagaaggcuggucagaggaugaagaagagggggaggaggaagaagaaggggaagaagaggaagaagacgaggagguuggcuauggggacggauacgaagacugggaaacagaugaagaagacgaaucacugggggaagaggaagaggaggaagaggaagaagaagaagaaguucaggaaagcugcauggugggaguggccaaagacucugugaagaggaaaggggaccucucccugcgaccagaagauggugugugggcccuucggcucucccccucagguaucugggccaacacgagcccagaggcccagcuguucccggugcugcggccccggagagugggcaucgcccuggauuaugaagguggcacugugacauucaccaaugcagagucccaggaacucaucuauaccuucacgaccaccuucacccggcgccugguucccuuccuguggcucaaguggccaggagcacgccuucugcugagacccugaacuccagaacccgccugggucacccuacagaaacuuuacuucucugagaguccaggacucugagaugaagaaagauuaccuggaucccacacccauggaaacuucccuucucugggaucccaaaacuauaauggaggaagguuccuggccagagcacuaggaggaggagagagagggacaucacauccauugccacccaucuccccacugccacggccaaagucucucaacacugucacccuauccauauaucuuacucagcuucucauuuccucugagguuuccugcucugaagaccaaaugacucccucuuuccugaacacacccauuugucuugucccuguguucuuuguugagcagggccuuggcagcagcauuuucugguucaguuguuagccagugcccacagguagacuuuccaucacaucugaagcuguuuuugcuguccucgaaguugagguaccccgugcccaaaaccacucuguugccuaccuuuccuggugucuuaaaucacuuuuccuuaccccacaagaguuaaauaugcaaagaugcaagaauggauguagucaugacccacagaaguuuccaaggccguguaaguuuguguccuggagugcugguagaaucaucuccuagcgugaguaccaaaguuucuagccucaaacccagaccugaguagguaggacuccccagggacaucuguguuucagaaagcaucuagguacuaugacucagauagugacugugaucaauaaauuaccucugcagagcaguccuugugaaggaaguuuuuaaaacaacccgaacaucuugcucuugaccaggaggucaagaccucguugcugacacuauggaguguccagauucacuuuccuaggagauggacuggggaaggggagagagggccaugaggaaucuagagagccucuguccuaggucuuacuauggagaaagggccugcaguaucgcccugcugacccagcuggugcccauaguugaacaugagucccugcuuagccaaaaugaugccccccuuuuuauccuuaaacauuccagauuucuucugcccgugcaaguguuagcuccucuuggcucuugaacagacuguucccagacacuggaucuugguggccucggagucaccacagcgucucgagacugaacacuucguaugcaucacaugcugccugagucacuaguaccuacacaguggcucccucaccacucuuuguucuagaguuaaucaucuucauuuccugugucuuuauuacuaaauaaacuacacauuuuucucaguggucagaaauuucaagacag

SEQ ID NO: 8588 - RNA, 7774 nt, Mus musculus
cuggagugaacuugaaccugagccauugauuggucucucuguagacagcuuuuaaauccccuuuuggcauuaaacuggggguucuggaucuuuucccucugaggccuguagccccgcuagccuaacucucacguagcuguagaugaccuuaagcuuccugucucaaccuucuaaggucugggauuucagguaggugccacuaugccuguuuuuuuguuuuuaugguuuugggguuuugguuuuguuauguuuuguuuuucaagacaggguuucucuguguagcccuggguguccuggaacucacucuguagacaaggcuggccucgaacucagagaucugccugccucugccugguuuauacagugcuggagacugaacccaggguuucucacauccuaggcaagcacucccccggguggcaucccaagcccugguccuauuucuggaccccgugucuccucuccuaacuuaacugugguuuugucacacauuuaauaacuucugaggugaguuuggaaguugaauuuuuaaagccuucaguaucuggaaauguuuaucucucauacacuuaagggauucuucaaaauuguguuuccuucagaaugucagaauuguucuacugccuuaagguccugauuuucagaauucccuuggggcucucugccucaugauaguucucaguggccuguuucuguuuuacagauggguuugggagccuuaccuguaucccuacuccuugcacuagcacauaugaagcacauacauacauacauacauacauacauacaauuaaaggacuggacaagaucucacuauguaaacauggcuggccucagacucacugggugggauuuaaaggcuuauacugucacaccuaagagggguaaaaacuuuaagauaccuggggcaaccuagaaaaagguuuguguaggcucaugguucugaaggugcaguccaucgucaucggucucuaugcuuuuagcuucugucaugguaaccuauccuggcagguaugcuugacagagcacagucacacauaccaucagccaggagacagaaugaaccaggcucccacaguccccuuccagagcauaugcuagagacccaaagacuccaccuucuagucauuuccacccuucggaccaguccuuuaacaccugaucauucagaggucuuaaacagugaaacaaucuugcccauccuccuuauaaguugccacaauaaacagauuagacacaaaacacaaaggcccuuagguuacauauuuuauuaaaacauccucucagaacguagauaaaugagcugaaggggcuuuaggguccacccagaguuguugaugaagcccuguagcaucuccagcuucguguccaaaagucauaaauuaguacaagucacagguuccugguuacccuacaguggucauuuugaagcuuuuacagcuuuuuguuugcuucccuuccaaaucccauugacucauagcuuugcuggugucuaggacaaugccuuccugucugcuggcucuccauucagagagaucaccguguccaggaacaggagugaaaggacuugcuacacaagauucccauuugaaugcuagggacagagcuggguuccaagggugcuggugugucugccgcauuucccuggcuccaccuuagucuuucaaaggcaggcagaggaacuuacuuuccaggugggauaggguuagaaaaagauggugacugaagccuuggugugggacauuugcaaggucucucccacaccuggucacaucuacacugcgcaggacagcugugucuccuuuugcauggcaggugggcgcuggccaguuggagcaaaaguauuauggcccagacaauguccuuggugcucagguccugccauccccucacccuggacacuuaggggaccauucucaugaugcagccgccacucaaguggcaaucacagagaggacuggacuuggcuuuguggucuguggguccagagugacaccucuuccccgcuucaggauggagcggcauccauccaggcugccugcuuccuaggcuucuguuucugaaggacaggagugacagcugugucugaggauuuguuucuuaaagugaaguggccagaacagcagcagcacaguaccuaggagccuguuaagaaacacaaaaucuuggccccugcccuaggcuacccaaacaagagcuugcauuuuaaccaggugaguggguaaauuuucuacaguacguuagagaaguagggaucaauauaagaacagacaagugcuugugggaacgauuaagcuccaauuugaaaguaaauauuuuugcucuuuccuccccuggucccuguuuuguggcacuagggcuuuaugggguaggcaagcaaacucuagcaggaaguuauuaauacauccuuagaacccagccccucccuacauccugccucccagaaacggacuuuguagcccaggcugaccucaaaccuguggcagucuaauugccucuaucacucaacugcugggguuguaacugugugugccaccaugcccagcaaaugcuagguuuuuaauagacaguauuucaaaucuacagagaaucuagcauaauucuggacaaagcucaggggcuuaauacauauuauggaugagugucuacauguaacugagaauauuuagcauucacugugugucagguacugugcggagguccuugcaugcauucauuaaaugcucaaauggauuuauaguguaggagcaaugguaggaagaaaaggguuaauagacccaagaccccaagcagucaggugucagguaagcacaucucauugcuguuuguggccauggguggaauggguaucaggggaaacccugaccccccagagcccuuguugauuaccugaaucugucuccagaugcugcaucaaguuuucugaagaaaggagaaacaaagaucugugagacuuaauaucuccuacagauacucccaaggggaggguguccuggcuagagcgugaggacagggauacacgagaagugugccucaccugccuggaccuccagggccucuauccuuggacaggggagaccacaaucuggggaacugcucccugaguagagugaggucuugugggaagguaugaggagagaagaugcuuaacccaagccacuguuugcuuauuuuuguuuggguuucacuauguaguccaagcuagccuccugccucagucucccuaguguuggcauuacagacauguccuacuaugcuugaugguuauggaccagguauugaaauugaggaaagauggagacagguggaagguagaacaccuaaugggauccugaaccccuuuaccugaaaauguccucaucaucuuugggaggcuaaguauuuuccuguggagguuucggaucuucuugacaagaucagaggaaauggccucugggcucacaaaagucuucagcucguaccugcagacaaguuggaagucaaauuccaaaaauaaaauacuucauuuuaucuaugugcauauauauguguguguguuugaguguauggcuuccguaagaggucagaggagcguuucagaugccuuagagcugaaguuaaaguuuguugugggcugcuucaucugggagcuaggaaucccaacugcagucuucugggaaagcugcaaucaguuuuuaaucauguuuagccaucccuccagccuucaaaaguaauacuugggagacacagggaaaagauggacugaaagaugaucuuagugucugcuauaaaaauuagauucaguauaauugggauuuaccaucuguaaguaagaaugguuuccaaaaugauggacuuuucauuagaugcaggaggagcuaauuuuaacuuucuccugagcacuggagcuugagucuguucuagcagaaaggggcagaggcuaucagcccucuccaccucuagagagaaguggagaaaccgcccugcuucuuucuaucugugugcugguuuguacaaugggaaaauugcugggaagagggagauucgggucccuuugcgguccucauuacucuggcuguguggcuuugcauaggcccuucucucucagaugcucuaucacacaauucccaccacaugcuucuugacuuuaauccaaacgcucguugagaagcauguuuggagacacuuuuaaauggcuuuagaauuuucagacacuaaaauauauuucauggauuaaagauacuucugggaacuggucaugucagacaccacaauucaguauccaguaucuacaugguggcucacaaccaucuguaauuccaguuccagggcaucucccugccuccucuguuuuccucuggcaccagccauacauacgaugcauaaacaaaacacccauacacauaaaauacaaauaauuuuuuaaaaauuccuggagcauucuaaacccaugacuguuauauguaacuuugcuuugagggucaaaagcacaucucaaaaaaccaacggaauugguguuggucaaccaaaaccaguaaauuuauuuuuauuaguuauuuaguuguuuauuuugaaguaggcucucacucuguagcccagacuugccucgaacauauagugaacucucugccuuaguuucccaaguggugggacuaaaggcaugagccacaauguccaguuucaacucaucauuuuacugaguucgaguugauaguaagagagggagugaccuggguauccaucaguguuuucuggaaccauccacaaggguccagauggauggcugugucauaagaugcacauaaaggaggcagaacuggggagggccuuaccugcucugauugagucuggcauccuacaaaagaaacacaaaaacauguacuuacuuuccacauggccuuccccaucagggacucuaaaucuuucugucuuaauaucagcuaaaaacuccuacccagagugcuggagccucuuaauuacuuagugugcauuucacugcucucuucuuuuuuccugacuaaaguagguaggacucugcagccagccaguuccuuugcucugguuguucugcccaccaugccccccccccacacaagugauuaagaaaugauagagagcagagaccagucugaguuccaaguuggcaccgauguggggcaggauugugguaaccacacaaggauauugauggugcucuuccuguguauuggggaccaugcucagcaccacacauggguuauuccuuacauggcuuaccacucccugaaacaaucaucccaugcuuagagaaacuaagagagucacccaagugacaaagugggaggggcugacaacaccaaacucaagauggucugaugauggccaucuuugcauaauccucgugcaugccuugggaaguucucuaguuuuuugagccauaaaaagcagaccccccuccccccacacacaccuucucaaucgagguaauccccaucaccuuccagcaccugcuuccuguaaacccucugcugucgcacuaggugguaggguuguggagucucuuacuugcagaagcucacuugcugguugcugacacuucuccucuagcuccuccaccuggguacucagccggucgaccuccugggagacuuugcugauguacucuucccucuccuugcagaucugccguucuaguuccuccagccuguucagcaggaggcaucucugguccacaagcucccgcuucagccuuucaaaagcagcuucuaccugaugcuuuuugcuuucaaccugcaucugugaggauaugggggaggcucagaacuggcucccauaaggaucaucuguguacuuauuaagagacaggaguaagccauuacaggacucauuucuuuaaauaauacaaugguagaaagagauagaucccaagauacacuugcagaugaugagcucugagcuguugucuuagccagagauuguaacaauaucauauggaacucuuuagagucacacuuaacuuaaaaaaaaauccuuucauagcuauaauauucuacuguuuuaguuuucuucucugugcuaugauagaacguuggcaaaaaccaaguugaggaggaaaggauuuauuucauuuucuacuuucacaucucagugcaucacugagagaacccagagcaggaacucaaacaggagcccagaggcagaggcugugaagaaacagcagguucuccguggcaugcucagccugcuugcuuagauuguuaggaccacggacccaguguaggcuggaugcucccaaaucaauaaucacgaugucucacagacuuaccacauacagccaaucugaaagaaauguuuuucucggcugauuuuuuguuuucaauuccucauuuaggaaggguucccucuucccagaugacccuugcuugagucaauuuggcaaacaaacaaaaacaacaacaaaacuaaccacacaaaacuaacuacuaugucuucuuuagacucaugaauaacuguuguaauuuauuuuuuuucuugagauacauguccaugucuuaugcauucuaggcuggccucaaacucaauucacaaugaagucaaagaugacauugagcuuuugacgcucuuaacuccaucacccaagugcugcaauuauagaacacuccuauucagugcugaguauugaauauagggcuccauguauucuacgcaaccacuguucauacugagcuagcuacccaacauguuaggaugguggcacaugccuguaauuccagcaccugugggggcagagaaaauaggauccgcuaaguagugacuuugaggccaguuugagcuacaugagacucuguaccuaaacaaacaaacuggaacaaaggaacagacagccauaggugugugugugaucuuuaccagaaccuccuggagcuucuggucuucuugacauuuccuaucuucuaucuugucccucuccauucuuagagcuucuaaccgacuccugagacgauccugucagaaaaaagaaagcagagggucggugaauaaucccacuggcaaauaccgugugcuauguuguggacacaccaccgaggcugagagauucaaacugacaagaguccuaauccuugaccuucauuguaucaccauuuagggcaagaauuggguuggguggcacuauggagauagaaagugugugguaaguaagguguaugugcccgcagggaaaccaggagcaaagaggaggacugagaggauuuuagacaguaaaucucuaucccuuuuccuucacucacccacaucaggucaccauccugcccccacgaagcagcgccucagcuccuuacccuguaggguuggauggcuucauccaggaaccccacagugugugccuggugggcggggcccucccugcagaacacgcagagcagcuccgcgucugucuuacagaagaaauagaucuucucuccgugcucuucacaguaggucucgcucaggggaccuagggacaccggggccacugcggccuggauuuucuccucuucugcccccugacagagagggcacagcagcugggcucccauuggggugcgcgggaggcagaguaggcagacaguguguccgcaggcuguggucaccgcauccugcaagggucgggugcagacaggacaggcuacuuggugaaguccccgcagggaccggguugagggcaucaccgugccuuccccugccuguccacagucuucugacucgguccacuccaauuuccuuucccugaaacugagucacuuuuaagugcgucacugucacagaagcaaaggaa

SEQ ID NO: 8589 - RNA, 8528 nt, Mus musculus
agcaggaggaaucucuucaccuucucccuaguuucacaggcaugugaguguauauaauuggcauaauucaagaagaaccggcucaucugcuggucuucucccuaggucuggagaccaagaaaaugaaguugaaaaggagagauuugagguaggguauuaagagaguaauuuuggggagggugcucaaacaagaagugggguaaagaagaggaggaggaagaggaggaggaggcacuuccuuuuuuaggucauccuuggaaguuguuugaaaggaaaggacaaaguagcgucauauguucucucucucucucucucccucucucucucccucccucccucccucccucccccucccuccccccucucuccuguucucuuucucuuucaacaugacaucauugcacucuuggauaacuugaugguuaauaaagggucacugacaagguuccaccuuaagagguuagugguaucaaacagcagcagugagcccuguagggaaccagccccagaggggacacauaaaguucugucugaauucucccugccagccacacaguagagacugucagcuugucguugauaguuuacuucuggccaugaccguaacaagguggccuaaaauuuagcuuuaaacuguaaaacgauugcacagaaaacucucaaaacagaauugggguuuggagcuccugcuuccuccaggucuguggaagaauuguauaaggaauaguuucaaguuuagcaaauacugaguuuuuuuugaaaucccugcaggauugugucucuuauaguccagacucuggacucucugauaguggacaguggccuuaaguccaggccccaguccacuuuaucuugcuccagaucaccuucuaccgagcccuuucacaugggacaaucuggccuucaaaagacccaguggggagacuagugaggugggaccaugggcucucuugacaaggacaaccaggacauuuguccuaucugccuggauccccugaaggaggcugugagcaccgacugcagacaucucuucugccgcaugugccugacccagcacauggauaaggcuucagucucugggauucucagcugcccagucugcaggaagccauguuccgaggggguccuuggagacaauuacaucugccacacccaccagaagagggugcgcagguucugugaggcuagcggacaucucuugugugaggaaugccuccaauccccugaacaccagucccauacugaacucuccauugaaaaugccaucagccacuacaagguaagcuugugucaccccauuggacccuuccuaaguucagauccucacagaggcuugguaacugacacucuccuuugacuuuucuggucauccaacuuggggccuuggucuuugcuuuucugugugccucucugcuacuaucaggguuuccaggucuccguguaucgauguaggugauccugcuacuaugauggugaagacccaggaaguaugggccacuguguuuacucuugcuguacuagauaauguauuaguucaugagaugcugugcuggauaaugagaggcuguauuacauaauguacaaguuaaugagauguuguacuagaaaugagaaccacuucuugacuaagauuauauuggguucccugguggaugguccuagaagcuagucuagacaugucaucaaguuuuaucugugcuguuaucuuguaaagauuugaaaucugaaaacuuguacacgaugcccuauuccccucuccccccuuuccuuccuuuccggaacacuacuguuguuucuuguguuauuuauuuauuuuuuucuaaaaaaacgauucacgccuuugguaguaaauacagucgauaccaaaugauaaaauaucaaaacuaaaacucuuaccugugagauaugagaccauugaggguaaaggaguguggaaccaagcuuucuucccugaguuugaucucugggacucacaugguagaaggauagaaaugguucguauuaacugccacuaacuuccaccuaaguuccaccaugggugcccccuuccaaguaaauaaauguaagaaaauaauaaugaaucuuuucccuugucuuuaccuauucacagucuucagagauaaucagcauuagauuucuuuugaucuguccuucuaaaauauaucaguguguuugaauagucuuuuuuaucauacacucgugugugcgcgcacgcgcacacacacacacacacacacacacacacacaugcacucauucacaagagagagggacagaaucagaaagacauacacuagggauguagcucagagguagaacaccugcuugacauagaugaagcuguggguucaauccucgguacuucaaaagauaaaacaacacugaauuauugugugucuacaugcuguguugguaaggaugugccguggcuugcauguggaggccagaggauaacuuugugaagugaguuuucuccuuuuaccauguggguugugaagacugggcucagauaaugagacuugguggcaagugcccuuacccacugagccaucuuuccagugcccucugucuuuuccucuaucuuuccgauguuuuggacauuuccucauuuuucccauuaaugcauccagagcuccugaaugucucuuuccaaccccaugaauagaucaaaaguuagaaaacuagauuauucacagguuaugguuuuuagguuacacaggauaacaugaugaauacauuuuaguguguauuuuggagacauuaaaauagccaagauauuuuggugaaaguauaagcuagaaaucuaacuuuaccuuuuccaaauuauagcaaacugucccaccaccauuuuauugaaugucccauguagcucuuguccugucccauuguucuuuguauccugccuguaugccaacccccuuccucuuccuccuuuucaucuucccccuucuuucuuuuuucauuccuuucccccuuccuccuccuccuguuccucucacaguacuagggguaaagguugaaccuagggucuuguacauacaugcaagguaagcuaaauauacagucuucuuuuuuacuuuuuauuuugagacagaaucuuacuuuguaucccugugcuauagccuccagaguagcuagauuacaggcauaugucagcagauucaccaugucaaacaguucgaagaacugcgcauuuguaauauagacagguuuuuuuuucacuuuguacaauuuaauuuauuuuuauuauaugugcacauguguuuugccacaugugcaccacaugcauaccugguauaugagaaagccagaaaagaucaucagaucccuuggaacuagaguuacaggaaguuacaggcugccaucuggguuccagguucucuccaggagcagucagugcucuuaacuacugagucaucucuccagacccauuguuuguuugcauuccucaagacagaacccuacucuguagucccaguucaucuguaacugauggcaguccuccugccuuagccugcugggugcuggaauuacagauguuaccacacuuagcuuuucuuguucuaccguuuggcuccgcccaaagcuucuugcuaggcuucaucuuuuucuuuccaaaccuuaguucucucuuuuugcuucuacucuuuucaaaaauaauuguaaaaaaaaaaaaaacccaaaaauaguucuaggguuugaacgcaaggccuccucacacaugcuagaccuccuccucagcacugguauuucucuugacucagaagagcaaggagucaaagguguacauuguacaccugcuaaucugcuagagaaaccugcgucaucuggggaugcuaaaggugaaugguucugacauuucuguaugaugucauauccuuaaaauggguucuggucauucagugucucccguggaguggccucacccaucccaucauccugcugucuacaccuugugguugcagccucaccucuagggcccacucucuaacucccucugcuucagaaguucugagcaagcgucuaucgucuauggacauuuggcuuccauuuaacuucuguucucaccugaugaucggcauuaucaaugccugugaauaagaagggcuguugucaaguagauacccaaccugaaacuucaggggcuucacggugaaagccaaagcugacccuuccuugucugcccugugcauacuucccugucaggucuuucuacccaauagugaaggcuaaauauucuuuuaucuuuuuugcccuuuuucuuuguggaguugugguuugaacccagggcccgccacaugccagguaaauguucuaucacugaacgucuuccucagcccugaaggguaaauuuccaaagucucucagauaguuggcuuuuaaagaaagucgucaccauguggaacaauagacgagacagucuaaaucgaaaccgaauguacaggaugauucagaaagcugaaagggccauguucuacugugucuacuaagucuacaguagagggguagggcuucccaugagucaggugugcaaagacagggcucuuccauacuugaaugauuaacucgggucugcgcugucuguaagaugucacgacaggcauuggggaggaaacgcaaaggugauucaggacuucaaguccauacuuaaguaguaacaggaaguguagaaaaauaaauaugaacauuuguucuuauaaggaagacagugagugucugcugcacguacauaaacaaggccaacugcacuuaucagagaggcaggcaagaaacagaacuacaaguguuggugaucuaagaaggagaauaguggguggcccuuccuagagugaucaaccaaggccuauccggaagugacaucacggaagugacaucacagcugagacaugcaccaggacaaagacgggguguggggagcagaugcagaauccaaguccagagaaauccuguuacacuuggagaauuuauuaaucaggguuuguuuaaaauuucuuuaauuacuuuuuuuccacauuagcauacaaagucauggucuggagccaggugugguggugcaaaccuuuaagccccagcacuuacggcaggcugauauccaaauuccgaaccaauuugagcuacacagugaaacccugucucuacaacaacaaacacacacacacacacacacacacacacacacacagagacacagagagacacagagagacacagagagacagagacaaacagaaacagagagagagacacagagacagagagagggagacagagagagaggaggugcauuuacaggcguuagaggcuaaguaguuaagagggaguauugcucucucagaagaccuaaguuugguucccagcacccacaccagguggcucagaaccaccuguauguaauucuaucuuccugagaucugcugcuagugcuugucuaggcuccuugggcacccauacacaugcacauauucauaugcagacacauacuccugcacauaauuaaaaauuaaaacaucuuuaaauauguuucuaaaaccggaacucucuuacuuaucuuaaacaugguaaaugaugcccccgucuuguuucaugcauuuagaauuauugacauuauuuauauuugcuuucucucaaaaauauuguucguguguacauguguaugauguguauguguccuuggaagucagaaaagaggaagguauugaauucccuaaaacugaaguuacaggcaguugugagcuguccaauguggguauugggaacugaacucaggucuucugaagaccaguaagcgcucuuaagugcugagucauuccccagaaauggcuugguuuuguuuuuuuugaaacagggucucucuacauaaaccuggcugaccuggaacuggcugugaaggccaggcuggucucaaacucaguauagcugccucugcuucccaagugcugggauuaaaggugaauagcaccaggccugguuuugauguuaguucagucucacccaagggccuguugugugcuguggaggauuccccuguggacacugccucauccuccaccuuugucucucuaggaaagacucaaccggagaagcaggaagcucagaaaggaccuugggaaccuucaacagcugaaggcucaggaaaagaagaugcugcaggcucugcagguggcugucugaguucugaagggccucucccuugucguggacaacugucuucagagcagccgcaguuguggaacugugaucaugcaggcugaaaaccuugguuuggggcuugguuuugagauugauuagugaacagaaugcgaagccuucugaccuccaugcauuuuuuuuucuuaaagaaaaauaccuauucucccugguucucagcgagaaucaaaauagauaguucaaaauuuuacaaaagucacgagacuccaaucuguccuuggcaaucacucuucuaucccccucgcucacuugggugagcucucuccucacuuacagggcugaaagcagacaucaaaagagcauagcugagugguguguguguguguguuccacuguggcaggacuccaauaucugcagaugugcucagaacugugaggugggaagugggaggagcuuugugaagagcuccugaaguacaauggcuggugaggcaaggcuguguaggaagaggaguggagaacaauauucccaccuagcuauucagugcuuagagagccaggagagagcccucuauuauugaaucucaggguagcuccucuucucugcuuucagguggauugugagugucacaggcuaagaacugaccugcagaaccaagaccaaaccaaggaacaacugaaggcucucccauggcauuggcuggaccaagaggacuuaccagaggagguggccaagaucuuuagcuucucugaggcaguaacacagcucagcauccugguuucuggccuggaaaggauggccaaggaucuggaugccagcacccugaagguguacuuccuaagacacccccaaguucagagagggauucuuugaauaguaaacaggcuuccugcaggucccuucugggagguguaaggggagguucuccugguauguguggugguuucagugugugugcaugcauguguaugugguguguguguguguacaugagagcacacgagugaguguucgagaaugugugugugcauguggucuguguguguacaugcacaugcaugcucuccugagcacaagugugcaugcauguguguguguguguguguguguguguguguauguguguguguguguguguguguugaguguggggcagguggauuguacaggucuacaccaugacacaacagagugaggcggggugcugugcuuugggucucauggcagcaugcagagcggcccucaagcaugaaccagggaggguauucaguggcaagaacauagaaacugacugucaccuuuucuuucccaggaugccagugacuuacuggacagguauaagccccuuucccucugucccacauaugaagacacaugcagaccacauaacauagauauguauaugggcuaaauuuaaaaagucaaggagauauacuugauaccaucauacuacauggccaggggaagauucaguagaacauguaugaauuaaugaaugauuucuuugucuuuaggagcgcaccacagaaauuagaaggacuucucucucguguuucuccagcugguccaaagcucaguuagucuuccugguauauucucauccucacagcucccaucugaugaucuagcuucugacgcugggacauaaucuccuuccuaagccagacuugagcuuguggcucccacugcugugaccagacauuucagaucuccauauaacugugugcugaugauugcaccuacugcccauggucucgugggcaucgaaacaucuggaugaaagagcagagugagcccaccucagcuuauggaguuuggcagguuuauuggguacuagcucuucugacucugauagaaccuccuguuuguacagcccacacugaccauucauuaugacuguugcaugcagacuugagggugauuuccacaguccucacccucauguucagguacuuguaacuuuguccucuggagaaugagugccaucagugacuugcuucucauuaaaggaauauagcagaaguaaugaaggucaacucuaguggccauagacgcuuucuugcugauagacacauucaagagacucuuuuugcuaaaguuggggacgcugaggggaaagauuugugggcagcuccuaguuuccuagagcggccuccaucuucugggugacaagaaucagggaaccugggcuuuacaguugcaguaaacccuuccaccaccacaaguaaaguuggaaguagauacuucugggaacugaaaaugcccccacuaaucacccugucccugcccauaguuuccauaaggacuggaaaauuguaaaaacaauuuucucuuacuucuguaucuguuuuuauaauaaacuucccuauuauuuaaacca

SEQ ID NO: 8590 - RNA, 5329 nt, Mus musculus
aggggggagacucacgcucuucagggacucacucacgggggcuaccaaacccaacagugcuaccuugcccacagcgcaugcccuggugcucaccuccuagguucuagaaccuaggugucucagucuucacacccugcugccccaaacccuacuagggaagcgggagaaccagaugaggcauuacgcaaggucugcuguuuaccuccugcaccgggccuccucccucccuauaaaaccugacguggugaggagacgcucugaguccgaucuggguaaccgaggcagcccgggagagggguagauaggaggugcgaagugaaugagggaggcgcagcgaggggcgucaagucagcacgcagcgggcgugguccgccacuugcgagcucgggggcggcugaggacuagggugcgucgggaccccugcuuuccauggaggcucccgagcugggcccgggguugguggagcgucuggagcagcuggcgacauguccgcugugcgggggccccuucgaggacccaguccugcuggcgugcgaacacagcuucugccgugcgugcuuggcgcgcugcuggggggccccggcggcguccggcucggaggcggcgcccccuuccugcccgugcuguggccagccaugccccagacgcagccugagguccaacgugcgacuggcaguggaggugcgcaucagccgugggcugcgugagaaacuggcggagcccggagcccgggccgggagacgacgcgguggccgcauccccaccauggguugccuggauccccacggagagguaaggcgccuucuccgguucugguuguuggugaagaagagguuuguggguguccuagcaaaggugggagccaugcuuuucgcucugaagcccuaauggaaauauagguggcagacagcuuggcaccagaaagcggaggcaggaggauugcucaaguucaguuugauagacauagcgaguuccaguacagaaauggcuacaucgaaaagauaaaggaauuuuaaauaagaauuuuaagaaagggaggaagcggggagggagggagaaagacuggccaagucuugagugaguaguuugagaaagggagguaggacaggcuggaagaaauugacucggucaggggaggaggaggcuggagggaagaggcagaaagaaacaggcuaguggcaguuagaaggcugagcccccuagagaucucagaagccuccuggagagccggggugggagccagaaaggggaauggggugcagacacccggauuagggaaaggagcagcccagggaggguggugauaggacccaauaaacagaaucacuggagccaagguugacacugggugcagaaaaagcagaaauggagggaugggaaauuaggagucuaaugcgagugugaguguguguguguguguguguguguguguguguguguaugugugugugugugugugugugucaaaucaaagugccucaagugaggcagggguuccccuaacaagccauagccgaacuguggguuguuauuguucucagcuccucccagauccccaggcacgggcggaaacagguggaagcuaggucggggugaacagcuggcaggccucuugcuagucuccacguugcagccauaaaguuuuccacuaggcccucccugagccccuuagacaucaaccacuccuauuccuuuacaguaccucaaaaccauccaucuggcuuuuuuaccccuuagcagcccucccgcccugggucuggcuuccgcccuuugaaggcuucacagaccuaauuagucuagguguaauugccauccucucuucuuccugccacacuggccuucccagccauccucucuggaaucagaaaagagggaugaaggaaacccaguguuuggagggugagagaaucuagcgcccucuucaggcuuccauggcucccuacaaaaucuguagggucucuuaggacacuucugagaucaggggccugaggguacagagacauaauaaaaccaaagagcccaauaaacgccacugagcuuuuaagacaaaaaggagagcagcuuuauuguuaggcuuuuauauaacaacucuuagcucaaggaauaugggugugugucccuuuuguggugacgggguggacauauaucuggaagacaugcugguaacuaaagaaggagagcauacuaaaagagagcgugggccugggaagauuaaacaagagguaagaaguaguuguguugaggcuguggaaggauggagaaggcauauaacagucuggaugaagcuaggaaccugaggagaaagugauuuuggaguaggcagaaguaaaggacaugaaagaagaagggagaacugaagagaaaaauggagcagagcgggcaggguguuuggggugggguggggagaugguuuuaaaaggugggaagguaucaagcagucagagcucaccugaggcggaggggaagaugucccacagugugaacucacaccuauguuuucuucugcccguaccaggauaugaggaagacauggagacggugaguuccauuuuuguuuguuucuuccuucccacuaccuacagccauagccaugaccuucccuccagaccccucucuuuaccuccacuuagcaacgggcuuucuagaguguagccucaccuguuucugugacaagugaguggguuaggaucaucagaagcagcaucaaaaagacagggaugccaauaacuuccuucgucucuccagauucgaugucccagcacccaagccaucuaacucagaggaggaucucccugaagauuaccccguggucaaaaacaugcuucacaggcugacaggugaagaggggagggagcggaucauaagcuaugcucuguuugcucccucuucgcucuagaaaaugcucaaguccacuuugguaucaguuuugacuuccuacagcugaaauaaugaagugucacaaauagguggcuugaacaaccaccauucgcacuucaaagucuagagauagaagucugagggcuaaggagaaaucuguuccaugcucucuccuggcucuggaaaccucaauacuuccuugguccacagauggucucaccugggcuuccuucuagguaccugucucugugugcaagugucuccacucucuuuuaagauagaaaucauccugcaucagggccuacuguaauaaucucauuuuuuaaccugauuaccuuugugaaaauccuccccucaaacacacgcgcgcgcacacacacacacacgcauaagguaaauucagaaaauuggggaacaaaacugacaccccacccccuuuaaagagucucuuucuauguaucccaggcuggcauggaccucuagucccugucuuugccucuaaugugcugaggcuaugcauauguaacuccacagcuggacaggaggcacaauguaacccagaacaauauccuuaauuccucagaucucagccacguucccucacguuuuuuauguacccccagacaguacaagaucccugcuuccaccuccucccauucuuggaaagggggucaagacuccagcaccuccucuaccccuucugugcucauucccaagguagcucucgagauguuccauuccuuagucaccccuccaucucacuuaauacaaauuccuucuagcuccuaauccagaagcauuuccuuaaagcgccccauaccugcaaggccagcgacucuuucuggucccuuaggcaauuucuguaucuccucugaccacaccuccuauagaaaugggccuggccuggaagguaaaugggcugguuuuacuagauaccuuggauuccucccuuugcccuuccuuuaaaucacucuaguuccuaucugguaucagucucucucagguaucagucucucucaguaaguagucuugcugaccuggcucccguacccaacccagauucaagguuuuugcuuuguguuguuguugacacagggucuuacuauguaguccuaaggggccuggaacuugcuauacaagcuggccucgaacucacagaguuuugcccucuuugcuucccaagugcugggauuaaagccaccacacuugcagauucaaguauuagucaucauucucccuauaagucccauccgccacucuuccaccaacaccacacaccagccuccccucaggucuccaugcuggguuccuugaccagcauagucuuuguccaaguccaguuccacaaaagugguggaucagagcacaaagcggcucugugccuuagugucuucccauccuggucgcccuggucgcuaggggaacugcgagaggacucaagcaccucugcucuucuucacccuucucucuagacuuaaaaaacguaccauguguuguucccccucuccccucuucugcagcugaccugacgcucgacccucgcacagcacaccgugaucugcucaucuccucugacuaccgcggcgugagucuggcuccacccggaacgccugcgccgcuggacagccccgcgcgcuuugaucagcucccggcggugcugggugcgcagggcuucgcgucaggccgccacugcugggagguggagaccgcggaaggcgcguccuucagagacucuacagcucaggaugagaacgcgggagagagcugcuacgccgugggcgcugccggggaguccgugacccgcaagggccucaucaagcugugcccaucggaggcuauaugggccguggagggccgcggcggccgcuugugggcgcucacggcuccagagcccacccugcuagguggugccaggcccccgccgcagcgcauucgcguggacuuggacugggagcggggucguguggccuucuaugacggccgcucauuggacuugcucuucgccuuccaggcgccgggcccgcucggggagcgugucuucccccugcucugcacuugugacccgcguaccccgcugcguaucuugccuggagaagccugagccucaggucucuagcuccuacccuaccgcaguaguccagauggccucgaggcuacuucugucccuugcacaaauccccaccuguuucagugaccuugucuguaacaccuaucggaacaggaguauuaauaagcacccuuuguccacucacauucucccaaaucaaaaccucaacuggcuuguacauucgugccuuuaagccagucuagucccgagucuccaugaccuaagaccuuuuucuugaguccucuuuccguaccauucuaggccaggcuagagaaagaggcucuguuuguaccaccaguguugggaaacaguccuaauuuaccuccaaucccaaaaggcucaggg

SEQ ID NO: 8591 - RNA, 4232 nt, Mus musculus
ggggagcgugucuucccccugcucugcacuugugacccgcguaccccgcugcguaucuugccuggagaagccugagccucaggucucuagcuccuacccuaccgcaguaguccagauggccucgaggcuacuucugucccuugcacaaauccccaccuguuucagugaccuugucuguaacaccuaucggaacaggaguauuaauaagcacccuuuguccacucacauucucccaaaucaaaaccucaacuggcuuguacauucgugccuuuaagccagucuagucccgagucuccaugaccuaagaccuuuuucuugaguccucuuuccguaccauucuaggccaggcuagagaaagaggcucuguuuguaccaccaguguugggaaacaguccuaauuuaccuccaaucccaaaaggcucagggcaugaugcacagcaggaagucugcagcuuccugcucauguccacucugaggauucucagaggaaaaaaaaaagucuuccuaagacauuuaacucauaaccuaagccgcgcagcucaaaccugaagccuagaacauaaauucuaggauauguaugcaagccagucuauacucaaccuuucauuuaugacuguuuccucugcucguggccuuuucccauugaacacccucuuggaacuuuaucuugcacauaaaagaacuaauggugcuaccuccuuccucaacccgggagcaacucaggcaccccaaacauucuguauagucucccauccuucccuuguguauaaaugggccuguauuuaacacacugugcaauguuggguuauuuauuuugugcaucuguggcaauaaaugagaucuaaguggugccauggguuuugcugauuucuguacugugcacagccagaggccuggagggcaguacccagauccuagcaccagccggggagggcugagagagcaagacaccuggguuggcagacaccaaagccuaggcaggaaaggguaggagcauacugcaggggccuguccccucaucucuuugcuuucucccucuuuccuuuuagggacccaggccccuaggacaccaaugcugaagcucaaagauuaaaggcugagaaaaucauuggcucuaagucaguggucucagccagcuuugucagaaauguuauauucaggacauggcuauuuuuuuuuuuuuuuugguuccacuuuccauuaggugugaaugacaaagaccucuccuaacuccuuuggagagccauaagggguaagaggagcagaagggccagggaacccuauagucuccacacaaccuuacaucccacaggcaagaacuaagauuuaggaaaacugcaucaguagaagaaccauaagccaggauuaauacgcagaacuggggugcaagauugccuggcaucugauuggagcccuggcagugaaagcugggaccguugaaaacccaguugaagugcuugggacucaagcugagggugcagguggccaagauacuggaucccaggacagguaguuuggcagugagaacaaaagggauagacugggaccaagaugccuggaucccaggcaugggagcaaacuguagggaagcaggggcugggagaacccagaagccuggguucuggaacagcagcaagucagaauuccaggaucuguauccacccuccucuuccucuucucuaucacucaggagacggaagaagggggcaggagaacggaggcaauggguggaguccccaugucagauggauauauuuggggcaggcagacacaugaauggugagagggauuuagugcugcauagguccuggagggggcuuagagggaucaggaggcuguggaggagugguuggggugggugcugggguuguaggacgccguccuuugcggugaccccguacacagugcuuaugacuacagccuucuucuucauccucaucacucucgguggagcucucgccaaaggcccgaggcuucucauaaauacagcagccugaauggagagagagaaagccagcuaagaaggaugaagagcaguguucagucaguuucauuuccaccagaucugugugaaaaccucucccuacuuuucuggaauccagcugccuuagccucuucccccaggaauucaagagagagucggaaaaaccugacucccauucugccauggcuugcccccgcccccaccccuaacuccaggcaguugguaccgcauaguuuuauucccaccuauuuuucuuuccaaccaagaacucgauagagcuauaaagcaacagugagaugguggccagggacacugggccacccacacucacauuucgacgagcgucgccccauaugcucauuguccacagugucacuggaccacuccaccuucuucucuggcuugcguuuccgaaguuucauaguuaggcucugauucuccugaaaaguuaaaagaggugugggcccaucugacucacuuccucuugauuuuuccuguuuccuauggaaccuccuuuuuucucuucccuggcucagucaguaacacacaucaugccccuggagaggcaggacagccuguuuguggagaguaugaaucccuguucuugauaaccaauaguaugcaaagaaggcaauucuuaaacuagggaaggugccagcaaauuggcaaacuaagauacaaccaacgcuaucacccuugguggcauuaauauaugaauguuauuuucucccuuuccugugacuggccuuugaucucacuuucuucuucacaccucuuauucauguucuaaagagacugagguauguaaucucagcacuugggagacugaaauggccucugcaacaugguauagcuauuuucucagaaaaaaauaaaauaaaauaaagcagggauggggagacaucucuguugguaaagcucuuuuggugcaagcaugaagaccugaguuugaucccuuguauccacgggaacaaaaacaacaacaaaaagucaaauguggugguggugguggugcaaaaaggcagaucucuugcuagccagacuagccuauuuggccagcuccaggcacaaugacucuguaucauaaguaaauaaauaaauaaauaaauauagaccaugucucagacaucugagguuaacuucaggccuacacacacacacacacacacacacauaucaaaauaaaacaaauauccaaaacccuccuucuacaaaaaagccuucauucuuucuucucucaucuucaagcccagggcucccuaauccuauccacuuauucuuuaacauucuggcaucucugguaauaacugcuaaacuacuaaucuccuucaacccagacauugucaaacccaacgcaucuuucucccuuugaaagcaauuuguuuuugcaaaaguuguuugcucauuugcuucucuccucccugaucugccaaaacacacuucaccuuauuuucuuguuuccucauuuccuccgcuuuaacacgcacccauuccaugacuaucuauugguaagcacuauugguaaguacucguucuguacauuugccuccaaaaccacgccuucucaaauggcguuucacuuccucccaguaccuuucuggcuccuuaacccaguuuccguuuauuacguacauagaccaccaccccaagccuuaacaccuauacucuaauuguaacuacggauuaaacaauccuugaccagucacuugaaccauuugagcggcuccaagcaucucuauuuaguuccuugcgauuuucccaauaagaguaaaccccacaugaugucccagaucccaaacccaccaacuuuccaaaccccccucccccucccagugccucccagaccccuaaauagacccccugcccgccuuucucacuggcucgguugucucgguaaccguugucucaguaaccguugucucagugacggucucacuuaucccggccccugucuccgccauggcuaaagcgaaaagcgagaaagcgggaugagacacccuuuccuuuuucugagccucagagaucuaagagaaccgguacaagacucggaguagaggccaggaugcucuagcuucuuaaucuccccuacuccuccacggccucugcuuccccaccccuggggaaaaccuguccaaccccacuuccggccuuucacuuccgguugugacgcauccugcagaacacaguuucccuuccccaccaccgccugggucaaagcaggcgucgccagaauaguuccgccguaaug

SEQ ID NO: 8592 - RNA, 4213 nt, Mus musculus
cuagcccuccgggcgcacucguugcccgacgccuugggaucgggcgcucuagcccgcgucugggaucgggacucuaucaguuuuccgccuacgucggaccuaaugagguuccccagcagcugaggguccuaccuagcacuccaaacucuugcugucagaggacccagugggaagaagacucagguaaauuccuuccugggaagcgauggggaaccuucaaggccagaauccugugccuuaauaauaaacacuccucuuucccagcucucauccgccauggagcuggcccgcccccgcuccaacuuucaaucagacuuggauuucugcccagauuguggcucaguccugccgcugccuggaauucaggacacugucauauguucgcguuguggcuucuccaucgaugugcgagguaaggagcugguaugcucagccaagagugcggguggaagggucuacggugggggugaccucaggaccgguugggcuuagcgaggugagacugagaacaggaaucugucagcgagagacauugggaagaaaccgaugagacgccugggagaguguugcugggauucguugccucuuuugcuguuucuacuguuauuacuuuuuacuuccugugcagauugugaagggaagguugugaagaccucaguaguguucaacaagcugggggcuaccauaccuuugucuguggaugagggaccugaauuacagggaccagugguaaguuaauaggggccagcuccgaaagagcaauggaaaggugauucuggacaccugguuuugcacuccauuccaggagaauguccaaggagucugauuucuguacagaaagcagagacaagaccaggucuccauaacccuucugucucuuccuagauugacaggcgcugcccucgauguggucacgagggaauggcauaucacaccagacagaugcgcucagcugaugaaggacagacggucuucuauaccuguaucaacugcaagugagaauauuuccccucccucugcccaguucagugcuugcaaaacaacaaaaucaaugacagauuuguauuauuucauuugguccaguccauuauagggggguuuguagcccuuuuuauuuuuuacuauuuacuuuuuuuuuuuuuuuuuugguuucucuguguagcccuggcuguccuggcacucacuuuguagagaccaggcuggccucgaacucagaaauccgccugccucugccucccgagugcugggauuaaaggcgugugccaccacgcccggccuuuuuuuugguuuuuauuuauuuauuuuuauuuauuuauuuuuauuuuugguuuuuuuguuuguuuguuuuguuuuguuuuguuuuuuugagacaggguuucucugugcaguccuggcuguccuggaacucacucuguagaccaaacuggccuugaacucagagauccaccacuugccucugccucccauguacugggauuaaaggcaugcaccaccacugccuaacuuacuugguguuuuuuaaagacagcucacuauauauccaggcuagcuuugaacucucaaccauacagcccagguuaacuucagauuugaagcaguuuccuggccucuguuuccugagugccgagauucaaacauguaccacugaauuuggcuuguuaaaaagauguuuauuuuuuaaaguuauauguagguguuugugugugcauauuugaaugugcaggugcccaccaaagccagagaccaugggucccuggagcuggaguuacugguaguucugagccgcuggauguuggugcugagaacugaacuuggauccuccgcagaaugagcucuuaaggguugagcuaucgcaacagcucccccuuacucuuuuuacagccagugaucuaaaccuuuuaagaugugugaaaagaaagcuggguggguguagugacaugugccucaaaaggaggaucgugcuuucaaggccagccugagcuacagagacucaccaaaacaaaccaaacuaggaaaacguaaaauacaugaaguaggcauugcuuugcauagugguacaacaugcugaaaauucccacugagaaggagugacuuaacauaaucuuacaugauucaaagaacguggucugaauaguuuggaguauucuuugucuugguugcuguguacuucuacguucuuguguggcuuucuguauuuucgcuuuugcuuuuuguuguuuucuucuugggguccugccagcuuuaauucauggccccaggcaugugaaagaagugcccugcacucagcuguagccagagcucuccuauauuuagaauuguaauuaaacuuguuuuuucuucuugaucuucuuauccugcuuccaccucucagaugcgaggauuacaggcgugugccaccauagcuguucaugguccugaggauccaacucugagcucuggaaacuacauaagcacucugccaacucagcuacauaaccagccccuuagguuucccaagcugagauuugacuuaucuuuugucaaucuggaaauguaucagcuauuaucccauuucaauauugcuuguccccaauguccucagauuucuuauuagacuuucacaucucucaucuucuguauuuuccaccucauuucaguuuauauugucuucuggguaauuucuccagauauuucuuacagcuuauuaauuuugucuucaauuuguauguguuuaugguggugagaauguuuuauguguaguauauuuguguucauguggauguaugcauguauuugugcaagugugcauaugguggacagaguuagacauuggguagcuucauuaaaugucuuuucuucucucucucucuccuucccucccucccucccucccucccucccucccucccucccucccuccuucccuccccuuccuucccuucuccuccccucuccucucuucuuucuguuuugagacaggguuuacuauauucuuggcuggucuagaacucuuuguagaccagauuggcuucaaacucccagauacuaaucugccucgaucuccagagugcuggaauuaacgauaugugccaucaccuccaauucuccacauuaucuuaugaggcagucuggagcucaggaggguggcuacccagugcauuuuggacauucauucugccacuguccuauucuucccagaucuagugcaguccuuucuguacauguggaccaccacacccagcauuuucuuucuuuuaaauagaucaggaguccagacucaaguuuuaacccagcugagccaucuccccagccucuccuuuacuacuuuuuucaaaccucaugaaucauccaaacaguuagcuuguuggucauuuuaaauguuucaaucauuucauuuaacacuuauuauuuuauguguaugaguguuuuguuugcauguauguaaguguacuauuugcaugucugauacccagagagguuagaaaaagaugucagauucccaggacuggaguuaaagaugguugugaaccaccgugugguugcuagggaucaaaccuagauucucugcaacagcaacaaguacucuuaaccagugagccaaaucuccagcucccauuaaucauuuaaaauugcuccuuuuauucuuuaaauguauguuaaguauauugaaaauguuugugugugugaugauucugauauccgauguuucugaggaucugauacugccaguuucugcugaccuuuucaugguacuguuuugcuuuguaauuuuugagugugaacuccagguuucucacaguguggaugaaugcagcacucccagcauggauaggguucuuugaggaagaucugugccaccauguccagcuacaguuuuuuuucuuuucuuaugaauuacaguuuagccuuuucuuucucuuggcuagugauuuucuguccuagggaaucugcguacuucauaguaauaauuagauaucaguuauuagauauucuuuuugguuaaauauaacgagucuucuuccuccauagguuucaggaaaaggaagauucuugacccuuuuuucuggcaacccagcaacaauccuuuccuucucucggaagugaagauacucgucuuugaugccuccuugguccccuccggcuaccaugcuuuguucucagaauaagaucgucgacccagaauacuccuuucccuuuugaauuuacuaaaguuauuuuucuaugaagccuugau

SEQ ID NO: 8593 - RNA, 7034 nt, Mus musculus
cugaaacuuuacagauccuuuauuuuuccuauuugaguucucaaaaagggugguacagcuaagaaucuccuuccaaaagguuuuauaauugugcucaaguccucuucauccugagauuuuuccauaagaacaucuacuuuaauccuacugguacaggauggcuggacuaguggguaugcaacuaccuucucaaacucuuuuuucuguuucuucacuugaucacgcuucucaggaagugggaucugacucgggcuuuuucucaagauucugucuuugagccuuugcuguagaaguucccucccucgaaucaugcgcucccggugaucuuuaauuuggagcaguucucucucgugugccugccuucuuuucugugcuugugggaugcuuuccuccucuagcacaauuuuggguaguguuguuucacugaagagucguggcugucuccaggguuugucuguaaauucucuggcauggcuuguucuaugaaugugccuuucuauuugcuucuucucucucucaggcacccaguaaugcuguuucugucucucucugcguggugguggugguggugguggugauggugauggugguuccucuugcacuuuugucuuuguuucaucaccugugucuuuuuucauucucuccaccauucucuuauuauaauacgacucugcuuuugcaagccaguaguccagagaauuagcuugcuccuugcagagugcuuugcucuccucauggcauuucugaguuaucaagugucuugcugcuguuguaugcacaccaccaaaacucugucaaagugaguuuuagaauuuuguaaguuuuccuuuaaacacauuuaaaagaaguuugccuucuccaguacaaguauaaggagggagucuugggccaggagugguagcaugaaucuuaaucucagaacucuuaagucaaaagcaggugaacacauauccacccaccccuuuuacuuccuuuagaguaacaguuuacaucuuacacuccaugcucccaggcaagccuggguguucucaaaguagauagugcccauccccaauagaugacccguuuuuaaaggggaugcaucuggaauacuuaacagaguggaacagaguaaugccucaaagggucaccugugcugaaggauuuuaaacccugguccuuuuucuaaguagcuccacuguagauuacuuaccaggaucuucuucuccaguggagacugcuggccuucugaaauccuagggucucuggauucuuuugcccaagccaaucuaaaagauaaagcaaagguagauuggaguaggggagacaccacauguuugcucacuuaucauuccagucagagaucucaaugauuuggccaagaacaugggccauuucuccaucggggaaacauuugcauuucccauggcacaaaaaacaacgagcauuucuuauauaugaacuaaaagcauaccucuccuguggacucaaggcaaaccacucagaaucauuuauuuggcauggacagaagacagaaauaggcucuuuggugagggauggccuaaggacacccagaccagauuguucaguuucaaagccuuuuuugucuucugagauaauucuagucucucguuuguccagcucauugucuuucugcacuuuguccagccaggcccucugugcuucuaucagcacauacagcaucuuugccuugcuuuguacugaaauucuauuccucuuugaucaucuggcccucggcuugacugacugauacuguuaaucauccuucacccugaauccauuuugagacuauucccugcugaaacucugcaggcagagguuuguggcccucuggguuuguuugccaggcugauggcaccacaagugaagaucaccaaguuguuaugagucauuccugcucaaagcucaguuuacugugaggucgcauuuaagccacugaagcuguccagcacacagguugggaacccucaaauuauagucaaaagcaaagccuuugaggacuggcaggaauaaaauugaaccauaauucuacuauuucuucaauguauggugcaggaaaagccagcuaccuuccaugucaguuuacuuauuuaauuaaaggcagauauaaaguaccugccucucagggucauaaagaaugaauauagcuuacauauaaacagauuucauagcaaauccucaguaaaugccagcugccugaccuuuacagguugaauugcccuuaacauguaagacaacuuuuuuuuuuuuuuuuuuuuuuuuuuuuugguuuuucgagacuagguuucucuguguagcccuggcuguccuggaacucacuuuguagaccagcuggccuagaacucagaaauccgccugccucugccucccgagugcugggauuaaagacgugcgccacgacgcccggcauaagacaacuuuuacaguuaagccccuuggucucuauuaaaucuuccuaguacaccucaucacagugauucucccuuucucuguggaguuuucauuuuuacaacucacuuaaaaauccaucacuauugggggcuggagagauggcucagugcuuaagggcacuggcugaucuucuggaggcccugaguucaauucccagaauccacaaagcagcuuacagcugucuauaacuguauucccaggagauccaaugcccucuuauggugugcagcuguacaugaagacaaaacacccauuuacauaaauccuaaauccuagcauggaagagcgagcccaugccuggugcugccuggaagcuggauagccaaaaggucuaggauagaaccaauauuauugaaaaacagaauuuaaaagucacuggguggugauggugccugccuucaguuacagcacacuggaggcagaggcaucucugugaguugaaggcuagcucuggucuacaaagugaguuccaaaaacagccaaugcuacacagagagaccuucucucgaaaaaccaaaaccaagauaaauaaaauaagucaaagaaaugauuccuaaugauacucugauaaacuuuuagacuggagccuagcauaaucaucaucagagagcauucauucagcuacugaugggagcagauacggagacccacagccaaauauuaaguagagcucaaggaauccuaugaaagaggagggaggggcuggcaagauggcucaaccaguaagagcacugacugcucuuccaaaggucccgaguucaaaucccagcaaccacaugguggcucacaaccacccauaaugagaucugacgccuucuucuggugugucugaagaaagcuacaguguacuuacauauaauaaauaaauaaaucuaaaaaaaagaaagaaagaaagaggagggaggauuguaugacccagaggggucaaggauaccacaagaaaauggccaacagaaucaacuaaccaggguacauaagggcucacaaagacugaaccaacaaucagggguccuguaugggucugaucuaggcccucugcaaauaaguuaugguuauauagcuugguguuguugucagucaccuaacaguguguguguguguguguguguguauggguggggagcaucucuaacucuuuuccugauuuuggaacccuuuuccucuuacuggguugccuaguccaguuuuaauaauaugagaggauguugccuagucuuauuuuaacaucauaugccauguuugguuuauauuccugggaggccugcuuuuuucugaagggugaggggagggacugggaggagaggacggagaggaaacagcaguugggauguaucauaugagacaagaauagauuuaaauuuuuuagaaaucaaucacuauuaggguagagagauggcucagugguuaagagcacuggcuacuccuucagaguaccuacauucaagucucgccacgugacagcucauggccaucuguaacuccaguaacaggggaucagacacccccuucugaucuccauggguacaaggcaugcauguaugccauguacauauacacauucagacaaaauacucaaaacaaagaaguaauccuaaaaguauuuguaaagaucgauuauugauuaccuauaucuauagccacauuuuaauguugaaaucuagaagugugugaauuauaauguguaucuacaagugauaaacuucauaauauuagagaggcucuaauaccuaauauuuugucugacuucuuagacauucuuuuaagauuuauuucuauuuuuaauguguaccacuguuuugucucugugugucuguguaccacaugcaugaaaccagaagagggcaucagauucucugggacuggaguuacaacuguuagcugucauagcuggcuacagcugccagugggaacugaaccuggcuucccuagaagagguccaagugcucuuaacuacuaggccauuuuucaagcccuucuuagauauuuguuuacugcuugagauugaaaagauuacuauggccggguggugcuggcccaugccuuuaaucccagcacuugggaggcagagacagguggauuucugaguucgagcccagacuggucuacaaagugaguuccaggacagccagggcaauacagagaaacccugucucgaaaaacaaacaaacaaacaaaaaacccaaacaaacaaacaaacaaaaaauuacuacgccagagcuugaugugaagguuucauaccuguaaccacacuuaggaggcuagauaggaauacugugaguucuaggucaaccugggcuauaagacccugccuccaaaaaauaauaaugaccaccucacuugcauuucuucuuuauaaaauauauauuuuauauauaugaguguuuugcuugcacgcauguuugugcaccacuugcaugccacuguggagguaugaagagggcauucgaucuuccagaaccggaguuauagaugguuaugagcacccauguggcauggaugcuggaaaaugaaccaggguccugagagcagccagagcucuuaacuacugagccauuucuacagcccuauacuuucauuucuugcacaaggcauccauuauaguacuaugauccuaagucucaaaauucuaaccauuaucacacaguagcuaagcaucuuucccuuauaacuaucucaggauuaaauucaguaguaaagggcuuagcuaucaaggcccaggaguccaucccagaaggcaugcauguacacacaugugcacccauacacacacggacuuacuuauuuuagcaacagaaguuuguuacauauugaggcuggcucgaaccuugaucugaagcccaagauggcuucaaacucacaacccuccugacucagcuccccuagugcuaggauaaaggcauguuccacugugcagacaugcugcaucuuuuuauuacagcauguaccugucccccacgaagucuagagguacauccuguagacuuuguaucccuggcucaaccaccgacuagugcauuuucuccauacucuaacuauucaucuguuuuaaagagagaacacagauuucaacuaugccgagucuggucucagcuuccuaacccuuguacaggugcuaaguauguacugaauagacagagcuuucgaugggaaaggaacauuaugccuuauacugcuugugcaggagagguagcagccaaaccaugauggaugucugaagaaugucaacauuuaaagggaaaguggggcuaauuuuaauuucuaccuugaaagaagacagguaaaauuuagagagcccaaccaucguagucucggcgguagggcuuugcuaaacaagcacaaugacaccaguuucaacccuaaguaaaagggcagggucuguccucuucagcaucuuugguguuuugagacaggguuucucuguguagcccuggcuguccuggaacucacuuuguagaucaggcugggcucgaacucagaaauccaccgccucugccucccaagugcugggauuaaaggcgugcgccaccacaccuggcccuccugagcaucuugcugaggguuuguaacuacuuuuccauggcuuaaucucacacuaacugcacagaaagacagacgagggucucuucuaugaaagaguacaguuuauguccuuuagaaugugaccaggcuuagcaugguaaucagguuggcuugcuggagggcugagacacuaucgucaaacugguacuucuuuagcacacguuuuccuuacuuuguaggccucaggugaaugaaacgacacgauuuuauauuuacccuauugcucacuuacuggguggcagguauuuaaacacgagugaaugggagcuuagggaaguggaagauggucugcaagcgaaagccaggccuaaucccuaguaaauccaaagaagcgcuuuugauuaauaacuaaccucccacaucuggcaagugccuaagauuagagcccuagucucaccaguugcaccaccuucaaacuaaacuaaacucccuaaacucucucucaaaugucgcaugugucuucugccuucacccucaccauuccacacuccuuacgaagcugacucacucaagugcucagaacugcccgaagcccacgcgaggaagcuggugcagccaagggacaaacggccaggagagcccaaaagaaugggcaagaaugcuucucgguuuugcuguuggccacugagcagccgcaaaaggacaaaacaaacaaacaaacaaaaaacccaaaaacaaaaaacaaaaacaaaaaaacggucucgggaaccggcaagaguugcggcucucucaauccaagcgaauccguugcucuggaaaaaucaguccaguuuuagggggguguucccaacccccuuacccugcuauguguagggcucccuacaaaagcaguaauaauccaggacuagugcggagcgggaaaguagcggacggccuaacucuggcuacucgccuuaacuuagucgacgucauaguaccauacugcgugccgcuguaaauucccuuccgccagagguucggcuuaaacugccuccaauaugugcgccauugauuaugacgucacg

SEQ ID NO: 8594 - RNA, 3539 nt, Mus musculus
agcauuuggaggagcugaugcgccucgccaggaggaucuuaauacucggucaaaucgaacuguggacccuguucggcuaucauagccagagagagaauggugagugauccuauauggaaggcuagucuauagucuccgcauauucuuaugaaauauguaccuugggcuggugaaaucugcaaguuccugcaauccuggagaagccugcagaaauuuacugugguuucauuucaguuugaaguaggcuuugaccaaucacgagcaggcugugugcaaugaauggggcuaaccugggacauggugcugaccacuuuggccucaacagagucucacacuguccagugacuaaucggcugugacauagggccagaccaucaccuccuccguggguauaagcacaucacuuaugaaggccaggauuacaucucucugaccgagaggaccugcgcuccuggguugcaguggauaccgaggagucucagaucacuaggugcaagcaagaggcaucugguuuuguuauaucaugcacaucuuucuuggagggaaggugcguugaaguggcuucucaaauaccuggauaaaggggaggagaugcugcagcaugcagguuucagggguagcuucuauuggcccuugagcagacuuuaugccaggaccaauuccuaagccaccuauugugaaauacugucccccaggcuccacacaaggcuguuacuguuucaaaaucagaaaagcugugauuacccuuacuggggauucuagccauucacacccuccuauguuccccaaucacaaggaauccuacuagccacaucuggacuucagaaauauuaguguauaugggaacuagaagguuaauugaugguauggguguaguggcugaugccuuuaaucccaucauugaagaggcagaggcaggcagaugagugaguuggaggccagcuuugucuauauagugaacuucuggauagccaguaugguaaugguguguguguguguguguguguauuaauugauugaauucauugguggcacacuccagugaucuagcuuuugugaguugucauucaugcuggagugggcuuuucaguguuguagguguuuaugaguauuaaguaacgccucacucgugucuguaaguaaccuucaaugcauuuaugggauugccaaacuguguuggaugguaaggaugggcuuugaugggaucauucauuuggucuguuguuggaguccugucuggggugaauagauaucuaucauaucucuccggagaaaguaauaaaauacucuacacccaaguggggacccagcaggaccaaaaugggcuugggaggaucagguucacgguuacugggauauaagacaugaaauugaagccaaaccauccaugggagaaauuacugaugugucucugcuuucuccaugugguguggaauggcagcggaggguugcaaugcacuugguguggaugauuggacucacaucugagacugcuccaucugaagguguaucgauaccucgacauggcaugcuaucuaucacaacagcaacagcaauuucugaaauaauacuuguggggcaggauccuaagcagacagugacagcaguuguguguccuuugcugugggcaguugagacuugcaacuggggcuuagccaucuucccagggcucucaaggcugugggacauagaagcagauggggucugggugauguagaaguagagaaauugaguguugucacugcucauuccucucugaaagaaagguugcacagucugaggcaauacaaaggaaucauugggccagcaagaugucucaauguuuggugcuugccauaaagccuaacaaccugaguuuggaacccugagcacacauggagaaggagagaacaaguugucuuaugaccucuagauaagugcugcacauguauagggguacacacacauauuggucuggagcagaggaagccucccugauuuccagaucccacaggauccaccugagccacagggaacauuuuuacauugaaagcacaauaguggacuccaucuuuucguggaugaagggguaccagcucugaaaagagugagugccaguccuguuuugaucucaguccccguuucugccaauguucacagaucgggaacagauccaaggaauagauauuucuucauccuaaguccaugcuguguaagagcugcuguuucaauuuucaacccaacuauggggaugaucacaugacuaaugcucauauaguccacaggagagaacagaagguuguuacccucugacucuucuccucagacuccccccaaaacaaauguggcccaucauucaacgcuugaaggugaugucacccugagaugcugggcccuggauuuccacccugcugucaucauccugaccuggcagagggaugagaaggaccugacucaggacauggaccuuguggagaccaggccugcagaggacgaagccuuccagaagugggcagcuguggugcugccuucaggagaagagcauaaauacacaugccaugugcaaccugaggggcugucugaaccucucauccugaaauggaguaaagguaguguguguagguacagagucuguccuugggaaagcaggaacccuucugcagaccuugagcauaucccuuaguucuauccuccucucccuucucucuuccagagccaucuuuuucucccaccacacccaucacggggaucacugcuggucugguucuccuuccaguuuuggucacuggaggugcgcugccauaguggugaggagggaaagugcagauaaggaugguguuugagauuuggguuuuccugagauauuucaagcccuggauacaaaugugccaauuuucuguuuuguuacuauaaaguguauccauuagugugucuuagccacuuagcggccuuuuuuuuuuuuuuuuuuuuuaaaccaacuguguaaggaacaccuggaaauagaggaggggguggugcuucacacagaggacucuacuaauguggacacaaaucugaggcagggucuccaggaagagggaacgggccucugggagggcacuccaucuuuuuccuauacaaauccuuucuucauguuuuuugacccuguuccaggucugucugcaaccauaccccuggaauauugccugaggucuaggacuaagaguuuccucuggaaccaaaucguucugcauucuguucucugccuuuauccucccagagauggagaaggauguuaacuuuauuauuuuuaucauuuuaucuccaccccuuaaccucaagucccagcacugaaagucucgaaaggaaacagagaccuagucccucccucauucuguuaaacaacccagcagcugggcacagccugaguccuuggcuccacuguggcgggaguccuguaucuugcaucggaucuggugguguuuggcuuuuguauucugucccuggauaugaaggcucaaguuuggaguuuuggauuuuucuaagauuaaaaaaaaaaucugugaggcucuaauguccca

SEQ ID NO: 8595 - RNA, 5479 nt, Mus musculus
uacuguuugauuucuuuaugagaaagaguuugucugggucuauggaaugcacauuaaaacuguuuuccugacggaaccuucgaucagaaucacacaacuugaucuucuccccacauccacauaaaaauuuuuucagaauuaauguaauauuuuaaaaauauacuuaaaauuuagcucaucacugaagaacaagcaugugggagguuaggcuaagaaaggagguuugccaugaguuugaggccagccuggguuacaugauacucuuucucaaccaaagaaacauagaugaggcugggcaauagugguacaugccagccugaccuacugagugaguuccacgacagccagggcuacaccgagaaacaguguuucaaaaaaccaaaccaaacagcacaaacagaaagaaaaaugaucaagcuuguauguuuccaaaaugucacaauugaauuacaauaaauucaauaagugaauucaguuuccauggugagaauuuggcagguaauauugcuuuccuugguaaucuaauugaagcaaacccauauccauuuauuccaaucuuaauuacuaauauucucucaaauaugacauaucacacuguaaauauauguauagaugagggucacagaauagaugcagauauugaggagguuacaguagcauuucaugaugcuuuugaagcgggcuuauagaaauguaaaugcaggggcuagaaaguuggcccagguuaagagcaucuugguuugauucucaccacccaggcuguggcucacaagcaauuccaguuccaaaguguggggcagaguguggggaugcugccccucaucuggcuuccuccucucccucccaugucuucaaucugggcccccaaaucauucagugcagcuccccccacagugcagcucuccccuccuuugguuagucucuggaaaacaccuucacagacauuuccugugagauuugagauccagucaaucugacaaugaagauuagcauucacagcuacacagugaguuccagcccagucuaggguacagugugagacccugccaaaauaaagaugggggaaggguagaggaugguuaaguaguuaacaacauuuguugguuuuuccaaggaccaaggaagguucaguuccucucaucaacaugguggcucacaacugccuguaacuucaguucuggccuccaugggauggugcacauacacucaagcaggcaaagauacaugcacaaaucacaugugcacaaauucaaauaaguaagcaaaacuuuauaaaaagaacuggcuagagauauggcuuagugguugagaccacuagcugcuauuguagccgaccaggguucaguuccuagcaccuacacuguggcucacaauuaucucuagcuccaguucuaggggacccacacguuuucugacuucugaagucuccuucaugcaggcaguacagauacauauacucacacauacacauaaauaauaacuuaaagcccagcagugguggcgcacgccuuuaaucccagcacucgggaggcagaggcaggugauuucugaguucaaggccagccuggucuacagagugaguuccaggacagccagggcuacacagagaaacccugucuugaaaaaccaaagccauaauaauaauaauaauaauaauaauaauaauuuuuaaaaugagcuggagagauggcucagcaguuaagaacacugacugcucuuccagagguccugaguucaauucucagcgaccacaugguggcucacaaccaucuguaaugugauucagugaccucuucuggugugucugaagacagcuacaguguacucacauaauauauauauauauauauauauauauauauauauauauauauauauauauauuauauauaaugaaaauugugaaaccucccuuaaaacagauagggaguaauauugaggcccccuguucugagacaggucuaggaagaagccugaaccauuuagaacaagauuuguggucacugauaccaauuaucagagucacccacagugaagaacaaucucaaauggaaauauauuauuuuucuuugagaaagcaauaaaggauuccugucaucaucccugagcugucauguugauauauacaugucuuuguuuuuccucucuccuauuggguuuaguuucaggcaaaagacuuagggaauaauuuuugaaauggaagccuuugucuauuugcuaucugaaaagccccuagaauugauuucuaauuucuaggaaaagauacuagaauucaaaugcuugucauuuauuuauuaauuuuugguuuuucgagacaggguuucucuguauagcccuggcuuguuauuauuaaacaugaaggaauaguauaugugauaauggaggguugacgguaauuuuauuauuuuauuauggaaccagguuugaguauuuacaggugaaaggagaaugcacaagccuaucaccuccaugugccacacaggauacacuuccugccacuggacauggguccaguucaugguggcuggggcaguuccccuguagcuccuggauacuggauguaccaauguacccuugccggacacauucucuacaguuucagcuuuuccuuaucaccgcgugcugaagccaaguccagcaugucaucauucgacaaggauuugugcugugcucagcugcaggaaugcuuuugggaagaugguggagggacaugaucucugcuuccuuucuagauucucagagggguacccccgccccugaaguguagaggucaagaggugagacaaguggccaagggagggaaguaaaaugggaaaagugagcuuuuagaauagauugaguaacucauccuuuuccaucugugggaauaaaaagaugggagagcggcaggaugggaaauccuagcagaauuccuggguucagcccuucaggaauguuuuuagaauuauuaucugaaaaccuagagcagaaucagaaaauaagagaagggaaguauuacagaaaagcucccaaguuccagccuggagaccugucccaacuggcaugucaugguuugucaugucaaugugagauauuugucacuuguuuccaaaugugcuuuagaaagaguuagaacacaauauccuagauuggauaagcacacauauauguauauaucuuauaccaacucacugggugugguggcacacaccuuugauccaucauagaggcagaggcaggcggauuucugaguucgaggccagccuggucuacaaaagugaguuccaggacagccagggcuauagagaaacccugucucuaaaaaaaccaaaaccaaaaccaaacaaaaaagaccucagauauaacccauuuccuaccuuuccucuuccucaucacuauggcaaccacagcuccaguaaacacaacuccaaagagaagcaggccaacagugauucccaugaugggaauggugugcuuagaagggucugggaagggaagggaaagagagagaaggugugagcccuggcccucagcucuuacccaugaccuucucagggucuccagaagggcuuccacuuucccaaaugaucaucucuguguccacaccacuccuuaccccauuuuagaacaaggggcuggguuagccccucauguugcacaugacauguguaucucuguuccucuccagaagguaccaccacagaugcccacuucuggaaggucccauccccugcaggucuggucucaaugagguccauguccugagucaggucuuccucaucccacugccaggucaggaugauguuagcaggguagaagcccagggcccagcaccucagggugacuucaccuucaggucuggggugaugggucacaugugccuugggaggaucugagggaaagaguugaacaauucaggaaucuugaauucuucccugaacugaagcaauguuuauggaccaucuuggaaauugaauggguaguugagggauuuaagcaccauacaguauucuagauucaggcaucuggaauaaucgaccccuugggaaacccuagacauaggaugacaagauggacuucgggacucccaaggaagaaaggagaaaggucuugacugggugaaggcugagagacuuagcaucauuggagucaagacuccaaagagguugggugugggcugagaacauggccugagaaagggcauggcuuacaaagggcugcagacugaaaggggcagcuguuuagggaucuucucucuuuccuuccugagacaaucucaacucucccgagaaaaagucgcaagagucucugucuaguguuugaucgggaaaaccagaacucucuuccuucuucagaugcaaagaaaagaagcaguauucuagcccagcucauuuugcucccuuccagagagacugugagccccagccccagaacagauggaggagauucccggcagccucauauaccuguucuuagcagagucuccuucccuaucuccagguaugugcggagcgacuccacacacucgcccuucaagaaggauugccuuugcucagagacaccagacuucucccaccugcgcagcgugaucugcgcagcugugucgccugcgacccaggagugcagguccgggcuuagggugagguaaucgcggccgucguaugcgugcuucucaugcccacggaggaagaguccaucuggccccacuucgcagccauacacacacugaaagacgugagagccuggccccgccccggucguauuuggaccacaaccuugcacgaaaccgguucagggucuccucaagucuggcaaccuugggggccaaaccucgggagcugaggacccgggaacucagggucguccguccguaagggaugugaaaggguuacucaccauccuugcugugguuguagauguccauggccuccugcaaauucacuagggcaaucuucucaaugaccuugacaguccuggucugcuguucccaauacucuggccccaucugcuucacccacagagcgcguggcuccauucucugauuuuuccccuuauuguuguagcacaggaacugugugucguccacgaagacgacaaagaugaaggaaugcucccucaaaccaggcugggucauggugguggcaaaaaacugcaaggaauggaugccuggcgacggaagacacaaauccuuuuuuuuuuuuuuuuuuuuuuuccgggacuuguagagguguaggugacagaaggggagcagggcgugggguucaggaugaagauuggagaaaggagagggaagaguggugaggcuauuucgguugugcggcuucuuggcuucuccagugcugcccucacucuccuuggccgaggcaguuucccuccugacccgcacucaccugcgcgaaccagggucaaggccaaagcuccggugagcagcaaggauaggaggguagagagcgcagggcuucucauccuccguguuuagaaggucuagagggacugagac

SEQ ID NO: 8596 - RNA, 9569 nt, Mus musculus
uccuugucucuuuccuucaucauccacuucucuccuguucaagccuccugauggcagaggucaagucuucaggaaaaaaacaaauacaaagaccucaguuugaccuccccuccccuucuuuuaguuuuaaaaauuguauuuauuuugugggguggggguaagggguggggguggggggugucgugcauggguaggugugaagucagaaaucaguccgaaucuucuucugucacaggacucucagggcugguggcacccuccauuucccacggagccacccuaccuuucccagacaggccuucuguuucaggauucucagugcaggcacguuuccgucuucuccuccuggauuccauccucuuucccgaggagucccuuacuuuaaaaauauuucccagcaccacggguucaugaagauagccgagcaaaugacccaggauuucccagcauuuacugaaucugauuggucuuuggcagcacaagugauccagcaggcucuccuuuccccuaaaggagcugucacagacggggcaaguguagaucuuuugcauucugaguguguuggaugagugggccgacucuuugcagcagaagugcugguuggguugacgucugaaguggaucuugagguggguuaagagacagguucucaugguaaacguuaugugacaauagggacaagagaucuuuucucuugaacggaccacuguaauagaguuggaucugacauucagggucgaggcuccgcuguuccgugccuuagcccuggccacuggucccuggaucacuuucacauacuugagggcgggcgcuugggaucuagguguuguagguggaacccuacucuucagccucugguugcuagccugguugccagccugguugcuagcugcuggcuuguuuugguguaccuucaggugacgguugaccucagacugaucccggaaacacuuuccacacucagggcaugaacggggccuauaaccuaaaugagcacgucggugacggcucaguccagaagcaucacgguaagucuugccacagaaauuacaaaagaaaggccucucuccacgaugcugagccuuguagcccuugccuuugcggcuuuguggauuugugacugccagccuccgggaccucacaggaaacuggugauuaaagaggaagguguucuuuuugaaacauuugccacaggucagacagaaaaagaaugguccaccuuugaauaccccugugcaacuggaggacuucuccugcuccucguucuuaucuugcagaucugagcuagguucuugagguuucuucuugcuuccuauaguagaggagggaaaauacacaguucauuaugagaaugccugcacaagguuugugcucaguacaagccacuuucccuuuucccaaccuuuaaaaugcagccauucacccuugggcuucauaggcuagaaauaggaaaauguaauaauugcugcugcugcugcuacuacuacuacuacuacuacuacuacuacugacuaguaaaaguuucauaggcaucuucuauaauugcaaauaucuaaauacccaacuuacaucuuugaaauccaucuucccacucucacuacgacucagucucccagauaaccccacagauaaugaagcaguaguccuccccucagcccugauuacacacgugucugccaaguacaaaauauuaauggagaauucccuacuguaagaccacauucacaucacuuuuuaauauagauuauaauuauucuauauuacuaguauuuugauuuacuacugugucuacuacagcaaacagaacuuaggaccuggggauauaguucagcagcacagcacuugccuaguacacacaaaaccuagggcucaauccccagcucuguaaaaacaaaaaccaagcaauuaggccucaguacuauguguggcuauagcuucaguaaccaccugaacaaaauacuuucagauacagagaacucaucccccaguguuggggaagcaaaccaugugcacaagggacacaaagcgcucuaccagugagcuagcuacacuucccacccaagggaagacgacuguaucaugaagauugaugcuaucauuacuaauaacugaauuggagcacaaagcaacacaccaggaccgucugagcugggaaguguggccaaccucaauuaacauuccucucaguuccuuaaguccuccuaucucuggaacaagcuuaucguucuccagagcaaggcuguggagagcuuguuucucccaggaagaacuucuuaaucaaaggaugcaaucucuccauuccuggaaacuaggaugacuuguuuugaaaaucuuggcuauucauuacgaagccaguggacuuaaaacuuugaucucgggguuuccucuagucccaagucuaacgcagauggaaagauacugagccugaagcacuaggucagcucaccaugcugggacuguccugggucuuuuuaacccuccucucuccucugcaguuuuaaaaugacauuuuuuacuauauuguaugcaugugugcaaguguuacacaugcuacggcgugcuuaugggggucggcagacaacuuguagggcugguuuucucuuuacaccaaguauauucaaauucuaauuaucagccuugguggcaggcacuccuaaccacugaaccauuuugcuggcccuugguuuugugagaugauaggcccccaaaugcacgaugaaaccaggguguugggauuacagaugugagcuaccauacccagcuuccuuuacaauucucaccuguugucuuuggagguuagagaccugaucucugcccuuuuucuuuuuguaagcuguuccaaucuuguauuuuggcucuaaauggagucauauuuuggguggggagaggggcaugguuuuguuguuuuugguaacaaggucuccauauacaauguaagcuggcucugaaauaucuccauccuucugagugagaugcacuaccaagucugucugcuguauggaaaugaagcaaaguggucccaugcuaagccccuuuaugucuuauaaacaaacaagcuaccuccuauaggcuugcuuuaagaacauuaaucuagggcuagcaagauggcucagcaguucaugcaccuguugcucuugcagaggaccugcauacugccccgaguaacugcaugguaguuuacaaccauccauaacuccaguuccaggggaucccauccauccucucuucaaaccuguauggacaccaggcacacacaaagugcgcauacaaacacgcaagcagaucacucuuauacauaaaacaaaccuuuuaaaugggguggggggugcuuuuaaagaacauuuaucuaagacacuugguugcagcuucuaguauaacaccucacacacaagagugacuaaauaucaguuggauauacaggcaagugguuuuuugagguaguuucgcaauguaguccaagcuggccucaaucucuauaaccaaggucgggguuuaguuugcaaucuccccgagucagauccaggaauguugggaggguuagaagucuugggauuacaggcuuuggucaacaaaccaggccugacaggaaaauuuacauauuuucacaauauaacaauuacaaugauaaagguguugccuugggguugggaaaguagcucaguagauaaccugcucaccauacaaucaugagcucuugaguuugagccucagaaugcacacuaaggucagguguaauggcauuuggauguaaacccaaccaugaaacagaaaaggcagauccuuagggcucacuggucagucagccuagcugaaucaaugaguuccaaugagugagacccaacccaaaaacaaaacaaaaaguauagaguggcucuauccugaggaaugaagcccaaauuuaacccuggccuccaugugaacaccuaaguguaccuacauauacaugaacacacacacauuaucuuuguauuccuggggugcuucuuuuguuuucagguuuauuuauuuuuuugaauuuuuugugacucaaguguuuugcuuacuuguguguguguauauauauauauauauauguguauguauguauguauguauguguauauauaucuauacauacauacacauauacauauguauauauguaugcccagugcccauagaagucagaaggugugggaccccuggaauuagaguuaugaauguuugugagccaccauguggggcuagacacugaacuaagguccucuacaagaacaaguacucucucaacccuuaagccuccucucugaacccaugcagguaguccaggcuagccuuaaaguugcuauguagcugagaaucacccuaaccuggucuuccuaccucuuauuuucaagccuagcuugucaucuaaguuuuuauugcuuuuaccuuuuuuaccccggaacuuugugacucagaucuuucaggcugauuuuggucuaucugagcagaaacaccaacaguauuuucuaaggcuauaggacagggagaaugcugaaggagucagucucuuaccgacaaaugucagguucuugaagguuucugacaucacuuucugguaaagggucuucuguguagaaguaagauauucccauucuuccugggugaaagacacugccacguccucauaacugacugguguccuggauggcugggaagacuuagaauguaaauacagagacuugaagugucuguucagggacuuuuugccccuaagucucugaacuaucacaucugccuuggcaacgcauucaggacuuucuacaguccugaccauagauauagaaccaaauguauaaucaaaaucucugcugaguguguaagcaaaacacauauuacagauucccuuaacuuauccugaaaaaugugguuuugcuuuuauaaaugcgguaccccugaguuuccgugccaagagcuuuccugaggcacuagccugcuccuggucaccagcuuaaauaaaggaggggaggagaggggagaggggagaggggagaggggagagaggaggggaggggaggggaggggagaggagccuaugaaggauuccaaggugguaugggaguuagagaucuugcaauuccuuuuuucuguuguuuggccugggacaaucugggguucuaccagauccacagguggguaaaagaccucaacaugaaccaagguucaagagaaucuagggccugccacuuccuuuaccggaccaucuccuuucugcuguuggauuucacuaguaaucucuccauguuaaguccucuauuuugcucuaccuguguucugagaaaucucucacugaaccugaagcucuucaacucaacaagaauaucuggcuagaaagccucugggauuauucugcugaccuugucugucugucugucuuccuuccguuuguuuuaauguggagacugaagaucccacauugggucuucaacuuugugcaacaaguacuuuacaacaugccgagccaucuccccagucuuuccacccauaaucuuucuuuggggcuucuauagagcagcuaacauacuaccuaccccauggagcagcaugucuuuaguggugucucuuucuacuuuuagagccuucuggucuggaucccaaggcuaaugggacucuauauuucccaggcacugggcaguuggaggguuccuacaugagccccagaauuugauacugcuucuuauaacaaaaguaucuacucuaaaaaagguugucuuccuugaugguucaacuguccaaauucuccuuucaugauugacagcuuuaguucccucaaagcccaggccauagaauucagggcucugauuaccuguuuccuagcugccauuguuugguaaugccaggcugguccuaggcguuugacuucuauuccagacugcuucuagccacaauuuguuggugcccacuucuagaaaucuaagguuuaagaaaaauagauaauaucagcaaagggagagaguaaggaauaagugccuccguagcacccaguuacuagcuuccugcacugugguagagccuucuccgcaguaccaagagagguaaauuggcuccauuuucacaaaccucaagaauaagcguuaagucauccauucuaggaugugugauccacgggaaaguaaaguuuaauucuagauucaguaccacugaaaaguacauaccugaaugcgucacauaccacucugaguuuugucucuucauccucugacuugauuucacuggaaagaugagagcuuauaucucuuccaggaccagaaauuaaaauauagauucugugauuugaaugugugugugguauccuggggcucaaaccuagaagcuuaugccugcuaaccaagugccacugagccuuaugcauaccccuagcuccaugacuucaauguuuaauauauagauacgauauuuccaauggaccuagccuuugaugaccucuuaagcugaaaaugucacuaggucagaaaugcaaguaauaugccuaccgaacagaaccuuauagcuuaguaacaaaguacacugacaguguguaguuuccuuuccugaucuacuagcugucuggaaaguguagccugugacuacuacccagcauaaaggacuaucagaguaucuaucuaucccuaugcaccacauaguacuagucuagggacgaguuaaaucaaaccccaaaauaagcugucugacuauguaaggccaucccaucauuuuggaucauuuuaagucuuggcagcgugaguccaguaucacauguacagcacagugauaacaacccaauaucauuuaaauucuuuguucacucugaaauuuuuuuaauuucuauuucuccucucuagaugcagggaagcauaaaggcacagagacucguggcccuuucuuuuccucucaauucuuuugcuacgugaaagugccagcaaggaacaaggcauucaaggaaucgcuagcucugauccccaaaaaaguugccaggaaagcugcauucugagguugauuuucuuccuuccuucugucugucucaccucucauuauucuuccguuggaaaaaaaaaaaaaaaaaaaaacauuccaaacagugucuuccaggaccuguccauacaguucuaugcuagugucuuccaggaccugucuuuaaccauucucagcaaagaccccuuuaucaacaagucuuaacaauagcauaaagaugcguggugaccuagacgauuaccuaaacacuaggaaggcugagacaggaucuccgggaguucuaggacagccugggcuacagaaagcauaaaacaucaucaacaacagcagcaggagcugcugcacauucacacaaagcagggaguggucuuuaauauagauacaggcugauuaaggagacugacagguguuggguaccuccauccaccuccucacucauuuaccucugauuguucuuuccuggugcaggagcccugagaaggcaagagacuaaauaagacuuggcuguugauuggccggaggucaggucccgucccucccgacucccaccccccuggcaugggagaugggccaggccuggccucacccuuccacuggguaaauuucuggagggacugugcagacgucucucaacccugagugcacuccuccaacuaaagcccauucauuguuucacaaaucugaggagucagccccaauagcacaaaggaagcuaagacaggaagaucaggcaaacuugccacaauacaccccgucuguccggcucucuaaaaucuguggccccgccgcucucacgcacaaucugacaagaaaugcccgccggcuuugcccggucagccccggucccagacucuaaucccccgagguuucagccacgugagccuuuccaccgcggagccaggcggcuucucccacccaggugucgggcccucguggcuccaccgagggagcggcuccacccggguccccgcacgcucucaccgcgcucgacagcccuacuugaggcucggcaguccugccguucccagcgcucggcuucugagccguagccucggaccacagccacacaaagggcugggcgcgcguuccagccucgaccagaacgcagcggcgugaaacccaggaaggggcccuugccagaagucaggaauccgcuacuuugucccucugcuuccguucugcuccguccgcagguaacacaucucaaguggcugucugccaaggucagaaauuuagaucugaagaagcccaaugccugaaugccacgccuucucgucccgccuacuguuggucuucacuggucucagcugcgcuaggaaauuccauuuccuaagauaaguauuuacuccugggguggggaaugggagugggggauggggguaggggguggugggagggacgggugacucaauuuccguaauuccuuguacuaggcagcugaaagugaguuccacgccugccugggcuacacaguaaaacacacacacacacacacacacacacacacacacacacacacacacacacacacacacacacacacacacaaauaaaauaagguaagacuaaagaaaaacuggaacacuucgcagacaaguaaagugggccguggagcaacaucuuagcuaaaguaaaauccaagaaagcacaggagacuuagacuauaguuacaggauagcucaguaguuagagaggauuccaggacaccuagcacagagagaccuguaaccagggaaccccacacucuucguuugguaccaucccauauguggcauucacucauacagacucaggacaauaaaaauaaugauuaaaaaaaaaaagauacagacacuucacagguaucacaucacggucaagucguauuaguguuucacauaccaaauucacuucagucucucucuguaauccuuucuuuuguuuguuuggauuuguuuuuaauaaguuccauuggaauuauaacacuuaacccaggucucaggcagccaaagcacaaacauaguuggggagggugauaggaaaguauagaagguacuagguugcuggguggugguggcgcucgccuuuaaucccagcacuugggaggcagaggcaggcagauuucugaguucaaggccagccuggucuacaaagugaguuccaggacagccagggcuauacagagaaacccugucucgaaaaaccaaaaaaaaaaaaaaaagaagaagaagaaggauugaagcaauccauauguaacaggccuguagugagguaaaagaacaaacaaacaaacaaaaaccacgcuuuccgucaauaaugaacuguuucucacccugacuucaaauuaccuuauuuacaaaacugagcaaccauaauuagcugauuuagguucuucaacuuuaaauaaauaaauaauuuauuuauuuauuauuuacuuacuuucuuagagacagcucuuccuaggaacucacuauggagccaugcugaccuugaauucaagacccccucgacucagugauugaguguauacuggcuucugguccuuaauucuugagguggaaacaccauguuggccagcagguagccccagcacacagucaaacacuauaggacaaaug

SEQ ID NO: 8597 - RNA, 778 nt, Mus musculus
cguucccagcgcucggcuucugagccguagccucggaccacagccacacaaagggcugggcgcgcguuccagccucgaccagaacgcagcggcgugaaacccaggaaggggcccuugccagaagucaggaauccgcuacuuugucccucugcuuccguucugcuccguccgcagguaacacaucucaaguggcugucugccaaggucagaaauuuagaucugaagaagcccaaugccugaaugccacgccuucucgucccgccuacuguuggucuucacuggucucagcugcgcuaggaaauuccauuuccuaagauaaguauuuacuccugggguggggaaugggagugggggauggggguaggggguggugggagggacgggugacucaauuuccguaauuccuuguacuaggcagcugaaagugaguuccacgccugccugggcuacacaguaaaacacacacacacacacacacacacacacacacacacacacacacacacacacacacacacacacacacacaaauaaaauaagguaagacuaaagaaaaacuggaacacuucgcagacaaguaaagugggccguggagcaacaucuuagcuaaaguaaaauccaagaaagcacaggagacuuagacuauaguuacaggauagcucaguaguuagagaggauuccaggacaccuagcacagagagaccuguaaccagggaaccccacacucuucguuugguaccaucccauauguggcauucacucauacagacucaggaca

SEQ ID NO: 8598 - RNA, 12661 nt, Mus musculus
gaaguaugcacagagaaacuuguauuauuaauuagcaccuagcuuguuugugucugguagaccaccaaguaguaauuuuugggggaaaaaaaccacauugguucucagagaaauaagguaggagaaaaugagaggcagggguaugaagggcacgaagguguggaacauaggggagcagacccaguucucagcccuugcuucucaagguccucccaccaggcugccaaagcaagaugguauuucucuggucgguauucuuuugaauuuuagcuccagguuuugguucaggugcucauauucauacccuggcucacuuagcuuuccccgauauugugggcucuucuguuccugacccccccccccccacauugauauucuucccagucaaggcuguggucuuggaagaaauauccaccauuugcagaguugauguucuauaguucacaaugaugaagugcugcguauccugguuggcagaaucacuccuguauuacucuggugcauaggugucuccugauagacugccuggccuucaccacaggguguuuucuauagucagacuaacaugguaaaaaagauguggaagucaaaaauuagaggaaggagcugaggaaagacaguugagggagggaaaucaaguucuacucgguauccagaaugugucuguagauguagauuggaaucuguccacagcaaagaggccaaugggaaauccccaaggaccugcugggcucuccuuccgcuccaggaagacacaaccaucacucaaaagggguuuccuggaaagacagacaagugacuuuaaaaaccucugccaguagguucuuuuuaugaaguccuugaaccuaggagauagaaaguuccuaggggucaugugaucucucccccaaccgccugguuggucuuggagggaggugagguucgggauaacuauuauggagaauguuaaagggggcugcagaaguggaauucuggcucaggggcacuaaaggcuauuaagucaacagguaagaguggcucagcagccucucuggcacugaaaaugugucucguuaauucccuccccuuuuccccucacaagaggagucauuccagccuucccugggauaauggucccucaguaaccauguucccuuugcuggguuuuuguucgauuuagaaggagggaaaugguuggguacaaugguaugugcuuaagacgguaacacuuggaggcaagaagaggguugccauaguuucuagaccaguuugguuuacauaguaaguucuaaggcugcauaaugagaugucucaagauuggagagggguguuagggagaacuuacuuagcucuucaagaaacuguccuguaaacaaaaagaaaugagucaauggguggucagugggaguccccccucaccuccccagacaacccucccuccccauuaagaggccuauacaucucauuaagugguucuccguuuuccuauggauucugauggugagaguaaagauucccaucccuggaaucuagaaccuugguuccacucuuuucccauacuggucugccugaguucccugaugcauagcaguccuguuuugcugcccagacaccgaaccugccagucuucggugcagccaguuguagcagaugaucaaggcaaccagggguccaagaacaggcacaauaacaaacaguguuaucuuccagcagggcacccucaggaagugaggaucugagguaaagcagagcagagugucucccucugugccacgcccauucuuaaccugaagccccgaaaugacaaaggacucuggggacaggcuguagaguccgugaacauggcuggggugcacugucccuuuauuuucauuaacuucugauugaauuuagcuuuuuaacugauuuaucauagaaaacagguugugugacuuuucaugcauuguuuauguucagccaugcauugacccucccucaccccaaucucuagcauuuuuauuuguuugaagagagguucuugcccuguaucccuggcuggccuugaauuugagaaauccugucucagccuuacagguguugugguuacaagucaucaaacccugcuuucccuaagguuuucuuuuucuguguggcagagguuuauuuggagguggggguggagacaaagggacaaagagaaaaggaaaaaacagggcacgguuuucuuauacuaacagacuagggaugcagucucaaaaagaaagaaaccagcaaaaacaaaaagucaaaaacugguauuaggacugacuguaugauuuuaagauacaaacaugguuaagaacuuagacauucaaaucuuuuuuuuuuuuuuuuuuuuuuggaggcaggguuucucuguauagcccuggcuguccuggaacucacuauguagaccaggcuggccucgaacucagaaauccgccugccucugccuuccaagugcugggauuaaaggugugugccaccacugcccggcuagacauucaaaccuuauaaguaaaauccuggggguugggaagguagcucaguuuguagagcucugaguuccacccccagcacagcaugcacuaggcuugguggcucacacuuauaaucccagaauauaggagguguaggcagggggaugaucaaaauucaagguaaucuuuggcuacauagugaguuugaguccuuccugaaauacaugagacagacauuucaaaacaaaauggaaaugggaacggugagaugguuuagcugauaaaggcacuugcugcuaaaccugaagaccugaguuugaccccagacccacaugauaggagagaaccaacuccuuuauauuguccucugaccucugugugagcacuugcccacacucacccacucacacccuccacacacacaauaaaauacauucaaagacuacaugugugauguccauauauuggcccaaugucaagugcuaggguguagccaaguaccaggagagcugaacaggguugcaucuggcuucagaaggaaaggcuguuuauguuuaggaagauugauuagagcaggauucugcuaugcucugcuuaauguuauuuuuuuaguuguguggaaucuauucaacaaacguuuggguauucuucuguugcugguguuguccuuaggaacucugcaaucugaagugaagaaaaugcgaagaugauucuugaggacuuaauauucuaguuggggcaugcaugguugaguauacauuuaccagaaucuugggaguugaagguagaaggagaagaaguccaaggccaaccuucaugacauagugaguuugaaggccagcauagccauaugaaacccugacucaaaaaguuacuagugagguuucauuuucuccucaaagaagacuucccuguugaaucaugugcuuggacuacauuccugaaaacuaacucugccauauaaguauagcagaugacuuuuuuuaaauguaauuuucuggauaugguggcacaugucuuuaaucccaacacuggggaaggagaguguguggagcucuguaaguucaaagccaaccuguuguucauagugaauuccagguuagccagggcuacacagugagaccauaacuuaaaauuuuuuuucuuacauauguauuccuugugcauauagcuguuugcuguggggucaggaaauggaacuuuagguccucuaggggagcagcaggugcucuuaacgauuuuucccaccagcaagcaauuuuaugugcaaaggaucucuuuaaccacuuuuuauaauucagaagaugaauauauauacauauauauacacauaaguacauauaugcauguauacauauaaaguuuacaauugguaaaauucaguguagggccugacacuggaauaugguacauuaaugauugcuacauuccuauagaucuugaaugugaagaaaaaagguggaggggccuuacaaaaagccacugguucuagucccccaggccacuagugaagucccacggugacuugggaggguugggauaugccugaacuuaccaaaaguccgauggagauucucugaaaaggacaaauaagaauagacuuaguaaggaacugaaagggagucccuuccuuggaucuaucuaaaucccucaagguugguucuagcccugaugcaaaguaaaccgugcuauaagagcucgggugaaaaaaaaaucuaauuuuuagcugucuauagucuuaaauauaaaguucccaauugaagggagcauggagcauugggggaaaggcagaaauggucugaagagagggauauuuugguuaaguuauaaagaccagaagaggaauuggggagggagggugucuggaacucaccuacuucugcacgaaguuuuccuaaaauagaaaaaagcagguauuuuaguuccugaucuaacaguaugaggacccuuccauaccacccagcaccuuggaccuuuguguggagaauucuuugauggcccgggagcaucuuagaauaggaagagcucuagauuugaaaccaagaguccagucucuuucugugaauauugucugauuaaauaaugaaauaaagagcaugagagccuggaacugauagugauugguugcguugucugucaucacagcaaggacaaggcugauuaugucgaucuagcuggcuucuuuucuuacaacuccguaugugucccucccaaaacuguuugcuuggcuggagaaaaugaccuuccagaagaacagggcccacuguucuuugguuacagguauaacaaauugcugcaguucacaacuggaaccuccaaaccuuuuugcauuuaagaaugcaaaagucuggggcuggugagauggcucagcagguaagagcacugacugcucuuccgaagguccugaguucaaaucccagcaaccacaugguggcucacaaccaucuauaacaagacuggauacccucuucuggugugucugaagacagcuacaguguacuuacauaucguaaauaaauaaagcuuaaaaaaaaaaaaagcaaaagucucaggaaccugcaauguuccuaacauaccacaugguuggcuuguucuucuucuuuuauuuuuaauucuaucugugucgcagugagugugugcgugugucugugcguacacaugaguaugugugccccuggaguccagaaaagguugucagaucuccuaauguuaugggugguuaugaguugccugauaggugcuagggcuagaacuugaguccucuguaggagcaguacaggcuuuuggccucugagcugucuuuccagcacuauaucauaaagcuuuaucacuucuuccauuauuucuugcucaguucacauggucaagaagauugucauuuuguaaauauaaacccauaucccaucuggaggagaaacuacacauuuagugagcagcuacuuuaugauugcauguaugcuacacacuucucccuguaagauucccacaguuuaagagggaaauucuaucccuacuuggagacuuggagaaccuaagaauuuuucucauaguuggugucuacaguagaguuggauccuaggcugccuagcuccguguuccugcucuaguagccaugauguuggagagccuuuucuuugccauggaguagguaaccagaaauucugggugaaaaaacaaaaaacaaaaaacaaaaaacaaaaaacaaaaaacaaaaaacaaaaacaaaaacaaaaaacaaacaaaaacuaacccucacuguggggcuggggauguagcacaguguggagaaccugccuguuguguauagggcagggccauuguugcucuuuuguccuuuccaugacucaaacccuccuugcugcuauauucucuuaucagcagaaggaaguggaaaugcaagaacucuugccuugguuugggaaggacacagcacaaggagacucugacugcaggcucugggcacaaaacaacuuccucuacagcugaauuuauuauguucauaguugaauggaaaagacaggggaaccaguuguuuaauacauuccauguggcaaagacuuucauuucagaaucuuuauuaaaacaugaaguaguggggcuggagacauggcucacgguuaaguguguuugcagcucuugcauaggacccaggguauaguuuuuaguacccacagagagcaauuuacagccaccuauagcuccagggucucagacacucuucuggucucuugcaguaccuauaaauaugugugcacauauagaaaagcacagacaaaaaauauaugugugugugugugugugugugucugcauauagguauaugcacaugacuguaggugccugaggaagcuagagauguuggaucccguggagcuagaugguuguuauaucaugguuacagaugguuguaagcugucuaauauggguucuggguccucuaaaaaaggagcaauugcucuuaaccauggaacuaucucuccagucauauauauaugccuaguauuuuagaccugacugacuuugaagagacuacucacccaguuucaugaagcugcuaaggacuauggagggcagagcucuacugccuguaacaugucaucugagcaagucaccaauccaccccuagacucaauuucuuccucggcaaugaggcuggcacuauuacuccacagguagaugcaagguaaauuguucaguagaaccuguuauguaguucugaacugagaagacuuaaggauuaacugucccuaagaaccaggaaacgauccugacagacccacccgcugcccauaccucucagucugugcugcaggaagaggaauacaaggccuacagagaccugcaggaggaucguaggcacaagugcgaugagagucagcacaccgggguugacccaauagaagggaucugaaaggcagaaggaacacgucacccagacugcuuccuaacacccuguaaagagcuugugcugcaguagguuggguugaauaagggaaccaacaucaagauuuuaaaaauacugacacacccaggcauggucuacauacaugacucccagcauucuggagucuaaagcaggaggauugcugcaacucacuggacagccugcaagacaugucucaauaaagaaggagggugacauaaagugaaaauguugguaaaguaaacuuguuuuuaaaagagaugauguggccauuguuuuuuguuuguuaguuaguuuguuuguuuuguuuuguuuuaaacagggcaagucuguccugaacucuuuguccucuaguuucuaccuuccaaaugcugggaauucaggccugagcuacaacuccccaaauuuuauucaguguuuucaaaggaacuccaaccaaucuuugugucugugucuaugucugugccugugccugugccugugccugugucugucugucugucugucugucucucucucucaagcuaauuagaggaauuuggaauguggacaccaacucaaaggaaagcacucuccccugaggcacaguuuucauuguguguucugccccacucccaccaccuuucuuauuuguaauuuguugggucucaaugaguguaccggaguuggcagaugaguugggaauuugcuaaucaagaagagagaaaaaaaaaaucuguaugcuaaaguucugaccuuccacuuuuugugugaguaaaaauucuccaggaaaaaaaaaaaaaaaacccagcugucugaggaacauucuguggcacacagcuauuuucaugucccugcaagcugucucuagaaauagagcuuuguuacugggcauacaaugcaucuucuggucucagccugacaacagucaccaccaccucagauacagaaaugauggauugucugauguucacacugcaggugcugaggaggaagggaaaagaucagaggcccagcacucacaacacuauuguucuucaauugcaucgcaauuaacuuucuauacgcuccuucugucuauuuuccuauccaugguuuaacgacucagaggcaggacaaauaaugaauaacuccaaaaccagccaccacacaaagcauacugaaaauaaaguuauaaagacaaagagcagugucaucgaaacuacaggucuccuccacuacuguguaugugcuuaauuuuuacuuagguguauauuugugugggggguauuggccuuuggaagccagagaaggcaucggaucccccagaacuggaguuauguggguacuggaaccaaacucuggacgccugcaagagcaacaaaagcucuuaagcacugagccaucucugcaaccucuugguuuuauuuuguuucguuuuagacggucuuuuauauucuagguuagugucugacugacuucucacccucuuggcuuuaacuucuaagugcuaugauuacgggcuucagguucuaagaucaguuuaugcagugcuggggacugaacccguguuuacuuccauucuagguaagaacucuaccaaaugaauuaucccugccauauauuacauacacacacacacacauuauauuccugucauacauauaauccacacacauauaugcauauauauugaauacacacacacacacacacacacacacacacacacacacacacacacauauauccacacucagacacagggauauguuuuuguucccgauacucuauagcuagcuuauguaacucgacaagcucucaugggaagcuaucugguaugucucuaaagcaaucauuuuaagcugagcauagugacucaugcuuuuagugccagcacuucagaggcuaaggauggaggauugcccaaguuauauauauauaaaaaguuaguugugccaggcggugguggcgcacaccuuuaaucccagcacuugggaggcagaggcaggcagauuucugaguucgaggccagccuggucuacaaagugaguuccaggacagccagggcuauacagagaaacccugucucgaaaaaacgaaaaaccaaaaccaaaccaaaacaaaacaaaacaaaaagcuaguuguggcaacacaugcauuuaaucccagcucccagcucuuuaggaggcagagacaggaagaccauugugagucugaggcuaaccuggucuauauaaugaguuccaggccagccaggucuacauguuaaaaagccaucacuuaaaaagccagauagucaaaaagaagagcuaccuggccgggugugguggcgcacgccuuuaaucccagcacuugggaggcagaggcaggaggauuucugaguuugaggccagccuggucuacagagugaguuccaggacagccagggcuacacagagaaacccugucucgaaaaaccaaaaaaaaaaaaauaaaaaaauuaaaaaaaaaacaaaaacaaaaacaaaauaaaauaaaaaccgaagugcaagagcauuugucuagcuuagauaucaucuuuuuaucuaaugucaccuucuuagccaugaaaagggacuuugauuccaguuucuuucccaauucaaauaacaaaauaaccaacagccauaacauaggcaucccuguuuacugacgugucuguuccuuuggauuugaucucagaagugacaaguuuggguagaaaaaccuuaucucagccgaaggaugaagggaggucaacuauccuacaggucauuugaccuuggaggacucaccuuccacuuucaacuccauugcugccucuucuugguaagaguggucucugaagaagcagguguagccuccuucaucugagaaucucacguucugaauccuaaggguaaccuuucccucacugauagucucuuucagaagcucugugcguccccgguauucaggugcuugcucugcaucuugguccuugccauuucgguagaggugaaccacucuugagaagggagaacgguaccaacccaccuccaugcccguggcauuuuucccaggagagaugcggcacggcagcucugcuucauccccaacuaaagcccggaugggauacccugguccuaucacucugaauuguccuguccaagacacaagagugggaaaaaauaacaacaacaaguaucagaugugacaaauucauccaucauaagaaggcugcuucaaaaagggugagagggccgggcggugguggcgcacaacuuuaaucccagcacuugggaggcagaggcaggcggacuucugaguucgaggccagccuggucuacaaaaugaguuccaggacagccagggcuauucagagaaacccuuuccccccucccccccccaaaaagggugaggaaggaaacauuuuucauuuuuauuuuauuuuugagacaggaucucacuguguagcccuggcugggcuagaacucacagagaucugccugccuuugccucccaagugcuaggaucaaagcuguauaccaccacacucagugguuuguuuuauuuuaaaguguguguguguguguguguguguguguguguguguaucaguacacacaugagugcaggugacuucagaggccagaggcauuugucaccuccccccccccccccaucuccaguccuuuguaagugaaguauauacucuuuaccacggagucaucucuugagccccuauuuauuaauuuugagaaaggaucuugcucuguagugcagauuggucuugcacucauagcaauccuccugucucgccuuuuuaagugcuggaauuaugagcaugugccacugugcuuagcuuaggacacucaauuuuuuugguaaagguuuugccucuguaucagagugggugacucuaugucaccuuugugcagcuacucuuggaacccauaagaggcugugagaucccuuggaguugggguuacagguagcugugagcuaccccauaaaugaugguacugagaccccuaccuuggaucuucugcaagagcagcgagcauacuuaacugcugaaucaucucuucaauaccucuccucauuauuugauuuuuuuuuuuuuuaagacaugcuuauaguucaagcaggccuuaaucuuccauguagcugagacugacuugaauuucugguccuucugcuuccaucccacaaaugcuacaauuauaaguaaggguucaccaccaggccagguuugggaauaucacauggaauucaugaacccucaguagggcuuuuuuuuuuuuuuuuuacuuuaagcuaauaugaaguaagcagucucuaggaaaagauauguucugagccgggcgugguggagcacgccuuuaaucccagcacuugggaggcagaggcaggcagauuucugaguucaaggccagccuggucuacaaagugagucccaggacagccagggcuauaaagaaaaauccugucucgaaaaaccaaaaaaaaaaaaaaaaaaaaaagauauguucugaaugucuaggacagaaugcuccaccaugaaaucaucugacaauggcuuccacuuuucuaccagcuauguucaucucugacuccucagcucagaugcuugccuccuugucauguggcccacuacuucuaagugcuucccagcgcucuagguuguugggagucaccccauggaugugggugccgguaaucaaacuccaguuucccauaagagaaguaauacucuuuaccacaaagccaucucucuaaccccuauguauuaauucucuucuuuucauuuguaucuucagccuuaugcuagcucuggaaacuucucuggacaucuccccagugagaaucagcuacuagcaaacugggcucuuccuuauaccaggaugcccacagaggaugccuggacuagggcgguuucuuuauuucuucuuuuaguuggacaacaggcuccuguaucucugccuuauucugcagagcaaguucucaaacauaacucgaugcuauaacucaacuuguuuuuguuuuuguuuuuaaauauauuauuuuauuuguguuguuucauuuuagcauucaggcuuagagacaagcacauuugcccacugagccaccucacugacccucaacaaacauuuauugagaucugcuacaaacaggcauugccuuaaugugcaaaguacaaaaauacucucacuuaacucugacgguaacuccaagaaguuaguguccucuuuugaacgaugaaaaaaggaaacgaaacuagggcuacagauagagcuuaguugugaauugugaacuuagcuugcaccaggcccugaguuuaauucccaguaccauaugaauagggaaagguuuggguuuacccgccccccccccccaagaagucaggaaggccuuuaaggagagagacuaugccaacagacccaagcauaaacaggaaguuuguauagccauuugaggaugauuaaaagagguuagccaaggacacucccuuucugcuccuaggucucugcagggguggaaugagcaugcuuaccugcauagcugcaugacaacuggaggagaaggaggaggagaagggagaggaagcagcugggccaagagaagcuccacaaacaggccaucuuuaugguuaccggggacagagucccuaacagcagggucaggccaagcugagguccuccggcugcaugucccuuccuccaagaagcccgaagggagaaucugggagggcacuacugcccaagcccaaccuccauguaagcauuaccacagcugugcccugaggaauggccccacgucacccuugccagauauuuguaca

SEQ ID NO: 8599 - RNA, 4327 nt, Mus musculus
ggaaauccccaaggaccugcugggcucuccuuccgcuccaggaagacacaaccaucacucaaaagggguuuccuggaaagacagacaagugacuuuaaaaaccucugccaguagguucuuuuuaugaaguccuugaaccuaggagauagaaaguuccuaggggucaugugaucucucccccaaccgccugguuggucuuggagggaggugagguucgggauaacuauuauggagaauguuaaagggggcugcagaaguggaauucuggcucaggggcacuaaaggcuauuaagucaacagguaagaguggcucagcagccucucuggcacugaaaaugugucucguuaauucccuccccuuuuccccucacaagaggagucauuccagccuucccugggauaauggucccucaguaaccauguucccuuugcuggguuuuuguucgauuuagaaggagggaaaugguuggguacaaugguaugugcuuaagacgguaacacuuggaggcaagaagaggguugccauaguuucuagaccaguuugguuuacauaguaaguucuaaggcugcauaaugagaugucucaagauuggagagggguguuagggagaacuuacuuagcucuucaagaaacuguccuguaaacaaaaagaaaugagucaauggguggucagugggaguccccccucaccuccccagacaacccucccuccccauuaagaggccuauacaucucauuaagugguucuccguuuuccuauggauucugauggugagaguaaagauucccaucccuggaaucuagaaccuugguuccacucuuuucccauacuggucugccugaguucccugaugcauagcaguccuguuuugcugcccagacaccgaaccugccagucuucggugcagccaguuguagcagaugaucaaggcaaccagggguccaagaacaggcacaauaacaaacaguguuaucuuccagcagggcacccucaggaagugaggaucugagguaaagcagagcagagugucucccucugugccacgcccauucuuaaccugaagccccgaaaugacaaaggacucuggggacaggcuguagaguccgugaacauggcuggggugcacugucccuuuauuuucauuaacuucugauugaauuuagcuuuuuaacugauuuaucauagaaaacagguugugugacuuuucaugcauuguuuauguucagccaugcauugacccucccucaccccaaucucuagcauuuuuauuuguuugaagagagguucuugcccuguaucccuggcuggccuugaauuugagaaauccugucucagccuuacagguguugugguuacaagucaucaaacccugcuuucccuaagguuuucuuuuucuguguggcagagguuuauuuggagguggggguggagacaaagggacaaagagaaaaggaaaaaacagggcacgguuuucuuauacuaacagacuagggaugcagucucaaaaagaaagaaaccagcaaaaacaaaaagucaaaaacugguauuaggacugacuguaugauuuuaagauacaaacaugguuaagaacuuagacauucaaaucuuuuuuuuuuuuuuuuuuuuuuggaggcaggguuucucuguauagcccuggcuguccuggaacucacuauguagaccaggcuggccucgaacucagaaauccgccugccucugccuuccaagugcugggauuaaaggugugugccaccacugcccggcuagacauucaaaccuuauaaguaaaauccuggggguugggaagguagcucaguuuguagagcucugaguuccacccccagcacagcaugcacuaggcuugguggcucacacuuauaaucccagaauauaggagguguaggcagggggaugaucaaaauucaagguaaucuuuggcuacauagugaguuugaguccuuccugaaauacaugagacagacauuucaaaacaaaauggaaaugggaacggugagaugguuuagcugauaaaggcacuugcugcuaaaccugaagaccugaguuugaccccagacccacaugauaggagagaaccaacuccuuuauauuguccucugaccucugugugagcacuugcccacacucacccacucacacccuccacacacacaauaaaauacauucaaagacuacaugugugauguccauauauuggcccaaugucaagugcuaggguguagccaaguaccaggagagcugaacaggguugcaucuggcuucagaaggaaaggcuguuuauguuuaggaagauugauuagagcaggauucugcuaugcucugcuuaauguuauuuuuuuaguuguguggaaucuauucaacaaacguuuggguauucuucuguugcugguguuguccuuaggaacucugcaaucugaagugaagaaaaugcgaagaugauucuugaggacuuaauauucuaguuggggcaugcaugguugaguauacauuuaccagaaucuugggaguugaagguagaaggagaagaaguccaaggccaaccuucaugacauagugaguuugaaggccagcauagccauaugaaacccugacucaaaaaguuacuagugagguuucauuuucuccucaaagaagacuucccuguugaaucaugugcuuggacuacauuccugaaaacuaacucugccauauaaguauagcagaugacuuuuuuuaaauguaauuuucuggauaugguggcacaugucuuuaaucccaacacuggggaaggagaguguguggagcucuguaaguucaaagccaaccuguuguucauagugaauuccagguuagccagggcuacacagugagaccauaacuuaaaauuuuuuuucuuacauauguauuccuugugcauauagcuguuugcuguggggucaggaaauggaacuuuagguccucuaggggagcagcaggugcucuuaacgauuuuucccaccagcaagcaauuuuaugugcaaaggaucucuuuaaccacuuuuuauaauucagaagaugaauauauauacauauauauacacauaaguacauauaugcauguauacauauaaaguuuacaauugguaaaauucaguguagggccugacacuggaauaugguacauuaaugauugcuacauuccuauagaucuugaaugugaagaaaaaagguggaggggccuuacaaaaagccacugguucuagucccccaggccacuagugaagucccacggugacuugggaggguugggauaugccugaacuuaccaaaaguccgauggagauucucugaaaaggacaaauaagaauagacuuaguaaggaacugaaagggagucccuuccuuggaucuaucuaaaucccucaagguugguucuagcccugaugcaaaguaaaccgugcuauaagagcucgggugaaaaaaaaaucuaauuuuuagcugucuauagucuuaaauauaaaguucccaauugaagggagcauggagcauugggggaaaggcagaaauggucugaagagagggauauuuugguuaaguuauaaagaccagaagaggaauuggggagggagggugucuggaacucaccuacuucugcacgaaguuuuccuaaaauagaaaaaagcagguauuuuaguuccugaucuaacaguaugaggacccuuccauaccacccagcaccuuggaccuuuguguggagaauucuuugauggcccgggagcaucuuagaauaggaagagcucuagauuugaaaccaagaguccagucucuuucugugaauauugucugauuaaauaaugaaauaaagagcaugagagccuggaacugauagugauugguugcguugucugucaucacagcaaggacaaggcugauuaugucgaucuagcuggcuucuuuucuuacaacuccguaugugucccucccaaaacuguuugcuuggcuggagaaaaugaccuuccagaagaacagggcccacuguucuuugguuacagguauaacaaauugcugcaguucacaacuggaaccuccaaaccuuuuugcauuuaagaaugcaaaagucuggggcuggugagauggcucagcagguaagagcacugacugcucuuccgaagguccugaguucaaaucccagcaaccacaugguggcucacaaccaucuauaacaagacuggauacccucuucuggugugucugaagacagcuacaguguacuuacauaucguaaauaaauaaagcuuaaaaaaaaaaaaagcaaaagucucaggaaccugcaauguuccuaacauacca

SEQ ID NO: 8600 - RNA, 29539 nt, Mus musculus
ccccucccuuccccccgccccgucuuccccugcacccuccuuccucccuccgcccgagagcuuccccgguccccggcgccgccuccuucccucccggcaccgugcucucgcggccgccgucgccccggggaaggagagacgggggugggguuugcggguagcgaucgcgaaggggagagaccccggccgggcuggagccuggauuccuguggaagaagaacagggggaggggaagcuggaggaccgggagggagaacggggagccgcggccgggccugggcccuugaggcccggggagagccgcggagcgggaccggccgccgagguaagaccggggccccacgaccggggcuuggcaaggaggccgguggacguaggguagggccggggggugcgugggguucgggugcgagaggcgagugaugggguagcgggaccccugagcguggguaagcugggcuagcgcuagccacaggggcugcugagaggagguggagucccgggaggguggggggccgagggaggccggaggaggguggggacaggcgcucucuccuccucucccccccagcccgugcggcuccgcccccgccuccuccgcggggcgcccuucgcgucccgaaccgcgcgguuggagcccgugaggugcgcggagcgagaccuguccgucggcuggcccaggccgcggccggcgggcuccuccgugcccucacuguugccuuuuccucagaugcugcugcugcugcuggugccucucuuccuccgcccccugggcgcuggcggggcucagacccccaacgucaccucggaaggugcacccaucuccggcgcccuggaccucuuccaccccacagcucguuuccuugcacgucuccuuuccucaucacucuugcggcaggaccuccccccgcccccaucccuggcauccugguccgcagccacuucacaacuccugaccuccuuucugucacuccgcaucaccaccagcacccauuuccucuaccucacguugcuacacuacaccguuuuucugugaccccgaauuaucucagccccaccucccuuuccgggccccacguuacuacagcgccccccuuccguaguccaccuuguugcuuugauggguuugugugguccuuguucaguggguuugugugguccucaccgguauucuccuucggcccugucccucauuuaaaccaccgaacauuauagcccuuaggauuucuucuuagauauuugucuccauuauacuucuuaaccgguggacucucgcaccagcuuuagcccuaacccacgacgcuggguucugcagcuugggguucuuaacuguucccacucccagcuuccagucgugugucccgugugccccuccuuuucugucccccugccccaaccccaccauugaccacgcccugcucuucccccuuccacugcgcgcugccuucccgcucccacgguuccccugugccuccccauucccucucagguugccagauuauacauccgcccugggaagguggcaucagguaccguggcuugacucgcgaccaggugaaggccaucaauuuccugccuguggacuaugagauugaauaugugugccggggcgaacgcgaggugguggggcccaaggugcgcaagugccuggccaacggcuccuggacggauauggacacacccagucgcuguggugaguagccugggaagccacccaccaucccugcccccuuccuucaggcccuuccauucucaguugcagaccauccuuaguuguuuugcaagucagcaauuuaaauccaguggaaccaaauucacaaauacguuuaaugaaugaguacuauguaggaggagggguguugcugugagcagcuagugggaggaagcaagcuaagcagccagcacauucacuucaucgucuucaugaggauacugaucauugggugaaauaacuuugauuuuucaucugaguuauccuuugagguucauuaaugagagauuauuuuuuaaguuauaagacgauuucauuacauuuucugacaccuuugucucccacucaaugaccauauaagccaguuuaguaguaguauagaccagccauaauaagaaaagcaaaucuggucuugcauccagguuuacguccauccacacauuucaaaggcagaagaguacccacuuuacugugcuguugagcaguaucuguuuugugugcuuauagcuccaucuugaguuccuacaauagaaaugcuauuuuuuuuuucugauaggaaugugaauacuggggggggggguagggcuggggagaacggggagguagggaggcacagacauugcacaccugauuuccuguggagcaggaugcuugugaacccagacccaaaccuaauucucuguacucccuaggggaaggauccucuacaacuugccuuuuuucuuauuuuccugucucuccacaguccgaaucugcuccaagucuuauuugacccuggaaaaugggaagguuuuccugacggguggggaccucccagcucuggauggagcccggguggauuuccgaugugaccccgacuuccaucuggugggcagcucccggagcaucuguagucagggccaguggagcacccccaagccccacugccagggugaggggaacagcugccugccugcagcugaugagggugccugcccuagaaugggaguggggugggaguggguagagggaauggaugguugcuaugaagaaugucggggaggaguuugggaggaugcaggugaaaccuaucuuuacaccacccaccugccucagacuugguuccacgguccuuucuguugggcuuccccccacccuccuuuccuuuaguguguucuuccugauuucaaaucuuggaccuuuuuuauuuuuccuucauuaaucucaacuccgccccccucagcuucuuaaaguuaaaaaacugcucuccccaccucccuggaaaaaacuacccuccccccccaccccccguagacuuagaacauccucuguaucacucuucuaggacugguccuuugcuauucacucuauaauggaauugcuguaaauauucagaauuaaaucauacauuacauuuagaaaaagucggugagauaugggauuggaaacauggaaaaagcaaaaaaauuggggcagaaugaccagaacagugauaauucaagggcagauggaagaagacugagucuuguguauacuuuaacaaucuugaucauuccuugagggaauaauugauugcuuuuguguuugcuacccccuugcuugccucuuugcugucuuuucugcaaacgucucccuuuucugggcacccaaacucuuguauauauauacucuucucuccuggaaugaauuaagcuucaggguucuucauuuugacuaaguccuuauuuugagcucuuaagacugugugcauaugcuaaccaaccuuuggagaacuuacuaaacuaagguauuuaaacagcacuuauuuaaaaccaauuguuuuguaauuugucuucuuaaagagaucauagguuuauauauacguauauaauauucaagcucuacaaaacucagcugcacccgacccccuuuacuugcuggaacaaauucuguuguccuuugaauaauugaagaaaacacgaguccugaccccuagccccgccuugcucuuauccucaggcacccuucccucaucgcagucuccgcuccgcaugaacaggugugggagggggcuggggaucaggccugggaagcugggcgccccugguaacucuucucugauccccgucuuuccugcugccagugaaucgaacgccacacucaggugagaucagaaacccuuccgcgugcacugccgcccccauccccucacucuucacccuccaccagcaggauaucuuugcuuagguuguggguguccuguuacucaugucccaccacccauucuaguuugaggccgggcccuccucuccuaccuguuucuugccgccaaaucgcgguuuuccgcgggucgcgcucccucccacuucccugcuuggccacgcuccuccgggucgcgcuccucucggacucagcuuucuagcgcgaagcccgguagggggcagccgcgcgccggaggaucccagaucucuccuucgugggguuccuucagaccucggggaccuacucuugccacccccuacccagguuuuaccugcgagguuccgucgacccuguucacuggucccacccaugcgagccucgcauccucuguagacccuuucucccaucaccuuucuuccagccuucccucaacuacacuauccuucuccuaagcugcacuucuccauaccaguucuccccuucugcaaagccuuucccaucgcucucgcucuuccuacccuuaguuccucgcuccaucuucccauaucccccuuucagaacugucaccuuccucuccuaaccuacccacccucgcuuccccucuuugcucugugcuuauccucucuccuuccaaauccuuauccucuccucuagucuccuuaggcagagacccuucccuuccuugcgcucucccucuucuccccuccccuucgggccucggcacuggcuccuauccccgccuccagcccgugacgucaagccccccuccuagcuccuuuucucccuccucccuucugucggucggucagucggcgaggagaguccgcgguggcgggagcgagcgucucuuggcccuaggaagcccacgucucugccuuccccgggcucuggccccuccuccccaaugagaccggggauggaggcgccuccccgacgcccucccagaagccuuccccagaagaaguguccccccugagcugcccccaccccaaggaggccgcccccgccccuccucgccaugggcccggggggacccuguaccccggugggguggccgcugccucuucugcuggugauggcggcugggguggcuccggugugggccucucacuccccucaucucccgcggccucacccgaggguccccccgcaccccuccucagaacggcgugcaguauacaucggggcgcuguuucccaugagcgggggcuggccggggggccaggccugccagccugcgguggagauggcgcuggaggacguuaacagccgcagagacauccugccggacuacgagcucaagcuuauccaccacgacagcaagguagucggggugagggacagcguggccgggguggugggaggcgagggcuauggauccucuuugggacugugaagcagaccccucccgagagugacugguuggagacgcacaggaggugcgggagcuuugggauaucucaguggcucugaaggccgacucucuugaaggcaguaggagauucacagaaguggugggggucuuaggugcugauccucuaaaguaagcuaucccuggccaggguugggggcuggaagggacgucagaggugggcagcuggcucagggguuuacauuuaccaugguaacaagguaaaucuuggcguagguuggggcugaaaggaauauggagagaaggggggaaggauuuagagaggcaagagggcucuacuuuaucugucaaaacaaacagcaagguaaagcugccugacucuucaucucuaucucuuaggggauuccugugagaauauggccuacagcucugggaaagacuaauaaugguuaagaggugggcugaggcacugggagagugaguguauuggggguccauaaggaaccccuacaacagcauuggggaugaagagucaguguacagggagaucaaaaagaauggaucggggaggggguggggaggagggugggaacagucagaacccugggccuccuguggaaccuggugggggggggguccugauuuuagcguuugguuuuauuauggccuaguggaucugaaaagagagaaaacaggauguaguuuuggggaagaggaaaagguuggucguggugaagaaauuuugggguuagaggauggucuauggugagauuucuuuaccaagucucucuccaagagggaacugacaggacaaaaguuuggguccuuucugacauguggcuccagcgauuugagauuagaaaaauuguacagguggaagauuuggccauuuuauucuugggguguguggagcauugguaugcaccuaaaaauagacaugugucuccaaaggggacagaaaugagccugcuggcagaacacuaggggaaggggcuuggaggggggaaaaacccccaacaacauaaguucccuugaauuuuugccuucucugugggucccaaacaucagugaacaaacacaccauuuguuuaaaauacuaguuugaacuccuuaggaaggauucccaaguaguuucuucguuuucauccauagagauccugccuagggagauggcuguaugcagcuuacuccaggaugccugugggaagagaggcagagcacaagaaaaaaaaaaaauuacacgugagggaggguagggaggaaggaagaagagagagggucuugaucugguuagagagcaacauaggucauugucugugagggggagaugggaagagaucagagauggggcacuacaggaagauaagggaggccugacuugaguucaaauucuucccccaugacaagugauucccuagggguguuggggagcaaaaggggugggggccacuagaagaagguagacaugaaggagaggcuauggugcaguguaggucuccauccuuggccaguggucaguuaggaaugucacggguugggguaaaugguugcgugugggguuuuuguaagagcagguagagaagagaugaagcagaagauggugcacacauuaggccacacaggcccuguuuuauguaacuguagguuuccgaguauccugauuguuccugugaaauccuuucuucagacaaacaguggagggacacuuucaggauucaggagaagcuggggucagcaucuguucuaagucagggaggacccacuaaugguaaaaaauaauaacaauaauaauuguaaagaagcugaguaggaagcagguuccaaaccuacaggugagcccugcccuuggcaggguggagagcagagcaggcagccguguucagaguaugauuuuuuuuguuuguuuguuuuggguuuuuuuuuuuugggugcucagauuugccagcucccccuggcucccugggcuucuugucuccaauuccccacagugucucaaaugucaggccucaguggggagcaagcagacuccagauaccuucuuuauuuucuuucuaacccccuccaccaaguucacccucuccaguccccugugccucuagucucuguuccuucugcucugacuccccacuggcugucauuucuucucugcuucuuuugggggcuccagcagcuucugaaaugucaugcuucagcaggaggggaacagacaguaggggacccacggcuggcccuuccucccccaauuuucccuccuaccauucuuucccucucuaagcuuuccuguuucaucucuuucaggcaucucuccuaucaucuggcuuguggagaauuccacucuaugucuauuuaucuggaucucuuuuauuuuagauucuucugcacuccccccuccccccuuuuuuuuucuaauggacucgucaaaugucagggcccagcaggaaaggacagggugcagagcagacacccuacugaucuuguucuuguucucugaaauugaagguggaaauuucauugagggagcugccuagggaucugcagagaacguauuuguauuuccugagcagauguucagacccuauaaacaugggaugaggugggguacagagaugaccaaagagagugggcuuaggguuguuugagaauaagcagaagugggagacagcagaguauguguuaauauggaaggaagggcaugcaguuuugaguagggccaacgugccagaugcaagacaagagaaggacgcuuaaggcaaaagcaaagucuagaaauuugacaggaagaagaaugcggugcuggcagugaauaguuaaggaaaggcacuagguugcccaagacacuaggcaaugugagauguguauguguguguguguguguggguaaggggcuugggagccaaccuucauuuccuccuuccucccucagugcgacccagggcaagccaccaaguacuuguaugaacuacucuacaacgaccccaucaagaucauccucaugcccggcugcagcucuguguccacacugguagccgaggcugcccggauguggaaccuuauugugguaugcaaggcagggggucacuuccuuuugggcuggguugaguagaaagcucauggcuauguucuagaggacucgggagagggaccacugccaggacucagccuacuuuuuuuuucuuuuuucuuucuuucuucuucuuuuuuuucgagacaagguuucucuguguagcccuggcuguccugggacucacucuguagaccaggcuggccucgaacuuagaaauccgccugccucugccucccaagugcugggauuaaaggcgugcaccaccacugcccgacccucugguagaauuucuugaagggcugugaggauccacagauguguguguguguguguguguaaaucacuuuucccaggacaaagauggggaaguuuagagaucugggagaaaagucagggccaagaaagcaguaaggacacugcuagcaugcucaguuugcacggacacuuccccuucuucugccucagcucucauauggcuccagcucaccagccuugucaaaccgacagcgguuuccaacguucuuucggacacauccauccgccacacuccacaaucccacccgggugaaacucuucgaaaaguggggcuggaagaagauugccaccauccagcagacuaccgaggucuucaccucagugaguccagacaagggguggggcgugaggucccaggggcaucugcucuugcggggaggacgugaugguuuaucagaagagaacacauuccaagugggcgaagugcuuguucuuucuguagccuggggaacacacgaauuggauuuuuguaauccucucugccauuucgauuuguuccccagacagauaggacucuguucuaugaaaguagguuuaauuccaaguugaaacaagaggggcuaagaaguagggucuuagggaaguaguggauuccagugccuucagggguagagggugauuggcagcuaaauauggagcugcugaauggaguggaaaagaagaggguaaaggggcaggcagauggauaagagacaaaugacaaguguguggguuugguaguugacccggagagaugcuuacagacaguuugaaggacagggagguuugcagaggcagagaggaaauggccaggcuccacacuggagaaaguagccugauucuucucuuuguuucucuucuuugagucuucauuauuuucaguggcccuuuaauuuucccuucucacuuucccucagugacucaguccauucuccugugauccuuuugauggucugcccacuugccucuugaguuggcaccauucuguguauuccagacccugcccugcuuuuuuuuuuuccccguuguuuucuucucaaaguccaaagaggggaagauggggcaggaucccuggauacagaucuugaggaggggcuugucaugcaucuuggaagcugccuccuaagacuggaggcacuuucuuucauccucuccucaugggguuuaggggcucuuggaauaagguucagauccuauuccugcacugcgaguauucggucaguucuuggccgcaagcucugcucuaucuauacucuugauguuucuuauccccacccaagacacuggaugaccuggaggagcgagugaaagaggcugggauugagaucacuuuucgacagaguuucuucucagauccagcugugccuguuaaaaaccugaaggugggagagcagggaugguaggcucaugccuugggguuggugugggugguggucagcaaggugggagagcaggcaugguggacucagcccacggugagaucagcgugggugguggucggcuggagaggaaaaccuggaagaggcaguuguucauucugugagacggcucagucuccugggaagguuuaguuccgucuuccaguugacauuuauccacugcccauucacugaacauuucuuugcacuaagcacuuggagcuaggaaaucaacgauuagaaagcacuggcuuaaccccucaggcgcucuuagcaucccucaggagcuccgucucuguuucuguuuuauagcgucaagaugcucgaaucaucgugggacuuuucuaugagaccgaagcccggaaaguuuuuugugagguggagauggaaucuggaccagggaggcagggcuggaugggcuuucuacuggugguuuuucuccuggguccuccucacugcaucucugcucaaauugauagcaaaugaccagaggugauaaugaauaccaggccugucuguaggccugacuucguuauuugucuauguucagacacacacgcacgcacacacacauucucauuuuauugcuuuguguuuuaacucugucuuuucugaguggccaaaggaggcauuuuguugagacucuccuaugauuugaagauuauauaguggauuucagugaagauuuuuuuuuaaauccugaucuuugauucuuaagggacuaaacaguauguaaugagcuaacacuacuugccccagaacaaaaacaaaccuccaaugcuucccucccuacuuugaaugcaggucuauaaggaacggcucuuugggaagaaguaugucugguuucucaucgggugguaugcugacaacugguucaaaaccuaugacccgucaaucaauuguacaguagaagagaugacugaggcgguggagggccauaucaccacggagauugucaugcugaacccugccaacacccgaagcauuuccaacauggugagggaacaucgaaggagagggaagaggcagggguugagaauagcaggggaguuggggaugggaaggggccuguacccaucuugagcuuguuugcgucauguucuaccugugcuugauuuccuugggcgagagagaaaaauuguggagcauacaguaggcuucugaugagcggaagggcuguuaccauggaaacaaggagcaguuggugagaagucaagugagggagagaggcguuaaugguaauauagucuuguacaugaagcacacuuuucccagagagcuucccuugagcacugauguguucuuauuuauugcuauuauuuauuauuguuguuguuguuauuuuugugugucugacuuacauuaguaccucagaggguugcuuaauauucccuuucuuguuuucuuuucuuuucuuucuuucuuucuuuuuuuuuuuuuuuuggagacagagucuauguagcucuggaugccuagaacuggucauguacacuaggcuuucgucaaacugacagaaauccuccugccucuaccucccuagugcuggcacuaaaggcaugugcuagcaugcuggcuuaauauucaguuuguauccaugugaaauuaauuuuuaguaaucuucuucuucuucuucuucuucuucuucuucuucuucuucuucuucuucuucuucuucuucuucuucuucuucuucuucuuuucuucuucuucuucuugaacuuuggauguacacaaacuucagaaauccuuuagccccggcuuguuuucuauugauaggcacuuugaaggcacacugucacugucuugauuuagagguccaggguagcccuguguguggggugaugagcauggguguggaugugugaggaggagauccuugcugcacagcacccacauccacagugcagggaucucuauaguucaguagcguaaccuguguaccuaauguaacuccagcugugaaaaaaaucagcuuucagaggggugaacuaaugauuguaauaauggcugauuuuuuuaugaggaaaaucaggauauuugguguauaauuucuggaucuuaacagcaauacucuaaaauagauuuguuauuucuaucuuaugagcuaaaaaauuggaaccaggaagguuuagugacauguccuggguuaugcaucuccucgugcccuguggaguugaacuccagucugcucugccuuaucccuccccauggcaaagcacaaugccugacuagaaucuuuacaccuucaugugcaaauucuguuuucaggcaauggugguguuuuaucaaagcagaaaugagauucgggaaucugcuucuggaaguagguuaugguaaaaaggagggcugccaugugaauucuggcuauaaacuguguucuacaauguucuagcaggaugcugugcuuaauuuaccucaauuaaaaaugacaguggagaaacacuggauaaccacucacuccccuguacaggacaagaaaacaaucauuuuuuccagaaaccaagguaguggaguaggcuaccaaaaucagaaaggcuuauaaguguccaaagccuagaaccugccacccaaggacucugucucacacuggggagagagaagggacugaugagagcuuggagggggugucacuggauauuugggccuugggguaggauaucuuuucuagcuuucgauuuucagagaacacauuuauuuauuuacuacuuucuuacuuuagaaggcacucuuuucucaagaaagcugaaggccuucuugagaccccagcuaaaaguguuagguggaaaaaccuagauuuuuuuuuuuuuaauaguggaaagaagcagucuuuucaggugauuagggaaaauuauaggcggaucaaauggcaccaaaagaaguggaucagaguaagagucagacugaaggauggaauggguaggaccauagagaaacagcagaauugccgcaaccccagaaggauggccucaggugugcuuggaucaguucccauacuccuaucagggccaccuggaaaauuagguuagugaacccuuucccuggaguucccuagaucugaggugugggaccugaggacuucauuucugacaaauuccugaaguuucugaggcugcagaucuggucgcccaugagaacuauagggacgugguuuucaacagagguugcaaugucuggagggugaggaugagggagggguccucuaaauaucuuaccaugcacacaguucaacccccagcaauaagacuucccugauuaaguaguucaacagcauaggaauugagaaacccugguuuauagaaagaaucuuagguaucauaucuggggaaauggaggauccgagaugauauaaacccgacccuaccuccucuagaaagaaagaaagagagaaagaaagaaagaaagagaaggaaaaagaaagaaagggagaaaagaauaaccauaaucuuugcugacucaaaggggaagagugguuuuucaugauuuucaguguuacuccucuuggcuagcuguacuguccugagugagcugagaaucugaggauaauaucaugcugagcagauuaaucccuucccaauauggugauuuucugauggaaucuuuacuuugaacugaggauuggcuagaccugaacgcugaaggccugacugcucagaaaguguuagcucgcugcugucugagagcuuccaggacagaagcagcucagggcagugcacaguaagcacaaugauggaugccagacacccugggcuggaaucccagcaucaccacuggcugcugguaguuacaggacccuguguccuuguuuccucaucucuaacauagagaucauaacaaagcacauucgcugaaaugucugaggauuaaacacacugaucugugugccucgcacaaaguaaggacaauuuaaauguagcugucaccaugaccccuaccaccaccaccccaguaucaccaccaccaccaccaccaccaccaccaccaccaccaucaaccucuuuucucuccuccuguauagagggaugguauuaaugaaacauuagaacaaacagcuuaagaggauuuccugauuugauauguauuuacuuggagucuuauucacuggacacugggaguaugagaaaaaaaagugagcuaaguuuugugucuuuugugguuuuuuuucuuuuuugucuugguuuucauuucacguauuuuuaagcaugugcaacuauguauauggaggugccaguggaggugagagauaucggaucccauggaacuggaguuucaagggcucuuuacaguagcuucugcacucuggaccauugaacuaucuccaaccuaccugccuuucuguuuuguuuuguuuuguuuugagaugagagucuuacuauguagcuuugguuagccuugagcuuagcuauguacaccauaauugucucaaauuugaaauucuauuuauuguuuuugucuaccuccuggguuugagauuauaggugugcaccauuauggacuacccccaccccaacccuucucucugaguuuggucuuacugucuugaccagguugaucuugaaccuacagacucagacucacacccccacacccccuuuagcuucauaaguagcuugguuaugcugcuacuguucuuccauugaauuugagaucaguggucauauauagccacaauguguuugaguaaaugggaccuacaagauguaagguuuggggucagaauuacaggccugagcauugggaacaaagacaagggugcaaccagggagacucguagagagagaauguaauauacuucauacgcaguguuuuauguguucuuacuuaauccuugcuggagcacuuuaacacaguauuauucccauuuucaagcugaauacucaguuuagugagauuuaauaacuugcuugagauuucuuaguagguaagugguuuaauuagaguuagaacccauucaucuacuuauccaaccagacuuucuuuuuacuuggagauguuauuguuuuagguucacagaaaaauugaaaagaaggcccggaguucccauacuuccccaugcacaccuucuccauuaucagguuacaccgccacaggaguauacuugugaauguugaugaucuuuaucaaccagcuguugucacucaaagcuuguggcuuauauuaggaccagcuguuagaguuuugcauuccagggguacacguggcgugugucuaccuuugcagugccaugugaauuacagauuuccaggggcauuuauaguauguccacuuugagcugugcucaacgauagguaccaguccucaagagaggaauggagcuucuuucuguucuaguguaguugagcccagaccuuuguguuucaaggcccaagcuauuucuagaaaauuagacagaaaaauaaaugucuuuagggcaugggaacaagguuuaaagauuuuuuaaaauuucauuuuauccauuuauuuuauguauguguucacaccaaggugcauaugugaaggucagaaguuaaccuuuggguguugguucucucccuccacuauguguguaccagaaauccaacucaggcuuggcaguaaguaggugcuuuuacaugcugaaucaucucacuggccaggaacaaagauucuucauucguguaucaucucugcuuuguuagagugugccugugaacguucuaaacccgaccaauuaucugugcagugacucugugucauacaagugcucugccaagacaaauuuaaauguuuuccuaucuggucaggaagggaagguaugauguucucuguuauguggaaggcaauucugagagguucaggaauucauucacccauaaguaagaaagccaagcagagcuauuguaagcuauacggccaguucucuucauccaugaaaguuaaagggauugccguucuuuuuagguuccuuagaaaaaagguugagugcaaaaaggggugugaauaggacugaaucuggaccuguaccaugugaagacugcuuccuguggcugucgccaguccaaggaggcagccaacagaagucauaucagacuagcgagaaguuagcucccuaaagaacaauccuccugguucgcaggcagagugcaaaaggcuguggugucgccuuuucuggaucuuucaaaauuggaggaguuguuagcuccugggucaccucugcuguaagagccugaggguugggagaaugccagcugccugcaauauccaucucuuccuuggcugggucuuugcuucgcucguuugccauucauuucccagaguguuuauucaucagauuucucuguuguuuguaguucugagcuagcagcuguacacucuuaagaccauuggacucagcuaauccccgcuuuuagucuuguagcuuccaacccaagauagacacauggguauagcuaacgauuuugucuguacauauggucuaccccacaacacgaacacaaaccauccgcucgagucacagugucugagccagaacugaggccucucccccugcgcccacgcacauuucaaugcucucuccucuuguucuucccuccagacaucacaggaauuuguggagaaacuaaccaagcggcugaaaagacacccugaggagacuggaggcuuccaggaggcaccacuggccuaugaugcuaucugggccuuggcuuuggccuugaacaagaccucuggaggagguggccguucaggagugcgccuggaggacuuuaacuacaacaaccagaccauuacagaccaaaucuaccgggccaugaacuccuccuccuuugaggguguuucugugaguuacagcagcuucuguugugcaccccaugaaaagggagaugccuggaaggucccuagauacauuuucucaguuaucuuucugucagaaucaguaaagccgucuuagacuauggaggugggacccccccaaaccagaaagccauacaaaauauggcagugaaaagaauugcucuauucuagugcuuuucaagcuggucaagguguuuacaguuuaaaaaaagagaacgacuugagaauucaucuccucauuccuuuuaaaguaaggaaauuagugcccaguaggguuuggugauugcuccugauccucucucggggggacucucuaauucagaucuuaagaugaaggaagcuucuucuccaaagaauacuguuuccagaaucuaggguaugugcaucugggguguguccuacaugcagcggacggaugccauaaauagccuucauucagaagcucaauuacaucaaaaacagaagguuucggagucccugauguucucuuuuccuccugcuuuuauccccucugccuuccuccacauguuucuccucagggccacguggucuuugaugccagcggcucccggauggcauggacgcuuaucgagcagcuacagggugagcccgggugugagggggcucagggaggggcaggcagggcugggcagggacugggcugagggcucucuuggaagaacauugaucagccuccacagauugccagguacauuuugccuacauugcauuguguucgucaggcuuuuaaauacugauaaaaagaacauggguaggaucuuugcagugauucuguucuuucaaaggggcauacagguuaaaaaaaaaaaaaaagcagcuguucuuucuucccaguggcuuuaguuuuagucccagaaguugccugccugaggcuggguugaaaggugaagagcuguccaaaaaguguguccaaaaagaucaaggaaagcuggcuucuuuuaaaaggaauucacucaguuccuugcuaugugagaacagcauuccaguccuacuggccuuucuagauagcguucccuguaacuuaguucugaggagucugcagaccuacugugaguuaauccuuccguuccaccugacuuagccucuuguggguguggccaagagacccauuucuuagccucugggaaaaguuucuuucucccucccucccuccccccaccaacgucugccaccaaauccucucagcucucuuuguauaugggacaagugaggcuggacuucagccagggcgaagugggugugagauggcguuuggaaggaaaguuguauuaacuguggccauucugcaaagagacaccuuaggagugacugccuuuuacugccuuguacuuuaagaggcagauguaucuucuccaaggcauuagaacccaagccaaagggagagaggguucuaaaauuaaagccacaggggguggggguggggggggcggauccugcaaucuguccaucauaagagggagaacaggcagaaauuguuuaaagcuuuggaagcgagagacguguugcugggagaggugugaggcaguagaagaugugguagacgcgccacggugccuuccacuguggagccucacaugcuuaaggguuauauuacuuauucauauauacacacauacauauuuauuuauccauacacaugcacugcuuauucauguauacuuacugccuugggaaucaccuuguguugcuguggauuuagguugccuacccaggugacuuggguccuuacagcauccuugaguugcuuauuauauacuauuauaugcaaccacggagagcaaccuugaggguaauggaagcuugagaaugucuucuccuuacccacggcaacuccuguccucugcucaggcggcagcuacaagaagaucggcuacuacgacagcaccaaggaugaucuuuccugguccaaaacagacaaguggaucggugaguucuucuucggugcuuucgaauagucauugucagacaucugaaugaggaaaggugcuuuuagguggaaauggaaggugggguuagggcagggauugggagugagcauagcccccaagaagggaggagaggugagugggugaagcuggagcaggccagggguuaccuucuuuuuuaauagugcucugcuucagugggugggacuuaaaggcaacagaagcugagagaaauggaagcugucauccaaccuugauauguuagaaccagggucuucaggucccuaucagaacaguagcugccuaauugcagggcagaagauagaauuucaugcuguuuuuauuggcucuuuggggcuuuuuuuguuuuguuuuguuuuccccucacguuuuguacauuuguuuguguacauguggaggucaggggacaacucaaaagaggccucuccuaccacccuguggguccugggaguugaacucagaucaucaggcuugguagcaagaaccuuuaugcccugugccgucucuccagcuuuuaucuugguuuuugguggguuuucccuccccacacacuuuuuucugaaucaaggcuucauccuauagcucaaguugcgcuugaacucauuaugucagccaggcucaucuugaagucagggugaucuuccugcuuuagcaucucaaguguugggauuucagguguaaaucaccaugccugacuuacauugcaggauuuuuuuuuucauguuuuguuuuguuuugcucaaaucccacuguguaccuuuaacugacccagaauuugcgauguaaacuaggccugccuccaacucacagagauucaccucucucccucuuccuucuaaaugcugggauuaaagguguaugcacaccuggccuaccaugcacuuuguaaacauuuauuuauuuauuuauuuauuuauuuaugagugcucugugugcauauaucaugccugccggaagagggcaucagaucccacuauagaugguuguaagccaccaugcgguugcugggaauugaacucggggcuucuggaagagcauccagugcucuuacccccuuagccagaaaugggcaccagaaucccuggaacuagaauuacagaugguugugaccaaccacgugggugcugggaacugaacgcaggucuucuagaagaacagaguguagccgggccgugguggcgcacaccuuuagucacagcacuugggaggcagagacaggcagauuucugaguucgaggccagccuggucuacagagugaguuccaggucagccaaggcuguauagaaaaacccugucucaaaaaaccaaaaccaaccaaccaaccaaacagaguguucuuaacuagugagccaucucccccaaccccuguuuugagauagauucuuacuuuguagaccaaagugaccucaaaguugucaaucuugcucuagccucccaaguguuaucuccaugacugugugagcuaacauaucuaggcgcuuuacuuccuuuuuuuuuuuuuuuaaauuauuuacuuauuuuuguagcuugaauuuaggccaguguucuguauaguuauaaaugccgccuggccuaaauuggcuuuuuuaauuuuuuuuuuuuaagcugagcaaauugaaauuaaguagguguuuugcaucuuccccaccccaacccccuuacaaaagugaguuuccucuuaauaguaacuggaaaacaguuuuggggaacgugucccugcuaggacuguucugucuuuugcuaggggcuagaagaccacgcuggauauucuuuuggcuuucugcuucuguaauugucuuuugcaccguuuuguggagugauugaugaccuuauaagguuauuucaccuguucccuucuuuucccuccuuuuccauugccauaaggcagagaaacaacaagaacaagcaauaaaagcuggccaugguggcucacacuuugaaucccagaacacaggaggcagaggcaggaggaucuuggaguuugaggccaaccuguccaggcaaaucuaguucugagagggaggggcuacauggagaaauccugucuccaaaaacaaaacaaaacaacaaacaaacaaauagccgccccaaacaaaacaaaacaagccaaagcaagccaaccaaacaaagaaaagaaaagaaaagaaaacaacaacaacaacaacaacaaaaaaccaaaaccaaaacaaauaacccccaaaggaacaagcagucaaagacugagucccucuuuggcacagaccccacugucuuauuucuacgagauucucaagguccucaguguccuucagcaaucugcccacugcagccccucaguguguugagggccucaugucuucagcccacaccaacucccucccucagcagcuugucucucgccacuuucuccuaucuugccuugaugccucguccucccuccuuuuucuuccccccccuccuccccugugccaugcaggagggucucccccagccgaccagaccuuggucaucaagacauuccguuuccugucacagaaacucuuuaucuccgucucaguucucuccagccugggcauuguucuugcuguugucugucuguccuuuaacaucuacaacucccacguucgguaaguuucucuucugacuugaucccuggccuggcugacucuccaaauacugacuccauacucucugaagauugugacucucaaggccacaugucauagagaguggugugaugacucaccagaaacguaaggggcacgaggcaagacccuugcuucaaagcagucagcuagaaaacccaaaaacauuccaguagggccuuaugcugcagaagcccugggcuccccuagguccaguccuccguucagcaguguucuuauccugaguguucuuucugccuguccccagccugucuccuuuuucugcccuggggauagggucgugcuauugauggcauuucuggagagccgagccucccuggaggagaugggguaauucugcucuuucucccacccucuccgccucugcccuaguuauauccagaacucccagcccaaccugaacaaucugacugcugugggcugcucacuggcacuagcugcugucuucccccuugggcuggaugguuaccacauagggagaagccaguucccauuugucugccaggugaguagauggugggccaauugcagaacauggcuuuccuagcccucucaggagcaccuucccuaucuuuccucuuucccugacuagugucuccuuuccugccuccuaguaucacccucuggucucucucuggcucuggcucuagcucuggcucuucuuucugggugccagaccuauuccauucuacaguucucuggcuguuggcaagguugcuaggcaugccuuggagaggagaggggugacuuacagaagacaaaaaaagggaucugcauacagaaccugugaacaaugaugacuugucugugguguaugggcugagaaacaaaacugugggcuuucccgugggauccuugguuggaguuuaaaauguugaaggcagaauccaagcacauagaguuuggguaagggacauagcaucucagagggaggaggccucugggacugggcuuauggaguuucugguacuaugaggaaaagcuggcuucaaugauguuugaauguuucucuccuauaugaagcauccauccuuuuccugguucuucccacuggcucccucucuucacuguguuucuguccugaccaugcacugugcacacauaugugcguucacaucuucaggaagugucuguuccuagugggaucggcauguagcaggagagagagacaacuggcugcagugugacuguagaaaguacuguggacacagaagggaaguggcucacuguccauguuugagugggucucaggaaggagguagcuuuugugcauugaaggaugcaggagaucugaaagaggguaggaaagggagacugaguaaguaguucagcauagcuggguggagcacagggucggugaaggccugggaggugaugggacaugcugugucacauucaaaggugugcaggugguaacugcaggugcuagauuagaucaguaggguuuagcaagaauacccuggugcuguagcaguaguagagauagaugggaggaaugggugaaugcagaccccuucccuugcuccccucucuuccgcucuccucccuccucuucccuccccuccccuccccuccccuccucuccauucuccgcuugcuauauccugcuugcuuuuugucaucugaucauuauucccauugcauccugcaguuccauccaccauggccucaguccaaccuacuuccaguguccuuucuccccuucuaggcccgccuuuggcucuugggcuuaggcuuuagucugggcuauggcucuauguucaccaagaucugguggguccacacagucuucacaaagaaggaggagaagaaggaauggaggaaggugagcuacuucccagacgcagccuuugauccuaggcauagagaagaccuccuucugaccugucuucucuggcugucuacucagacccuagagccuuggaaacuguacgccacuguaggccugcuggugggcauggauauccugacucuugccaucuggcagauuguggaccccuugcaccgaaccauugagguaucuaucacucgaggaguugcuggggucaggaaacuagauagggcucaccagcucagcaucuccggggcuguaugugcuccugaaggaaauguguagugguacauacauaccuuuaaucccagcaugcuuucaaucccaaaacucggguggcagggcagacagauuugaauuugaggcuagccuggucuacaugaugaguuccaggccugccagggcuacauagugagacccugccuuuaaaaagaaaaggaagcugcuccaggagagaacuuuuucuguccuauauauuagggugcuucugucuuugccagauggagcuucucggaagcuucuagguuuaucugaagaagggaagucagagaccugggaggauguguaggguccccgagccuuggggaaagugggagcaaaccguucuaguguguucaggaggauguccccaggccuggaguaggaucuggcacaguacugagucucauagggaagacaggcagagguggagguucaggagcuggacaagaacacagucacucauccuguuccuuuuucucccuuagacuuuugccaaggaggaaccaaaggaagacauugaugucuccauucugccccagcuggagcacugcagcuccaagaagaugaauacauggcucggugugugggaugugggugggagguaggggagggaggaagcauaagccggagaaagggguaacagcagcaggccauggggagaagggccauucagaggagaccguuucagugccuuucucacuacacuaaacuuuuccaagaauaggagagcuuuggucuuuuugcugugaguagugauguucagcagagggccagggugggcgggugacucacccaucugugucuggccagcuccugaaaguaagugacuaaguugugaggucguggacuuagccucccuucagccugaccaacguucauccaaucuacaaauccaccuggugaacuaaaacccccucgccugcgcugcauguugcugccuggagggaauggguugagauacuggguagcauccauuggaucauuucuagccgcuccauaggaagccacagagggucuagaauggaaaugaggcguggcuuucuuuacacagaggagcuacaaagagcaguaguaagcaaagggcaaagagaggaagaggauuugaguugggaguauggcgguccuuguuaccccugaaaccuuuuccugcucuccuaggcauuuucuaugguuacaaagggcugcugcugcugcugggaaucuuucuugcuuaugagaccaaaaguguguccacugaaaagaucaaugaccacagggccgugggcauggcuaucuacaauguugcgguaagcuuucuugacaccuggcguugguccuggaaaugggccauggcaugguuaacgugauagaacuagaagauucagaaaauuagaucugagauuguuuuguguaggagucauaaaacacuggcuaaugucugauuuuaugaagucauuuuuuaaaagauguauuuauuuucuuuauaugggugcacuguagcugucuucagacacacccgaagagggcacuaaaucaccauauagaugguugugagccaccaugugguugauaggaauugaacucaggaccauuuggaagagcagucagugcucuuaaccacugagccaucuugccagccuccuaaagucauuauuuuauuuuauucuauuuuuuaaugacuuucucgaggaaacgugagcaaaucuuguaauugacuuucacauugucucccuuuuucuuuuuuggggaaggaaugcuugaauucagaggacgagcaguuuagaaagcacacuacauuggggucuggggugauaaguucugaugcuuacaagacaauuuagaacccacaucagaaaaacuagguguagugacaugugcuuguaagcccaacucugauaagauggggacguguagauccuugguucucagugaccagacagcuucuagccagugagggacccuguaugaaaacaccaaaauggagcagaaaugaaaggugagguuuuccucuagccucuguauacaugugcacugccgugcaugugcacacacauauaugauauaauagauaaggggcgggggagcuuuuucaaaaagcacaccauguaucauuuugugacaaccuggugaaguugucucaaggacagacugaaugugaggaagggaggcauugaucuagagcugagagcugguuugguagcuuaucucugauuuccuuuuuuuuuuuuuuuuuuuuuuuuuuuuuuuuuagcuauuuaaaggugaggauuugcagaguguaucacaagccugucuuuacugacucuugagaggaagaaaacucugcaucucacuugaaccacucauagcucugagucucccaaaugcugucuuuccagguccugugucucauuaccgcuccugucaccaugauccuuuccagccagcaggacgcagccuucgccuuugccucucuggccauuguguucucuuccuacauuacucugguugugcucuuugugccuaaggugaggucuggcucuccccacgggcucccuagacagaagcaggacuucgacucuguccuuacuuuggcccagccugucuuuuguuuuuuuucauuacucuuuauuggcugcucacuuacacagcccugcucagccaccccaugcccaaacguuuguccauagaugcgcagguugaucacucgaggugaauggcagucugaagcacaggacacaaugaaaacaggaucauccaccaacaacaaugaggaagagaagucccgacuguuggagaaggaaaaccgugaauuggaaaagaucaucgccgagguggguggugacaaccaggggccccugucuaagggcagauugucuguagcugagccucagguacagguucaaguguuggugauuuacggagggucucagaaagccugcagaggagcaggagagcgaaaggggaaggguugaguuucaguagugguagccugaggagagggaggaggcucuggagauuucagccuuucugaggcaaaaaagaagucuuuggcaguaguuagggggaggccauugugaaccauucauugcucacaguguuacuguguccaugcuguaguuagggaccgcgcagugcuggguggggguggggaaugaccuuccaacucaucugacauaaucuucauuuauucuuucucuuuucuuuuaaaaucacuuauuuucuccauccauucucuuggcgcuguuauguucuguggcuuccuuuguucuucccucgauucacauuuuaauuuccuuucuuacuuguacaucucguuucaaugucucucccuccccuuuccuccucccauaccacaucacccuccucccacacucccaauuguguuucuuccuccagaaagaggagcgugucucugaacugcgccaucagcuccagucucggcagcagauccgcucccggcgccaccccccaacacccccagaccccucugggggccuucccaggggacccucagagcccccugaccggcuuagcugugaugggagucgaguacauuugcuuuacaagugaggguguaucgagaaggaugaggccagcaggggagggaaggguguggggaguggguggggaacugggaagaggguggagaacaagcuccaaucccccucuuagaaauacaugucauucugugcaucugggguuaucugggucuucaguacucugggaaacagaugguuuucuuucuuuccauauaauuuuauaucaccacuucacaguuuuguuugaacccugcuuggagcuauucacucaugacuccagaggggcaucucguuugucucccauaggcugucuuguauaguuguuacuacagcaacuccugucauuucagcagcaggggucuuccuacauuaucagggcuuucucuccauuucucagcauuagaaucuccuuccaucauccuucuccuccaugucccugugucuuccucuccuuaaauguugcuucuuccaggggacucaccacacacacacacacacacacacacacacacacacacacacacaccauauccucuccucuccuaggcagcuggauguguuucugugcaaauauguucuuuucugaaugcugcuaucacuuguguuugcauaugcugcaccugugagugcacagugguugugggugugugcaguggugugcuuggguaggcgugcaugauguguugagcacaccaagcugucuuccucaugugcauaugucaugguugucuauguuuuacuugugugccuccuugcauuguguauuuuuucuuugcauuuuaauaucacuauguaguguguguguguguugcccugacucgugucagggcaggcuuccugucucagccuucugaguauugggauuacaguugucugccuagcugauguccugucuucuuucagcagaggcaugugcacccaacaugcacaugauuaagcaggcucuuccccaguacguguuuucugagccaugcauacccucuccuuggccuuagguuuacucucaaguguucccucuauucucaugcgucccacuuugggucuguacaaucaucucucagaacuacugcaucuugguuuucuuuucuuuguugucauuauuauuauuuuucagaacuaaggggaaaagaaauggggacagguuggaggcuguuuccaguggauagugggugcacauuugaucaaaugaaggcauggacagauggacugaccgggcgggaggcagcaucccuuucacacuguggugucucuugggggaaggaucucccugaaucucaauaaagcaguuaacagugugacucagcaccucauccacuguccugugaacugagugggcuccaggaagcgagaagcccaggcucucaagauuggaguuaaugaaaaggcuuugaagcagagaggugcaaagagcugugugauuguuccaugcagggauuaguggggcagagcgggaugagaugaagggcucgauuagugagugauggcauuagugguuaaaagugugggcucuggagucaggccugcaccacacgcagaaauguucccuaaucccuauucuccacuuuuaugaucugaugauagauaacaauaaugaugauucauuucucuguggagugcacacaagaacuaggcuaauuaugcaucccaaugccuggaucugcuugguccaugguaguagccucuguuacuguugccuccuggauuccccagcaguggugggcaugcucugggagccuggaguagguggcugagcagaugugaagagucuccuccucaucagacaggaagaaucacaagcaaacaaugagugccagguucuggaauaagcgccucagaacuuggaaaccguucucuaaggaacucugagcaucuugggaagaauuuuugaucaagaugaauguuugaaaagccuggaggagaaaacuuggaauuuuuguaauucuuuaaggugguucuucuucccucuugcugcauggaagcuucaaggguuggaugggccuaucauuucacuguccuguuuauggcagguuagaucuuaaaccuccuuugaaaacaacccauagugauuauccacuuuggaccaguuggauuuaauuugcguuccccucuucccuguagugggauauucucagaguaaaaaaacaaaaacaacaacaacaaaaaaaccaaaacccgcaguguagacacagauggaccccugaguagacugaaguuacaucccaauccuguguugcccuuagguggggaaaugaggaguuaaucaaagcucagccgucucacaauagccaagggugaggcagacauagcaagagaaccaaguaacccugaguagcugagcugagagaccugcuuagugccaggaucggagggagccgaggaagcagcuguccugaagaggggcugacugacuguaccugcagcuuugccucaggcaguagauccugcguucuagacaaccugcuaguccucagugcucugucacacacuuauggucuuucucgucucugc

SEQ ID NO: 8601 - RNA, 956 nt, Mus musculus
ggacucuaggguaucucauucaggggguaguuagucuuuucaucuuaacguaucuuuaaguaggacagcauuggugaggggcagccuccuauccuggugaaugauaguucuauuuggguuagcuucuaagacaggggccuauacuaugcuuuugugaccuuacagugucuuuugccauuccaauaaaacuuuacaaaaacaguaguggccacacauggccacagacugguuuguugaccucugcccuacaccaugaccugucuacgaggcuuuggauucuguaauaaggaguccaagagacggcaggggcaugggacauuuggggaagauggucagaagccucuuuugcaagcaaacugacuuugucagggucuagcacuaguagaggaaagcuagagguauuggggaggggaggcccgccaaagucacgguucuuucauggacugcaggcuuccagaaccaagauguucuccuuucaggggcauuagagcaaccuggagcacuuguuugaaaaguucuagaccagugcuggagagaugacuccauaguuaagagcacuuguugcucuugcugggggcucagguuugguucccagcaucacacgcagguccccugcaggcaucaggcacaccugcggggcauauacaugcaggccagauugcaagguggcacaggccuuuaauuccagcacuugagaagcagaagcaggcagagcuccgugagucugaggccagccuggucugcauaucaagcuucagagcauccaagccuacacaaugcuguaucaacaaaacccaacaagaacgaaaaacaaaauaucccaaauauuaaaaaaaaaaaacaaaguuaaaagguugcauuacuuacaggucuaagauuaggguuacucaauacaacuggaagaugcccugcauuaggacagccccaaaauguagcugaagagacauacuauggcu

SEQ ID NO: 8602 - RNA, 941 nt, Mus musculus
cucagcucuccucagaguccucaucuuuccuuagcagcuuccagaaugcucuuuuuaccuccuuguuccucaggguguauacaagaggguugagugugggggugcccacugcauaaaagagaccaaagaacuugccccucucucgggcauacagguuuuugggcugcagauaaacagcaaugacugagcuguagaagagagugaccacaaugaggugggaugagcaggucccaaaagcuuuccugcgccccuuugcagagcuuaucuucagcacugcccuggcaauggcaccauaagagacaaggaugaggcucagaggaacaaccacaaugaagauacuagcaacagccaucuggaucucauuauaggugguguccccacaagagaguugaauuagagaugggacuucacacagaaaguugucuaucugccugugggaacaaaauggcaguuugagggugggaggugucugaacuauggauuggaccaaaccuauagcccaagcuauaccugccaacuggcgacauagguggggguugauuuugguggcauagugcagggguuggcacacagccacauagcggucaaaggccauuacagucaggaggaugcacucuguuguacccagggacaugaagaugaagagcuggacaaagcaucccaggaagcugauggucuuugcagggccccagagguugaacagcaucugggggacacagguuguggugaagcagagguccaagaaggagagguuagagaggaagaaguacauuggagagugaagccugggguccaggguggacagcaggaggaugaguguguuuccuaggagggugaggagguaggagcacaagacaaccacaaacagaaccuuuuccaguuguggguugucagagaagcccagcaggaagaagaccacaggggagcucugguugaccaug

SEQ ID NO: 8603 - RNA, 894 nt, Mus musculus
cuuuuuuuuuuaauaaaccaaaaggaauuuauuuacaaaaugccuuacuucaacaauaguuacaaccaagaaacgggguaucaagcaauaaugaccuaagagacuccacuaaugguauuuaagcuauuauggccagaguagcuucucuugcuagcuagaaagauguccguuugaguccuccacuugcacaauggcaucacugaaccaaagggggcucuauguacagcagacacaugugaguucagcugagucacggguauuuuggcuucccuuuucuccucccucguuaguuuccuacuuuucuccuucucuguuggcuccuuccucuuuuucuccuccacuaccagcuccuuucucagcuucuucuucuuuauugccagcuccuuccucuccuucuuuguccugaauacugauggaaacugcuuuguuauagccuucccgguuccgagcaauuucaauggcaaaaaaauugaauccugggugcaaagaugguguucucuucagaguagcccuggaaacaauccagucgcaguaaagucccguaguuauaaucuucuacgaucccuucaaauuuuaagcagaauggucuccacuuuucuuuagcugauucugauuugaguucuucuggguccaauacaucuacccugagugucucaaaaaucucacggaauggaacucagauuuggucaucuacuuuggugaguuucagaaacugugggucagcugaugaaucaguuuauaauagauuucagcaugcugcauugcucgaauggcucaagccauuucaauaucagggccguugccauaugacuccggagagugagagagagcaugggcuauggacaacgcuuccccagagaccagcucuucacuuucgccagcagcauccauguu

SEQ ID NO: 8604 - RNA, 921 nt, Mus musculus
cucaucuuuccuuagcagcuuccagaaugcucuuuuuaccuccuuguuccucaggguauauacaagaggguugaguauagggguacccacugcauaaaagagaccaaagaacuugccccucucucgggcauaaggguuuuugggcugcagauaaacugcaaugacugagcuguagaagagagugaccacaaugaggugggaggaacaggucccaaaagcuuuccugcgccccuuugcagagcuuaucuucagcacugcccuggcaauggcaccauaagagacaaggaugagacucagaggcacaaccacaaugaagauacuagcaacagccaucuggaucucauuauaugugaugucuccacaagagaguugaauuagagaugggacuucacacacaaaguugucuaucugccugugggaacaaaauggcaguuugagggugggaggugucugaacuauggauuggaccaaaccuauagcccaagcuauaccugccaacugcugacauaggcggggguugaugacuguggcauagugcaggggcuggcacacagccacauagcggucaaaggccauuacagucaggaggaugcacucuguuguacccagggacaugaagaugaagagcuagacaaagcaucccaggaagcugauggucuuuucggggccccagagguugaacagcaucugggggacacagguuguggugaagcagagguccaagaaggagagguuagagaggaagaaguacauuggaguguggagccugggauccaggguggacagcaagaggaugaguguguuuccuaagagggugaggagguaggagcacaagacaaccacaaacagaaccuuuuccaguuguggguguucagagaagcccagcaggaagaagaccacaggggagcucugguugaccau

SEQ ID NO: 8605 - RNA, 4269 nt, Mus musculus
cguguacuuagcgaaucuaaucagggcuaccacgggaaggaugggguccucaagcaaccgcgcucuccugcacauggugguggucucuuuggcuguuacccaaacagguucuggugaguucaggggucgggaaguaaauaaccucuaaagagaggaucacggcaucgggaccaggugcucggggaucccuuuucugccgggaccugaguuccgcucccugccccacccccaacccaaugcuuguucacuggcccgggguuaucagggaagaguucugaaguuacccugccucgcccccaggcucacauucacugcgcuauuuccacacugcggugucacggccgggccguggggagccccaguauaucucugugggcuauguugacgacgugcaguuucagcgcugugauagcauugaggaaauuccgaggauggaaccucgugcaccuuggauggagaaggaaagaccagaguacuggaaggagcugaaacucaaggucaagaauauugcacaaagugccagagcaaaccuucggacccugcuccgcuacuacaaccagagugaaggcggugagugacccuaagccugggucagacuccuuccugucugucuacugccaaaccagaguagcccugggugccagguuagauguuuggaguugggcuucagagcucucagaaaccuuuaaccgguuucacuuucaguuuagguccaaauccuguuggcgggcggagcagggugagguggcuaaggcugacacccuguuuguggcuaggcucucacauccugcaguggaugguuuccugugagguagggccagacaugcgccuucuuggagcccacuaucaggcugcguaugauggcucagauuacaucacccugaaugaagaccugagcuccuggacugcaguggacauggugucucagaucacgaagagccguuuagagucagcuggcacagcagaguacuucagggccuauguggagggagagugccuggagcugcuccacagauuccugcggaauggcaaggagauucuucagcgagcagguaugaggaacaacuaggaaccacuuuuaguaagcaaagauaacccccucaaacauacaagugaggcucuugaugucuggggagggaggaaauaccagauccgcuggaauacugcacaaggaggaggaagagugguacuggccuuccugauccaacaucagagagugacuguccccagggcugacccuacuuucagaacauuugaaucugucccagaauggaaggagaaaacacccugagauacacaaccaaccacuuccauucagucugcagcucauuguguaccauggccucuuucaggucugguucucucaacaccccuaaugucuuuggaagucacacugcacuaaugcugugagucucugcucaaccuaaucaggacuagagaugggaaaugugaagcucccuacuagauuuucucuuagggcuucuauugcuacaaagaaacaccauggccaaaagcaaguuggggaagaaaggguuuauuuggcuuacccuuucagcacuguuugucauugaagaaagucaggacagaaagucaaauaacugaucuacaugacauggaggagugcugcuuccugucuugcaccccauggcuugcucagccugcuuucuuauagaacccagaccucaagcccagcgauggaaccacccacaaugaguugggccccacagcaucaaucacuaauuaagaaaaugaccucuagucuugccuacaauuugaucuuaugcugucauuuuguuaacggagauucccuccucucauauaacuuuaguuugugucaaguugacauaaaacuauccagugcacuaacccugauuuuagaacauuccaaggaauggaucaugauaggucccuggauccagacucccguauggugcuuacaucccuccugugcccuaauucuguccauccagaggaugcuccuaugaucuccaaugacucuccaaaaauaaugcaaaauacuugaauuuuccaccuuucccccacccagaucccccaaaggcacauguggcccaucacccgagacccaaaggugauguuaccuugaggugcugggcucugggcuucuacccugcugacaucacccugaccuggcagaaggaugaagaggaccugacccaggacauggagcuuguggaaacgaggccuucaggggauggaaccuuccagaagugggcagcugugguggugccuucuggagaggagcagagauacacauguuaugugcaccaugaggggcuaaccgagccccuugcccugaaaugggguaaggaagagaaggguaacagagucaaggaaagaaggagccuagauuaagaucagaacugagaacugggcaucaugacucucacccuccacuccuuucccaggaagaucgucucaaucaucugucgucaucauggucaucguugcuagucugguucuccugggaggugugaucacuauuguuguggugugcaagaggaggggugcagguaagcaaaaggguugacugaguccuuuuucucaccucuggacuccaggucuuaguuggaauuguuccugccuguucacuggguagacauuuggcccaccaucucaaaagacacaauaguuuauuuuauguuauugucuaucuaugaguauaugauguagaugcuguguuuauaauguagguauacgcuagucauauauguauguauguauguacauacauauguguguauguguccauguguauguuuauguguauguauguguaagccaguggucaguacuguaugucucccuccauacuucuuaucuuuuuuuugagauaggaucuuacuaauuugguuagaucagcuagccaguaaacuccagggauucuccuauuucugcuucccuaguacugagauuauagaugugaaucaaccacaugcagacagacucaauauacacaguuuagacaacuuacaucuaaaucacaaauaacuaaauguuaaaagaucaaauuuccaaaauuacaauucugggaaaauauuuuuuugauucauguaaagacuuuuagcuacauuuugaagagguguuuacuuaagaugcauaaaguaucagagaggucuccuuauucauguuugcauggguauaguaaugaaagucacacugauguacauuuaugaacaauuaacuaggaagaaguaucacaaacaaaugcuagccuugccugagucucugugcugacaaucugcugugcauaggaucgugggaaagaaaagacauaaucagaguggaagguuccugcugagaacagauccuccaaaagacuuuauuacacuuccuuuauaucuuacauguucuacauccuucccugagccugcaguccuaguucuaucggcuucccuggggcuaggauuaaggcuuuucauagacuuucauggcccugcugccucccuggccucuuacccacuguuuucuuuccacaggggaaagaugaaucaguuauacucagacugccaguaaguauggugggauaugguuccugauaugagauaagguggacaggagcccauggggcaacacagccagcucaucuuguggugucugaucaagucucauuuguucuguuaaaggcaggaacagugauuaaguucugaugcuucuuucaccauuuagaaagguaagaaguugccgggccuaaccuguagcaugugguggaacagaggauagaccccuggguuauggggacucuaacaaugggacauuugagcugaguacuuuagaguaucacaccucccaggaaaguuugaauuucuucuauuuucuuccccaguaugaaagaaagccuugccuugugugggacugaguuuacagcauguguucugaucucuccuucuguacuauaauuccaaaacccucaaugucucuuucugcaguuggcaucucauggugugucuccugucagcacagugugacaaagugagcagcccagggcaucccugaggacugagucuccucuccauaccugugucuccuccuuuucucaccuguaccacagggggauccaggacuucuucaucccuuguggaacuuuagguuucuaugggcagcuucuucccuauugaaaaauaaggauguagauauagcuuuauuauuauuauuuuuuuuuuuaccuucucgauaaaagcuguacuucaugcuguuaaaaguguaagauuuguacauuggaaaggaaauaaaacaugaaaacucacaaac

SEQ ID NO: 8606 - RNA, 2706 nt, Mus musculus
guucauacagagaccccucuucuaucgugauuucucuuccuuccuuccuuccuuccuuccuuccuuccuuccuuccuuccuuccuucuuuccuuuuucuuuuucuucguuuccuuuuucuucuuuuucuuuuuccuuuucuuguguguguguauaaauaucccuuuaaaucuaucuuaugguuuggauacuuuuuucccuuuuuuuuguauuucuuuuuuaaauguauuuuggggauuuugauuuuuugagauuaaaauguuucaguuaugacauucagaauugugucuuugggaauaaugggccacacuccuucccaacaaggaggcagagaaaacuuaucuggggcuuagagucucucaguuggaaaaaaaaaaucagaggcugccccuuuccccacccgagcucuucuuccacaugacaagaguagccacugaagcucccaggagaaccaggccaacagcaacuauuaugaugaaaaugaaagacugaggaggucuaccugaaaagaaauguaaaauuguaggacccugaccccagaucucaaccuugacccugcucaggaucuccagaaaggcuuuugccuucucuaaccacaggcuaugugccuacauccuacuuacuccaucucagggugaggggcucaggcagucccucaugagccacauggcauguguaauucugcuccuucccagaaggcaccaccacagcuacccacuucuggaagguuccauccccugcaggucuggucucaauaacauccauguccugggucugguccuccccaucucuuugccagaucaugaugaugucagaaggguagaaacccagggcccagcaccucagggugacaucaccuucaggucuggggugaugggucacauaugccuuugggggcucugaggaggaagaguaggauaaguaguacauuuacuuuuuuucccccuuuggauuugguguuauugugaucauuuugggacuagacaggggaauaggguggggauaugugcagaccuacauagcaacuguacucaagcaucugggauaauaaacugcuugaaaaguucuagaaucaaggugaccuagccuaggguaggagacgcuggguuaccaggaaaagagcaacuuuuguccugacugagugaagccaagaaacuacaucacugcagccguaucauaccauugaguguggucagagaaucuaaccucagagaggguacaggcugcagauugaagggaauagcaaguuuagggaucuuuucuccuauucugagauagauucugaacugagacuuggagagaagagugaguccucuggagagacguccuaugauguugaaccaggaaacucaggaucauucuuccuucucaagguguguguguguguguguguguguguguguguguguguguguguguaagagagggaggaggagggcacagagagaggugagaggugagacagagagacagaaacacagagaggcagagcuagggagacagaaacaaagagacacauagagacagagucagagagacagauacacagagaauucuagcugaucccauuucucccuucucaggagacaugagcuccaguucauuaagaggaguuacuucuuugccccucguaccugugcgcaguagagucucauuucccacugucagguauuuaaagagccacaccaugcaagggcccuccaaguagacccuccagaacucagccacauuaguugccucccacucucuacgggugaucucagcugccgcaucugcugcaguccaggugcucagaucuucauucagagugagguaaucuugcccaucauaaccaaacugacgguaugcgugaaguaggugcccgucugguccaauguagcagccagucauccuuuggauggugugagaaccugguuccguaucacaaguuagucccucccgcuuagcccuuucauccucccuacccacccaaccagauuugaaccuaaacugacaaccauaaaacagcucauaggcaccucaacccuucugggucaauacuuucuguggucucauagccuuaggcugaacuuggugauauggggacauggaagagguuuggcaaccacuuggccucaggguuacucacuguucuggcucugguuguaguagucucgcaguuucugaaaguacacucuaaucugcuguucugcagcuuucgcaaugcgugucuggucaucccaguacuucugucccaucuguuccauccaaggcacucggggcucaaaccucggauucucagccucauugucaaaaugcacaaacucugugucauccacauagccaacagucauguagugggucuccucuaggccaggucuugacacugcgaugucgaaguaccgcaaggagugggauccuggaggaagcaaaaggcugauguuuggcuugaaccuucuucccucauggggauccagggcaggugguagaagggaagcaggaggugcaggguuuaagggagugggggauguggguagcccugcuggaaaggucuggcugggugggauucccaggugcucuucuuguaaaagaccuguuuuucaagaccugcacucaccuuuaaaggucugugccagggcaagggaagccccaagcagcagguagagagugaagaggagagugaagaaugcugaagucuccauucucuggauuuggagcgagucugucu

SEQ ID NO: 8607 - RNA, 997 nt, Mus musculus
agcugcuacugcaauuucuguuuucaaaaugauaguggaaaacauaaccacaaugagaggauuccuccucaugggauucucugacaaccaugagcugcagaucuuacaggcuuugcucuucuuggugacauaccuauugggcucagcagggaacgucaucauuaucaccaucacaacacuagacccacagcuccagucuccaauguauuacuuucugaagcaccuuuccauucuggaccucucaucccucucugucacaguuccccaguauguugacauuugccugacacagaguggcuacauuucauaugcacagugcaugcugcagauauuuuucuucacagguuuugcuuggggugagguggccauucucacagugaugucauaugaucgguauguagcuguuugucuuccacuucacuaugaagucaucaugggucccagcaaguguaggugggcugugacagcuguauggcuaagcagugucauuccaggaacccuguauauagcauccauauucucuaucagauucuguggggacagaauaauccaccaauucuucugugaugucccccaggugcucaaguucuccugcucugaugauuaccuuguaacaguuggaguggcugauuuccugucugcaguggccuuugccugcuucauugggauugucaacuccuauguccacauauucuccacaguucucaggaugcccucugcugaaagcaggucuaaggucuucucuacuugccugccccaucuuuuuguugucuuauuguuccuuucuacaggcaucuuugcauaucuaaacccaaccucagacucuccaacugcuuuacaguuuuuggucucuaucuuuuacacaguauuaccuccaacucucaacccuguuauuuauagucugagaaaugagacgauaaaaaguguuauaaggaaguuacuauugaguucaaaauucacugguuagaaucauuuugcccuguugcuacugacugau

SEQ ID NO: 8608 - RNA, 952 nt, Mus musculus
acaauuaacaagagcucggguggugauuucauccuggugggcuucucugaucagccacaacuugagaagauccucuuugugcuggugcugaucuccuaccuccugacacugguaggcaacacagcgaucauccucguuuccuguuuggauucugcgcuccaaacacccauguacuauuuccuuaccaaccucucuuucguugauaucugcuucuccaccagcauuguuccucagcugcuguggaaccuccaugguccagccaagacaauuacugccacaggcugugcuauacagcuuuaugugucucuggcucugggguccacugaauguguccuccucgcaguuauggcauuugaccgcuaugcugcuguuugccgaccacuucacuaugcuacaguuaugcacccacggcucugccaaucucuugcaggaguggcguggcugaguggagugggcaacacucugauucagggcaccaucacccuucgccugccucgcugugggaaccacaaaauuuaucacuucaucugugaaguuccugccaugaucaaguuagcguguguagacauucaugccaaugaagugcagcucuucauggcuuccuuggugcugcuccuccuuccccugacacucaucuugguaucuuauggguacauugcccaagcacugaugagguuaaggucagcucuaaccugggguaaagcucuuggaaccuguggaucucaccuaauuguaguaguacuauuuuauggcacaagcacugcugucuauauucauccuaacagcuccuaugcacagagucagggaaaguuuaucacccuuuuguauacugugguuauuccuacucuaaacccccucauuuacacuuuaagaaacaaagauguaaaaggagcuuugaagagacugguaaggaaagauucuagcacuggaaagaaaauucuuucgagguaga

SEQ ID NO: 8609 - RNA, 968 nt, Mus musculus
guuaccuauuuauugcccgagaugucuucagacucagaguuuuucucagugcugccuucacuuccuuguuccuuaagcuauagaugaugggguucagcauggaugucacugcuguguagaaaagggccaagaguuuguccauuccugguaaguggcuagauuugggccucaaguagguaauagauccugagccaaaaaacagugugacuacaaguagaugggaggaacagguggagagagcuuuauggcgacccucaggugaaggcaucaccagcacugcaaccagaauucugacauaggaauaaaugaucaacaaaaaugggcuagauaugcagagaacuacggccacaaagauugcagccucauuuugggauguaucgccacaagcaagugccaggacagguggaaggucacagaagaaguggucuaucucacaugguccacagaaguucaaggagaaaauaaaauugguuugucccaacccuacuauacaucccauuccccaugaaacuaaugccaaaugggcacauaccucacgacucauucggguugaguaauggaguggggagcauauggccauguagcggucaaaggccauggcugccaauagacagcacucaguuauaccaaagaauauaaagaaaaacaucuguguggcacacccuucccgagagauaccucggaucucacuuacaagguucugcaacaucuucgguaugacagaacaaguguagccgaucuccaggagagacaaguuggccagaaagaaguacauggggguguguagggcuggacuggugcauauggcaagaguuauaagugcauugccugucagugauacuaagaacaugaggagaaugaggguaaacaggaggaagcauucuucaggaaccucagagaacuuggcaaaugcaaaguguuugacagacaacuuguucuccugccacagagagcaguugacacucauc

SEQ ID NO: 8610 - RNA, 1815 nt, Mus musculus
cggggcugacgcugucaguuggucggagagccucgcggccugaggcuuccuacccaucccgccucuucccugcgcuucagacgcaagaccauucauuaaagcguuugcguucgagagcugaaagucugcuacccaagaugaugaaugcugacauggacgcaguugaugcugaaaaucagguggaacuggaagaaaagacucgacuuauuaaucagguguuggaacuccaacacacacuugaagaucuuucugcaagaguagaugcaguuaaggaagaaaaucugaagcuaaagucggaaaaucaaguucucggacaauauauagaaaaccucaugucugcuucuaguguuuuucaaacaacugauacaaaaagcaaaaggaaguaaagggcucaccucccucucuucuauggauugcugcuuuuuuccuucccccuuaaggcuuggauaggauccaaaaguuagaguaucuuuguucuucccugaguauuuauaaagagaaugucagaucuagguaacacuaaugcugaacaggagcaucucugaguuaacgcuauauguauacguuagucuaugaaaaugugcacauguagagacuuuauauuagaauuacagauauuuaugaaacuugaagaugaauguuuugccaauuugcuuauauauauauauagguuuagcacugucuuuuaucauaagccuaacuaguaaaauauacaaaaaaauaaccauguugugaaaagugaccaaaaccauguacugaaugcacagcuucuguaccuugugcaccgucuugugccucucccaucucccucccugacgguaacuucagcaguucuccuacaagaguaaccugaacuagaauuguugacacuuaaccaaaacaagacacuuccuuaucuaaggcuugccguuugugauacuuaguaauaagauaggauugcugguuucucuuuaaucaaucgaaaguagauugaagcuauagaaaaugaagaguuuucuuugaaauguaaacugccacacugagaagcuaaaaacucccuauugcauaaaauaguucauuugguguugaaaagauaggaaugcuggucauaugugugugagaaauuaaaaaacaacaaacaaacaaacaaaaaacuugagaaaagauaggaauaagaaggaaaacuggauuaacagaaauaaccagcucgcaguguuuucccucuaaauguguauuaccucuggcccacagcugcacuuuggggacauauaugaaaguggacugagucuaauguaaguggauuaagagagacuaguuaagaguuuggucucaaaguuuauuuguacccaggaaaugaacuuuugcaaaauuaauugagaguauauuaauaucagaaucaugaauauaagaguuuuguauaugugauaauuauuaaccucgguauuuuaucucaguuguuuucccagaauuucuguaaacucaacuacuuaguuugcagaauuuuagucauucuuuuaacaaauuuuaaaaauuuaguuuguagcuuccauuugauaaggagcugauaucagaaauaauagugaagucuuauaauaggaaagauccacuaaugcagcugguggcucuuaggcugggcugcuuugacuuguggaauuaucuaauguauuaauguaagccuugaugagugaaguuagcuauauggauguguaacccucacauugcagacauuuugcaaccauuuugugaccuuguuacaaauauuuaaaauuguguucaaguucugcuuugcuguuuaauaaaaagcuguuucagaaaaaaaaaagaaagaaagaaaag

SEQ ID NO: 8611 - RNA, 956 nt, Mus musculus
gaugacaauuaacaagagcucagguggugauuucauccuggugggcuucucugaucagccacaacuugagaagauccucuuugugcuggugcuaaucuccuaccuccugacacugguaggcaacacagcgaucauccucguuuccuguuuggauucugcgcuccaaacgcccauguacuauuuccuuaccaaccucucuuucguugauaucugcuucuccaccagcauuguuccucagcugcuguggaaccuccaugguccagccaagacaauuacugccacaggcugugcuauucagcuuuaugugucucuggcucugggguccacugaauguguccuccucgcaguuauggcauuugaucgcuaugcugcuguuugccgaccacuucacuaugcuacaguuaugcacccacggcucugccaaucucuugcaggaguggcguggcugaguggagugggcaacacucugauucaggguaccaucacccuucgccugccucgcugugggaaccacaaaauuuaucacuucaucugugaaguuccugccaugaucaaguuagcguguguagacauucaugccaaugaagugcagcuauucauggcuuccuuggugcugcuccuccuuccccugacacucaucuugguaucuuauggguacauugcccaagcacugaugagguuacggucagcucuaaccugggguaaagcucuuggaaccugugggucgcacaugcugguaguaguacuauuuuauggcacaaucacugcuaucuauauccagccuaacagcuccuaugcacacagucagggaaaguuuaucacccuuuuguauacugugguuauuccuacucuaaacccccucauuuacacuuuaagaaacaaagauguaaagggagcuuugaagaggcugguaagaaaaaauaacagcacugggaagaaaauucuuucgagguaga

SEQ ID NO: 8612 - RNA, 1569 nt, Mus musculus
uggucagacccggcagguacgcggcgcguuuccccggugcccccccaccccggccggguggucccacaccccaccgaggccgcgugggccggaaagccgccagggaaggcuccccagagguccagcuuagccccuaagcaccaugucggacagcgaucuaggcgaggaugaggggcuccugucacugaccggcaagaggaagcgcagagggaaccugcccaaggagucaguaaagauccuccgggacuggcucuaucugcaccgcuacaaagccuaccccucagagcaggagaagcuaagucucucuggacagaccaaccucucggugcugcagauauguaacugguucaucaaugcccggcgucgccuucucccugacaugcuucggaaggauggcaaagacccuaaucaguucaccaucucccgucguggggguaaggccucagauguggcucuccccaggggcagcagccccucucugcuggcugugucuguuccagcccccacuaacaugcucuccuugucugugugcuccaugccacuccacucaggccaaggugaaaagccagcagcacccuucccacaaguggagcuggaaucccccaaggcccuggugaccccugcuagcacacucacccugcugacuagggcagaggcuggaagccccacggguggacucuucaauacgccaccacccacacccccagagcaggacaaggaugacuucagcagcuuccaguugcugguggagguggcgcugcagagggcugccgagauggagcuucagaagcagcaagagccagcgccaccuuugcuacacacuccgcugccuuucgucucagaaaacgccaaguaggcaccugcucccggguggcuugagguuccuggcucacugcccuuucaugcagaggguuauccaaguacggaucacugccaaacaucaggaccauucuguccaguccucagcugaugucgcugcgcugcacuguuacggggccuguacucugcugagugccauuccuucaaguguccucuccgaggagaccaaggcaccagagccaggcaugguguugcugcugcuccuccagagagcccugggacaccugcacuccagccugcuuuccuaggcaggcucaggaaagcugccaaguccagacuugagcuggguccaagccgccccuaagcugugccucuuuugguugagccaggugugcacauuccaaccuauucaaaggacaaaggaaaugcccagcagaugucacagaaccgacuccaguugaauguuuagauuuuugcuaaauuguuuuauuuuccuuuugcugugguuuguguuaauggcaguagguagcccagaagcacagguguggggagagagcaccuuacaugguggguggagcucgauaaguggguaauauacuucccacaggaugauuguauagggaccagcagauucucugcaguagugcugaguucagacuagagugguuguuuaauucuugguuuggucuacccuauuauaaaagacagaaggaaaauauacacagguggugggguuauuugcaccagaca

SEQ ID NO: 8613 - RNA, 11999 nt, Mus musculus
ugggaaaccagggacgcacagcgacaagacuagcacgcuguugaaaggcauuuugcagcggugaccuccgaauuccaccagccuggcgggaaaugagaacccagucagucaccaucuauauuucaggagcaagcaggggcggcuuccuaucacagaaaauccgugaagaagaaggaaaggacagcaagauagauagguggagcagaugaagccaauaagagaagaauccugcaagccugacgugcuccacagcgcacgggcuuacucacaguguuuggggaucacccggaccaagcccggacuucagaaccgaacccagacgccggggucacacccgcucgccgcaggagcucggcagccaaucaaaucagggggcguagccaacaccgcccucggauuagccaauccaauccggacauugcgggcgcgcgucugaugacguaaagacauacgcuccgcaggccggccuucucuacacaaguguguuugcguuccucacugacgcuuccgguucccagauccuggaaguucuccgucuuuuccgguuguuugggcggauuaagucagaagcgcgccuuuugaauccgugaagcaacugugaagagucgaggaagcgauaaagcggcugacagauccaggggauaauuugagccucacgcguuugugguaaaacuccguuuuguuuuguuuuguuuuguuuuuaaggggcaaugucuaaugucugaauaggucucugccauuuagggcaacuguuugagauaaccccagaguggagugaaaauauugaucuucccucucuagucccccugacccucccggucuugguuccugaaucucuguaccucguccuggagcgacggacagaguagcccaaguucacucucguuagugguucgcagaugaacagcuuaaguugagauaagucgguuuaaacuaguuucaguaaaccggccaagaaaacaacaagcaaaccgaagcggagcgccuuuuuccacuccucccauaaggauucgaucuagucugaacgggcugauucauaaagaaaaaaaaaaaaauguucuuugagcugucacgccguccgacuuuacgcugguuucauuuaagcacuuuauuucucuucgucuuggcuaauuaauccaaagauauccccacagcugcccacaagucauuugauugcauuuaguauaucucauacauaauaauuguagucauagcggugucuaccaacccacuguuaagcuaugauuuccuguggaucugggaacaguaaggaauuuuuaucuucuaucuuaauuuuucuuuucuuuucuuucuuucuuucuuucuuuuuuuuuuuuuaaauuaacacaaguugaguggucccaacagguagaaaucaugacccugguuucgauacuuacaaugucugucucaugauucaauguaggcguuuucuguauuacauccugccauauauguuguuuagcuugguguuuuggggggauuccuaaagguuggaguaggagaaucuccugcucuuuugccaucucuuggaagacccuuuuccucauuucuggguugcauuauccagccuugauaugaugguuugugccuagucugauuacaucuuauuaccucauguuugguugaugucgcugggagcccuguuguuuuaugaaaggaaacgcagaagcagugguuuggggaaagaaaagggacccaugacuugaggagugggagaggaaacuauggucagauguauugcaugagagaagaauaaauuuuuuaaaaauuuauguacucuuuucaacaaaaauuauauuuauauuauaauuauauuuuucaccuuugcagacuauguaucguugugauuauacuguuuagaugaaaaugucugguaaagcacgugcuucuaggaaaaaaccucaacaggugaaaagaaguuugaaacaaagagccaauaaggaagcggauuugccagagaaugagguaagaucucuuucuuucagaucucuuuaauuagaaauaucuauuucccuucaaagggcuaaaagucaguuuuacuacacauuguaauucauaucacaaacuuuagugcauucuuuguuuaucauaucuacaauacuuuuuucuaccuccuggaagguauaguauuuguauacauggaguauguguugcaaaaccaucuuuuuaucuguuguuuguuuguaugacucuagguuggaaacacagcaaaaagaaacagaagucaugcaaagcaucuguccucuaaagguauuguucuguauuaaagugucuucuacugcuuuucaugaaaaauguuucaguaucuugguuuugaguucagaaaugguaaaaggugagcauaaacagucacauccucaauauuaauucuaacagcaaauauauagagguuugccugucacaucgaaaggaacuaggagacaaauuauuaucccucauucugaacuacucaucuuugauauaaagacaaaccuacuucuuccucucuaagacaccacggauuuugguucugccacuacuguacagauaguuuguaaucacuguaaucacuagcuuaagcauuucaaagguaauuaguuggaaauaccauuuccuuaaacaucucuucuuuguaagaugauuccuuacacauuggugcaaauacuguucugauuuucuauuuccuagggugccauacguuuacuucguaauuucugcacuccuauaauuugcauagcauucccuuuuucuuuaccuaaucuuugugaagccaauacuguauauuauugcuuaucccuuguacguggaauaguucauugucuaguucuuccagaaaacacuguugaggguuaccugcuauauugauaaguagaaaaggaaucucuguuccucucuaugagcuacucaucucugaucuaaagauauaccugucaguguuuauuucuugcuuguucuuucauuuccaauguuugguagaaguaguuuuccaguauuuuuguugaaagucuuuaagaaauaaagucacuuuucagaagcaaguuuuaauaauaauaauaaguugauucucuauugaaaaguauuuguguugcaguaucaguugauaguaugucagguauugccaaauagagcagaugcaucuucaguaacugacauguuauagcugcaguaagauaugagcuaaagaguagaaugccuuagcuucauaaugccacuacuguucuuuauguuaaaguuauuuuuaagugaaacugcaaaacuucuagauugauuagacucucuuguauuaccaguaacaggacaagcaacguauguucaucuaaaacggguaaaaauaucauccagcaagagaacaaccuggcaaccucuuccaaaggauacugaagaguauuugcaaaguaugauggagucagucauucugugaguuuagaaaguuuuucuuuguguuuuucagcucuugacucagguauuuacuauauacagcugucucaauauuacuuccuaucugaguuacuuucuucaggaaguggcagcaugccuaacauaacagagagauuguuagucuuacaggcucagcagcuuugaaccaaguccagugacucugagcccuugggaggcagaacaucauggcagugggagcaaugcuuuucaggaagcaaaacacaagacuggcaccagggaccaggugucacuuaaaagcauacccuaguccccuguguaucacccagccaguuacuaacuccuagaauuuccaaagugaagaccguacauuccacacauaugccaagggcagacauaccaaauuuauaccaugacuauuuuaaggaaguauucuuccauuucagaaaagauauucauucaugauuggcauaccaugacaguauuuuaaggcaauagaguguucuucaacuucagaaaagauauucauugauucaugaucaccauuacacacacacacacacacacacacacacacacacacacacacacacaaagauuuucuacauuguagaaacuugggauucuaucagugaaguaguaaaaaucaagucuguguggguuguagucuaaaacuuuuaaauuguuccguuaauauugauucuucccaagguauguucaugauuuacacuuucugugaaaacuaccauguuauauaaaacacaaacagagaacuccaccaugagagaauucaacugcaccagagauguuggguauaugaauucuuaugaugcaauaugauucaaagaaauuuccauuguucuguuuaaaguguuuuguagauaauagaauaaaaaugugaugagauuaccauguuguaugugugagugugugggggucaaugaaacccacuauuuuguuuuaauauauaccaggagcaauaaaaacauagauauauaauacuaaauacaauacuaaaaauuuuaauaucaugaauuucaauuaaagguaaguuauguuguucaauaauguaucuaguaaacccacagaaucaauuaagcugggcucauaggggcucacagacacugaacugccaaccagggagccugaaugggauggacguaggcccucugcacauauguugcaguuguguaguuugguccugugugacuccuaacagugggaacagggguaucucugacuguugccugccuuggggaccuuuuccuccuauuggguggccuuguccaccuuuacuggguaaagaggugucuaguguuacugcaacuugauaugccauggcugguuaauaucugugguagggcugcccuuuucugaagagaaacagaggaguggauagggaugugcagguggggagaagagucugggaagagaggauggauguaaaaauuaauaauaauaauaguaauaauaaaucuaguauaaaggaauaggugaaugauucugcugaguaugaacacuugaaaaauuuuugaaauacagauuguguuaugcuucaaaguaauauuuccucaaucuuuuuguuccccaguggaauuuuauucaacauaaaaagaaaagaagaaauucagugucaucucaaccaguugaagaaaagguaacccauaauuggaaaugauuagauuuuaauuauuuuaaaagugacuuccaccuguguucuaaaauagauuucuauagaauaugccuuucauuacuuucuaaaggaaaugauauuuggaauuacauauuuauuaaguuuuagagaauguauacaaaagaauauguuccucauauaacuuuuauuuucguacuuuagcggucuguguuuugugucaguauuuaaaaauacuugaugauaugccccaauacaggggaaagccagggccaaaaagggggagugggugaguaggggagugggggguggguaugggggacuuuugggauagcauuggaaauauaaaugaggaaaauaccuaauuuaaaaaaauacuugaugacaucaacuccuuuacauuuuaacaacuuaaaggaagcauucacagcucucacuuugucuuguuguccacugcuguuguuaacccuacuguuuuccuucgccucugucucaauuaaauuuuccuaugcuuugguaaaacauaggcgacuuggaaaggacaugguuuauuucaucuuacagccuauaguugaucagugagggaagccagagcagaaacguagaggcugaaacgagaguagaagccauggaggaacacugcuuauucauuuccuccuugugccauguucagucuacuuucuuacagcacccaagaccaccaucccagccgugguacuacccacaaugaccugggcccuccuacaucaaucgucagucaagaaagcacaucacaggccaaucuggugcgggguguugucucaguugagguucugucuuguccauacaaguccguauuuuauugcucaguuauuuacacaagcaacaaguuugaucuaucuuguugauuuucucagagaaccagcucuuaguuuaguuuauucuuuguauuguucucuuuguuucuaauuuauugauuucagcccugaguuugauuuccucccaucugcuucucuugggugugcuugguuugguuuuguuuuguuggaguucuguucaguugcuaguaugagaacucuccaauuucuuugugaaaguucuuagugcuguuaacuuuucucuuagcacuucuuucauugugucccauaaguuuguguauguugugccuucauucucauuaaauucuagaaaguuuuuaauuucuuuauuucuucccugacauggugaucauugaguagagaguuguucuggcuccaugaguuuguagacuuucugcuguuuguauuauugcugaagucuagcuuuaauccauggucucugacuggggccugaaugagaaaauguuccugugcuugggcugauuuacugcauuauugauaggaacuaagucauguuccuauccccaugaacagacaaaaggugccugcccggcagaccaaucuuuuagcucaauucugaacacaaaauucauuuauuuaucuuguuacuugucucaaauuaaugucaugcaauauuucuuuaaaacuucauauuuauuuguauauguguguguacacucacacauaagcuauggcaugcauugaaaguaaauuacacuguagaagaauuauucucuucuaccuuguguucagggauugaacacaggucaucaggucugcaugcugaggaucuagagucuuuacccacugagccaucuuaccagcccuauaauucagugucuuugauagugaauuuuccacuaguuugaaauuccacuagcuagggaagauuccaugaguuuggcaucaauaaaggguuaaaauuuuggaacauuuuauguguuaggcuugggaggauguucaccuuacaauagaauuuuuagacaaacuacaguuauuguggcagaaucucuacagugauuuuauucuucauuucucauaaauuugaagacucaaguuugagaacauuauuuugcugucugcuggagauagggacucgcacagagaagacuucauuugggauauagaauaaaauccaugucauacuacucugcagcaaagccuguagaccucuucuuaucugcccuagcuuuaaaacuaagugaucuucgaaaccuuuagauuaaccuuuauuggcugcguccuuuagagugaaaggugggguguagggucagacucaaaauuucuagaguacuuucuuuuauccaacauuccauauuaaacugucagacucacauucuauaguauagaaaaugcauuuaaacaauauuaggaaauucugauauuauaaaauguguaaacuaaaaaguguucuaguaaaguagccuuagcauuccaugauuugagauaauuguuaauguauuuuuuuaaauuuuuuauuggauauuuucuuuauuuagauuucaaauguuauccccuuuuccgguuccccccaccccuguucuaugaggguguucucccacccacccacuccucccugcccucuaaccaggcccuccagagcucccagggacuaaaccaccaaccaaggaguacacauagagagacucauggcuucagcugcauauguagcagaggauggccuuguuggacaucaaugggagaagaggcccuugguccuguuaauguauuaaaaaguuaggugauguuuuaucagaaauguuuuggaaaggaaugccauuagcugcugugaggaaaaaaaauaaaagaauguuguagcccuuaagugugaaaaaaaugaaacuuuuaaagaaaaugguauucuucaugaaaauaaacauguuauauuuuuaagacuacuacaacaaugugcaacacugaaagucccuccaagaaaguugaacuauuuaaaggaugugucaaaaaugcugaaaauggaaaaggcacaggaaagagcaaaugaagagagccuggcuucacugcagguaugccauucaaaagggccucuguaauuagagacccagggagagggaacaaggagaaaagcaucauagcauuaguggucuagcauuaaacucaaauuuuggauuagaguuuuuguugauuuuuguaucuuuuguaagaaaagcaaagcugucacuugaacguuaagccucucaauuugaaguguuaaugacuuaucccuggucaaguaacagugccguuuugguuugguuugguuugguuugguuugguuugguuugguuugguuugguuugguuugguuugguuuuucgagacaggguuucucuguauagcccuggcuguccuggaacucacuuuguagaccaggcuggccucgaacucagaaaucugccugccucugccucccgagugcuggcugggauuaaaggcgugcgccaccacgcccggcccuaacagugccauuuuuauaaaagaaauuuuaaaacauuuuuucauauguucugaucaugucguucaccccacaguuucucccagauccuuucuuacucccacccaacuuuauauucucucagugucucucucuuuaaaaagcaagaaaacaacaacugcuuuuccccugccucugccuaguuacacagaggcagaggcucgggugcaugcaacauucgccuucacucauauuccacagccauggccaaggaaggcauacaugcuaaagguuuaauggacaucaacacuguucuacaagagcugcugaggacugcccacacccgugauggccaagcacgugguauaugugaagcugccaaagcacaaaaaucagucucucugcuugcauccagcuguagugagcccauguaugucaagcugguggaggcacuuucugcugagaaccaaaucaaccggguuaagguugaugacaagaaacuaggggaaugggguaggccucugucaaauugauugagaucagaagccacaggaacugguuguuugcaguuguguagugguuaagggcuauggcaaagaauccuaagccaaggaugucaucgaggaauacuuauaguuuagagggaucauagccaagccuucauuuugugcuuuugcccuucaggauaaauuauugcaugucauuuucuuuuaaucuguuaggcuaccaauaauaaacugguaugcaugguuguggagagcagugccgcuagcaaucgccauuauaagauggcgcuggccuccgcugugccuaacuaguaaacaagccuuguacgcagguacgagagugaacucacaccuaggcacugcccaucucgggguguaguaauggggugaugggcgagcaacgaaucaggagcugacacgccacaucaggugcugaaacaccauggcugagggcuauauaagcaacgccauuuuccggggucggggucuucccuccugaagaagcaauaaagcuuuuugcugcagaagaaccggugguugagucuuucuugccggucgagugggacgcaacacaugguuuacuuuauaauugucuuaaucuguacuuuguaaauccaacagccaguucauagcaguguggugcuaagaaacauguuaacuucaccauagaauguaguuuacagaauucaagcucugggacguucaugaaaaacagccuacuuccuucuaccuagcaauuucagugacauaaagaauugaaccaaaaguauuuaaaggaaaaauaaaucagucauaaccaacauggagucugacucaaagaauaaagugguuccuguguacaaggaagucaaacaguggaaauggucaauauuacagacuuuacuaagacuuuaacuaauguguuauacugaucuuacauauuuguuagguccuuuagaguuguacauugaaauauuuacaagugcaauguuaugaugucuaggauauacuuuaaaauagugcaucuuuaaugacccagaagcugauuuauacuguacuuggccugcaaucagcauauuccuguuacugugauauuugacucauuaauuuuccguauugucuuuuuuauaaauuaauauauuucuuuaaauuagaaaaauaguuuacaguguuuuaauaauuaauuuuaauaauauuaauuccagugccuagcauuccauucuuuuggcauauuaaaagagcaggcauucaaauguuccuaacuaaaauuaaaaauauuuucauuuguuucuugcacuugaaagcaccuguuacuuaacagaugcuguugccuggaguccuugggcugugcagcucauacaaaggguucugcagagccuccauugcuuguuagcuucuguguuaggguuuugaugggcagaguuagcuccuuaauccuuccuaauaacucaggguuauauuggccaagcagcuuucuugagggucucuuuuugaaagaugagcaaaaauaaaguuaacaauuucuugcagaguguuuuaaaauaagaaguaucauauguauaaucuccuaggguuucauuuaucauacauuuacuuuaaaauauuaacuuuucuuuuugcuuuaggaagaaauagacaaaauaguagagaccacagagucaaugacugagaguauucaaagccuaaagaauaaaauucaaauuuugacaagugaaguagaagaagaggaacaggaggugaaacagguaaugguugaaaagcauauugcuacuauuuaaauauaauuuuuaaugcuaaaauguuacuaagauaacuugaguuuugcaaggugaacaaaaccagccuuuugaaauaaucccuagcuuucuguuucuguuuagguauuucacauagauagcaauaaaguacuugcucuuccagaacuuucucagaaaagucuuaaagcacccauacuucaaguaaguaccauaguuaauugaccauacugacuauugccaggcuauauuauacacacacacacacaaauacagagagagagagagagagagacagagagagagagauaaaaccauaucccguuucauuaaacaaacuaauccuguuauaaaacuuuugauaaauuacuugucuuuacugggcauauaauuugaacaucuuuucuguccauucauguacacucauucuuaucaguauuuacauaacauuccauuacacagauacaccauuguuguaaagaacugauagaaauaagaaauuuuguauuauacuccuuuauauacuuuuauauauuugcauagucauaacuauaggcauauccuucuuguuugacuuuuaacaaaguuauacagcucuuuauagacuagcauugugguauguuauuaaucaguacucuuguaauuugucuuucucccaaagagcucauugauauugucauguaaaugcucuuuucauuaucuggaauaugccagcagagcaagaaaggggacaaggaaagacuuauuuguaaaugaacgcccacugguugaugacuagugaucuugggugguaguuacuuaagauugcaaauaacagauguuugacauuuuucaucauaaaaugcuaaaaauauaauuguacugccuuacccacaggaagaaauuuuggcacuaauuccaaaccagaaugcucuucugaaggacuuggauguucuucaugauucagccccagugaagaaugugucagcauucauugaagaagccuauaagaaacuugacuccuaaagaguuggauuuuguuuugguguuuaagccguguuccauauuaacuuauuguugauaaauuguaaaacucuuuuuucuuuuaguaauagucucucacucuguuuguagccuaggcuggcucagcacuuauucuuucucccauuuggccuugaacucccagcaauccugccucagcauccugagugcugggauuaccggggcgagcuucacaucuggcccaaaggugugcaacuuaacuggagaucuuucuucaaaacaauuaaccuuuguuaucuaccuuaaaacuagccugugugggcuuaucauuaauaucuaauguccuauaaacauugcaguugcuaaaucuaggaaauuuauauauauguagauauuugcuaaaacuguuuacugagaauuauuuuuaaaaauaaaaaaaaaaaugccaugauguaauaguuu

SEQ ID NO: 8614 - RNA, 1115 nt, Mus musculus
caucaaaucaaggaugcucaggguggccgauaaaauacagcagaagugaugguuugacagagacuacggcacaaaagaaccuuuuaucuguuugcucuucuacaaaagucauuucaguggcgaccaaccaccaugccauagagacacucacucacacagagaugcgccauuugaagaacagaugcccaccacaagaagaaugcccaugccaguuaaacaguaucaugcugaaauguucaugaacuccaaaagaccaccaaggagccggauccgaugcuaucacaccagggacuuuauucacaagcucgagcgugggucuugauucacugcugacccacaggacgguuccauggaaaaauuccuugaucacucacugggacaagguuuuauaggaaaucacaagugaagggugaguguuucaagccuagcaagcaucuaauuggggugcuacugugaccuuugguguaauuggcuggugcugggagccaaacguuggcuuuccuccuaauuggugguuguuaggcaggggcggccuuguaaccuggagguguugggauuugcuggggauuaaccuggaaauuggugcuagacaguggauuuguuagaggagaauaaacuggagauccagaucuuguuagggguagccuggaaacuggagcuaagcucagguuuuguuuuggguaaucuggaaacuggagcuagguaccgaccuguuaauuuacuuaagucaaguuugucuaagauggagucugaacccaaagaauuugaucuuucaacagcaagugacauaaccuuggccaagaugugcucacugccuuuugagagccuggggccagacccacacagcuaaggagccccugaauucuugaucuucagaugccaaaugcugucagaaaugguugcuauuuaaaauggcuaaagggucagcaggauagaucaauggguagagcacuuuccucacauuccuaacaacuuaaguaugagcucuggagcccacauaagguagaauaugagaaaugacuccacaaaucuguccuuugaucuuccacaugcacuuugggagccugcacaugaucaaaaauaauaaauaaauaaauaaauaaauaaauaaagcu

SEQ ID NO: 8615 - RNA, 4107 nt, Mus musculus
ugucacuaucaugacuccauguuuuucuuauaaccaaaagacucuuguaaaaauagagaaaaucauauuuagcugucuugaaauguuauucccauguucugccacccauuagcaucaaggauuuugccagcuuucucugaauaagcaauacauguuucacuguuaacauuacugggcacuucaguacauucauuguauuucuuuucuuuuaauuaucugcucugaagaacaucaaacugaagccacugcucagcuccuaagaugguaccacucaaacugcaggcgcuuuucugccuccucugcugccucccauggguccauccuuuucacuggcaagacacaucuucuuuugacuucaggccgucagguaagaggcauuacucucugagcaacuuuaagauguugcauguuuugauaugugagaaugcaaggacuggggggauggcccaggugaugaaguagccacugugcaagcaugaggucaugaguuuggaucgccaccacugaugugagauuucuuuguuauggggggagggguguagaaacgggaggaucccugaagcuuauuggaaaaccauuauagaugacauaaugugcuucagcuuuggugagagauccugcaucaaaaaaagcaaagaugggggaugaucaaagagucauugaccucuggcuccuauggucauguucacacauaugcauguacaccugaauguucaugcucgcacuaacaaguauuuacaacacccacacgcacaagcacacacacucacacacaugcucacucacucgcaugcacauacacacaggagcauauauauucagggaaucuuuguucuaggguagggaggaguuucacucuucaaucuuuacaacuccaaaagaggaauguguguguguguguguguguguuuuuucuucaauagcaagucugcagcaugggcauuguaacacauguccugucagcuugcugugaccauggaaaaaugccuucaacaccuccuucucuuccccuccuucaugacccuaguuuaacuccugccagguacgggagcauacuugccuuggaguuuacaaggcagcuucaucgcuguuccaugaagguaggauuggucuugugucuugacaagcaaagcugguccugcggaggugaagaggcuugcaagaagaugacagucuggacucuagagguccaaagggacauggcccuuucugccugagaaugagaagaagcagaggcacguagaugccuggaccuucuccagaagauaauggccacggcuacuuucucucuucaguuguguuaaggagaagagauaaggggaugaugauuuagacaauacgaggaugaguagccaguguucgggagggacaucucaugccaccaagaagggccuauguugcaaggacauuccuucuggagcauugugaauaccuaccuguucaucuuaaagagcggugacgcacaugggucucagucuguguccuuuggagagcacagcagguaacuugaggaugaucucacacugucuauacccacagaucugcacacgaggauagauguacucacuccagauacuugcuggguuuguugaguaacucuuuaccacagcaucuccaaaagggcuugcguaacucaucaucacuagcauaaccuuugcccuacuugauauuugaggaaauggacuaaucaauaggaaagggcugggccuuauguugauauuuacacagguaauugaagaauauuucagagguccauucaucccucaauacuucccaggaagggaaagcgccauggauacgguggugacugaggugcuggaccuugucaucagagaaccugugaccuacuugaaaugaagaaguucaucuuucuaaacuguaucaucagggguuggaaacaggucacacaauggguccauuaucuuccaggguacauuuuauauuauugacucuuauuggugcagggugaaaauuuaaagacgugguuuuuuacccucugauuuuuaaacaucacuggguuguuuaaacaugcccuuggucuuguguuaacccuaugcuauacucagucuagcuguucagaaguggcuacgugaauauuuuaaaaguuauaauuaauacuucaaaacaauagauaauuguucuuuauaaucuauuaaaugaauaauagaaaaauauagcuauuugggguauaacuuauuuaauuagugaguguguggguuuguguuauaagugcauauguauaugugaguguccacgcuuguauacacagguggaaggcagagaaaaguguccacuguccuguucuauuacuuucuaccguauuccccugagacaaggucucucauugaacuugaaauuaggcugacagccagcaagccugagaagcccuucugucuacacaugaaaggacccgggguuucaucucugugcagccaugccuaagauuuuaugugaugcagcagauuuaaacucagcucuccauguucaugcagcaagcgcucuccccauacccuucuuucgguugucugagacaaucucauguagcccuggcugaccucuaacucacaauguagcaaaggguggccuugaauuauuuauccuguugucuccuauucacuagcacugguauuaaaggcaugugcugcugggccuuaaaaggcuuacaaauaugagauacuucgcaugcugaggaaggacuguaaaaguacuuuaaaaagaauguguuuuucuucuagaauguauacaucucaagacucgggaauauuugacacucagagacacacgugugcuuuuaacacaaacccgcacacucacaaauuaaauaaauuguaaccugaauugcuauauuuccuagauauaccaaguagcguccuacaggguucaaaguucccauucacauaaaguugaagaggauuaagaaaagaugaacucugagccacaaacuauagcacagaccaagcuauaguuggucugauccgccucuuuuuccuuaugaugauuucagauagauggauagauggagaugcagauucgugugaugugcaaauugcaagaugcuccuccuuuucuguacccagagugguaccugugacuccuaaauuccaggugaacagguuccuaaaguagagaaguuggagagccacagguuauuagaagagguucccuugguuucuguggaauuacgaucucauaggaggggagauccacuugcggauguucuggaacucugcugauagguuagggucuccaagguagcuaagaggucucugggguuccaaccugagcugugagagccaaaguucucccccuggucuagcucugaccuugcugccuauguguggggacacagcugcucacuggcugccaacuacagaaggaaagacagaagguggugucuacccugcuacucucuagacaugucaccucccaguuacaccaaggcugacuccacagauaaucugaaacgagagcagaaccuucuguaauuaaaaaaaaaaaaaauccacaccuuugaggaagugcugugaaauuugaauugucccuggagaaguguggaaguuguuguguagaucugcuaaauccuucaaaggacuugacagccccugggaagcaagacuucaccagcucuggagaaggaaggaagucauggcaguugacugccaguuaccuacuccaguugguguuaagcacacaaugaauacccucacuucauccaucuuuacccacacagcugcucugcaggcugguuaagggcuuuaauggcccacuucaccagugggcaccagagagaagaguuaaacugcuuaggccauaccaccauagguugguaucugaaacagaaucaccuggauccaauaccgggcuccacucugcuucaccuucugucuuucaucaaacugcccccucucacugcuuuaccaauguggcaggccaagagauaugggcugugccacagcauuucuucaucuugaaucagccuacuuugaaucuuuuugauugucgaauucgaaccaggagucugcauuuccaaaucccuaggugacagccaugcugcuggcccacaaggaucaucuuuguguaggaggccuuagguacugaaagagucug

SEQ ID NO: 8616 - RNA, 8125 nt, Mus musculus
caagcuggcgggagccaauggcguuccagcagcggggcgggcugcagcgacgagucaggugcucugcgcugaggcugcgugcaggugagcgaacaggauccuacagugccccuuguuucugccuccucuuggucccaaacguuccaggacagaucugucucagcgcgggugaguccccggagaaggguggccugccuccagaggcccacacuggggcugucaccggccagcggggcggggaggccuagcaaccccguagagaagaggcgacgcacccacccacccuggcaaacacccugacauaagcccacuccucugcucuuugauuggugcgccuguuugcuuagguuggggcggggugggggugggggaggcuggagagaggaaggacuggaaaggccagggcgauuucaaucgagaucuagagaguuucagggcuccgugcuguuucugcguggagaaaugagagauuuguccuuuuuuccucauccccacccccaccugcguuguggcacccauguaauuauguugcuucuuauuaucgaacauccccgagcuuuagacagagccucauacuucgcuucaguuugccccaagaaaacaguugucuucuauuuaccucaauuaacuaaaauagaugggaaaaaaaucauauguuccgugcaacugauucuuucuuggcauuaaauuguauuugguugauaauaauuuccuucguguuagugagaugggagagaaaauugggggaaagaaaagaaaagagggaagaaacagggaucagucauuugcaguuuccugcauacauuuaauuccccgucauggccauuauuaauguugcucccagaaugaguggcauucaagauacaauaguaaauuuaaguuuggaaucagucauugucuugagaccaauguccaaaacaguuucuagucuggaugaaaccacaguuuaaaaaagcaaaucuaaccuuaagcucauaugcauccuuugcauacagcuuaugguucugaaaacaaagccagccugccucauagguuacaucugcccauuccuagaccauagcaaggcaagucagagccacaugcacacauuccacacauguacacauaucacacacaucacacaugcacacauaucacacacaucacacaugcacacacaucacacaugcacacacaaucacacaugcacacaucccacacauacacauaucacacauacacacacacaucacacaugcacacauaccauacauacacauaccacacauaccacacaugcacacacaucacacauaccauacauacacauauaccacacauacacacauaccacacaugcacacacaucacacaugcacauauaccacacaugcacacauaccacacauuuauacauaccacacaugcacacacaucacaaugcacacauaccaccuaugcgcacaucgcgcacacacacagacacacaccauaucuacaaauuuucaagcauucuaaaucauccugaauuugucucugaaaagucacauauacaaaucaucuuuuuaaauauuauugugggguccauuugaguaauuccuuuguuucuuugaggaauaucuuuugauagaauauaggaaacuauaagauuguuuguuuguuuguuuguuuguuuguaaaguggcacuaaagcguuuuggcccugguguccugugucaaauggaguucuguacaguuuuuucaggcugugacuuaggauguaaaugagaucacucaucgcugucauucucaguuuggaagaaaauguauuaaucacaguugucagcauuaauuccuuugugcuuauucuacagauuaccuuaugcugagcugaucaaggucuugaaaaaugauuccagaguuucuccuugcgucuugcacacuggcuacucuaugccauucggcuccguuuucucuacagccagaagagcagaaaguucugguaguuucuuuugauggauuccgcugggauuacuuauauaaaguuccaaccccucauuuccauuauaucaugaaaaaugguguccaugugaaccaagucacuaauguuuucaucacaaagaccuacccuaaccauuacacuuuggucacuggucucuuugcagagaaucaugggauuguugcaaaugacauguucgacccuauucugaacaaguccuucuccuuggagcacauggauauuuaugauucuaaguuuugggaagaagccacaccaauauggaucacaaaccagagggcagggcaugcuaguggcgcggccauguggcccggagcagaugugaagauccacgauaguuucccgaccuauuaucuaccuuacaaugagucuguuuccuuugaagacagaguugccaaaaucauugagugguuuacagccaaagaucccaucaaucucgguuuccucuacugggaagaacccgaugacacgggccaugaugugggaccugacaguccucucauggggucuguuauuucugauguugaccacaaguuaggguaucugauaaagaugcugaaaagggcaaaguuguggaauaauguuaaccucaucgucacgagcgaccaugggaugacccagugcucuaagcaaagggugauagaacuugaccgcuaccuggacaaagagcacuacaccuugauugaucacucaccuguagcugccauccugccaaaagaagguaugucugaccucaugccgaucggagcacagcaccacacauacccaguguguaagcagcggucuuuccaagacacuugccugugccguaacgguguaccaagauuuaguccuuagacuuggaaaacaaaaucuccuuccucuugaguuuaauuuccucucacaccuggaaauacugacacuuuaggggcugugcuugucaauccuaggcucucucucucucucucucucucccucucucccucucucucucucucuuuuaaauuuuuguaaggaguuuugaauagugccuugcauucuugauaaacgucugggaaucccccuccccaacacuuuaaaacuaggucaaggaaucauguggaggagagguugcagaauaugcagccaaauaugcaaggcuugcuuuucugaaugaaacuguagcacccuggagaguugguccuacuuagagagaagggauuuugaaaagcucuacuaccucaccuaggggaauugugaccucucgggggaguuaagcaaaaucuauuaaguagcaaugcggaaguaugccugccugccuguacacaugguuugcaacucaaauguuccgccaacccauuagcuucccacuagcccauuagcuucccacuagcccguuagauucccucgggcaguuggguuuuggugguguggguuuucucuuguugagguuuguugaucagagagacaaagaccugacaacuggauuugagaaauaggacuuaaagaugguggcaagaugugggacauuuuuaguucugauguguucucuaauccccccaguaauuucucaagcugauuuccaccccuaguuuucuuccguuacuccugaccucuacauacacugcucuacucuacauccacagcaauuggcugcugucuguuuaaucuaccuguguucucuccuuuggguugcauaaaaccuuaguguugagguggcgucuauaguacaauaaauaagugcuuguaucuccaugcauauuuaagucuuuagagaguaucgaguacaguuuuugaaaaaagccuuuuuuguuauuauucuguaagagaaugugcuaauaagaaaguugcuguuucucuuuuccccucgagccucuuucuucuucgggguguggagugucacugugcauggcucacauucuuucuccuggcccucagugacuuguccuggaaugugagucuucuucugagucccucacucuuccuuucuccuuagguaaauuugaugaagucuaugaugcgcuggccggugcccauccuaaucuaacggucuauaaaaaggaggagauaccagaaagauggcauuacaagcacaaugacagaguucaaccaaucguagcuguggccgaugaagggugguauauuuugcagaauaagucagaugauuuucugugugaguauguuaucguauuucuuccaauucugcaccguuucuugcuaacuuggaggcuguggauaauacagcaguuuacuuacugauuuuuuuuuaacucucuguuacuuaaacguugaaggaucuguguuguauugguacucaccuagaaaugccauaaagauauacacaggagaaacauacaagguugaggcuaccgcuugguggcacauagacuugccuagcauguaaaaggcccugggcuugauccccaaccagggaaaaguguguaaaaaugucucuuuaguuacaauugaguucuugcccuguuuagugacugaaagcaaaguaguugcaugacuauguacuuguaguguuucugugacuccuaauagcggauguguacagcuacaugcauucugguuucuaaccguuuguacccacaaauaaucaguaaaacagcaucugaucacaccaaggaaacugggaaggcuguuuccugagaauaaucuccaccuucauuuguuugugaacucuguagguagauguauuuauuacucagaaaaggucugcugcuaucugagggcauuuucuauuuucaaguuaaccaaaauuuagggagacgcuguagggcguuugguucugugagcuacaguuacacugugggcuggucacauuuauguuguugauagaaacauuccagcgauccuguuucuacugcuuucugcuuccguguucaauggagaauucaacucugcccccugugguccuuuucugucagaauucuacaaguuacugagugcaaaggcaggaguuuucaaaguguguccuuugguacaucagugucuaaaccaucaggaaacugucagaaaggcacauccuugagcccaaccuagcugcacugaauuggacacugggugaacauggccuacuccucuguuuuuacauagacccuaggagucacauucccaaccuagucugagaaccaucacccuuggacacuuauuauuaaauauuguccacuagcucaaaugguaaugguaaccacuaccauuaaaaaacagggucccugcucauugcgauuuccucuggacucugauucucugguccauggcgugugagagaauuaucguugcuugcucauaugacuuagacgcuagauccugaguucucacaaaaaugaacacaaccuaaaucaacucuggauuacauaacgguacguuucccaguguaauuuaucaacuaaacagacgagcacagcacccugucugaugguugcuauuggcuuauaagcccagcaauauucaugcucgagugaacuaaaaggaaugguggcguucagaauggguucugcggguggaguugacucacaggaagaugucagauugcuuuggggaugacagaucagugacuuucagagaagugaacuugagcuuucccguucuacaugugaaugcuguuguggauuuccuuguagcaagcaaggauaaaguaauccaguuggagucacgagucaugcuccucauuauucuccaauaaaagccugucaguuuucuuaggucuccaucuuugccauaaccguggccaugccuuugcucugacagcacgccagccauacauucagcuuugaauacgcaguuucaauccccccuuuuuuuuaauggaaucacugggaaaugcccaccagaagaccucuucagguuuuauuuguagccacacuaacgcacugcacccucagcugggucuccaucggagccaccaaacuucucagucccccuacguguccugaccuuugaguuucagagugggucagagcugugacuaaagguuugauggcugugcugucucguguuuguauagugcucuucacucucugcuggccaucagggguucuacuuuuugugacugagacuuccaccaccuuacuuuggaaugacaguuagacauuguagcuacccaggaaguauuugcuaagaaucagccagccacaggacaaagcaaaaucaaccaccugccugcaucccccagccuggcuuggcucagcuuuucucuguucccuuccuucucugugauuuaagguaguacaggccuguaagaaagacggguaucuagguaacauuugacuucuugaggugauuuguggggcugacagcagcagagaugauaagugauaacuucauuuuuuuaaaauaaagucaaauuggauaaccuuugcacuuaaggucagaacuugacccuacgacaguuucuuucccuucuaaugccaucugguuggcuaacuuauucaugcauuuucucuuuacaguaggcaaccaugguuaugauaaugcauuagcagaaaugcauccaauauuuuuagcccacgguccugccuucagaaagaauuucacaaaagaagccaugaacuccacagaucuguacucacugcucugccaccuccucaaucucaccgcccugccacacaauggaucauucuggaauguccaggaccuucucaguucagcaacucccaagccaauuccuuacacacagaguaccacacuccuccuugggagugacaaaccaggggaggaugagcaagaggaaucguacccuuauuacauaggugucucucuuggcagcaucauagcuaugguauucuuuguaguucucauuaagcauuuaauacgcagucaagugcauacuuuacaauauaggcaggucgaaguugcucaaccguuacuccaagcuuagugcuucuuugacauggaauggcagaucaaaguggaggguccgaaauucuaucagcggugacccuucagcuucucacaagcuagucacagauaucugcauaggccaucaagcaguuuacccauacgcgggcccagucacagguacauacacgcacaccgacagaucgaaacacucccugccugcaaaugaucaaagacguuaaggguaccccuccacggcuuucucuggcuuaguagguagauggugcucugucugggguuggcacguacaauguacauacuuaacaacuuugcacuauugagaguaccuaagugcuauccuaguagguacuacuucucugacaugcacuuuauaaaugcaucuaguaacuugauugaacaugauauccuucuucaucucugucaccaaauacuagcauuccauguacagagugaaggaaguuucuagcaauucccaaaugauguagaauucuugucuccuuaaauggaaggaggaggaggaggaggaagaggaggaggaggaggaggaggaaguaaagguguugaaagucagcaggaccaaguuuguagccugcaucuggauagaugcuuuuccagcagcaggucgcacuguggacauuucuaguuaugccccccacccacaccucagugaccaucguuuucauuugcuucuucccucagcuagcuuccagcacugaaaggugaauucuaaagaucuuaucucuauacauuaguauuguucccuguggaugagucuaguccugacuccgugaugaggaugucaugccaugcacaugagucuuccuuucuguguagaauagcgguggccugaaaagcggggggccagacaccaucucugcuguguuuuuuuuuuccugccugucaugauuugcauuauuaaucauauuaaaaagaucaagugaaauuuaaaaaaaauaguguuuuguuuugcuuacugguuguuucugguggcaagaaguggcauacagacaccauuuaacccugagccuuucaaaauccagaguugcaaaagaggacaaacuguauuagguaacauauaggccaccaaacguuaucaagaauaccaagaacccuggaaaauaaauugagggagagauacauaaaugugcagccugucaccauaguaacaaaguguagcucuaauagggcaaaaaagcuuuugguuauaauaggugcgggaacacacaaacucggagugcuuaauuuuguuucaagaaauauuugaacauuucuuguaacaccugccagguguuuacugauguaaaaggaggaugcacuuucccagau

SEQ ID NO: 8617 - RNA, 1770 nt, Mus musculus
cgggguagcggguggggacacccgagaggcgcggaucuccaccgggaggcuugggagucccuggcgguggcugcaacgagcgggacgcgggggcguguuuggcccagccgccgcaagggacuugaaguuaacagcuugcaguaggggccccuuggggcaccguguccugggugcgcuggcgccccgcuccggguuccaguacgguaguggagccccgcagguucagcaguccaucucggcggugcguguggcuccucgcuguccgccaccgccaagcagagcgcggcugcccagcucgcggcgccgucgcuugcccgcgccgccuccuccgccuccuccuccgaggccgcugcgcgcuccccgcgccggcagcgcgcuccgaguccuccggccgccgaguccuuccuuuccccggcuucuccucucgcccucuccuucgccgccgucuagcucgcagccucgucucuccugcucuuugcaaagugccccgggccccccucgcguuucaaggugccgggagguaagugggggcggggggagagcggaucucggggcgacagaucuggagccugcggaucgcagccgcugccgccgcccgccggccgcuagaagcgccgcugcgcucgcucggcgcccgaagcuguagggaggagguccccgccuaggacaucgccgccugcguccucggcuccccacuucacccucaggaccgggaaccacuucucggucugacgacgcuaaagcugagaagcgggagagccucaggcugcuccgacuggcguuaauuuuucguuguuaacuucaggagaggaggaagggaaauucucaagucuccacguugacuucugagcacucuucacccugcccccaaccccaccccacauugguuggggcggggggcagguuuuuacaggcuucgggagugcccccccuuaggugacaccaaaaugggugacaggaguguuugucaaaauaguuuuagaaacucuaacggaugucuggacacuuuucuuauauauuccuucuugucauuauuggagaauaaggauggguugcuuuuuuaauaaaaagaacuaaaaaaugacagcuugguaauuaaaauaaguuguaaguugauaaaaugcuugcugggaaagggggaauacacagcgguuauccauucauuucccaaucuuuuauuaaguguagucuucgucucagacuaagucuagugucuaacugucuuucuagccacuccccacuuugggggguuaaaaauaaaaaguuuaaaaaaaaguucaguaauuauuuauuuauguuuuuguuucccggcguuauggggggaggcgauuuuggaauccccaaaagauugugguugagagaugaaggagugcggggagcggcagcaguuuuguuuuuuuuuuguuuguuuuuuuuuuuuuuguuuguuuuuuuaccuaaaaugugguuuuuggaggcugggauuucuaaugauuagguuuuugugguuuauauagacacgacucaaacugaggcgaucauuauacugaugggaaucagaagcacgugggugucuccgaccagccucaaauucugagccuucaaaacaaaucaaacaacgugcggcggcgcccacagaagccgggaaauccgccggaggcugauacaccccaagaaccaggcagaagcaauaucgggcuggcucaccucucagcgugauguucuguuauaugucuugccuaaccuauuauuuuaaaacuuccaacgcuuccaaauagaaucauuuuacca

SEQ ID NO: 8618 - RNA, 911 nt, Mus musculus
guagcuuaaagaaacagacauuuguuucucacaguucuggagaccagacaucaguccccagcccccaccaggucccaggccgcccccuccgagggcuuuaguggaggcucugacuuuggcuugugguuuuugccugcaggcuguaugaguccugucuucgggagccaugcuggggagagagaaauacaggguaugcauuugggccaugucuguagaaggaggacccugagaauggagaauggucaccccuccagagccucuggaucuuagagaugacccuccucucugcugugaaaggggaaagggguccccaggggcuacagagacuggguggucugggauguaggaggucagagaggcucaccugggauguggagggagggaaccccuuucacaugugaggacagaaacggcugccuucccaggguggcggguagagaggaagcagccccuagcagcuggccagccuggggcagcaaggagcagcugugacugagagcuagcuuguuuccccacccuucccguccccucccccaggcuauucugggcaggaggggaugugaggucugagcagagaugggguggaggaaacagcgguugcuucaaucuccacuucaccucuucaucccuggagagccccuccuucucuucuuugcucucuucucugguugggagggacuaauuggccugcaggccccagaacaaggggaucacagacggcggcaagcuuuuuacauggcugcuggggaauccaagcucagcuccucacgcuuguguggcaagcaagcccuuuccagacugaaccauagacucagcccccugagcuucuuauacucaccuucagugcuggguuggccuccuaauggaucacuggucuugacagagaaagauugagacauccuaaugaaagg

SEQ ID NO: 8619 - RNA, 34838 nt, Mus musculus
acauggaaagaucaugauuggaaaauuggugagaaaaacaucugaggaagacauauguagauguacagaggaugugaagauauuugugucccaaguaaaugcucuucaaaaggugacuucagcuaaggaguucauuaaucaaguagauaggaugaccuauucuggggacagucaaccucuuucccuagccauuccugucauugcccaauguccacaugaacaaaauggccaugguggcauagguggggguuaugcaugggcucaaugauacagacuuucacucaucaagacugaccuggcuacagcuguucugagugccaaaucugccaugccaacaucagagaccaacauugaaacccagauaugaugccauuaccuggggugaucauccagcaaccuggugggaggcugaccacauuggaccauuuccuccacggaaaggacagugcuuuaucuuuacuggaguaaauagucugguuacagauuugcauuuccugcaccauaaugcuucugccaaaaccacaauuuaugaacuuacagauugccuuauccaucaucauaguauuccacaaaguauugcuucugaccaagguacucacuucacagccagagagaagugugacaguggacccaugaucauggaauccacuggucuuaccauguucuccaccauccuaaagcagcuggccagauagaaauauggaauggccuuuuaaagacacaguuacagugccaguuaaguagcagcagccuagagggcugagguaggguucuucagaagacaguauauacuuugagucagcauccaguguaagguacaauuucucccauagcuaggauccauggguccaggaaucaagggcuggaaaagggaauauuuucacacgccaucaccccuaaugaacccuagggaaaaaaugcuuucuguuccugcaacccuaaguucuuugguuccagagggagaagucuccugccaggagcugcaacaaaaaaaaaaaaaaaaaauccauugaacuagaagcucagacuuaaccccuggcaacuuugggcuucuagugcccuuaaaccuacagguuaacaaaggaauagcaguguuaggaggaguaauugauccagauuacuauggggauauuggauugcuucucccacagagguacaaaagacuaugucuggaaugcaggagauucuuuaggaugucucaacguacuauuauaacaugaauuaaagucaaugggaaacuacaacaaccuaauccaggcaagaugacaaagggcacagacccuucaggaaugaagguaugggucacuucuccagggaaagagccaagaccugcugaggugcuugcugaggauggacaaaauacuuaauagguaguagaggaugguaguuacaaauaccagccaaggugaugugaccaguugcaguugcaaaaaaggaaaaaaaaaaaaaaaugccggguggugguggcacacgccuuuaaucccagcacucgggaggcagaggcagcaggcggauuucugaguucgaggccagccuagucuacagaguaaguuccaggauagccaggaugacacacagagaaacacuaucuggaaagaaaaaagagagagaauaacaguaauuaucauuauuuaaguuuaagauacuaaaaggauguccccuaaaggacauugccacuuagucuaaauuuauaauuuguuuuuaguuggaccaggguuguacgaguuauaucauguuagguguaauuaugaccugguuaaauauauaacgcaucugugauuuuacauggaaugguuauauuauguucaagcauuaucaugaccugauaauuguuuucauuuggaaauuaugacauaagaagcuaugauuguguaucaaguugaaaagagguggacuugugauggcuauucuugguugucaacuugacuauaucuggaauaaacuacaauccaguaauggagaccacauuugugauuguuuuucugcuucauuugaagugggugaaucuacuuccagucuagaccucuaagguagaaggcauacaucuuugaucugaauuuuaagguaggaagacacaggcauuuaauccaaaucuugagguaguaagacucaauccguuuaaucugggccauaacuucagcuggacaucuauauaaggacguagaagaaggaagcuuuugcucuuugucuacuugcucuugccuugcuagcacauccauucccucacuggcauuaaagccuacuucugcauugcagcauauacugaagaccagcugagacuugcaccuuagugggacugagcaacuacuacauucuuggacucucucuguucacagcuagccauuguuggaucagcuagacuguggccuguaaaucauuccaacaaaucaucuugagaggggacuguuggggggagauuaauucauucuuuagguucucugacucuagagaacacugacuaguacaggacuaacucuuaagguauggucuuuuacagauaacaccauucuguuuuccuucucaaaguccugguaugucuuugccaacuuuucaaaaggaccuccuagaaugaaguggugcauucaggcuaucgcuguaguauaccaugucuucaccagugaccaccuccauccacauggauuuuuuuuuccuuugauaaaacaaaaaaggaggaacuguggcaaugcauugugauaaaaauaucucuuacauccuaggaggcuggaacuuuugacuagcucucacgggcagaguuaauaauacacccugaggucacuuacuauugcuaugcuacuauguacucugccuguuuuuuaaucugccuuuaagagaacaauauuaaaaccagcuuuaccugccuugggucaacuuuugggauuguuuuguuuuguugggguuuuuguuuguuuuggguuugggugguuguugcugcuauuguuguuguugcugcugcugcuguuguuacuguuuuugagacuaggucuuugugguccuggcugaccuggaacuugguauguagaccagacuggccuccaacucacagaaauccuccuacuccugccucacaagugugggauuaaaagugugaaccacgccaggugguggcggcgcacgccuuuaaucccagcauucgggaggcagaggcaggcggauuucugaguuugaggcuagacuggucuacagagugaguuccaagacagccagggcuauacagagaaaaccugucucgaaaaaaaaaaaaaaaaaaaguguguaccaccaugcccagcccauaugaucagcuuuuucagauucgacuaaugcauagcuauaaucuugaguuaucuauucccauagcuauaaucuugaguuaucuacucuuccaugccucugacccaagagugaugcaugugugcuuauacauauguuaugauaaucauuugcuggaaacagcgaauagccugaaaucuggucuuuaaaaggggcagagugaagugacauggauacacaguaugaacaguguguacacagaaugaggcauggugggggggugaugguucgcagacagaucuagagcuguaguucucauucuucaacccuuuaauauaguuccucagguuauggugaccccccccccaaucauacaauuauuucauugcuacuucaugacuauaauuuugcuacuguuaaugaaagcauacuauaaauaucuguguuuuccgauggucacaggugagucaccccugugaaagggucauucaguaaccccaaaggaguugcaacucacaggcugagaacugcugugcuagagguaaagaaagacaugaggugcacucuuuccccugaaccuccaaggacccgacccugggagcaacuuguccuccuaccucugcuucugaagucagaagagaacccacuucucuuaucaaagacguuuacuuuuuuuuucuuuacuauguauggguguucugcuugcguguaugucugugcacauuuguauggugccugaggaggccagauggcaguuuuagacccuuugaacugaaguaacaugcaguuaggagcuacucugcagguucugggaagcaaaccuguauccucuagcuccaccagugauuauacugacugugccaccucuccagcccagaccccauuucuauuuccuacaccaugguagcucuagaagcuaauacauuuuucuuuuccuuuuuagauuuuuuuuuuuuuuuugaugcauaugagugucuugccuguauguauguuggaugccuuugaacuggaauuacagaugguugggagccaccagaugggagcugggaaccaagcccaccacccucuacaggagugguacauacucuuaaguacugaaccaucucccccacccguccuuguuuguuuuguuuuaaagaauuucuaaauuggggucuggagagaugacucagugguaaugaacacugccuguccuuccagagguucugaguucaauucccagcacccacacggcagcuaacaaccaucuaucuauuaagggaucugaugcccucuucuggugugcagacauccaugcaaauaaagcccuaaaauauauaaaagaucuuuuuuaaaaauuccaaguugaucugacacagagacccuuuuucacauaguagcuauugguaugcaagaagcacagucucggggaaucuggcuccagaaggacagcaguggucuaucuagcuuacgaagggaacuuuaagcugugccauucuccauuuugccaccauaaucaccuucuggaacuggaucugacugagcugacauuuacuuaccugaggaaaauacuuaaauaucaacuucuagcucacugguuuuguuuuuguaccuucucguuuuauuuauuccuggagagggagcgcugaaaaccacagcauacacauggaggucagaagacagcuuucaggagucaguucuucccuuccacagagggcuauagagaucaaacccacaucacugggcuugcucacuaagugcuuuuaccugguguugccagcccucaccuaucuuuuaacaccaagagacuccacaaaaaaaacuuaaucccaagauuagggaugaaagucaacagcaacaucaggacaugggugggaagaguguuagucauuccuuauaauguuccccaaauaaauguacucaauuaaagacaagcccucuagcuccacccccaacaccccucucauuuacacacuugccagcacugagaaaacugaugaccuagcaucuuuacuucaaaaugaauugcaugcacccuaccacaguaaucaauaccauauuacaaaaacauucuuuaaggcuuuuuauuuauauguaacguucguguauauguacgcaacacaugagaggauguccggugaggcaggaagaggguuugagacccucugaugcuggaacuacaggggguugugagccucccuugggugcugagaacugaacuuguuccuucuggaagagcagcgagcaccuuuaaccguggagccaucuccccagucccugcaaaacagucuuagucaccuaauguggcuggaguccaacuaccagcucuuugugguggauccaauugugguuuuuaaucuuuuuuccucaggaauucaucuuugugggucuccuuucucgagagucuccugugcccugaggugggacacuguucccaaagagaaucugcuuuuccucaggccccaggguucaagagucauauaaguucacugcucuguuugggaccaguaucccccagacccugaaugcacaggucucauguuaugucucagagagguuuucuuuugucacaugaauauauuuaugccccagacuuuuaugccaauuacaucauaggccuuuucaucagcaucuguaaaaccuguaguuucaugugaauuucuuuuuccaggaaauaguacagguugaucuguauggauguauaggaaguuuacugaacauagguaaauagggguugaaaucugccugacaaacagcucacuuguacaucccucagcuauauccauuagagggagguuuguuuuguuuucuaauuaugugauaaugccaugugggcuuuaaggaguccuauagacagcaccaacaucucucugggaccacuuguauuuccuucacgaagagcuacaucauccugaaggcucacuuagucucugcaucuccuuauguucucucccuuauggucacuguaaguuucugagucuggcucaaauguagaauucugaguuuauuugaaaucccauugaagaacucauuuuaguguagcugugcucugacuauccauagcagaauuacuaucauucauauuuguagccaaauaaccaugccacacuacugccuuuacuauugggauagaacuaucuguugcccccugaacacacucuuaaguuuguuagagauaggcacuuuuaggcauugggcuauuuggcugauaguuuaagagauucauaggcuggguuccuuuguacacacgcagaaauguuugccuuucacauacagauucuuacagaguucaaguagaggaaccucaguguugagguucucaaggcagugguagccuccuggaugcuuacugugggaucauccugcauuggaaggacaccagccaucucucugaguucccugucccguuccaaauccacugggaacuuggcccauagggucacuaaaaagugcaccaccccugucuggcacauuccccagucaaaguggaagugcagauacacugucuuugauugucagaccaagcaagaaaagccucacagaccugcugcgugaccuugagaguaaaacuggauaguacuuugccuugucagucagugccaccacugagcuaaguuuugggagccaauugcucaagaucaaaaggaaacaguccaaccaaaguaaaucucucaaaauaaaacugugggaugcaucucuuagggaauuguuaaguuuccuauugcuauaguuuggauauggcuuggucccucuggugauugaccuuuacuguuaccuugacuagauuuagaagaaacauacucuguguaucugaggguguuuuccucagagacauguaauggaggaggaaagacccacccucaauauggacagacucuucccaugggucacaaaugaaauaaaaaugagaaauccagcugagcacccagugggaccagaggcuucauauugcuacuguuguaccuucccugacugugauagaccauguacccuaaaacggagagccaaaauagcccugaaauugcuucucaucugauacagcaaugagaaguggaaaaaaaaaaauacuguccccaauacagugacauugaaaacugauaggacugacuagcugauggcacgcgccucuaaucccagcacuugaaaggcagagccaggcagaucucuugaguucaaggccagccuggucuccagagugaauuccagggcggauaggacuacauggagaaauccuguaggacgagugggagaaaaugaagaaaauugauaggcuuuugauuaggaagagccugaugagaggugaucugguguuuacugucccuaugagagguaaugcugguuucaaggagucuuucaggagugaauuagaucuuuugggguaggaaguggguuacugggagcaggccuuguggcucuacagccugguacuucucccuguucauauuuggacuguagauacaaugugagcagucaaccuccuacuaccacaauuccuuucaugccugcugccaugucuucgcuaccauggucgacugcaucccucugguaaugggaggcaaauuaaaccuuuccuucuuuaaguugcuuuuguuagaguauuuuucacagcaaaacacacacacauacaccacacaaacauaauccccauaucaaaaggaaaaagaccucagagauccaacuuugccccucccccuauaugagugcagagcaggaaggcagugucucaccagauaccaaaucugccagcaucuugggcuuggaauuuccaggcucuagaacuagaagaaggaaauucuucuuguuuauaagcuaccuggucucuaauauuccguaauagcagucugaggaaacagaaacacuuccauaaugccugccugcuaccauuaaccugcagugucugaguaaaaccaaacaugagcuguauauuagugucagugcaaauaccaagcuugcauuggaaguuuacaugugguuagaaaauaucccccacuucaagagacacauguuuaagguaguaggucugaagguguaaaggagucugaugugugucacuggcuggcaagugggucagcaaauagagggagaggaacaaaagcacgggcauacaugcuaccaugggagaggcuagaugagggcacccaggugucugcuuuauaaucagugcaacuuuucuacacaucuugaaaguuuucacaguugaguguucaacaaggccaaacauagugauuccucauucgagucaaacaaaugguuuaggacagagacaaugucaaaagcaaagaauaaaaacacccagcaauggcagaggcuggcugggagggcagucagcgaaugcuugggggcucaaugucucugcucauuguugucuugaaaaguuggaagcaccuguggauagagguacagcauuaaagagcgcguucccucacaagcccaacagcucucaagcaacacauucaacccucagagcacggugaggaccucugcccagaggaccuucuggaggcagaaggcacacccacucuaggagacgcccugccaccucugagcuccacgugaagccucccaaaggacugcucuucugaacuccuccaguuucuguaggugguuugugagauuuugugaaccuaccaguggagaagaaaccauguaggaagggcaucggcaccugccaguugucaagcuccucgacuucuuuuaucucguucuucaaauuguuggcuuuuuccuucucccagaaaggcagacugcaggaagaacacagucccacugaguuugaacguaugccguguuaaauuuacaaacaccaucuaugggaaaggcacugcaugaccacaugaccauaaagugaacgaggccuccacauuaaggagcuggggagauugcucagugaguaaaaugaguacgguuaaccccaaggaccugaguucaaaccccagaacccacacaacaaggcaggguguggucagcaccuaagaauagcaccuaagguugaccucugaccuugacacguacacauuccaacacacuaaguaaacauaaaaauguggauuuaacgccgggugugguggcgcaggccuauaaucccagaacuugggaggcagaggcaggcggauuucugaauucaaggccagccuggucuacaaagugaguuccaggacagccagggcuauacagagaaacccuaucuugaaaaagaaaaaaaaaaaaaguagauuuuaaaaaacagaccuaaacacagagugauuccaaagcaauagaaugaccuaugauauuuuagcuaaaugcaaauggaauagagcaagauuuguaaucuuuuaaccacugacccuucucuucagccccagagaguuguaaucuuaagauuuauagauauggaugagaguaaugcaauuguauaaagccuacccauccaauaacaugggaaauaaaaggccaccugcauauuuggcuucauaauugaggaagugggcaguccaagugacagagcacaguguucucaacaagucugaagagccagagauaugucaucaggaaaccuuagaugcacagaaaaggcggggcaaaauugggggcggggagcuacacagaaaaugaacuuccgaaauuuguauaccaguucccuugaguauugcugaacguuaagacguuuauuauaggguggggugccacaggacaauaauguagucuaucaugggcugcgcuggauaguuuuaugucauuuugacacaagcuaacaccaucugagcagggaaccucaagaaaaugccuccaugcugggcagugguggugcaggccuuuaaucccagcacucgggaggcagaggcaggcggauuucugaauucgaggccagccuugucuacagagugaguuccagaacagcaggaaacccugucucaaaaaaccaaaaaaaaaaaaaaaaaagaaaaaaaaaagagagaaaagaaaaugccuccauaaaauggagguuguuggcaggucuguaagacauuuucuuaguugguaacugaugugagagagccuagcccauucuggguagcaccauccuugggcuggugggccuagguucuauaagagagcaagcugugagaagcaagccaguaagcagcaccacgucugcaucagcuccugccuuuaggucuccagguuccugcccuguugaauucuuguccugacuugaugaacugugauauggaaguguacaccaaauaagcccuaagguaugagcugcauuguuccuggcucucacagaaaacugaaaaauccuucuaaaucccaccaacaaagcggaaaacgucauugauuacuacaagcauuugguaaagacuccaaaggggguaguuagguacucuauaaaacuauccuuagagaaguccuaacaacagucaaaauauacucaaaagcaucacaccuuuaaaaacuaaagaccaagcugggcagugguaacacacacuuucaauccuagcaaucaggaggcagagguaaguaaauuacugaguucaaggccagccuggucuacaaaucaaguuccaaaacagccagggcuacacagagaaacucauauauguguauguauguguauauauguauguauguguauauauacauacauacacacacauauauaauacaguauagcauaacacaauaggaaaaccauccugcuuggcauuuuaugauuuauacauacuauuuucauauauuuauaagaggcaguuuacaaaaacuaaaauggguaggaugguaaaauuaggcaguggcuaauauuuugaauauucuagaauaauguuuauuugaaaagaaagugcagacacgagaagcuuaauuauguguuguaaggaauaaugaggcauaaugaaggcauuagaggugccaaguuuaaaauaaaaggcuuuuauucccacccugcucugaauccuggugugugagacucgggagcauacaugccuaccucaccauauuacaugagacuauuuguauucaaaaauugagagggaaaagagguaaauaaauacauaaauucaugggcagagcagaaguuugaaaucagggggcugggaauauagcucaguaguuaggggcauuggcugcucucccagaagacccugguuuaaugccuugccagcaccuacacuauggcuugaaaccauuuguagcuucaguuucagggaaucuaaaacuaucuggauaucugggcacuggcacacacaugguacaagcaaaacaccucuacacauaaauuuuaauuaaaaaaaauaaaauucuauaagcauggaauuggggccagugagauggcucuguggauaauagggcuugcugccaaguaugacagcgugaguucaagccuugagacccacauagugaaaagagaaccaacuuccuaaggcgaggcauaugugccucuauacaugcacacccuuuuuucuuaauuuuaguauaaaaacagaggacuaguauuucccucaaguacaaggauauucuauuggccuucuguuugguuuugaaacacuaaccaaguucccccaguuggaaucauuaaauguguguuucuuuuccagaacacucuaauauucuggaaacaggguaucauugauuuugcuccauguaaacuacuuucucaugcauacccaagcacaccauggcaucuggcaguuggccagugucauauguagaauuuggcccccucccauggccagaugccacagacccuuugacuuccaugggucucuccaacuguccaccauauauauucugcacugacccuguugcgggacacaaaagguccccaugguuucacugacugaaggccccuccaugggagaaaaguguuucauuuccacagagggaucauaaacaaccuggugaaaaacucacuugggaauuuuuggaaguggcucaagugggauaaaugugucgaauuuuuucucguaagguccccuggggggaaaacaaaacaguaaaaacaaucauaaaauugcuauggcuucuaaaagcacagagagcaacacaugaucacguccagaauguguccuauuuucugguaucaguucucaaacaugagcuucaagacuacagagaacaauguuucaucaaaaucauugacucccaccagacggguuuucuagauauuuucaauauaauacaaccacuguuuguucuuucaguugaugacucuucucucuaaucauauuguucuaaguuugcccccaccuuuaaagucaacccacaaacuagucacuagcaaucagacuuggugcgaaagcuccgaaguccacgagugugugguaauagacaucaagcaaaaugaguaacuacuauuucuggcuuuaucagguuuuaaaaggauaauguaauggguuuugugacauucccauacguguauauuaauggaguuaacucauaugcauccccccacugcccuccuaacuauugcaauucuuccccaaagagucucccucccagugacauuaugugugucuguauauauuuguguguauguguguguguguguguauaaauauauaugugugugauguguguauaugagugugugauguguauauguguguguguauauauaugugauguguguguguauauauauauguguguguguguguaugagugugugauguguauauguguauauauaugugugugugguguguguguguuuaaaguauggugccuuuuuugugguacugggaguuaauacuaaaaccuugcacaucaaagcaaguucaccaccaaugaauuauauccucagccuuccuugcaucuuauaggcacaaaguaaguaaauaugaacucuuuaagggauuuuugcauccuaucucacugcuacccaccccuuuaaaaaucguuccuauacagagacuauggaaaagguucagugaguaugagaugcugugaagccaacaggaucuggauuucaaauucccagcacccacauaaaagccaggcacaacuggguaugcuugugaccccagcgauaggggcagagacaggcagauccuagauacucacaggccaacugaccuggucaaaaugucaagcucuagguucagagaaauccagucuaaaaacauaagugcagaaagcaauagagaaaaacacuguguauccuccuguggccuccacauacacgugugugaguauacacuccugcauaaauaggugcuuuuaacacacacagacacaccaagauacguaacaaaauaccuaaguacuguuaauuuacacucagcagagacgguuaauaaaacuggggaaugagcauggacucacagugagaaguucaccggaggcaaaguugcucccgcuuugaagaacucuuuacucuguucugggaacauguacggauuauccccuggugucaauuuggggauuccauuucugggaucaauaucugugggaaaugucagaaaacaucacacaucaggcugaagccaaugcccugucugcugugagcaacaaccugacagugaacaauccggucccuucauguuuaucgcaagauaaauuuguuaucccgccuuaggaaguuaaaguucaugggacuuuuuuccccaugcuguguucucagauaugauuacuuaaaaacauggagggccgcagaagagcagcuguggagagccauccccuggaugaggcguggcuguugcucacacaggcucacagcggcugugcaagauuugccaauuacauuuuucagcauagguugguugggaguagcuucugaggcccuggggaucuguuggcaguugauacccucgaggagagggacagucacuuuuauuuaagaguauggccacugguaggguccccacaccaccucacaccaauacacauauggacagccccaguagaagguuaaaaauucacuaauuuuuuuuuaaaaaggaaagauuaagguugggaaggagauaggggugaagguuccaagaggaucagagguggggagcaacgugcagauacaaucaagguacacugggcacauguauaaaauuuucaaauaauaaaaauauaaguuaaaagaaauaaaaacgugaccaagugguaaugguguaugccuuuaaucccagcauucagaaagcagaggcaggcagaucucuguucaaggccagccuggccuacagaguugaguuccagggcagucagggcuacacaaagaaaacucacaacucuccauaauucuagccccaggggaucugauaccugcuccuggccuccacuaggcacacauguaguuacacauguaggcauaccuguagguaaaauacuuagacacauaaaaaauguuuuuaaaaaaaugaagaggaaaugcagggugggaagaaggguauggcacaagcauaaagaccugaggucagauccgcaguucucaugcaaaagccaggugcaguguauccucuguaaccccaaaacucaucaggcugagaugggcagauccuuagagcuugcuggccagccucuacagccacgggaguucagugagagacucugaaucaagaaggaagggagagugccagggcaucaugcaugcuaggcaagcacacuaccaacugagugccauuuuauucuaugauugauauuuuaaaaacuaaaaacagagacgugugcuacgcucuccggucgagucaacuggacaagccgaaaggcuuaaaagucacucaugaggcaaaagaguuucaaggaagcucuccuggagucuaguguucucuacccauacauuaauuuuucauucccgaguuccauuaccgcgcuagucuagaguauggauccacgugcucucuuucaguauuuuccuauaagugcucugacauggcuaaagucuuccgccaguguuccaacaguccaaggguguccuugaccaagaucaaggguuuagaauucagcaagauuguaaaagcuaagucacucccuuacacaggaauuuaccaucacuuaaaaagaaggaaguuucagaccaaaggagaaaccagaauagauacuauagcagaguuacacccauacacacguauuuacaauggccuaaggggaagguggacuauacaagagacuaaaauaggaacuguggcaaggacgcaaagcccuugacccuggcuucuaggauuagugaauuuuagguggagcccuuguugaucccagcuguuaucaauguauucuauccugggugguucccguuagaccuuuuguguuuauguuccucuguuuuauguaagauuccgguuaccucaauuguaccuugcgaauaugucacccaacuuccuuauuguccucugcauaaaaagucugaugcucgaguuguaaaauuacacucagauuccacacgaacucuccuucgugugugucugucugucauucauccacgcuuugcccacccgcgucgagagaccccguuccacgcagacacagggacccagaaggucuguggcagacgugauuaucauaagauacuggauucgcuaguucaucaagucuguguguguguauagcauucuggcuucaacuccaaauuaacacaaggaguaaaacauuggagugacaaaaaaagcaaguuguguacacucugggucuuaaguuauuggugguggugguggugggguguguguguguguguguguguucuuuauccagacaaaucaaagccuggguuugaaaaucuuuguccuucacgugaguuuuuacaagagaaguugcuccuucuuuuugcacagcuucuacaaagaccuuauucaucacugaggcguuggcagccuccuccuccauggguauuucuguaagaagcgcccucugaggaucuuuugagaagccaauucagagugaguugagagggagaacucaccaaguuacgaacuaaggugcugcauggauuuagauacggcguacguauagauauuuucguuguaguaaauuuaaaaauagcacuuuauacuucaugccaaggcuuacuuuagauguaugugagugacaggugcccuccaacugaaacaugcauuauuuccuucggacuucaaugaggcugcuauuaacaaucugaagggacucaucuggcgacuuaaaugccacauuagcauuucaugagagucggagaaaaacaaaaguggaccagcaugcauucugggcccuuuaucaaaaccugccaccuggaacgaggcucucugccuuccugucuuccuggcugcacugugggaaaacaggauggcccugcagagcuguucccagccagagaaagcaggcuccacagcugggacuugcuugcuuucuuucuuucuuucuuucuuucuuucuuucuuucuuucuuucuuuucuuuucuuuuuuuuuccaccuuugauggaggaaacacacuaccguauuucuucuucccgaggcuguuguccacuguccucucugccacagaccuccuguugccccggaagaccccauugaagaagcacugcuuuccaaugugguagguguggauguugcugcugaaccuuggauaaaauguccacucaggacgcugcccaucuucugcaagacaucagaaacccuucuguuagcgcugcuccaggcccucaagacaauuagaugacaagcuguuaaacccaccccuccucaggcccuaucggcuuacagcccucucacauacacacauuuuuuucuuuagauuuauuuuauuuauuuuauguauaugaguacagugucacucucuucagacacagcggaagagggcaucagaucccauuacagaugguugugagccaccaugugguugcuggggauugaacucaagaccucuggaagagcagucagcccucuuaaccgcugagucaucucaccaacccacauaaacuuuuuuaaaaaauguguaugagccuuugucugcaaguacacauguccgccacacaugcaugcaguacccacagaggccggaagagggccuugggucuuccuggacauggaguuacaggugguuaugaaccaccaugucagugccaggaacgaaacccagguccucaaggaaaacagccagugcuccugaccauguaugcaguuucacuauguaguccaggcuagacugaacuuuugugaggugugugcacgucuguauauacauguauguucagguagguacauaugugugaguguaggauuauguagcaaaaaucagcaucaaugucuucuucaauugcuuuuucaccuauuuuaaaacaauuacuuuugcuucuguauguuugggugcuuugccugcuuguaugucuguguaccaugugucugccuggugcccauggaagucagagaagggcacugacuccccuggaacuggaguuaagcuguuagccaccauguggguacugggaauaaaaccugugcccucuggaagagcaaucagugcucuuaacagccauacuaccucugcaucccuguccaucuuacuuuuugagacaggaucucacacuggaccaagagcucacucauuugacuugaucgcugggaucuucuuaccccugacgucacugggauuaugggcacauacucucgugccuaccguuucuuacauggugcuggggucuauacucagaugcucaugcuugugagguaagcuuuaccuacugagccaucuucccagcccccagccucgaucucuugaucuucagccuccuaacuguagguaugcaccaccacacccagcuaaacuggagacuuucuccgugcauaaaagcccuugguucugcaucagggguagcaucaaacucagggaaacuaggcacgggaggaagaggaggaaaguuauucaagaagcugcucaguuguaguuuuccuucccuuucagaacucaccaaaguuacaggcucacacaugcuacagaggcugggaaggguccuaacauccucccugugaucagccgucccuccaguggcuguggggagaggggggaugcgcacuauagaucaguucuggcagccuaucugggugcagcaugguccuggccccacauguguggugcaccacagcgaccuguggacacacagccaccaaagaagggaaaccacugugcuuccucaggcuagauacuggcccuuugggugcccaguucauuugaaacuguccuuauaaaacuaguuaaagugacuaaacaacaaaagaauccagucguucuagagcugcaggagaagccccuggguagccagcgaagagcagaggucagaugggaggcccgggggcuugggguguguucugauaggaagcccgggggcuugggguguguucugaugggaggcccgggggcuugggguguguucugaugggaagcccgggggcuugggguguguucugaugggaagcccgggggcuugggguguguucugaugagaggccugggggcuugggguguguucugaugggaggcccgggggcuugggguguguucugaugggaggccugggggcuuggggugcucccugcacuccgcuuccugacugcgagugcuuguguggaggacuugagucucucuguaacuucauuuccaucuguaacuccaguucugggcaaccugaugcaaacaaacacucauacaugaaauaaaaaccaucaguccuuuaggacgagaaaaacagcaaaugcgaacagccacacaggccugaagcacuguuacaggggaaggucugggacccaugcaacuagagaggacaugcucugcauacugcaacucggcuguucuagcgugucacuggaugacuugagaaaugcgucacuggguugcuucacucuucucugaaugcugcuguaugcugacacagaccuacacagagaggucaaugggcucaacugaggggaucucaauucaccuaggacacaucucugagcauaccagugagggcuucuagauuagguuuacugagguagaaaggcugguauguagacagaauccuggguugaauaaagagaagcaagcugaacaucagccauccuaucuaucaaucuauccauccauccaucuaucuaucuguauaucuaccuaacuacuuaucuauccauccauccauccauccaucuaucuauauaucuaccuauauaucuaccuaccuaucuaccuaacuaucuguagcuuucuuucugucuccucuaugugugucugucaaucugucucugugacuccaacguaucugucucugucccucugucugucccucuaucugucucucugugugucucuguuucucccuaucucucucugccuaucucugucucucugucugucucucucuguguuucucuguccuucugucugucugugugugugucucugucuaucucucucugucucuuugucucucucucccucuccauuuccugaauguggacacacagugugaguugucucuaugucuucccgucugcuguguggucuuuugagucaaaacaaacccuuaacuauuuuaaguuguuucuucacaggugugaaaaguaaguaguaauuaguccuaugcacaccguaugagggagcaagcuagccaagcacagugucaaacaguuagcuuuauguucuguguacaugugugugcaugcucuuguguugcaucaucauggugggggccagagcacagcuuccaggagucaguucucuccaccauguguguucuggggaucaagacuccggguggucagacuuagccacgaggaccuuagcccacugagcugccuugcccagccccuuaacuucuugugcuaaguagaaagaguauacuuuauaaugauggaauuguguaguguacuaaauaucugaaccaauaguguaguuauuuaucauuaucagauaugaugugugugcuaugcuuuuauauaacuggccagcaguagcaccauagacauaagucacguaugcguuacaacauuaggaaagcuaugacaucacuaggcaauaggaaguuuucaucauauuuugguagaaccacugccauguaugcaggucauaugcaacauaugaaugcuuuuguguguguguguguguguguguguguguguguguguguguguguguguauauacacaggucauauauacauuucaaaauucaguucuucacagcuauagagcagaauauuguuggggaauacugaguaagaggguuugcauucuauacacuuuuauauuucuuuagaaccuuuuauggcucucacaugaaggcacuucagguuugaaaaccguaggaccacaccucccacccagcugucaugagaaccggagaagaaacaugcuaaaugcuuagcacugggcagaggaggucuucugugacucgucccacaucagggcagauuucuugaaaggucccgggggcagagaccugugaaagaaggcccggggccacucaccugucugugaauugagcaggcugaauuccucgggauauuuuuccuuugggauuucaggcagcgaaacuuuugaggaacgauuagacugagcagaggaagaggaggaagacgaagaggaggaggucuucugacccagcuccgcagccgugcuggaaggcaaguggaaggguuagagucaucacugugcucaaaccagagucugugccagccagacucugaucuucuacucauaguacaugaguccucauccaacaggacuggccucgcuucucuauaaagucccugagugugguuuacugacucacagcuuggagguuccuauucaaaagaugugcacuuuaaaacagucagguaaagguguuugcugcacagccggagaaccugaguuugaucccugguaacauguguggcagaaggagagaacaaacuccugugaauauccuguagccuccaggcauacacugugucacacgauggauggauggauggguggguggguggguggguaaugggaucugaugcccucuucuggcauguagguguaucugcagauagagcacucauacauauaauuuuaaaaaaagaaagaaaucuuuuuaaaaacaagcugaaaacauagcuaaucaauuaggagcacuugcgauucuuacagagagcccugguucaauucccaucaccuacaugguagcucacaaccaccuauaacaacggcucuaaggaaucugaugcccucuucuggcauccacgggcaccaggcaugcaugugguacuuaaauacauccauauuuaaacaaauuaaauaagaaaaacaaacaaacaaggcacuagcuccuccggaagucaaucacagaauugcuacacgauccagcaguucucuccuaccccugggugugugccccaaagcacagagaacagcagcucaggcagacacuuguguaugaauggacaauacagaagaguaauagcucugccgauccaccaacaggaggugaucaggugaaguucagcguauacuuacacaaagggguauaacucggccuacaaaggggcgcaguuugcaacaugcuauaauucaggugagccuugaaagaauucuuugaaauaaaaauuaaccaaccacaaaaggaaaaaucaauacgacuccaucacuaugagagcagagaguagaugagagguuucccagagcuggagagggaaaauacugcucugcucaauggauacagaguuugcauuugggaugaugaauugguuugaaaacaggcagcccugguggucuuaaggccaucaugaauguacuuaaugccauuuuacugugcacuuacaaagggacaacaugccuuugucguauuauauguguccuaaagauuuauuucaugugaguguguguguugugugggggugcaugugugugugagagagagagaguguguguguauaugugugugugaguguguguguguguguguguguguguguguguguguuugccugcauuguaaggguaccauguacaugcagugcccauggaggccagaagagggcauaaaauccccuggaacuggagcugugguggcuccuggugagcugugggcuuccaugugggugcugggaacaaaaccuggguccucuagaagggcagcccgcgcuuuauuuuuuaaccacugagccaccucuccucuccagcuuuauugugcugcgauucacaccagccucucagcugcugugagacucgaaccaguguccaugcaggugagggcaguucccucccaggcuggcuugcuucucuuacuuucucccaucuuccuguguugccugagccugaagaaggggagggaggugaaacuggaaggcucguggucuucauaagaggauguggaugccucuuuauaauucugaucuuuuuucuugcaucauuuuaauaaugcaggaccgagaaagacccagccccuuggcauucugacaaguaaguguccuacccugagcuacuuaagaaguauuuaaaauuaggucuugcugggcgugguggcgcaagccuuuaauuccagcacuugggaggcagaggcagguggauuucugaguucgaggcacagccuggucuacagagugaguuccaggacagccagggcuauacagagaaacccugucuugaaaaaccaaaaaaaaaaaaaaaaaaaaaaaaaauaggucuuauaggagaguaagauacauaaaauaaaaauguguuuaugcauaagaaagggcuuuuaucgggcuggauguauuacagacaucagcgccaggcggaggcuccuggguaugguguugugggcuugauccccccucacagcaaaaacaaagaaaaacaaaaccuaacaucaaaauguuaacauuuauucucuacaguauggaauugugacuuuuguuugcuguaaaagugguuuuauacuuuuuaauuuuucuauaagaaacuuucauuauaucaaaaaaauuagaaaaaguuuuuacugcuagcagaaauacaaauggagaaaaguaccuaaaauauaaacacaguuuucuacguaauuauaaauucaaugucagugucaggacggcaagaucagguauaggcgcuugcugccaagccugaggaccugaguucaguuccugggguugaggaagaagaaaaaugacucccaaaaguuaucuucugaccgccacaugcugcucugccaggcacacucauaaaacaaguaaauaaauaaaccaauguugcaaagucauggagguuuuuaauuaaguacauuuccaggucaacagacaaaacaaugccagaucuuucuuccccuucucucccucgaugcccagguaccaucugugagcccauacccagaaagguaaucauacucuugacuguauuucuuacaauagucccucuuuacuuuucuuucuuuuucuuuuguguguguguguguguguguguguguguguguuucucucaaguucuccuuugaccuccauauauucauaacaauaugcaugaacacacagggggugggaggggaaauaaauaaauaaauaaauaaauaaauaaauauuuaaaagcaaaacaccagagucuaagagaagcgaugcaauuugcugaauucacucaguuuguuaguggaagacuugggauuugaaccuguguagccuagcucuaauguucuugccuagcaggucacacugaucucacacuaccagcuucuggcucacaguucaacccaauagugucgucuccucccccgaccaugacauacacacuuacucagagggagucaacacccugggaaggccuagggacucagugacucucggaccuguuccgucagaagacgagaggcugguccuuuuguucugacgagaggacguccuguuagccaagcaacuuuuagauucuagagcaucaccgugcuggguaucugcaacacagaugucgaccacuuaaguauauugcugggguaucacuugacagucuguuuuauuuccuauaucauaaucaaaagucggggaaggcagggaucuggugagauggcuuaguggguaaaggugcuuggagccaagccugacagucugaguucgauccccagaucucacaagguggcaagaaagagcugaccccugaguuuguccucuaaucucuacauggcaccauggcaccauggcgcaagcaugccuguacucacacacucaauaaauaaguucauacaacugcuagcauuuaguauuuacuguguccuggggaucauauuagccucucacacacaauauccaauaucccauccagcucucauaaguugugugugugugugugugugugugugugugugugugugugugugugugugugagagagagagagagagagagagagagacagagacagagacagagacagacagacagacagauagacagacagaccgacagacagagacugagcgcagugcagaaacagauucagguuauauauacaauacacuugccugggcucagaaaggaaacaucuaacuccaaguuuaacaacaagccuugcgaggccagagucuggacucccagccacuaggccaggcugcuugagccuccacaccgcucagagcaccuaggugucaccguacacuguguggacaccuugguacaacucuccagcauguuugcucaggucagaaugaaugaaaugaacacaaccaguggccaugaccugaagaagugccuucagaaguguccacaggucaccuccaauuaucaagccauuauucacaaacguaaccaagccacucauuugcaaacauaacugccuccaguggcaccucuaguagugccuggcgugacucugaucucgagcaguauuugaacaaauguaaagaggucagcagcccggggauggaagucagcaggcuggggguggaggucagcgggcugggcguggaggucagcgugcugggggggggaggucugugggcuggggguggaggucugugggcuggggauggaggucaacgggcuggggauggaggucaguuggaaauuccccaccuggugugcaggaagcccugaguuccauucccagacauaaaaaaggcaugguggcuuucagccgccacagccaucuuccaguaacucgccaaaaugacaaacacaaagggaaagaggagaggcacccgguacauguucucuaggccuuuuaggaaacacggcguuguuccuuuggccacauacaugcaaaucuacaagaagggugauauuguagacaucaagggaaugggcacuguucaaaaaggaaugccccauaagugcuaccacggcaaaaccggaagagucuacaaugucacccagcaugccgugggcaucauugucaacaagcagguuaagggcaaaauucuggccaagaggaucaauguacggauugagcauaucaagcacucaaagagcagagauagcuuccuaaagcgggugaaggagaacuaccagaagaaaaaggaagccaaagagaagggcaccugggugcagcugaagcgccagccugugccacccagagaagcacacuuugugaggacuaauggaaaagagccugagcuguuggagcccauuccauacgaauucauggccuaauguacacaaagaaauaaaauaccagcaccaggaagaaaaaaaaaaagucaugguggcccuugccagugauacuagcaccugggagguagggacaggaaaaucagaaauucaaggucauccucagcuacauaaaguguucaaggucagccauuguaucaaaaggaggagaaaaaaaagggggaaaaaaaaggagaccccccccagccacccuuaaugacaaaggaguccuuuaagucugagacugucacauggaaagaugaacuguuguuuguuuuuuuauuuugcuguaugauuuauguuuuuguaaaaguugaucuguucuuuaucauuuuagaacagugugugcccuguucaguuacuuuuaaaauaaaauauguauuuauuuuauguauaagaguacaccguagcugaauucagacacaccagaagagggcaccggaucccauuacagauaguggugagccaccaugugggugcugggaauugaacucaggaccucuggaauagcagucagugcucuuaaucauggagccaucucucuagccuguucaguuacuuuuuuuaaagagcuuuuuaaaauuauguguaugugugcaugccuguaugugcacuacaugugugcagugcucauggaggccagaagagggcgacagauccccuggaacuagaguuacagaugguugagccaccuuaugugggugcugggaaccaaacuccagucucugcaggagcaacaagugcucuaacuggcccagccuccucuccaccccuccaauuacuuuuuuuuuaaaagauuuauuuauuauuauaucuaaguacacuguagcugucuucagaugcaccagaagagggcgucagaucucauuacggaugguugugagccaccaugugguuucugggauuugaacucaggaccuucggaagagcagucggugcucuuaaccacugagccaucucuccagccccccccccuuuuuuuuacuguauuucuuugugaauaacuucacagagcacaaaagcucacuagacacaauguaauugugguaagaaaauuacauacaucaagaauccucucagagugugaagucuauccuuaggcucugcccugguuccccugcacaggaccucacucuacacaguuccuccaugaaucuccacuaucugucaacaggacuacagagcagacaaugucuucaucaccucuuaaauucauauacccagagcgauuccgucucuccacucugaucaaguguuuacccaucgccuaacucuucaugucugccagaugugguaucacacgcccacaguucuacuuggauggaagcugaggcagaaagagccccgaguucaagauuagccugggcagcauagugauacuaagggaggagggggggggaauaagaaugggggagggaacggggaggaaggaaaaaagggaugagaagaaaagaagaggaagaggaaagggaaauggagaggaggagagggaggggaggggaggguuggggaggggaggggagggaaagaagagguacacacacaucauacucuucacaggaguaugcuugugauuacaaacuucaaaggucagcugagcugcauccugucuucaaaaucccccacuccaccuucagaguuucuggaauauggcacaagaccuggagacuuguaaccauggcagauucccaaagccuugggagccagaucccagggcagccauagguacagugaaaccaagugguuaccagagauaaagccagcaaaaggaaugggaaaaggacagaggugugaggaggguagggcaguuuccagcauccagagaaugaaccaucuuuccucggccacaaaagagccaaagaaaagcauacagacucuacucaacaggaugcaauuagaaaucaauaaaaaagacagucccaagccaaaaccucaccauaaacuugggagcucaaaccacacugcugaauaauucaccaaaaagaaaucuugauggaaaucacauuaacacucaaaccuaugggauucaaccaaacaguaauuagaaacugguauucuuaagugcaaauacuguauuucaccgaguagaagacacuaucaauuuuaacaacauuguuuuaugcaccacaaagaacaaagguugucaguugacgacaugaugcuuccugaccugggauucuuuauuuuguuuuauuucaugugcaccaugugagugcaguuccugagaaggccagagagggcaucagaucccccggaacgagacagaagugguugugagucacccaguguaggaaucuaauucagguccucuucaaaagcagcaaacacucuugaccaccgagccaucucuccaguccagaugaccuagaacuuuuacuuuaguccccauugaggcauuuuagaggucuuuuagaccuggguguagguuuuaaucauacugacacaugcacauacagauaauaauuggggcuggguggugguggcacaggccuuuaauaccagaauuccagaagcagaggcagauggaucucuaugaguuugaggccagccuggucucaagagugaauuccaggauggccaggguuacacagagaaacuaugucucaaaauauuaauaauaauaaauuaaaaguuuggugauggcacacaccuuuaaucccaucacuuggaggcagaggcagguggauauuugugaauuugaggccagccugcccuacagagcaaguuccgggacagcuagggcaacacggaauagggagggagggacgaacaauugauuaagguauccuuacaccuuauuuauguucaaaaaucuggcuacuaagucauuuuccagcccagucacugaucuccgcauuuucuaccaauagagaacuccgugcacuaaaaacacauacuguucuccucugucuccggaauguuccuccaagccauggaggcaguugacaugcuucagugcucacacagcaaagacaugacuguggcacuccucuccauaccuggagagcuggugacaccagcucuaacuucaaaaacgcaacugcaagguggcucagcaagggacaagcacuugucccuuaagccuaagugaccugagccccguccccagagcucguauaagcuuggaaggaaagaacugagaccacagacuugucauccaacauccacauaugcacggagaagcaugcaccugcauacgcaaacacacaacaauucuacagcuacauauuucaaagccagauguaguggcacguacguuuguaauuguagaacccauucaguaagauggaagauagagacaagggaauugucugugagcucacaggccagguuaaucuggaguacaaagaaacaugagagacccuggaaggaggaucaacuucugaaaguuguucucugaccuccagaugugugcagcggacaucacacacacacacacacacacacucaccacacacacaguaguugaccccuauggauaguaucagagggucuugccccuucauaaguauuuugucuguguugggauucugggagauuuuuaaaguacuacaucacccugacccgugaacacugaguuauaucuaagauuuuagcauauuuacuagcuuucuuaguaaguuuuacaguagcaagacucuaauaaaauaguggcccagggcuucugggaugggaaagcuuguccaaugcaaggguggccagagccaucucuaagcuaaaugucacaguccccaucucaagcugaguacaggaucucccuaggaauaccccugucucaaacgagggcuggaggcauuaaacauggccucaagaugccucccacugcccaggcagaggaagaaugccuucuggcacugguguuggccuugcucuagggaagcaaaucaccucccacgcucccagcucccagcucccagcucccagcucccagcucccagcucccagcucccagcucucccagcucccagcucucccagcucccagccccagccaucuuuugcugcugagcucaaaggcugaugaggaggacuaugugccuccagaaggucaccauuuuuccagaaaccgguacaaaugccaaguaaguuaugacucucgacaacacuguaagaugaaaaaauaugacgauaacuuaaaaaacaaagagggggcuggagaaauagcccagcuguuaagagcccuugcugcucuugcagaggaccugaguucauuuuccaguacccucuucugcaggcucagaaccaccuguaacuccagcuccaagggauccagcacccucuucuggccuccguggcugagugcacucauguaugcauacacauaacauucaauuuuuuguuuguuuuucaagacagggucucacuguguagccuuggcucuccuggaauuuguucucuagaccaugcuggucuugaagucagaaagucaccuguuucugccacccaagugcuggcauuaaaggcgugcaccacuacugccuugccauauuaacuuuuuaguaaacauuuuuuaaggccaauggaagauucuagagaucagaaaggaauucacgagggaaauggaauuuggaaggaaaucgguaucuuuggugccaucugugauacucaagaggaucugcacuacuuuggguggaaacaacgccuuacauaacaguacauucucauacuugucuccucgacuaacucaaaacccucugucuggcggggagaaaaauaaugcaggcagcaaaccauguuggcucaauauggaguguuuuuaguuuuaaauaacucucauuuaccuacuuccugcuuuaucugcucgacaagcaagcuaaagaucuagggugagugacuauuaaaacacaucaguccccagcccaaguugagacccaucccauggacaagcaccaaucgcugacacuauuaaugauacugccaugcuugcauucagaagucuagcauagcuguccucugagaggcugcacccagcagcugacucagacagaugcugacccccacagccaaagaguggauggagcuuggggacucuuaugaaagaauaggaggaaggaucacaguccccagaaggggacaggaacuccacaggaagaccaaaagagucaacuuaccuggacccucagggcucucagagucggaaacaacaaccaaagaauauacacggguugagccuaggccuccccauacauauguagcagaugugcagcuuggucuucguguggaguaggggcuaucccaaaagcuguugccugucugugggauauguuccacuagcugggcugccuugucuggccucaguaggagaggaugugucuagccucaaagagacuugauguuccagggugaggggguaccggggugggggggggguccaccugcucaaaggagaaagggagagggaaugggagaagcagugugugcgggaugauugagagggggcuaaugagugggguguaaagugaaagaagaagaagaagaagaagaagaagaagaagaagaagaagaagaagauuuuuaaaagauaaaucaacccaacagcaguaaggaaaguaaugggcccucccugcugaaaaaaggcagauacccacacauuguacgaggagcuagcuugugaggcuccucaguuccccaagaccuggacucccuguuaaacugaacauucaguaugucuccugaaaggaauccccuauuacaaagcauggauuuccccaccccaccccuccagcuuaaaguggcuuccuucuuacuccaaaccagauuggagaaacaggaaguucugaagcuuaaagcuagguucccaggacuggaaaugcagcucaguugguggagcauuugccuaacauacaugaggcucugggguucaagcccgagcaugcaccaugcauggggccagacaugauggcgcacaccugggaggugggggcagaaggaccagaauacaaggucauccuuagcuacguggcagguuuagguuaaaaugaaccacaugagauggggaaggaauggcggcugaggacagcuggaauucccacgcuaucuccuugcuaucuuggccaugaugggcaguuaaugggcugagguccuccagcuacuuccagcccaguuuacagccaaggauggaaccgcuccuacaucuguuauuaaggagaaucacauaagaagaccugggaccaggaguuacagagacaaaguuuggagcugagacaaaaggauggaccaucuagagacugccauauccagggauccaucccauaaucagccuccaaacgaugacaccauugcauacacuagcaagcguuugcugaaaguacccugauauagcugucucuugugagacuaggccggggccuagcaaacacauaaguggaugcucacagucagcuauuggauggaucacagggcccccaauggaggagcuagagaaauuacccaaggagcuaaagggaucugcaacccuguaggugcaacaacaauaugaacuaaccaguaccccggagcucuugucucuagcugcauauguaucaaaagauggccuagucggccaucacuggaaagagaugcccauuggacaggcaaacuuuauaugccccaguacaggggaacgccagggccaaaaagugggaauggguggguaggggaguggggggggggaggguaugggggacuuuugggauagcauuggaaauguaauugaggaaaauacauuauauauauauauacacaaaagaaagaaaaagaagaccugggaccuaggagacugggaacaaggcugagacuucuccagccccuuuugcaguacacuggcuacuuacugaccugcagucaugacagccugagccuggauucaccccgaaggguuugggggaacuguaccaucgucuggacucuguacccucaagagaaacaugcucccauucuuucuccucuuccuuaagagccaguuauggaguaagagcaugggccugcacaaaccugccuuggagugcucaguuccaccugaagugccccaaucucauaaguaaugccgcauuucuacuaauaucugagcaagcaaaaacauggauauggacagacccuagggcaaagcccagacucugugcuuauuaaacaaagcacgaggcagcucaaaccccuggcucccuuuacucguuuacaauauacuucccugcuguuagaagcuccaggcaaccacacagucagaucucugccuugucuuguuguugggacagggucucacgcaggcgagacuggccucaaaguugcuguauaccaugagaaugaccuugaacacugcgauccucgugccugccuguccugcacaagcacugcacgugugcaagcgccagcuuagcuccucuuuuugauggaagucucugacugaucagaucucaaauguagacaugagcucauuguguguagccccuaacuaucugccuuagcuuggaucugcaaugcucuccaaaaacccauguuuuaaagauuuagcucccagucugucauacuguugggaugaugggacuguuuuaaaagucagagggcauggagguggagagaguuagaacccuugaugcucuugcaggggggggcgggacuucuauccccagcaccacguggugguucacagccauccauaacuccaguucccggguauccaacgcccucuucuaccuucugcaggcaccagacgcaaacucaguauacauacauacaaacaggcaggcaaaacauacauaaauaaaauaaagacaacuuuaaaaaaauaagaagucuugggucguuggggugccucugagugaaagagugggaccacagccaucccuuuuacucgucauuauuucuugacuaagagggagacgcuuugaugauugccacuaugauaugccaccagagggccaaagcaacaggaccuugaccaugagccacaccuggaaugucgggggccugugaagcaaaagauggagaauuccgggcuacucugggcuacauaugagguagcagugcuuagucuuuaaaaaaaaaaaaaaaaaaaaaaccuauaaagcuaugaguccaauaaaccuuuucucuccauaagcuuauacacccauccaaccuuuugauuucccagaacucaauuguauuucuuuuccaccuuagucaugcccaagucgcuuuucucuggaaccuucugccgcucucuaguacaggccgcucuugagacagagggaaguuggcggacgggauugccauauccaguauucaugggcucaccaguucacacagugaaaagcaaucggacccaaaaggugcuuguuagaaaggcuaucauucaaaaccaacagaccccauaagucauugaaauucaagaggcagcgcaagggaaaaaccuaaaucucacuggaccuccuagcgguguucacggguuugaauguccugcccacuccuccuccuccugacucagggcucccgaaaguacucgccccgccccguccuugggucuccuuuccaccucugagucccacccuacuucccugggggaagcccuucaucuacccuuggaagacuccauggaggauguggcccagaucaacgcaccaacuggcagcggaacugccaaauaccaggaugcaaagcgaaagcaagggcgucuaccaccgccugcaaggcucgguccaggguugccaggacaacgcgccacuucccgcgagcuggcgcgcuacucuugacgcaccuaucuuccugcacccggcgcuccggccuggguugaggauggaggucucagaccucagagcugcagaaccucaggauuuuguuuuaguuugcggcucuuuuccaacaacugucauugcuacuucugucaccucggguggccgugugcggugcacccucuacagagcuugcagaugucgguguagaauuggcauccugauuagacaggauucacccaccacuuaccgcuccuuuuucugggccaggcgcccugcuggaugcugucuugccucagcagccagcugcguuuuucaaaauagaaaacugacuuugaacaaaggcucguucaaggucauccagaaaacagauucacucccaaguuccacccuuacaaagcuaucuuucucuccaugguauagacugaaauuuaucuuucuaacccuuucccuaauaaaucucaca

SEQ ID NO: 8620 - RNA, 3163 nt, Mus musculus
auaaauguacucaauuaaagacaagcccucuagcuccacccccaacaccccucucauuuacacacuugccagcacugagaaaacugaugaccuagcaucuuuacuucaaaaugaauugcaugcacccuaccacaguaaucaauaccauauuacaaaaacauucuuuaaggcuuuuuauuuauauguaacguucguguauauguacgcaacacaugagaggauguccggugaggcaggaagaggguuugagacccucugaugcuggaacuacaggggguugugagccucccuugggugcugagaacugaacuuguuccuucuggaagagcagcgagcaccuuuaaccguggagccaucuccccagucccugcaaaacagucuuagucaccuaauguggcuggaguccaacuaccagcucuuugugguggauccaauugugguuuuuaaucuuuuuuccucaggaauucaucuuugugggucuccuuucucgagagucuccugugcccugaggugggacacuguucccaaagagaaucugcuuuuccucaggccccaggguucaagagucauauaaguucacugcucuguuugggaccaguaucccccagacccugaaugcacaggucucauguuaugucucagagagguuuucuuuugucacaugaauauauuuaugccccagacuuuuaugccaauuacaucauaggccuuuucaucagcaucuguaaaaccuguaguuucaugugaauuucuuuuuccaggaaauaguacagguugaucuguauggauguauaggaaguuuacugaacauagguaaauagggguugaaaucugccugacaaacagcucacuuguacaucccucagcuauauccauuagagggagguuuguuuuguuuucuaauuaugugauaaugccaugugggcuuuaaggaguccuauagacagcaccaacaucucucugggaccacuuguauuuccuucacgaagagcuacaucauccugaaggcucacuuagucucugcaucuccuuauguucucucccuuauggucacuguaaguuucugagucuggcucaaauguagaauucugaguuuauuugaaaucccauugaagaacucauuuuaguguagcugugcucugacuauccauagcagaauuacuaucauucauauuuguagccaaauaaccaugccacacuacugccuuuacuauugggauagaacuaucuguugcccccugaacacacucuuaaguuuguuagagauaggcacuuuuaggcauugggcuauuuggcugauaguuuaagagauucauaggcuggguuccuuuguacacacgcagaaauguuugccuuucacauacagauucuuacagaguucaaguagaggaaccucaguguugagguucucaaggcagugguagccuccuggaugcuuacugugggaucauccugcauuggaaggacaccagccaucucucugaguucccugucccguuccaaauccacugggaacuuggcccauagggucacuaaaaagugcaccaccccugucuggcacauuccccagucaaaguggaagugcagauacacugucuuugauugucagaccaagcaagaaaagccucacagaccugcugcgugaccuugagaguaaaacuggauaguacuuugccuugucagucagugccaccacugagcuaaguuuugggagccaauugcucaagaucaaaaggaaacaguccaaccaaaguaaaucucucaaaauaaaacugugggaugcaucucuuagggaauuguuaaguuuccuauugcuauaguuuggauauggcuuggucccucuggugauugaccuuuacuguuaccuugacuagauuuagaagaaacauacucuguguaucugaggguguuuuccucagagacauguaauggaggaggaaagacccacccucaauauggacagacucuucccaugggucacaaaugaaauaaaaaugagaaauccagcugagcacccagugggaccagaggcuucauauugcuacuguuguaccuucccugacugugauagaccauguacccuaaaacggagagccaaaauagcccugaaauugcuucucaucugauacagcaaugagaaguggaaaaaaaaaaauacuguccccaauacagugacauugaaaacugauaggacugacuagcugauggcacgcgccucuaaucccagcacuugaaaggcagagccaggcagaucucuugaguucaaggccagccuggucuccagagugaauuccagggcggauaggacuacauggagaaauccuguaggacgagugggagaaaaugaagaaaauugauaggcuuuugauuaggaagagccugaugagaggugaucugguguuuacugucccuaugagagguaaugcugguuucaaggagucuuucaggagugaauuagaucuuuugggguaggaaguggguuacugggagcaggccuuguggcucuacagccugguacuucucccuguucauauuuggacuguagauacaaugugagcagucaaccuccuacuaccacaauuccuuucaugccugcugccaugucuucgcuaccauggucgacugcaucccucugguaaugggaggcaaauuaaaccuuuccuucuuuaaguugcuuuuguuagaguauuuuucacagcaaaacacacacacauacaccacacaaacauaauccccauaucaaaaggaaaaagaccucagagauccaacuuugccccucccccuauaugagugcagagcaggaaggcagugucucaccagauaccaaaucugccagcaucuugggcuuggaauuuccaggcucuagaacuagaagaaggaaauucuucuuguuuauaagcuaccuggucucuaauauuccguaauagcagucugaggaaacagaaacacuuccauaaugccugccugcuaccauuaaccugcagugucugaguaaaaccaaacaugagcuguauauuagugucagugcaaauaccaagcuugcauuggaaguuuacaugugguuagaaaauaucccccacuucaagagacacauguuuaagguaguaggucugaagguguaaaggagucugaugugugucacuggcuggcaagugggucagca

SEQ ID NO: 8621 - RNA, 3163 nt, Mus musculus
ugcugacccacuugccagccagugacacacaucagacuccuuuacaccuucagaccuacuaccuuaaacaugugucucuugaagugggggauauuuucuaaccacauguaaacuuccaaugcaagcuugguauuugcacugacacuaauauacagcucauguuugguuuuacucagacacugcagguuaaugguagcaggcaggcauuauggaaguguuucuguuuccucagacugcuauuacggaauauuagagaccagguagcuuauaaacaagaagaauuuccuucuucuaguucuagagccuggaaauuccaagcccaagaugcuggcagauuugguaucuggugagacacugccuuccugcucugcacucauauagggggaggggcaaaguuggaucucugaggucuuuuuccuuuugauauggggauuauguuugugugguguauguguguguguuuugcugugaaaaauacucuaacaaaagcaacuuaaagaaggaaagguuuaauuugccucccauuaccagagggaugcagucgaccaugguagcgaagacauggcagcaggcaugaaaggaauugugguaguaggagguugacugcucacauuguaucuacaguccaaauaugaacagggagaaguaccaggcuguagagccacaaggccugcucccaguaacccacuuccuaccccaaaagaucuaauucacuccugaaagacuccuugaaaccagcauuaccucucauagggacaguaaacaccagaucaccucucaucaggcucuuccuaaucaaaagccuaucaauuuucuucauuuucucccacucguccuacaggauuucuccauguaguccuauccgcccuggaauucacucuggagaccaggcuggccuugaacucaagagaucugccuggcucugccuuucaagugcugggauuagaggcgcgugccaucagcuagucaguccuaucaguuuucaaugucacuguauuggggacaguauuuuuuuuuuuccacuucucauugcuguaucagaugagaagcaauuucagggcuauuuuggcucuccguuuuaggguacauggucuaucacagucagggaagguacaacaguagcaauaugaagccucuggucccacugggugcucagcuggauuucucauuuuuauuucauuugugacccaugggaagagucuguccauauugagggugggucuuuccuccuccauuacaugucucugaggaaaacacccucagauacacagaguauguuucuucuaaaucuagucaagguaacaguaaaggucaaucaccagagggaccaagccauauccaaacuauagcaauaggaaacuuaacaauucccuaagagaugcaucccacaguuuuauuuugagagauuuacuuugguuggacuguuuccuuuugaucuugagcaauuggcucccaaaacuuagcucagugguggcacugacugacaaggcaaaguacuauccaguuuuacucucaaggucacgcagcaggucugugaggcuuuucuugcuuggucugacaaucaaagacaguguaucugcacuuccacuuugacuggggaaugugccagacagggguggugcacuuuuuagugacccuaugggccaaguucccaguggauuuggaacgggacagggaacucagagagauggcugguguccuuccaaugcaggaugaucccacaguaagcauccaggaggcuaccacugccuugagaaccucaacacugagguuccucuacuugaacucuguaagaaucuguaugugaaaggcaaacauuucugcguguguacaaaggaacccagccuaugaaucucuuaaacuaucagccaaauagcccaaugccuaaaagugccuaucucuaacaaacuuaagaguguguucagggggcaacagauaguucuaucccaauaguaaaggcaguaguguggcaugguuauuuggcuacaaauaugaaugauaguaauucugcuauggauagucagagcacagcuacacuaaaaugaguucuucaaugggauuucaaauaaacucagaauucuacauuugagccagacucagaaacuuacagugaccauaagggagagaacauaaggagaugcagagacuaagugagccuucaggaugauguagcucuucgugaaggaaauacaaguggucccagagagauguuggugcugucuauaggacuccuuaaagcccacauggcauuaucacauaauuagaaaacaaaacaaaccucccucuaauggauauagcugagggauguacaagugagcuguuugucaggcagauuucaaccccuauuuaccuauguucaguaaacuuccuauacauccauacagaucaaccuguacuauuuccuggaaaaagaaauucacaugaaacuacagguuuuacagaugcugaugaaaaggccuaugauguaauuggcauaaaagucuggggcauaaauauauucaugugacaaaagaaaaccucucugagacauaacaugagaccugugcauucagggucugggggauacuggucccaaacagagcagugaacuuauaugacucuugaacccuggggccugaggaaaagcagauucucuuugggaacagugucccaccucagggcacaggagacucucgagaaaggagacccacaaagaugaauuccugaggaaaaaagauuaaaaaccacaauuggauccaccacaaagagcugguaguuggacuccagccacauuaggugacuaagacuguuuugcagggacuggggagauggcuccacgguuaaaggugcucgcugcucuuccagaaggaacaaguucaguucucagcacccaagggaggcucacaacccccuguaguuccagcaucagagggucucaaacccucuuccugccucaccggacauccucucauguguugcguacauauacacgaacguuacauauaaauaaaaagccuuaaagaauguuuuuguaauaugguauugauuacugugguagggugcaugcaauucauuuugaaguaaagaugcuaggucaucaguuuucucagugcuggcaaguguguaaaugagagggguguuggggguggagcuagagggcuugucuuuaauugaguacauuuau

SEQ ID NO: 8622 - RNA, 19262 nt, Mus musculus
ucuuuucuugguagcuuuauugauugccagggaaaaugaaaaccagaaaauuaauuaaucucuaaaauuaaacuuuacacugaauguucuuguuucucuaauuagaaccucugcuagcagcuguggcuacacacacacacacacacacacacacacacaaacacagagagagauacagauacacacacacacacacacacccucacaccuacauguuugcacucuggaacugucagagggugucaggcacagaggacucuaggcugcccccgacaggcacacacacagucacucccaagcccccucuggugcucuacucagcgccugcuucuugcaaagagucccuggagugcaggcccucuuggauugcagcugcagucgcccaucuuugagguagacgggcacugggucacucagcccgaggagaguugggagauaagaguuugaauuagucagccaagauccucucaugaauccauagucugugauuccuauggguguggccccauggugggcagucacagcgugccagggacucaaggagaggguaccuggaagacuguauguccugaggauaagggcuuguggggugggcuaggccuggcucgggagaagacaggccucugucaaauugggugcaucacacuguggccuuucugucauggaauuccaagcgcaaagauuguacaaaucacacugauggauaauaaaaguguggaugacucacuggucugcucccucagugacacuuguuccccauccuucugccccccgccccccccauucccgguuugaggguuagugagggcgcgaucuguacaagcagacaacgucaggcaaguagcaucuccagggagggugggagggugagggagacaggcauaguucugcucuguguguguacacgcauauguguguguguaugcaugugugcucaugcauguguguguauguguguguguguguguguagacugaggucagggcucagcuaucugcuuaguaaaaagggaaagggguggggugagucaagagguagauggugcucaugaagaguuugagcagggauggucuuuuagaguccuuugccuucccuguuccuguuaugggucuaguaauggccauuuucuaggugugggagcuagugcacacauuucauccuuaggugccccuucuguaccuuggcaucuucauauauacaaaucuggcugcucauuccaaggagauucgugaucccuucuucucgauaccucagaaccaggggcagacauaucaagggugugaaaugaaggugugguugccgggguaacccaucagaucaccgucuaucccuguuccacaucuuagacuacagaauucucaguacaguuguuagugggugaggagaaguggccaggauucaggguccgcuggcgggcagccucucgguuggcaugcagaaccuggccaaugagguacucgcucuccugggauacaucugacagucgcaggucgaacucuagaauggucuuguugucugauaugccuuccaggaguugcuucccaccauccuggggaggagugaggcagggggucacuuuauaucacaucgcagggucacaugaacagauuuccauacagaugggauaccuuuaaaagccacguguaaccuaucuguucgggccauggacaaaaaugacauuuuacuugaaaaacugugguuaagguuaagguuaggcucaaccuaaguguuuuggaaaacguggauucaugguagugauguaguuccauuccuucauuucagucuuggguaccugagaauagucggucuagugagaugugaggggaaguuuggaagggauggaagaaggaaagacaagguauggcuacaauccuagcagccggagacggaagcagguggaucucggaguuugaggucagccuagucuacauagugaguucuaggacagccagaacugcauggugagacccugcuucaaucaaucaaucaaucaaucaaucaaccaaucaaucaaucagucaucaaccaaucaaucaaaccacuguacuuucccucccagaaacuaagaguuaaaggaaaacgaggagccuggagguaacccugaggcaggagcuugagcacaagcaucaggaccagcauuaggucuccagagcccaugggaacgcugagaagguagagcggcccacugggggucggggagacagaggauuugcagaguaagcuggcuggccagaugggucauuucagagggugccuccggguuucacugagagacccugccucagcaaauauggaggaagagccauugaggaugauggcauaauccacuuagggucuccacaugcaugcacacacacguguucacgcucauacagguacacccucucauauguguguauaguacagacacaugaacaaugaaaggaaagagauugggcccuggagcgcgcacaggagaagagcacucucucugugccgcacaccacacaguccgcuccuagcguuucugccccccccgcccccccccgcaaagggucuaugguaguuggauucuaccacccgugcccacccgccccagaagccacgacucaccugcccaaugugguugcaggauagguugaggcugacgagcguaguguugacagugagcaucugggagaggaguguggcugugggcucagacagcuuguugccaccaaggugcagcacggagaggcacuuguuggucuccagggcgugggcgauugcuuggccacccucguccucgauacaguugaggcggagguugaggaagaccagguugguguugugugccagugcgugagccagugacugugcgccaggcgccugcaguugauuguuggccagguugagcacucucaggcgacuguggcucagcagcuuagccgcugcucgugcaccacggucuccgaugagguugugggauaaguccagcuccuccagggcugggugguccagcaggcuacggauuaggaugcgcgccuuaucgucguccaccuuacuucgggucagcuugaagaucugcgggcagguaggaguuuuacagcaccugccggucugggauagccugcgcuaccuaacugcccugggcugguacagaaagaaaauacaagguggcuggaggcucagguaggagguggguucacuggaugaugcagaaucacuggccgguggcagagggaaaggcuauugucauacucagcucauucuugauuuucuggauucuuuugaccaagaaacugacaguggaaaaauucaccuacguuacugucacuggcugguaucacagaaacuuccaguacagugugccaauccaauuguacuucucuggaccacaaacucucucaucauuuguggcaauguccgcuucuccaguuuccagucuacucacaugccaggguaccuauaagcccccuuuccacugauggcugcucuucuguuuuauuuauuuuuccccuggccacugaauaggccccucuacuguuuucaugauaccaacacagaucuccauagcuguccaucacaugccaacugcccugcuucaggucucagccccagcaagcacugacccuggucccugagccucuccucucuguauaacaaaugauuuucuggggggggacggggaccaauucagcuugaaauuggugcaauuuccucuucagagacccagaagcccuccucucuuccaguucugcucuccacuuugcaugcagccaaagcucuuaacacaguccccccaccaccaccccauccgcuuuuccucacuucccacucucuccauauccacagcugcccagcuucuguuucugguauccacugaaguaaccccaccgccagggaccucccaggcccccuaugccaguccugggcucuauccuacccuguuacucgcuccuucuauuugaaacaugucccuaucugggaucugugacaaaaugccauguucucuuguguacucuuucuuggcaagcucuuccuucuccagcacugcaugucacgcuucuuucugccucccuuuggaucuuccuccuucucagacuccauccaaaugugaggccacacucaaagcucagcucaggcuccucccagcaucagacccucccuagcgguagagaggaucucuacucuggacaaccucaagcuggaacuccuucaaacccacccuccucccuucccccucucccauucgcugacugccuauagcaucuggucuuaugagaagaggcuguggcaccucugccuccuccucccucucugcauccuccuuacgucacagcagcaggugaccugaguguguuucucuccagauucuccgcuucauccaucuuugcagauauggaugugguuucaacuacccgcauagugcuugcuuguuucuugguuuguuuugguaguggggcgggggcaggacacagcugagaagagaggcucacuugaggaccgagaucagauggacugggagcauaccuaugugggacugccuugauuguugauugauguaggaagaucuagcccacugugggcagcacgaucccuaggcagaugguuuugaacuguaugagaaagcuaguuaaggggcuggagagauagcuaaguggauuuuaaccuguacagcucuugugguacaggaguucaguuucuaguaacuguaucagguggcucacaacagccaauaacucgcagggaaucugacacccucuauuggucucugcgggcaucugaacucacgaguauguaccaucccguauguauaauuuauaauaaugaaaauaaaucuaaaaaagaaggagaaagcaagccagcugaguaagagcugucuacgagccagcagcagcauuacuucauaacuucaugcuggacuucuucggcugugcgugaguuccuugguucaaggcugugugggauaacaagcagguuugccuucaaguucccgccuucacuuccuucacuaauggacuguggccuggaagugugaaccagacaaccccuucccccccccccaaguuguuuuuugucagaguggacaugagaacacuagcuucaugugcuaacgcuugccccuucugugaaccugagagaugaggccuuuaagaggugaggcggggugcagcuacguuguuagggaugccacucuuggaagagacuggcuaggcucuccuggaacccaaguuaguucuugcaagaggcaucugcuugcucucuucugugcaugcccuuuccuuuuuuuuuuuuuuuuuuuuugagacaggguuucucuguguagcccuggcuguccuggaacucacuuuguaaaugaggcuggccuugaacucagaaauccacuugccucugccucccgagugcugggauuaaaggcgugcgccaccaucgcccggcacaugcccuuuccuucuggcuuuucugcuguuagugcuggcgucugugagucccuucagccaccaggagcuaaggcaauucugcuuccccugcucucucucucucccucccucccuccuucauguuuucucucucuuuagaaaagauccucaaguaugcugugccuguguguagguaugugggaggcuagaagaggccagauacccuggggcuggaguugaugaaggugcugggaacugaauuaguguuuugugcaagagcagccaguaugugauccuaaccacuaaaccaacuuuucccuuucucugggacaguuuccuguaguccaggcuagccuccagcucaccauguaguaaggcaugauccugaccuuucaauaccccugcccccaacuccagacauguaacauguaacuccagacauguaacacgacacuugguucacaccgugcugcugauccaacccaggacugugugcaugagaggcaaauucucuagugaccgaguccucccaauccuccuucuguuuuguaugucuuggugccuggaacugaauccauaugcaucagugucuugucuuguugcugugacaaaauacugacagacucaaguuaaggaaggaggagguucuuuggauuacaguuuugagggcauggaucaucauggcggggggagcaacaucaaacugcuaggcucuguuaagagagaaaggaaagaaaugcuguguccucuguucaccggcuuugcagccagccauccaacugacagagucgggcccugucccaggugcugaaguugcaggggggugggguguggggugugggagcgcaaaauuacacuguuugagcccuguggagugagcagucugaugugaugaaaggcacuaaugagcagccauggaaaugugaaauugcagcuaggcgguggcugccagauuucacaaauagaaacaugaaaaguccaguuaaauuugaauuucagauaaaaaccucaguguuuggaugcauagcccaaauauuccauggggcauacuugucugaaaauuucaauauaaccagugugaugguuaauauagacaagucgacaagcuuuggaauagcccagagaugagucccugggugugucuuuggaggauuaucuaguuaaauagcuagcuaaauuaucuagcuaaaucuuucuucccgccuugagacaggguugcucugugcagcccuggcuguccuggaacucaacuccguauggggguauccguguguguuuguguguggggucuugggcuggauaaaaaggagaaaaccaaguuccaccauuugaugcucucugcuugaccagcuccguaggcuccugccaauauggcccucccuccaugaugaaccaugcccucccuccaugaugaaccaugcccugaaaacuggagccaaauaacccccaccuccucaguugcuucugucagggauuuuaaucacagcaagaagacaaguuaaguggugcaguagaucugcuguagagugcuuuuuagcuuuccccagaggcaggggccagacccacagccucacacaugccacagacacucugccucugagcugcacccucagccugggcauucuucauuuggauuaauccuuaguaugacuuagacugggcguaguggugucauacgcaugugaucccagcacuuggucauguuugugcauguaagguggaggcaggaggucagaaauucaaggucguuuccagcuacacauugaauuccaggccugccuaagguaugagacccugccucaacuaaguuucaaaacaaaacaaaacaaaaacccaacuaacuaucuaaacaaucccuuccucuacucaugaaugcaaaggaaaugagagaagaugguagaaggagaggaagaggcagggagaagcaaucccaaagacaaugagaaaggaggcaagugaguuggggggcgguggggguggggguaguaccuugaggguguggcaagcuuugaugguggcugccagagaguagcagucucgguaggugaagagaaagagguuccacucaaaauucaugccacagucuuugacgccguacaccagguccagcuccuccagguguuugaggccacccaccagcgucugcagcugguagugguccuucucuggcucgcuccccucgcccucacugccagaguccgacuguuccucucccuggagcggggucggcauccgcacaggugggaggaacugguccacaugaaugcggcgcacguaguuccugcagaggggcagcagguccaggaucacguugggguccgugguccccgggaugaauagcuucagcagguucuccaggugucucucgaagaacauacgcuuccagcugccgccgugccuggacacguggcacacggaccagcgcuugaugcagcagcggugccaguaauucucaucgucaaucaaguuagcggucaccgucaaaggcagcucggggggcagguugcucaagaccuucuuuuggugcucuagcggcagcugcuucaggauaggguugucuuugagaagggaggaaggaaaacaggguucagccgccaugcugggaacaucgcaacucagcauccuggacugucuugggagacccuuuguggccucgggaacuuuauuuugagaggauagucuucuaaagagacacucuuugagggugcucuugccugcaacuaacuggcaauugcacugggcgguaucuggugucauauauauauauauauauauauauauauauauauauauauauauauauuugguuuuucgagacaggguuucucuguauagccuuggcuguccuggaacucacuuuguagaccaggcuggccucgaacucagaaauccgccugccucugccucccaagugcugggauuaaaggcaugagcccacugcccggcuucagggccaguucucaauguacaaucuagucugacuucugauacucccagucagacuuuacucauucauuucagaauaauuauauguauuuuaacaccugugugccagaugcugcugggggcaggggaggggggaagugaagaaaacauggggccagaaagauggaucaggggguuaaaaaaaaugccuacugagcagaacugguggccugaggugagagaaaggagagcugacggcaugagguugucuucugaucucuguauguguacuguguucuguggugaguguucccccaacccucaauacauucuuaaaacgaagaaaucagacauggcccuggccuccucuaguucgucuaagcuugcuguggcacacagucaauaagcgucagaggaaugugauguguuaaaugacccaguucucgggaagcccuugucccauagaguaggagaggacagcuaguucucuuuggaaggggcuggaguacagaagaaaccaggaagccauuugcaucccggaggacuaugucagauggggaaagcucugucagagcuucugggaggagggagaggaggauguggcuaagguucagcuugcuggagagagcagacaugaucagagaagggcaaaaucauggagggcacaauguguguguguguguguguguguguguguguguguucaugcauguucaugcaugcacaugugugugugcaugcucacguaugugugugugugugugagugugcauguguguguguacgugcgggugagugcuugaguguauguguauucgugcacgugcaugcauguacauaugugugugggugcucgcguaugugugugugugugcgcgagagcgugugcgcguguguacggcaggaaacacuacugauccugagugggaguagauuagagaaggcuuccaggccuggguacggugguccccuucuccucuggcccacaucacauggacgacuuacucuggaaguucuugacgauauguugaaugcagaguucuguaaggagagguacgauggccagugaccacucugcauccucggagaugauccugcgcaugcgacggacauuugggaccuuggucuucagcuggccugggguaggggugcugcuggucuucaaggacguggguccugugcuggagcugcccaaggcagagaccuggcgcuggauggugagaaccgacuggcugugagacgaagaguuggacgguacugaugggguuuccugcauguugccggccagcggggaggcaggggucggaauccuggcagccuugcaguaggaagcuucuuacagcaggcaggauacaggaugggggcggggucguagcuugagcaagaggaaggggacagcguuacuugggggggggggauuuagguggcacagaguggugcugaaggaucagucucuggggggagaguagaccuagaugacacucucagagacuggcuguguggcuuugggcaaggcacaucucugcaucucagaugcugccucugaagugagggcaguagcuaccaacaggauuauuagaggaguugauaaaacaacguauucaaagggacacagggugugugcaaggagagccccaaaguuuagacaauagcuguucaguaauuauaaucauugcuacauaccagguauucguuuuggauaguaacucaucugucauuaagggggaaaaaagccuuuuggagacaagaguucauuuucauuuuuuuuuugaaaggaaaugaaguacagagcgguugcuggcuugcucggugaugcacagcugacaccgaaugagagggaacuuauguuuuaaagauuguguguuugcaugcguacaugagugugcgugugcacaugcgcgugugcaagugugcaugcgcacacacagaggcuagaagaggguaguugugagcagccugauaugggugcugggaacugaacucaguccuucagcaagaacagaauauuaagugcucaaaaccucugagccaucucuccagccauccauagcagugcauuuaaacucaauuucucaagucagauucuggacugcccccucuaagggugaguguggggguaucaaaugccaagggagagugcuaucaugaacaacuguucaacucagaagcucccagcucccagggcauccugacggcacgacugagaucacuggccaacagagugggguacaggcuuacacacuaucuuaauuucucuccuuaucaauuuugagacaaguucucagguaucccaggcuggccuccaaguugcuaugaccuucaagugcugagucuccuguuuguaucuccugagcacgggaguuacaauuuuguuucaucucagccagugaauccgggguuucaugcuccugucagcuuuucuggccuccaaggguacuucaugagcacggggcaucgacaacaagcagggcuacacagagaaacccgacuuguaaaaacaaaacaaaaaugagaggacuggagagaauggcucagcgguuaagagcgcuuacuguucucccagagguccugaguucaaaucccagcaaccaccugguggcccacaaccaucuguaacgggaucugaugcccucuucuggugugucugacagcugcaguguacucauauaaauaaaauaaauaaaucuuaaaaaacaaauaagcaggagaugggggggaggggaggaacaaaauacuauuuuuacugccaaaaacaaaaccaacuaaccaaccaaagaaacaaaaaugggggaaaaucauuuuauguauaacucuggcuauccugucauucacuccauagaccaggcuggccucgaacucagagauccuccuggcucugccuccugagcucugggaucaaaggugugcaccaccagugccaggaaaauaaauauaaauaaauaaauaaggggggaaaaagaggcuuaaguagagugggaguauggcucauuggcagggcucuuugccuagcucaguuaaaaacaaaacaaaaggaaauaucaaacaaaaaacccuacaggaaaaccaaaaugaacagaacaacaaaauccugaaacagguucgaggccagccuggucuacagagugaguuccaggacagccaggacuacacagagaaaccccggcucaaaaaacaaaacaaaacaaaacaaaaaaccaaaaacccuaaaacagaugaaauuaguuguauacucaauccagugugcccaaacauuauuguugaaauguguaaucugcauacagauuaaaauuaaaacagaaaacaauaaaaaccaaaggaguugacacaauuaaugcacuguacucaggguacugucgcucaaauguaugauccguauaguuuaucucuauauuuugaguugucauuuaaauauacaucuguacauacuuacacccugcauacgagggugugagcaccugugccgguccuuggagccagauccagcccccuggaguuggagugaaaugugagccgacauggguccucuucaaaccucugcguaaaggcuuugagugggaagaauagguccgucccugucaaaccugcaccuguggccuccauucagggcgugcgcaguugggagggaccagacacagccuccugaccagagugcgaaugccucuccucccuucaguucccaccuggcucccacuucgaagucucccaucauaccagaagguggcgagcaggcgugggaggugagaaggcagcuaaauauggggcugaagacugaggaugcugucugggucugggggaaccucuuugcccuccuguugcaggcacccugccagugaccugaaggcggaacagcggugccugggcccucugcccguggcuggguagcuucccuuugugcuauacuguggugugaccagugagaaggagcgcccggcuccagcaacgacauccuuggcagagggaggaaccagaugguacucuagccugccaggcagcucaaggaggaaaagccuugggagagggcuacugucggcaagauauuuauguauugugucaccacuguaugcaaaucaaaugcaaauucacagacccuguccaucuuuacauaaugcuuuuaaucccggcacuuggaaggcagaggcagguagaucucugugaguuugaggccagucuggucuauauggugaguucaggaggguaucauuuagauagaggcaucagcugguuuuguauuucuggcuugcuggugauuuuaggcaaauugaauaaccuauccgaacuucaacuuccucccuucccuuaucuguaaaacgggauaauaaugucuuccuauguggcaucuguggagauuccugucuagagagcugagagaugucuucaagugaaugcuagguugguuucuaagccuugucccugucucuacaggagagguaaagggcaaggggucauuggcaacuugaagaucugcugcaccgugguuagagguuaccugccccacuagccuggguguggcucugcucccaccuccuagggcgcuucaacccagcugaggccaguugggaaccccucugugcugcuuacugucuuucuugguaccaggcagcucuuccuaaggucuaguucuaguuguuuuugcugcuucuucguagcaugccucuggcagagaucacagagccaucuauggcccuaacaaaccucauaaggggaaccccagucgccaugggugccacagguacaguugacauaacaagagcccagugccagccuuccaugacagaaacacccaucucuuggucugacguuucuuggcuuuaguuuuugucuuuuguuuugagacagggucuuacuauguagcucuggcugccuuggaucucacuaugugaaaccaggcuagccuugaacucacacagcucugccugccuuugccuccuugguugcugggauuaaaggcauccaccaugcccauccugaugucauuuuuaaggcuaauauugaaaucaauuacaucauaaggucagaguugacuauuuuaauauacuguauauaugaaauauacauuucauauauauguauauauuuuugugguauggagauuaaguccaggaucuugcagccaaacauucuaccccugagccacacccuaucccaccuuuuuauuuguuuuuuuaaaaaagauuuauuuauuuuauguauaugagugcucuaucugcauguacaccugugugucagaagagggcaucagaucccauuacaggugguuuugagucaccaugugguugcugggacuugaacucaggaucucuggaagagcggugcucuuaaucgcugaaccaucucuccaaccccuugucuuucauucuugagcucacucuguagcugaggcagacugggaacuuccuaucucccuagaguagccuuccuagcaguugggauuacaagccugcaguaccaggcuuggcucuaaagaucuuuuugacaggaagaauauuuauuaccaggcacagcugggccuggugacacagaccuguaaucccggcuacaaggaguuugagguacaaagacugaaaguucaaggucugccugggcaacuuagugggacuucaucuuuuucuuuccuauuucuuuuuuucguucuucuccccuuccucuuuuucuuccuccuccucuuccucuuuguuuuucuucaagacaggguuucucuggguagcccuggcuaucugggaacucacucuguagaccaggcuggcuuuagaaucagaagucuccagagugcugggguuuaaggugugcauuaccacugccugccuaagacucugccuuauuucucaaaauaaaaacuaccaagagaacugggcauauauacaguuuuuagugcuagaacacuugccuaacuaacaugcaugaagccauagggucaaaccuuaguacugccaaagguaagaaauaaaauaacaacuagaggcuaucuauagagauuccaguuccaugugauuuuuaaacauauauuuugagggacgagggguggugugcagcugagaguaccugccuggcauuuuggaagucuuggguuugcuccugcauaagcuggcuuccugguacacaucuguaaucccggcacuugggagguagaggcaggaggauccaaauucaaggccauccuuggcuacauaaugaguuugaggcagcaggggcuacaucucaaacaaaccaccaauaagaaaauguguuuugaggaacugauguaugagggauggagagacgccucagccguugagagugucugcugcucuugaagagagcuugcauucaguuccugggacccacaucagacagcuugccaccaacuccagcuccuggaggauccaacgcauuuagcuucggaggguaccugcccucaagugcacauacccacagaaagaugcucaauugaaaauaaaacaaaguguaaaagaaaagaaaaaaaaaucuaccgauaguauaucuaaguagacuuaauaggaaguacucaagucccuggggucugucacuucuugcucuccuccugccccucuugccacuucugguuugguuugguuuuuaauuauuaauuauguauauguauauauauauauguauacacacacacacacacacacacacacacacacacacauacauaugaguguuugccugaauguaugugugggugccacauacaugccuggugccugagaaggccagaagaagacauuggguccucugcaacuggcguuacaggcaguuguguccugggaaccaaacccagguccucuagaagagcagccagugcuuuuaaagucugacucgucucuccagccucccuggguguugaguuuacaggauguuugcauggcagauuuugggcacucuguccauccccacccccacuccaccucccagguucuguccaccuugcuccugucaggggacccagcucuccacacucuugaguuuuacacucagguccugaggcuucuguccaagucccucagauucaaucuacacagaaagcugaaagcagggacucagcuccuuuggcaggucacacaagaagcuaaccugucccuucuuagcacucuccuuucuuacuacugccucagcguaggacuucugggucugucacacacagcuccacuugcccccuggucuccugucugguccucuccacccugcccugcacagccaaugaggcaggccucuacauaaacccuuaagcggcucagcacugccugagggcaaaagucaacucccucagcaccucagaggacaagggccuucuacagcgauuaguggcucuccgaaauaaagucugcucucauucaggucauugcagacuacucugggccuuuacuuuaucacuccuuaaacuugggaagccuuucuuagcaucuccuccugggaaagagacaagcauccauccacugaccaguucaaccacacccuccgcgcuauuccucaaaaaacacuuuugccggagcccuagcucuccaggacccgugccaccucccccugugccaaaauucacagcagagggagcucucuggaugugcaugcccaaacccagugccaggucugccuuaggcagguagcuaguuugggucuguccuauuugcugcuaaaaauagauucuagagaguaucccuauuggcuacugggacuaaugggcguggcuuuauaaugucagccaaucagagacuuuuuuuaggauugguccaaguagaggcugauggaaggaaggacagcuguguguccuugaaggagcaggagccccacugcugagagucacuuucccggacuuagagccuaucugcagcagcagaggacggaaccuaguuuggcugggggggugggggugggguggggggggaagagagagagaaccagcaaccaggaaagucagggugacgaagccccugaucugccggucuugcagguccuguccuucuccuuugugaccacaggguguugaacauugcuaggcucgcuggggagugaaauggagaauuccuaaaucaaggaaguuugaaguuaaccugaccuuauaugaaacccugucgaaagaaaaaaagagaaaggaaggaaggaagaagggaagggggaagggaggaggggagggaggaaggaagggagggagggagggagggagggagggaggaaggaaggaaggaaggaaggaaggaaggaaggaaggaaggaaggaaaggaggcuaccccaguuugauugaggagaaagaugggaggaaccaggggaaagggagagacaggcauagcugcuuacagcaucugcugguaggccuuagucuggcuggcuagcuccaggcugcccugaggauucugcagggauggacagaaaccuagaugaccagauacuccggaagacccacugaaggaagauagcuccagaagggacagggcccagugcgggcuggagcagugguugucaaccuaugggucucgaccccagagggucccauagcagauauccucauguuuuauauuuacaauccauaacagcagcaaaguuacaguuaugaaguggcaacgggauaaucuuaugcuuuggggguuuaccacaacaagagaaaauguucuaaagggucagcagcauuaggaagguugagacccacagaucuacagacucaucuuccuugagagccugugggguggggagagaaauggaguuuaguacuccaaggucccacuccuuucuucaugucggggauucucuuuggcauuucagacaagcuggggccaccagaaaugcaugugucuugugcugcugugugauguccccacucagggcagucucugcccucagaacauagaagugggaggugggucaugacuuuaaucuugggguccgucucaaggaccuguaggcuuuacauagcugcgucucuagcaucaagugcagccaaccaggaccacuauuggcagggaaaggccauucuuucucuaggugucccuguccucgggaccaggacagggguauaaaaauacaggacacaaggagucacaacauaaagggcugggaauuucugggccuugguaaaaguaauaaaauggugucccauuuuggccggggcuguccucauuuuguauggcuuuguauaugguggacagguggucugggaucauaaccuuggcucuguguagcuaugauuuauugcauucuagacgugcaauggcagaugcccacagggggccggcccuacagcugcuggcugagcgcucaggccuuggacugucuccagacaccccccaccccuugccucucacaccucaacagcuuucaggggcaucaccugucaaauggagacagucauuaauauuaccuucaucaccuaucauccacuguaggugauuuaggagcuaaacugugugacauuucacacaggcuuggccuggagcuggcacucguuagcagccuccccuauacgaagcucacuaagcccucauguccauuauugacauuugucaccauaacaccauugcccacaccuuacaaaagaggaaacugaggcuuagaaaacugaagagauucgcugucaccaagccagcaagccagacggacugcuuaucugccccaugggcccucuugcuucucugagguaccccuuucucaccucaucucaguuccagaaagguuucuggaacucccuccccccguggguucucuggucaccacuguggagccccagccuucaccuacuucgcugccgagacgcuucccuaaggcuggauuguggccgacuuuggcuugaggucuccacaagggcccaagagaauguugcagguuugcucuucugcccugcucacgcugggagcgcauguugcucacagacugggucaagcuuggaucucucccucauauuccuucccuuuucauccuucuucaaguccccaguaaaaucuggccacgucagggagguuccugccacuacucaaaugggccugucacgccccauguuucucugcaaguguagcugugguggucugcugcaggggcagguuagggucuccauccaccucucugccagcuucccacccacgcguaccccaugcuccccacaaagagcccuccuugggucucagguuccuguauucagagcccugggcuuuuguuuacaucuucccugcccucuauugcccaaaguccuguugugaagucccaguuuaugggcugaaggaagagagaauuuaaaacaaacaaacaaacaaacaaacaaaccaaccacuguuuuucugagagcccagguuuggucucuggcucagggagauagcuuguucauagcuucuggguccuccccauccuagcucaggcaucuguagucagcucuauggaaagggacacuugcaguagcucuacccacgacuccagccuccucucuucuccuccccuugguaacucagagagaccagguccaugggggacgugcagaacccacagggccuguagcauuguccucagcugaggauuggggacucuccucuucccaggucuccccauuucuuuacuugaauucuagaccucuagaccaguuuacagauagucgcuguguggaaugcagagccuggaucccaccucuagaagacaggcgugaugagcugggggcuucauguaacugcagaauggguucucccauuacaggacauacgaagcuaagaugacggcugcggggccauagacccgcguggguugcaggagcuggcagggcuuugagcuuaaccagcauggucugauuggggagaucagaguugggggucccuuucccggaggucaccucaccugcucuggggacccaggagacugcucucugaggcgguuggcuuggcgcaguugguuguuagggacgccugagucgccagggggcggacccugagcccuccgcccugggcguuggcgcccuccuccucgguugccccuagugcgcgugcuca

SEQ ID NO: 8623 - RNA, 7861 nt, Mus musculus
agacaaaaggcggcggcgggagcgggcgggaggcggagcggcgccgcgagggccucaaggugacacccgcccccggccccggcccccccagcccggccccuucaguccgcccucccacccauccccccaucuccagccucccccgugcccuuucuaggcccccuccccccggcgggggguggggagcagagagggccccgccccucgcgcccccuccucaggaccagcgcaggaugcccccggccccuggcagccccccgggagguccugagcucaacgcgcccccucuacgccaugucccccccuggcucggccgcgggagagagcgccggcggcggcggcggcgguggcggcuccggggucccagaggagcccauggcaucggcggacgagggccccgcccgagaggaggugagagccggcgguccccgguucccccguacaaccgcgaccuggcccccaucccccgcaccucgcgcgguccccgccgguuccgccgcagagcggccggcgccccgcaccccgagccggccgcugcagccgcaguccagcagcauugccccgaccuggcugcccgcgcaguccgcuguggcuaggaaggggccgugucgggggcggggcucacggggguccggggcagggggaggggcccugggcggagccucgcagacccccggcuuagcagagaagggcuaggccaucccccaggugaggauggugggcggcaucccaccuugaaggccgggagggaggacugggagugcucggaggcaagaagagugccuugggggaagugauguugucacccuagcugggaucauaggaagaucagacggguacaaaggccauacccccuggugucacugagaguguguguguguguguguguguguguguguguguguaagggggcugcugcucaccucucucucuuaaugccugaugcucccccuagggggcacuaagcuuaagaauuucugagucaguacugugcgguaccuugcuaggguccuacuuuuagucuuuugaaaccaggagacaaagaaacuaagggaaguagaaacucuaaguuccagccuugcauccacacuggugcacaccgugcauauugcacggaggcaggaggagaguggggauggacguguggguagccccuuucgguuguacucacauugggacaagcacaugaccaggcgggcacacaggugcaccuauacacucggcuuccaaaggcacagcuccugaaaggcuguccucuuacugccuugcagguaccugcucuguguuguuuccuguucuucuuaacuaugcccagaaaucuagggccucugcuguuaacuugguuaaaacacuugguuucuacugccuuaucucucucuuucugacuggucccaaggccaggcaugaagaauuaaaggggccagucagaacugcaucagaagguugugugugugugugucuuugugugugugugugucuuugugugugcguguauacacacaugugugcaacaaugcaaaaagaguggaagacagguuauuugagcaaucaaacucaaucuuuauugauuaugugccugcugggugucacuuaggcaaagagaaugagacaugagcccugcccucaggagcgcuccaucugguggagaacuagacauguaaacaacucagaagguaccaagugcuuuuaacagaauggcccugggagaggaucaaacauuugugacaaaugccugagagcuuucaaugucuuccuuaccuaugguucauacccccaucuccucugccaaggggccccauucccucuuucccauccuagaauagagaggaagaaugugugcucaccaggaaggggugugugugugugugaauaguagggagacucacagaaggacacagaggaggugggaaggaugagacugaccuggaagcguuagauugucugugagggagagagaggugcgugagcuaacggagaauggcuccucuugcaacccaggacuggcaauaucuacaagaggucagggccccaccuguuaagaggggagaugaugucagugggucccuccuuacucuccugggaccucuggaaagggucugggcugaggacuuaccuuugcuaaugccuguuugucuauuccuuuuuuuucccauccacccuuucucuuguuucaucgccaucuuugugucugccuuuggaacucuuucuggauaccauucuauccaucugggccuccacuucugaucucucuccgccucuuguggugucucucucuguacuuucccauguuggcauucuggucacccuuuucucgugguucugugugggacccuucuguguuuaucucggguugcugguucccaucucugucucuucccgauacauuccugucugccaccccggugcuggucuacugucucuccaucucuguucaccucugugcuggcucccgccuccucaccuuggcaugcccucccuucucauccgagcagcagcggcccauccagcccucuuucaccaaaucucucugccgggagucucacuggaagugccuccugcucucccugcucauguacggcugccugggggcaguggccuggugccacgucaccacagugacgcgccucaccuucagcagcgccuaccagggcaauagccucauguaccacgacagccccugcuccaacggcuacgucuacaucccccuggccuuccugcugaugcucuacgcggucuaccugguggaguguuggcacugccaagcccgccacgagcugcagcaccguguggaugugaguagcguucaggagcgcgugggccgcaugcagcaggccaccccuugcaucugguggaaggccaucaguuaucacuacguccgacgaacucgacaggucacccgauaccgcaauggagaugccuauacuacuacccaggugaggggcugugggggagcacaggcuguucaagacgaaggagguuucuccuauugccugccuuucucucugcccgugagggagcaggagacagcagugagccccucuggguauccaguaauaacaacaaacaccaacagaaccuagcuucaggcacguacaggcuuaaaacgguuuauuuaauucuuacagcaaaccuaugaaguagguguauccccccauuuuauuuuaaggagcaaacgaauguguagugguaaaaaccaaccaaccaaacaaccaaccaaccaaacaaacaaacaaaaaacaaaaaacaaaaaacaaaaaaacaaaaccacccaaaaccuguucaaggucaaauaguagguaaggagaugggacuuaaacucagcuggcuggcuccuggauggagucuguuuaguguuuugugucugcagaugaccucaucuguauaugcucaccuguucaguaaaguaauuauuaccaaguacuuauucucagcuaaggagaccucagcucagacuugccugaggguacuucuacuuggcagagguagauguaaagucagguuucugggucucaggccaagacucuuagaggagguguuugugcgugguacaggguuuucagggcaaucaccacuuacggguuuaauaaacccacuggggcugggagagggagggggcggagauaaugaugaugguggugguggaggaaaugauuucaguuauaaggacuucugucuguguugggaugaguagacaaaagcugcagucugcuccccuugcgacuccaacuuccuccugcaggucuaccacgagcgggucaacacacacguggcggaggccgaguucgacuaugcgcgcuguggcguccgggauguguccaagacgcugguggggcuggagggcgcgccggccacgcggcugcgcuucaccaagugcuucagcuucgccagcguggaggcugagaacgcguaccugugccagcgcgcgcgcuucuucgccgagaacgagggcuuggaugacuacauggaggcgcgagagggcaugcaucucaagaacguggacuuucgcgaguucaugguggcuuuccccgacccggcucggccgcccugguacgccugcucgucggccuucugggcggcagcccugcucacgcuguccuggccgcugcgcgugcuggccgaguaccgcacggcguaugcgcacuaucacguggaaaagcucuuuggucuggagggaccgggcucggccaguagcgugggcggcggccugagucccagcgacgagcugcugcccccgcucacacaucgucugccgcgggucaacacgguggacagcacggaacucgaguggcacauccguucuaaucagcagcugguacccagcuacucggagguguugcuuauggaccuggucgagcugggcucacgcugcggcgggccaggggguagcuacgugcccaggugucgcuacggagggguugguggcccgggcgcggcgggcgugaccccgcacuggcggagcugcgagcacugucagcgagcggucagcagcucguccaucuucucgcgcagcgcgcugaguaucugcgccagcccgcgggcugcccagggcccuggagcgagcgcggggugugggggcagccgcuucucgcucagccgccucuacggcucccggcgcagcugccuguggcgcagccggagcgggagugucaacgaggcgagcugccccacggagcagacgcgucugucgagccaggccagcaugcgggacaacgaggaggacgaggacgaggaggaggccgggccaccgccgcccuaccaggacgcccucugcuucccuguccucaucguccaucggcaggaggggugucugggccacagccaccggucacugcaccgccauggcuccugcguggagaccucacugugaccuccugccuuuggagggagccugcgccgccguucuccuuccugccucuccuuguguugugcucccuguguguagcaggggaaggcaggaugguggcuaaggccaggcaggguaugagggaaggcaggaggugaggggcacucucagacaagaccucagugaucugagacugcuucccuguacacagacagaggcugggagauuggcagcucucuuaagaaucccauccaccugggcagagguguuucucucccaguccucaccgaguuccagcagggggguacacccccuuucccaugcacacucgagauuucccuuccaggcuuucaucgagucuugacuguuaguauguugugggacccguuucuggccucccaaccaagggagccaucaugguggguaccaagaaaggcaaagcacuuggggcuuuuuuuuuuuuuuuuuuuugcccuggcuccccguggagaugggcggugguuuggugaagagcagcagaguuggcuuccagccagcaacuguguucccgggucugaggguggggccagauggcagcccaguauucaucuccauaccuugaaagaguucuggccucucggcgcugccucccgccgccgcugggaaagccacacucagcacuguuguuuguuucacuugagccccagagguccgguccuggagggacuuuuccucacaccaaugacgucacucaccucggggcuuaccggcucugaagagcuguugucagggugcagggcaagggaagggaggcugggagggcuccgcaggccuuuucuggaaaagacucagucuccgguccaucagcugcuuccuccccuagguucuggguaggugcuuccgucagggaggccauccuggagguccucauuaaagcccgccaggggugagugagugagcaaguggacagagccugagacacaccccgaugucgagagaccucaggaguagaguuaguaauggcugguagacugagacuagcccuggagggauggcgaugggcuggcgugcuguagcuuuuccucagcaggcaguggagcaaacacuuaagaaggaugucccucacacaugccuccauagagccgaguccaucccaaacccuagcuagagagauacccauuuccaguggcaggagauccguucucaccagacccuccacuucuuccuguccagcgaguugaagcucuaggucuucagaggggcuccaugacacagccccggggcaccagcccuuuguccugucccuucaaagcucugacaccaacuuugcucuccccuauacccucuuaccccuccaccccagugugcaugucuguguuuggccccuugcucucccagcugcccuggcugacguuuucccagcagacuuaguacccagggauugggcucacauccauccaaucuugcucccucugcuucuugcuuugccuucaccagcagaacuccaucuuuuuggcuuucccucuuccuccuggcugugccaggccuaugccaaccaaugggaguggccccuaccuaugcaaaaaucuccucuggcucccuguccccuuuuucccuggggaaugugggaagcccuguuguggggaugccauggucuagggcucaaaugggggcugagcuuucugguuauacagagaugcuugggugaggagggaggggugucagagaaggauagguuugggcagaagggagcaagcacaccacuggguuuccugggcaacaguguccucuggccacuuagcacagaacccuccaggacccugaauuugaggugugugugugugugugugugugugugugugugugugugugugugugugguguugacuauuggagcacagguacugagugagcuguggccucaggccucaguucuuggccaacugguaccugaaugucuuguucucauuuaggggcagcuuggccaucuuacagcuccaaggagggaaggacuuggcucauccucuuucauucuggguccagaaacugagcuuggccuugggagaggaggggguggggaagccccguuauuauuuuugccugaccauuucugccuaggucuccuugcacagacagccucaccucccacacacacacgcacagacuuagagagaaagcaauucuuugguuucuuuucuugguagcuuuauugauugccagggaaaaugaaaaccagaaaauuaauuaaucucuaaaauuaaacuuuacacugaauguucuuguuucucuaauuagaaccucugcuagcagcuguggcuacacacacacacacacacacacacacacacaaacacagagagagauacagauacacacacacacacacacacccucacaccuacauguuugcacucuggaacugucagagggugucaggcacagaggacucuaggcugcccccgacaggcacacacacagucacucccaagcccccucuggugcucuacucagcgccugcuucuugcaaagagucccuggagugcaggcccucuuggauugcagcugcagucgcccaucuuugagguagacgggcacugggucacucagcccgaggagaguugggagauaagaguuugaauuagucagccaagauccucucaugaauccauagucugugauuccuauggguguggccccauggugggcagucacagcgugccagggacucaaggagaggguaccuggaagacuguauguccugaggauaagggcuuguggggugggcuaggccuggcucgggagaagacaggccucugucaaauugggugcaucacacuguggccuuucugucauggaauuccaagcgcaaagauuguacaaaucacacugauggauaauaaaaguguggaugacucacuggucugcucccucagugacacuuguuccccauccuucugccccccgccccccccauucccgguuugaggguuagugagggcgcgaucuguacaagcagacaacgucaggcaaguagcaucu

SEQ ID NO: 8624 - RNA, 7492 nt, Mus musculus
uggguccgggggcggggcgacagagaagaccuaacuagggaccguucagcugcccaaagcacccgcugcgguggaccuggccggcgcccuggaccucucgcuuuucucauccgcuccccgcgccugcacaggcagguaaugaagccgcucggagagugacucugguucuguuaggcggucacacaaacccggaaaagcucgcuuuugcacaccucagaguuagaucccgcuggacccuggaccccgggcuggcgcggccggcaugucggaugcgcggaaggggccggacgaggcggaugauagccagugugacucuggcauagagucgcugcgcucucuacgcucccugccugaaccuacugcggccccaggcuccggaucaucccaaagcggcugcccacagccuuggagacaugcuccggagacccacaaggaaccagagaaagaagaugcggauggagagcgagcggacuccacuuaugccuccuccucucucacugaauccuuccccuuacuggagagacccgaagccaaggauccaagcccucccgccccaggaucgccgcugccccccgcgggggugcugagcccucagcaacucgaggcgcucacauacaucucugaggauggagacacgugaguaaacuggcuaggcugagauaagauguucaguuagagccccccuccgagcugcaacuggcugggcuaccaccaccacuucaucacccgagaggauagacccucacagcaccugcccuggaagggccagccuccuucuccaaacuccaaacuuaacuugcaacuugcuuuuaagcuguagccagguucagaccaaaaaccagacaucaucaccucuuuugggaguggacaggauagcagugcccuuguaaccuagaacaccagccacagucuugaaaaucuacuagugacccacuccugggaagaggaauucccccgcaaccaauucaguuuuuguuuuucuuguugggggaaggaaugucccuguuugcucaauauuugggauaccaaugccuaacuucagaacacccuaaccagaggggggaaaaaagacuacaccaggauuacagguugucaucugagcucaggaagccuggauuaacggugcuaccuggaugcccauuugaaagugguuccaaaagagggacuagacugagaauuuuugcccccaacaaacaggauaggcagcuggcugccccagcucacuuccuccucugcugagaaaagggaaguaauggcuuggccucagccuccccaacaguuaccuccugagcuccccaaauucuucuugcugucccaucucuugaucucccuuuucucccuuagguccagcuggaaucaggugcagcuggacugugaggcuaucaaguguguaggugucaagugcagaagaggugacugggcuuuguggguguuagagcaggggcagcuggagugcuagcuagaugagagagacgcugggaugcaggggguaccuguccugaccugcuuguuggagauguaggggucuugguuggguacuagcaaagauagucuccauccugugagcaggagagaggccuuuuguauuucaggcgccagucacaacccuuaggccaggaccucagaguucugggagcucugugcacagcuucucgggccaccgcgcccuccacgguuagccccugugcugcaugcagccuugacacacucugcuuagagacagauccagugugucuggagaagcaucagcccccucccccccagcccccagcagacaucuucccuccuuuggagguggcuggacugugggaaguauggaagugggaaaaggaagugggcaggaggaggggagacugagggagagagggagguggcugcaggaaugugacccagagagcaggcccuggccgaggggauuuccacagugguuccucccucccuccgucacucucuccuggccuccucuacugccugccuacagcaaaaguuugcccccccccuccugccuaaguaucccccucccuagcccagacaggccuuuagccaaguugcccccaaggcagcuguccaggucuagaccauuuaacccuggcuuucauuuuccccaccugauguggggaaaccccaagacuggaacuucccaucccaacugcccuguuggcccuaacuuacaacucccaucacgcccccccacccccgccccaucaaacccauuuucugcacugcaccaaacucccccuuggagcuguaccuaggagaggguuugugaccagaccccauaugauggcuuguguggaauggcccgcuugacuaguggguaaggcagcaguuccaaaugccaugcuggcuccuuggagugugugacauugagucgcugggggaaccccacaucggccuccuccuguccucccuguuguggggagguggguagcucagcccuggaaacccccucuguguuucuccggcagcuuucgguuuagcuuugagcugcagcuggccuggcagggcccugggggcagaagggagcugggugugggcacgguggacaggaaggcccuuguccugucagcacccugcccacagguuccacccccagccaaggcucuccacggguccagccauccgagcuuggagcucccaucuccagaauccuggcuuccuguaucaaccccucacuuccuggcccaaacucucacuuccugcaccugcuugguuguggguagcuaguuaagaggucgaugcauucauuucuaaccccaagacaccagcuuaucaccucugaccugggcucugacccuagcccucuccugcuccaggcugcuccaccuggcagugauucacgaagccccgucggugcuauucuguugcuuggcuuuccugccccaggaaguccuggacauucagaacaaccuuuaccaggugaguagagagagaaggcuaugcccaggugccugcugccauccccagcagccaaacccucugcuaggcacagcgccagaagcugcaauacaaagaugcauacagaggaagcagcgucugcccaggcacgaggugcccacagacucaucacuggcaccugauuauacagcacgaugacaaguguauugaagaccuuaccagauucaguggggucuggcgucuuugugggacaggcaagaaaggcugaauauaagagaugacaucuuagcugagccugaaugggagcaguugucagggagaggcccuggcuccuccgucuuuccuccccucccccagccccugcagagagacccuggaggaugauacagacuucccuagggaugaaggauuaagagcaagacccuguuucccucaucuuacuuccagaacugggguccuaagcauuuggggagggguucaggaguaauuucacagaagacccaacuaugacucuuacaguuaccuugagagaggcuccugggaguuggaggugguuguauucccacauguccucagggguaggagccagcugcagugguucugugaccccgugaccccucuaugccuacagacagcacugcaucuggccguucaccuggaucagccagauguuguccgggcgcuggugcugaagggggccagccgaauucugcaggaucagcauggugacacggcccugcauguggccugucggcgccagaaucuggccugcgcgugcugucugcuggaggagcagccagagccaggcagacagcuuucucauccccuggaccuccaacugaagaacuggcaaggugcgaggagaaccuacaccugugaacaggaccacggaaaugcgagacagauaguaaacagcacacugugaaguguguguguguguguguguguguguguguguguauguaaaggaagugggugcugugguggaccaggaggagaagaaccgggauguggcagaguuggagggaauuuuuuuuguagagacguccucagagucaggagccuuugaacagagauucaaaagagacaaaggauguaaauuuuaaucuaaaucucuauuauuauaaguaagguuggagaaacaaaggagguucuaggccagaagagggauaggaaaauaaaagcccuggggcauaaagggagaggugaccccuggguagagauccaugaggauccccagacagcucugagaaaccucgccugggcuugaagguaaaagucuagaguuagcaggggugggugugugcacuggaaggccgugugugacuggggcugucgcucagcagccugacccuugaagcauaaaaguuucaguaacaugaccgaaaaaguggaaacuuugaguuccuuuccucucagaccucugaggggauuucugggaggugguauuucaauaguccugugauuagaggcauugaguaggcaggggucccuugaggcugaagggcaggguaccaaauagcaguccccucccuccuccaccccaggucuggccugucuccacauugccacauugcagaggaaccaaccgcucauagaacuguugcuucagaauggagcugacauugauguacaggugaggcuccaccugguccaccaaucagggccccaccugguccaccaccugccaccaccugauccagcaccugccaccaccuggucuaacuacagguccccuggcagcgucaaacauauugacaugccaucuccggagcgcaugcucagcacgcuaccucaucacaugcauagcugacaucccuguucauugcaggagggcacgaguggaaagacugcccugcaccuggcuguggaaacccaggagcgcagccuggugcaguuucugcuccaggccggugcccggguagaugcccgcaugcuuaacgggugcacaccuuuacaccuggcagcuggccggggccucaacagcaucucauccacucugugugaggccggugccgacucucugcugcugaauguagaagaugagacaccccaggaccuggcugaggacguaagagacgcacccgcaccaucugccuugcagagccucucacccauaacagaguuaggcacaugcauuaggcaaaggaugcucaccaguuaacagugccggagucaggcuggagggucuaacuugguugacagagugcuuaccuagcauguaagaggugcuggguucaacacccagcaccacauguauaguggugcaugccuguuauuuaagcacuuaggaaauggagggaaaggaucaaaacugaaggucuucuucaucuacauagcaaguucaaggccagccuaagcuacaugaguucccucaacccccuaaaacugcuggggguagaacagaacuacuuuuuuuuuuuuuuuuuaccaacugugacauauugggcuguauuugccgccccccgcccccccccccagccuacaaccaguucccuaggcugguuaagcccaaggagcccaaacauggacuccaacaggagugacucugugaagcuaaccagacugaagacaaugccauagugaggcccgggagggaggacaggaggagcaacaccuccacacacguugcacgugucuugaagcaaaugucuucagcauauaaauacccgggguuuucaggucuuagacuuuuuuaaaaauuuuuuguuuaagauuuauucuuuuuuguuuuuugguuuuuuugguuuuugggguuuuguuuuuuguuuuuuguuuuuuguuuuucgagacaggguuucucuguauagccccucucuuccauuuuagugucauauuagaaugguggcgcacgccuuuaaucccagcacuugggaggcagaggcagguagaucucugaguucgaagccagccuggucuacuacagagugaguuccaggacagccagggcuacacagagaaacccugucucgaaaaacaaaaacaaaaaaagauauauucaucaagauaugcuggcacaugcuuuuaaucccagcacuugagaggcaaagccaggcugaucucugugaguuuaaggccagccuggucuacagagugagauccugacucaaaaaacaagcaaaaguauccaaaagccuuccacaccccaacccuaaccccaacaacagccacuguguauacauagugccaauggacauacuauaucuacuguaaggucacuccuagcucagauauucugcauggcuuaucucagaucuugucuaaucuucgggucucugccaugcccaggucuuucacugucuggccuucagcuugcccaggucccugcugccaucccuggugccaucacuuagggcauuaacucugcuucucucuguuuucucucucucucucucucucucucucucucucucucucucgcucagcuccuuucuuauuugcccuucgaugaccugaaaaucuccggcaaaccacugcuauguacugacugaagcucggauggguccccaccgcuucccaccuggaagcuggauccgcagcugcugcaguugggacccaagcaaugucgccccucugcugaugcugguccuggggcuagcauaguccuaaaaugagaugaaggauugcagacgaggaagagccgaucuggaaggaaggacuucccaaguggccuggauggagauucuugaaagacccucgaagccacugguauccugaaggaagccuccuugcuucuguugaagauggcaugggcugaaauugccagcuaccuggaaaauggggaugagcaaacugacccgaggggucucaccuaaaauaccuuugugaguguguuuggcacuggggugugaaccuagagccuccccagcgguaggcaagcuuacuaucauggagcuguguccccggcccucuuuucauuuuuuauguugugaugggaucucaaugaguugccagagauggccuggaacucacucuauagcccaggcagucaucuuugaacugggaacuuccugucucagccuccugaguagcugggauuauaggucugguggcagcgggccaccgcaaaguuaucuaaagacuucaaacauaaggcucccaacugaaccuuugcaguuauucuaauaugacacuaaaauggaagagaggggcuuuaaaaaaaacaacaacaacaacguuucccuucuacaguuguaugcauaggcaggccugacucucggguaaaggcagagagaaggaaacaagcccugagcaagcacagggccuugcuggguaugguaggagaccuaagugguuccugccaccacaggcacaucuccuucauguggaaaugcccagggcuggagagugaggaggaagaauauggagacacacacgugucccuggagaaguuugaggacauugaucacaagagaguugcaacuuuccucccccacccaacccccuuagacuccacacacugagggcccugcuaggucaugcacgaagaaggagaagaaauaaaucaacauacuuuccgaugcuuagcgcuuauaagcacuaagcaaaugcauccugugagugagacagauauuaaaggcauaaacaacuaaau

SEQ ID NO: 8625 - RNA, 3804 nt, Mus musculus
acagguccaaagucacugcugcaguuuaaucaaauaagagcaaaaggugacauuuccaaguaccaaaacuuggguaggaacacuggggccccaacugggcugggggccuuugucccuucuggcacagcaccauucucacuggccccuaggggaacugcaugaccuguaaacaauucucuucccagcuggugccugguagccucaagggugcgugcuaugagcaaagcccuggugcugguuugcuuggccaccagcaagauuucagagauugggggaggagcucugggucaccucuaaccaaacacccacagcugucauuuccaugaagugggggcucuuaaggcaaaagaggcugccuccagggcuccaauccucugcuguaugcugauacugagccagugccucagaagaugagggucuuuacugcacugcucacaccuucuguacugggggcucagugggcacagccuucuuuccccgcugcuuccggccccgggcauagacucugaguaggagggcagugaagaccacagcuacucccaguccccccaccacagugacaguauggccauagaggaggcaggagaggaggauggcaauagccuggcguagagucaugaugauagugaagacagcagcuccaaauuguccaaugguguagaagaugaagagcugcccaaaggcggagcagauggagaggaggagagcauggagcgcaaacucacugugccgccccaugaagcgugcccccuccaguagggcccccuguuccaguagugagccuacugugaaaagacaggagaauaaauugaccccaaacaucaucugcaccgaugacaucuuauaggcaaacagggcauccugccaauuugaggugaagcugucgaaagcaauauagccugccaguaggaccaagccagagagugugguggcuggagagcuucuaggcucugguccacuggauagaagaaacaugcucacuccaauggagaugaggccggcagucagguauucccaguguucauagcugcgccgggacaccagcuuucccaucaucaugacagggaucaccuuggaggccuucgccagcaccuggguagggaagcugacgaacuuaagugcuucauacuggcaccagcugcuaagcacauuugacagacuggcaaaggaguaccgguacaugggugcaccaugacggggcugcuugcgcaggacacaguagaggccugccacaaccagcgccagcacacgguucaucagcaccagaaacugggagucugugaaaugcucuccuggugauguggcuguggccccguagcugccagucaucacucuuuccugcaguaugccccaagucagauaggacaccuggaagagggagggcagagaagagcgacaguauagaaggaaaggcagaagucuguuuccuacuuccucagaguugguagcaucagauguaacugacaccauacuuuugguuccucugagggaggggccuucuuucccaagcuuuagcucauuuuaugggggaaucaaauggaguugcagacaccaugacaucugcuuuaagaccaaacacuguccucuuucaugaugcaaauccauuagagcuggcuccacauaccauauaaagaguuuuauuuaguuugaacuaacucaaaaagaaacugggauguuuggaagcuggggguggggguggcuggacacuucaauucaacauauaucuaaggugaguuggcucccacucugaaugcccugugauagccucacucaaagaaauccuacugacaaaauuuuggagaaagccaagcauggugguacacgcugucaccccagcuauuuggaaggaagaagcaggaggguugaaaguucaaggcuugcauuggguggugguggcacaugccuuuaacccacucuguccagcacucuggaggcagaggcguuuggauuugaggccagccugguauugagagcaaguuucaggacagccagagccacucagagaaacugugucuggaaaaacagcgaagaaaaaaaagaaaguucaaggccugucugagccugugaaacucugucaaaacaguguggugggucaucaauccuagcacuuguagagcagggggaucucuaagcuggagaccaaccuggucuauauagugaguucuggaguaauuagggcugcagagugagaccuugucucaaaauaauaaugugggaagcagcucuggagauauguuuagccagcaauuccucaaauucacacucagauacaacauacagacagagcagaauaugggcauagggaaaaaaaauacaacucaggcaggccuucuuccacacuguagaagccauugcaugggugcgcgcgcgcgcgcguggacgugcgcaugaacacaugcguguguacagugaacuuucauuucaauacagguguugaaggaagcgcuggaaguucacuuucaggacugggcuguguccuguagggacacaaaccagacccaaacuaacaaaccuuuggggugggcagggaaaauuugguuuaagucaggggcugucuguacccagcuggggaagagaaggggagccuguauucuuaccuggagacccgaggcacagaagaccagcuucaggaccugccaagacgggguggauuccgcugucucuguccgcggagccaggagaaccucaucaggagccuugggcucauugccaaacacacaggcuuucaccagggggaagcagagaccccugccugaagaagacacagucaagguccacaaccucugcagagcagccagcccgauccggugucugacuuacuggccucccucccggcccaagucccgcucugccaacaccugcaaccagacuucccucaucuccccacccucuggccacauuaccugucuccagguaguucuuccgucuuaaguacugcaccaggagguagccagguaccauaaagcuggcauagcccgcuacauucaacaagaagcggaagagccacagcuguguccaggacugcggaggggcuucgggugacucuccaccugcucccaaggaagggaguguggcgaguaccacuacugcccaccaucugcugggacagccgaagcaacgauuagguuugcagcucuuccgccucucugcccuccggaggggacuguaccagggaagugcccaguggccuccccgcccccuccgcugcagcccagagggacggacaaagagccucucucucccucucucucaggggguccggcgcaggccaggcagaaccuccucccuucucggggacggccccgccuguccagccacauaggucgccucuguucccuucagcgcgcgggcagcucaggccacaggcaacccccacccccuucccucuccgaagcgccacugucccucaucccccuacgcgcgacaauccccgaagccccgcgaggagcguaggccacaugccgcgugcccauccacacggggcucccaacagugccacgcggaucugcggcuggaggaccccccaccccgccuccggagcccuggggucucggucacguggccccggggucucggucacgugggccauggcugcccgagccccccaccuggcguccauggcccagccgcguggggcggaggggggaccggggaaugugagucccccgggccgcgcgcucccuccgcucccucugccgcccgcuccagcagccagccagucagccagccagcggaagugcugcgcucuucccgccuccuccccgccucagcccccuucgcgacacuccggccacagcgacccca

SEQ ID NO: 8626 - RNA, 7139 nt, Mus musculus
gcuaaagcuugggaaagaaggccccucccucagaggaaccaaaaguauggugucaguuacaucugaugcuaccaacucugaggaaguaggaaacagacuucugccuuuccuucuauacugucgcucuucucugcccucccucuuccagguguccuaucugacuuggggcauacugcaggaaagagugaugacuggcagcuacggggccacagccacaucaccaggagagcauuucacagacucccaguuucuggugcugaugaaccgugugcuggcgcugguuguggcaggccucuacuguguccugcgcaagcagccccgucauggugcacccauguaccgguacuccuuugccagucugucaaaugugcuuagcagcuggugccaguaugaagcacuuaaguucgucagcuucccuacccaggugcuggcgaaggccuccaaggugaucccugucaugaugaugggaaagcuggugucccggcgcagcuaugaacacugggaauaccugacugccggccucaucuccauuggagugagcauguuucuucuauccaguggaccagagccuagaagcucuccagccaccacacucucuggcuugguccuacuggcaggcuauauugcuuucgacagcuucaccucaaauuggcaggaugcccuguuugccuauaagaugucaucggugcagaugauguuuggggucaauuuauucuccugucuuuucacaguaggcucacuacuggaacagggggcccuacuggagggggcacgcuucauggggcggcacagugaguuugcgcuccaugcucuccuccucuccaucugcuccgccuuugggcagcucuucaucuucuacaccauuggacaauuuggagcugcugucuucacuaucaucaugacucuacgccaggcuauugccauccuccucuccugccuccucuauggccauacugucacugugguggggggacugggaguagcuguggucuucacugcccuccuacucagagucuaugcccggggccggaagcagcggggaaagaaggcugugcccacugagcccccaguacagaaggugugagcagugcaguaaagacccucaucuucugaggcacuggcucaguaucagcauacagcagaggauuggagcccuggaggcagccucuuuugccuuaagagcccccacuucauggaaaugacagcuguggguguuugguuagaggugacccagagcuccucccccaaucucugaaaucuugcugguggccaagcaaaccagcaccagggcuuugcucauagcacgcacccuugaggcuaccaggcaccagcugggaagagaauuguuuacaggucaugcaguuccccuaggggccagugagaauggugcugugccagaagggacaaaggcccccagcccaguuggggccccaguguuccuacccaaguuuugguacuuggaaaugucaccuuuugcucuuauuugauuaaacugcagcagugacuuuggaccuguguuuugguuggcauuaauaguugauggacaaguaacugccuuucaucaccuuccaacaccacucaggaagcccugaguguuacaaggagagcaggacuguauaaaacugcaucuucuuuauuuugcauacuuuuaauuuuagaacaaaauaaaacaaacaaaaaaaccacaauacauaacacccaacccugcuauucugugggaggggaucuuccugccuuaaggcacaggacaggauagaagauucuuguagacaugagcagagagccaggugggucagggcugcugggggagccacggggauacuauacagagggcagggcuucuuccaggaggcuuuaauccaccucuuccaugcgcgaggcauccucaucgccuuccagaggggggaucucaucaggaacagcagcacugggcuccucugcagugaccucaucuucaucgaugccuaagagaaagacacagauuuaaguaagccacaaagcacuaagucugcccaaagguccagcuaguacaacaacuugcuaccaggagcucacaagccagacucacccaggccuaguuuaaucaugcgguagaugcgguuggaguggguuuggggauccucaagugagaaaccagaggagagcagagcaguuucaaacagcagcaccaccagguccuugacagcuuugucguuuuugucugccucagccuucugccgcagggucuccacgaugggguggucaggguugaucuccagguguuuuuuggccaucauguagcccauuguagaguugucucgcagugccugggccuucaugauccguuccauguuggcuguccagccauaggugcuugucacaaugcagcagggugaagacacaagccuauuggagauugucaccuguggacaaucaagaacaaugacaagauguaccuuggccauaauggaacugcuauguaugaagaaccuuacuaagauggcaggcagaggacuaacccccuuacaugcucuggagacugaagguugcuugaguacagggauucaaggauaaccugggcaacacaggaaggcccuuuccuugcauacauacauuagauggaauaauuacuguuuagucugugugugccuggucugugcugccugacauuucuagcuguacagcagacuaaaauauuuggagcuaggggagacucaccuuuucaaccuucuuguccaagaucuccuucaugagcuugcagagauucucaaacuuugccuugcucuccuccauuuucuucuucucuuccucguccucugguagcuccaggcccuccuuagucacugagaccaggcucuucccaucaaacuccuugagcugcugcacgcaguacucgucaauaggcucagucauauacaccaccucgaagccccgcuuccgcacucgcuccacaaaggcagaguuggccacuugcucuuugcucucaccuacaggauuaauacaacaauggccacauggccaccacauggccuccacaccaccacuucccccuuucccaaguccacaagacagcuuuacucagacccaaucuccgacauaccagugauauaguagauggacuucugggucuccuucaugcgagacacauacucugacaaggaggucaucucaucuccagacugagaggugugauagcgaaggagcucagagaggcggcgucgguuaguggaaucuucaugaauuccaagcuuuaaaagaaaaauccaauuauaugagcuggaaaaaacacccuaaauacaaaguuauuuggagaacacuuguccgucuuaccuuuaaauuuuuggagaaggccucauagaacuucuuguaguucuccuuguccucagccagcucggagaagagcuccaggcacuucuugacgauguucuugcggaugaccuucaggaucuugcucugcugcagcaucucccgggagauguucaggggcagguccucggagucaaccacaccgcggauaaaguugagguacucagguaucagcucgucacagcuguccaugaugaacacacggcggacauacaauuugauguuguucuucuucuucuuguucucaaaaaggucgaagggagcccgccggggaaugaagagcaaugcccugaauuccaacugaccuucuacagagaagugcugaaaugaacccaauaauacauuuuaggacaggacugcuucaagccccaauaucaaacaucugacagcacugugaaugcuguacugcugaacccuaugaauaggaaagcagcccuaaucacaaauaaacccagcaugcugguagcaagaauuaucccgccaagcagaacccuggcuguaaucagggugguggccaugacagugggagugauugagaagaguaauccagugucagauauggcugacacccugauucccaccagaaagagaaugugaaaccacuguuagcucugaguagcuccaguguugucacaugguucuuuucuguggcuuucaggucccagcuaccaaccagucgagccaguuauuccuuaccaccuccagcuucugccuaccuacccugccuuacacaacagaggaaggcuucucaccuugacugccaagugguccucccagucauuggugaggcucuuauagaauucgccauacuccuccugcgugaugucauccggguuucugguccagauaggcuuugucuuguucagcuccuccuggucaauguacuucucuuugaucuucuuuguuuucuuuuucuugucuuugccgcugucaucuuccucaucggaucccacaucuucaaucuuaggcuucuccucauccuccuuaucuuccuccucuuucucaccuuucucuuccucugccucaucaucacugaucuccuucucccguuccuucuccaacuaaaucaccaaugacacauguaauuaauuguggagaauguagcaccagcaaggcccagugccauuagccugcuccaacacugccaagcccauacucacauagagggugaugggauagccuaugaacugcgaauguuucuucaccacuuccuugacccuccucuccuccaaguacucugucuggucuucuuugaggugaaggaucacuuugguaccccggccaaugggcucaccuacagagaacaaaucaagacaugaaaaacugaaacuaaaauacaagaacgaacuacgcuuuuuucguuccugguuucucaagcaagcuaagauuccuguguagccccuuugcuugccuuaagaacucacccaagugcuggcacucaccaccccuuaaaauguacuuuuauagaauacaacgucuaagguuuccccacaauguagccugcugccucaccauggucugcccggacggugaaggagccacccgcagacgacucccaggcauacugcucaucaucauugugcuucgugaucacaaccacuuucucugcaacuagauaggccgaguagaauccgacaccaaacugcccgaucauggagaugucugcaccagccugcaaaggguuugaaguaaagaggaucagcaacaugguucuuggccaaguauaaccaucugcugcgcaagguaacaaucaguucaauguccagagaucuaggggucaaagcuguccugaccaaccacuuguacuuuuuuucuaauaaguguccuaauauguaauacccuagacagacaaauuuuaacuuaagcaguaacaaauuagaggacgguguggaugaaaggccacacaccuggagagccuccaugaacgccuucgugccagacuuagcaaugguucccagguuauuaaugaggucagccuuggucaugccaaugccuguguccaccaaagucagcgugcgcuccugaggguuggggaugaugucaauuuucagcucuuucccacuguccaacuuagaaggguccgucaggcucucauaucgaaucuuguccagggccuguaguaaacgcaaaaagccagauuauuuuauuuuuccaaacagucccucccccuucaacaucaacugaacuguucuucucaaucacucccacacacacacacacuuccgugaagccuuagaaauucaacaacagaauacucacaucugaagcauuagagaucaacucgcggaggaaaaucuccuuguuugaauagaaaguguugaugaugagggacaugagcugggcaauuucugccugaaaggcaaaggucuccaccuccuccucuccauggugcacuuccucaggcaucuaagaaugaaagaauuacuacuaaggaccauuauagacacacauuuuaauauccagcucaaacuucuuuagucugggaaaguauccaacccaaagagacaagagcagccauuuucuuuaaaaaaggacauuuaagcuacaauggccaagacaaaaaugacagaaaaaaaccuaaaagauggguuuuccagaacagaugcccaaaagucaaacucuugaacauuggcauguucagugcauagcucacugacucugaacagaacaccuggcaauaugguaaaaauccagacuaaguuaacaauacauaaaaaagaaccucaagcaaccccugguacucacaccccuuaacuacaaucuccucauuggggugaggaacaacuuuaacagaaaaagcagucuuuuuuaauuuuuauuuuauuccacccagcagggcaagagaaccuugaagcuguagucugggaggcgcucacggggcaauuaaaucaggacaaagaaaucaagagcuccaccgugaccacucacugugcagacuugcauaggccggaacccaaguaaaaugguggcccagccguccaacgacccucgucacugccggacaugcgucggcaggagccacacggggagggggcgccauugaaacccucccaccgccccagcauccgggcacuggggcggggcgcccaggcuuccagaacaaucugagcuccggggaggggaggagaaagggagggaccuaggaaucuucucgugccugcucugucucuccucccccgcccuccacugggagggcagaaagaucuggaaagggaaagcgcgguggguuccggcgucccugcugugcaccccuccccaaaaucaagcacguugguaccggcggcguccgggggaggcagccaggccaaccuccccaggccuugcugagucacgcagagcagcccgccaccgcgcggacccugcagccgcgcccggaaguggagggcaaacauggcagcgucccgggucggcgacuaccacgugcggccgcccaccaccuggccgggccgcacccccaccccacgcuccggggaauccacccgccccggggagccucgcgugcaagcccgccgggguacagcccgaaccucuaaccucuagacacguuaucuccacaggcugccccgccggggaaggaggcuuugggacagaugagauggaggcugggaccccgggaagaagcccccggagagccgccggggacgagagaccccggccuuaccuugacgggaaagccgaguaguaguacagagcaggguggugggcccggaccaaguccgacucgcacggcaagccuaggcugcgcgggggugacucaagagagcucccgaacgcccccgaccgcccuauauaag

SEQ ID NO: 8627 - RNA, 14410 nt, Mus musculus
gcuauggagaaaaaaaauguuuauuuaaucagauggccucugaaggcaccugguuucugucaguauaaaaaaggcaguaaaaugacaagggcuggggacauggaacaggcacagaaggaagaagggcaaggggagggacaucaggucacacgacaccaaucagccauccgccuccgcccuauccugugauaggcaggcggacagaucucucuuggcccuggagucucuugugcuuggaguaagcgggcaucagucggagcugucagucagaggccauugagcccuugccauucugacccugaauuccaaguccacccgcaggccaucgcuggcuccuggacagcugggcgaagcacaguccagaggaaagcagaagucagcuagaagaacagccccucucgaccccugcucgucccuggcagggaaggaagugagcaggaagcaggcaguguaguucuucuguccccacagggucacacaagugcccuuaacaagaaggacaacacagcucccagagccaggcccagacacagaaagaaggacaugauguuuccugcugucuccgccucagcugguuugacuuuccuaaaaggaaaggcaggguaaucuuaggcaagcugagcccagcccuguccccccacccccaaaccuuccaacacucccaaucccagcccacuucuugggagacugugucuagggaccauccuccacccugucuuaaucccuucccacacagcucagcaggagcacauuagcaagcccuuaccuccacugccccuuaaaaccccccagcaacuccaacuccgugcagcuaugagauggggagggacucuccuacugccaucucccuguaaguccugccugaugucaccaaauccccucauggcccgacucacuugggcccgaagcacaugcagaggcuggcgagguagccauuggagaaggcaaaggcagccaugaaggcgaugaaccaggcgucaugcuuaaagacgaaguggugccgcugcgcgccgcaguggcgagccuucacguugcagagcaucagcaggggaauaaacacaauccucgaggcgaccaaaaccggcagccagcggcuauccuggccaggcugcggacacaggcaaggcuucagcacgcaugucaguccucccggucuccuggggccccuggggacuuggauaaaaccacuaggccugggugccuuugggggugcugauugcuaggggcgcaguggugccuaugauaugucgagauguaucuuuccaucuaggugggagccaugacaugcacaccucugccaggcuacacaccuaagaacuguacgcaugggccaggaauggcucaauaguuaagaguccugcucuugcggaagacccagguuuaguuuccaguccucacaagcuccucuaacuccagcuccaggggaucuggugcccucuucuggccucugugggcauugcauucacaugcacacacacauaauuugaaagucuuagcugguggcacaugcacuugggaagcagggaguaaagagaucugaguuccaggccagccuggucuacagaguaaauucccagauagcaacacacagagacccugccucuacagacagauaaacaaacgaaugaacuuguacacagaguuacacauaaguuaugaguaguacacgguauuuuucccuucuugcagguuuuuuguuuuugaugaguacacugguagcugucuucagaugcaccagaagagggcaucagaucccauuacagaugguugugagccaccguuguggcugcugggaauugaacucaggaucucuggaagagcagucagugcucuuaaccuguugagccacugccccacccccuccauuuucccuucuugcaguuuuacagaugggacccaggggccaugcaugcuagcaagcccucuaucagucacagagccacacugcagccaccauacuuucuuggguucccucuuggccucagcuggacaccugaaccccacagcccugccgcccaugcuguacucacccacaugcagacagcagugaggcuccggccuagccagucaaagacauugaaauucaagaaacaggccacgggaaugaaguagcuuucuaggaaagagacuuaagacuuagcaacuggcccucucugggccuaggacucuucauucugccucagagguuuccauccaauggcagggugucuaguaggcccguguagauccagcugggcagagggagccccagagguugcccauaccccacccaugauuccacuuuagacucugggugaauccguccuaggagggaagugcgggggcugggggggggggcugggagggggcaagggacacacauacuccagggacuugugccugcgaugcuggauuccaccucagcagucacagcagggaacaacccaaugguaaccgugaagaugaagcagacagacagagccgggacacagaucuggagagagagaagagaagagagauucauacagggcccuagguugucauggcucuguguacaaaagaccaaagagccagacacugguaccauaccccuuuuuaaucccagaacucaggaggcagaggcaggcugaucucugaguucaaggccagccuggucuacagagugaguuccaagacaaccagggcuacaucaaaacccuguucuugaaaaaacaauaaauaaauaaauaaauaaauaaauaaauaaauaaaucucagagauggggcuggagagauggcucagcaguuaaaagcacggacugcucuuuugaagguccugaguucaauucccagcaauuacaugguggcucacaaccaucuguaaugagaucuguugcccucuucuguggugucugaagacaacuacaauguacuuauguauaauaaauaaauaaaucuuuuuuuuuuaaaucucacagacagacagacagacagacagacacacacacagcauucauaggaagacaggagaaagcccagucuuagaucagaaagggaagugguauaagguagaaacagcaaaaggagaaagaagggugaggaaggguaggcaggacaccccgggcccacguacacucuuaaguauggcuuugauagacugguuucuguugguggguggagaguuggggccuggcaccccagauuccucucuucuuccuuuuggcuccucuccugucgggugagagguuguaaaaggaucuuuaaguuuuggggaggacagaacaacagguagaaugagcuggaggugggcaccucccuuaacuggcuaguccgcaguucuacccuaauaacccuugacucgagccccuggggacugacccuucccccaggaggcuccugucauucucuguucccucugaagccgcugaccucuguccgaaugcccgagacauucagggugacccaaguuucccuucuuucuucaucaagaugucauguaggucaggcuggccuugaacucacuguauagccaaggaugaccuugaauacaguccuccugccucuccuucccaaacgcuaagguuacaugugcaccaccuugcccagugcaggaaucaaacucaggccuuugugcacccacucuuaccaaccgagcaacacgccaagacccugcaaggcaucugcgcuaucuucccuggcucaccccucuuuuccccucucccuacccacucacggcccgaguguccuccuuuggcucccagcugccaguuaacacaacaugcccacaacccucccacucccauccuaccgcccuaccagacuuccuuuaguaauuaagaccuuuacuuaugagauccaacuuggucuccugcucugcaggccccgcaagguugagcugcagguaauggcgauagaauuccuguucagcaagggagaugggagaaguaaguagagucagggcagcucuaggcauccgagcuugccauccuuuaguuuccagacacccuugcuuugaaaccccgaggccuccccaaauccccccauuugcucaccguccgaggcagagccagguagcacaggauggccaaaaugacaacugcacaggcugugaugaaguagccaaaggcgcuuucugacagcucagaaccaccuggcgcagacagugcacaagcucagauacgcuccacccuuccaaaucacccuacccugccuccccacaaccagcaaagcagggcagugcgcgcgcaguuggacucacuggcaauggcacagaucauggcgacagaggugaagaagccagccaggcccuggccacucaugaugggggcuguguaguuggcuggcaggacaccugccagaccaaaaaggcuggcuugcaaaauggcaccaaaugcuggggaguagcaaagacagcuugucagcagaggcuggcaaucagggcuucccaggaagcuuuaaccugaaccacccccacccugaucucaacccaggcccauggcuguccaucccguccccucccgauuacaauugaugagcacaaucuugaucauggugaugacaaagaagaucagagcauccaucuccaccuucaccagggcggcagugacaaggaauaccagcaggauugccagcaggcugcccaagauccgaacagauugagagauccuaggagaggcagggguggugguggugguggggugucaggaagggucagccuggggcugaggaagcaggagcuggcugggcaucauggacggggaggcucaccgcugaugcagaaacgaguugaggcaggugaagaccagcaagggcagcauggcacacagggucaugacauuguugaagauggcacugagagaacuccgggcuggcaaggccacuguggggucagccaaggccuuggugcuuucgcaugauugaucaguguccgaggacacauucugggacacguccaggcgguuugugaaauacugugggguuugcagagguugaguguugggaccucugucccucucugugcccagaggcacagaaccaggccuugaaagccuaaggaacauguccucuggagccuaguaccugacccccacuccaaccucaccuugguugcggucauaaaaaaauuccaggggagcaguguccccaggcccagcacaaagaagauaagccauacugccuuauaccugcguaggaaaaaggcaaagugaucagucagcccaccuccccucccucccgucuacccagcggucccagcuguguguauccacaaguaggcgcccuccugcagaggugugagggauguguagguccuggguacaggacaggcuguaagauggguugaaggaaaagggcugguggcaguucugaaugacacgggagacagaaccuuuguucccaaguccuagaagguucagggggcugggugaucggggaagcagugugaugacccacacuuccagagcugguguuggaaccucuguuaaaggugggcggguaaagggcagugggcacaagccccagccccaccacaccagcuggaaguaguuaagcugucuaagcgggaacgccaguucucucaagaacucuugaggucaaaaaacaacacccagacaauucuagacccagugggucacauggcuggggguaggggguggggacuaggaaguagagagcuauagaauuuuuuuuucccuuauuagauauuagacagacagaaccaguuuuauaguccaaacuaccuacggcagggcagauagauuaggacuuauggcugccaucugguucugagcaugacuucggacagucuuugccuguaagcuuaguggcccuggucccuuccauuacaguugccuaugccugguaaaauaccuuccccuuagccggcaucuacaggcugcacagagaugguagcagagacccaacucaguggaacaggccucuugcaagccugaaaugggacagccagaagagcaaccaaauucgccagucuaagccauggccacaccacagccuucaaagcccucauccauucccuuugaggucaagaugcucaaggcuugguucaaaggcucagauggaagguaaaauuccgagggaagguuauacaaggacaggaggucagagaagagcugcugagccaggcagcagugaaauggguagauuguugaagaggccagggcaccaggcagccugggaaggaaaggaggcaggaagcuggaaccuacaaugacaaugacaauucuuccccucagaaaacagucacagaaggcugguguucucaccagacuuuacaggauggagaaauggucccagaaagaugcagcuaacucuccagucagaaugggccuaguuacauagcacaagaggaaaauggugggcaggggagccgugagagguucagagacccaacaggacagaggggccaucuggaaagaguguaucauggcuucauaaacuuccacaagccucagccccucugaaggacuagacucaagcuccuuuuccauccuagcacgcauuccggaccuuaacuagcuugaggaagaucccaagcuccggagcuagaaggcuggaagggucaggccagagagcagcgugggcugaggucaugcaagggcgacccccagggacagggguaguccugccagauguguucuggaaugagggaagcagccaagugucuccccacagugauggugggaggagcuggaagcugcugucuagcugcgcauaacaguggaaagacugagacacuccaauagggaccuacugcucaccuagcccugcgggcaugcuagccagcacccagccagggcaugcauguucuccacccuaccccaugcagaacugacucagaaccaccaggcugggaacacaguuaguccugagguccccucccucaagucccaaacaccgcaccucccucccucccacccuuacccuagagacucacuccccagaucuccagaccggcuccccccucccugcaaccacccuccgucacaccccuuggccacccaguaccuguccugaggcuggugacugguugucauggcuccaguguucucggcugugccuggcuggcagcucccucccucuggcucuugcuggggguaaaggaauaucgagcccugucuggcucugcuuccacacugcccugggccuuucucuugggggggggggguagagcuggacacagaguaggcaagggaagccucugcagacucaggaccacucaacucagccccaucuggccuuuggccccaggaaggccuuccugucgucucucugccugauugggcugcaccuggcugccagccuggccgcugccaccgcuauuuuuauccagcagcagaagcaguuuauaagcuuggaaaccgaaggguggggagcaaucgaggaggaggaggaggacggaugauugagaggcagggaaagacagucaaagaagacagaaaagagaaaaggggucagggacagugacaacagugacagagcaggcaaaggggaggagacagagcagaggggaaaaagggagaaagagugagagagcaaacagacccuguaaggaacacaggucuccugaggccugccaugagccugcacucuccccuccugggugcccccaccccaucacccaaucaagacuguggcagggagggccuucccuucgcagacugcuuccuagaguaaucgggacucccuccagccucugcuggagccagccucugcuggagccagccucugcuggagccagccucuacgccuuuccagcugcugccuaggggcuuccugaguucuccaggaauauauuucauaacugugggagggacacagacuucuccacagcaaguuccuuuccuugaccuccaguuccagaauguuccuuucuucccccccccacccccaguuccuuucucaguccaaggccacuaacuauccucuucccgugucugacaguggcuuugaagggaaauuuggaaagcuagcaucgugcucccagagcuccuaaccaaacccuugacaugcugcccugugccucacucucaaagaggagauaacagcaccagugggcuaguccuguaaggaagaagcauauucaagggacaccccacccaucagacugcuauuucuuugucuagggcaagcugcucuagauccccaucucaucacucaccaaauuuauagacucgauguuggcaggacggugagagccaaagguaccugggcguuccccaggaagggguccuggcucaggcucaggcaggagguuggguccuaggugaggguccagaguggaaaaguuggccaaggcuuaucgggagagaaucccucaggccucaaggggcccccauucagcgggggucucacaagcuaagaagcugcagaagcuaaaaguaccagcgaagcugggagagauaaagggccacccuguagcugggagauaagacagcagcccaagcaaccggcucagcaggggaucuaagccuguggcagccaggucagcucucaggugcagcuagaacuucaguccccgcccacccagacaggcgucacagcuggucacccugaggcccuauagccgcuuuucuauucugcugugggugaaacccagacgggccaaaucccucaguacuggacagcaaagccacacaccuccagaaggaggcagaaggcuccugcuguugguuaaggacuauuugcugagggucucuguggguccgccaggcauccuccuaggcacuggggacagagcagcagcaaacaguagcacugcuauuuaucuaggacaagaggguucugcugcggcugcggggagccugaggacucagguuucuauuagauaguagggaagggaccccaucaaaacauagcuaauucuccaccgagcaccccacaccucucccaugcaccagcaaaagugaauacagccacaagccagagggaggcuaacucuuccaucauaaaacuggcuuaggcuuggacaaguauacacauacauauacacacacacacacacacacacacacacacacacacacacacacaucacuucuccccuugcagaaauucccaccucucggguuccacccacauccaaacauuccauuugcugcuuaggggcuuucuuuacuuuugucccaguagagaucugauagcaguucagggccucugguaucauuucagccaugccuugaccugccgagauggagaggcccugaaagcuaucgcccaucugaggccuuccugcguccuaaggguccucucacauagcucaguuucucagccuaguuucugcuacaucggaaucuucucuugaaaucugaggaugccccucuuccagcugccccguuucuacuaaacaguuagggcgauugagguuuaaagaggcuccaucacuugagaaagcccgcagagcuggugaaugggggugacagcaucaauacucaauguaccgaucauucuagauuccuucucaaguggggaaggcaaaauuaacaaggcuccucagcuauucguguaggcuuccaggaaggcaacagugcuccaauuaaaggguuaaaacaagugggagauucaggccauucuuucacauaacauuaguuucagagucaugacaacucacaaccauuccaccacgcauauauuauuguaugcaaaggucacacaagcaggacaagaggaacaggacggaaggaggguuaauggagaagaggggguuggcucaggcuuggcaagaggacccgaaugggguauaaggugcagggguggagagagccuucauccaaaggaagccugggugugcgcgucaguccuuuaucuugucacacguucacucuccgcguagaguaaaugaggacucgcccaggaaagggaggccaggaacaggaguuuagucuguaaauggccagcuagcucccuucacguccauuuguauucccgcauuccccauccuccugccucggggcagaaggcaacacaaccccucccucuaguucacacaggacuguagcauugaacuacccacacgccgauccucugcggaagucaacacagcgacagucgcuuccaggcccagaagccaggcugucuugggcccagcuccgcccugguccccacaaaaggagagucccccuacccagagccaggcccaugcgcgccacgugcuggcgcugcucugcacgcgccgcgugggggccgcaccccaaagucccugucgcggccucggagcuggcagaccgggccuccuuuucccuccuggcaagccggacacuccacucucuaccccggaguccccaacaugucccacccaagcccuacgagcaccugcuggagaaggacaccuccggcgacgaaaucugcgcgcuuggccagcgcuucccgcgcccgcccgagcgcuuucaaacccgcccucugcuggguccgccccgggcccgugggagccaccuccucccggcgacagccccgcccccaggcuccucgccgcccccucaacaguucaccggcucccagucagagacccuacgccuagggccgccagggcugcuggcuucgauggcggagcacgucuuuggacccuucccaacugucacccggacacgcgagccugggaggggggcacgggccccccacugcguaccccuaauuuccgcgcuggcccugcgcuccuaacuccuacacauuccacggcgggacucuugcacagacaggcccucugcucacccagguccagacgcccccacaagccacgcuccaccucagguguuccguuaucccucuccgaaccccgcccacgccauuauucacacuccaccguuuuacugcuagcaacccccucacacacacacacacacacacacccuucuaauacauccuuuuuccuuuccacuccuccuuuucccuucaagaagacuuucugggauaccucagauuugagcguucuggaacccagacgcuggagguguuuuguuuucucucuccugcccucagacucgccgcacaccacacaaacagcaucucucccccccccauccccauguugccuugaaggcuccuuuaugaaggcauaagaggacagcccugaggccucuaagaaaacugaaacacagcuggagaccggagaaaggggagccaggaagaaaggccucacauccugcacaucuuuguccuagccagcauuucacugucccaugucccaucccaagauaacccucggggcuagaagccuugcugagccucuuaccauucauaccccuccccuuccuuccuucccccccccccccccgcugggguacaaaggaggagggacccccuacaguagcacucccuacugauguaucccagaaguuggggaggguccugaggcaagaacaucccauccagauugccugucucaccccaccucccuaaggaaccugugcuccagagaaaccauuggagcuaauuaacaauuaccagugcuaacaucguagggaaaagacgcacucagucuccccagaggacgacugagcccuuaggagguagcugacucuguaggacaguggguucucucaagcugcucuggugggggcguauacagccuuccugcucccacagagaugacacaucuccccacuagcacuaagcaaacagagggcaggaagucaggcuugggugguauuuuucugggcacuaucccauggcuuaagaguagccucaugucuguccacaacgccagaucccugcccuguuugucuggucugucucucccugccuuugccucccuucuuccguugcccccccccacacacacacaccucacccccucuuucccuucccaagucuggcucuguuaccauagcuggcacagcugugggagagaucgacuaggcauggucaggcugggagcccuugugugcaaagugagcuggaaguggacagacgaagugguaagggucccagccagacuggggaaggcugguuccuuuccucaugcccacugggaccuggccgucuaugcagauggccacaggcaggccuguuauuauuggagaacagcccaucuggcaagcuccuugcauggguuccagccagcacccacaccccaggcagccucaggcaguugcuggugcccgggcccucugcuggacagcccugggaacccagcucgcacaagccugggccuggcagauccucaggcacgucuaccaggccucucuuuuuaccuuccuccucauaucauggcuccccauucccugucacuaagguugggucaggagggcugguccaccugaccucauggcucaccuuuauguccugucccccaccccagcugggacuguggcuaacucuaucauuucugccccucacccuuuagaagguagguuugcuucccaccacacucaacucucucucucucucucucucucucucucucucucucucucucucucucucucuuccucucuccucuccucuccucuccucuccucuccucuccucuccucuccucuccucuccucuccucuccucuccucuccucuccucuccucuccucuccucuccucuccucuccucucuccucuccucuccucuccccuccccuccccuccccuccccuccucuccccuccccugcccuucucucucucuuucucucucucucucccuccucucuccuccucuuuccucucuccucucuccucccccucccccuccccccucuccucucuccccucuccaggcccuguucucucagcuguuagcaacagccaucugaccaucuguguuggcugcaagaguguuugcucccggcucuguaugugugugugugugugugugugugugugugugugugugugugugucacaagcuaugucucaaguucucucuugugagugauuaaaucuuuguggccuuguggcagaaaaggaacuaggggaaacccggggaaacacuugcccacugugcugaauuuaaggggacacauaaaagagccagcaaugaagaagaguuuuaaggcaauguggauuuuguugucuucguuuuacucuuguuuguuugaggacacuggggucaaguucaaggcuuggaacagaacaugcuaggggugugcucuagccauugagcuaguucuucaggccuaaugccauugcuaaaaaaauaaguuacuggaaagauucuguaucaauauaagaucaaacugucucucucccucucccuccucccacucucauguguguuuguguauguguguguguguguguguagccagagaacuaccuuugacugcaguccuuagggaccguccacauugauuuguuuuuuucaagauuauguauuuguguguuuacaccacacagagcaaguguacauggaggccugggggacuuuggaucucuuggaacuguugugggugcuggcacccaacccagguccucuucaaaaacaguaaucacucuuaaccacugagccaauucuccaccacccugaguuuuguuuuuuugagacaggaucucacccuguaacucuggcugaccuggaauucucuaggcagaccagacuggccuguagcucacacagaucugcgugccucugcuuuaggagggcuaaaaucaaagccugugccaccagccuggccugugccacuaaccuggccuggcccacuuguuuuguagcauagaauuucuaaccauuuguccucucccuugccuucccagugcugggauuauaaguggcaucauagcuuugggaaaaauauguauauauguacauacauacauauacaaaauauguauacauacauacauacauacauaggcucugagagaauugaaccaauugagugagucuucccugugcccaguaucaaauuuucaaauaaagaccgauguguacacaggguggauacuaggucaggguccaagaagaauugacuuuguucauuuugucuaaaucuggcuucuagccaaauuucucugaugacucuccuaacccgcugguuggcagauaagucuccuagucuccucugacccaggagacaauuuuaaguggcccagaguuuaaacaaccauccaacuguacaaacuccaaaauaaauaaauaaauaaauaaauauuacauauauauccauccuuccucacgaggugacagauuuguacuccaggagccaaauccuccuuuucaaagggccaguuggacaccaucagaaccguucggucuccauggccgccccauugcaccugcugagacuggaccugggguggggguggggaggcuggacaggggagaaugaaaauucccaggucguggggaccccauccaucucccgaccuccucaccuggggggugggggucgcugccaaggccagagcugaccagucucuggcacggggcgcgcgauaguagcccccaccgacgauagcucccuagccucacgcuccgcagcugcugccugcucugccccgccccgcgcg

SEQ ID NO: 8628 - RNA, 1134 nt, Mus musculus
auaacaacacacuguccucguuuauugacuaccugcugcguaccaagcuuugaaaguacucauucuuuaacgggaagcaagggcuuauaauuuuaagguagacgggacaguuuggauuuaaauaccaccucuuagcuaaauugucuugagucuaagugaaacaucaucucuuaacugaccuugauacccgcauuugcagguccacccuggaggccagagauaaggcagagggagcugcagagaggaagggucaaucaacacaaucuguagccugcuaggagcuaggggagugggaacuguucaggucagagcccucuugcacucagcccggacugucuucgcccacugggcagucugccguccaugcccgugcgugcggaccgacgccuggacuaaccggcuccaaaaguacuuugaugggcguugcuguuuccaggacccguggccucacuucugggggcccaaucucuccuuccucugggagugguccacucuggaggccucuccagaauccgguggcuguugcuggcugaggacaaagagcagacagcucagcagagccucucucaugucuugggagcucagucggcgggccagccggcgcagcaagggcaggaggugcugccgggccaggcgggcaacaggcagcagcaggcgggacagcagcgaucgaagcaccaucgggagcaauggaacgggcauggcaggaccugcaccugcaaagggaacccggguuuuagacuguaccucaggcacgcaccucaccuggcaaagcagggugcggggguguggaguccucccuucagcuuauaccucuguacuccccaguuuucaacuggauuaguuuuacagugcagcuuucuucuggcaugaaagcugguuaaggaguucacucacuguuaucacagaugggaagggagcccagggcuggaaggugguggggacugaggcuagggccuuuuccagaacccacuuccuuuaaucccucccucccuuugcauacucugaccugaagccugaacuucuugcccuccugcucaccaguucuaaccggccaguggcagcucucaccagucagaacugcucagaaucaauuucaggaugcuuuugccugcgguggauucagcaucacug

SEQ ID NO: 8629 - RNA, 1134 nt, Mus musculus
cagugaugcugaauccaccgcaggcaaaagcauccugaaauugauucugagcaguucugacuggugagagcugccacuggccgguuagaacuggugagcaggagggcaagaaguucaggcuucaggucagaguaugcaaagggagggagggauuaaaggaaguggguucuggaaaaggcccuagccucaguccccaccaccuuccagcccugggcucccuucccaucugugauaacagugagugaacuccuuaaccagcuuucaugccagaagaaagcugcacuguaaaacuaauccaguugaaaacuggggaguacagagguauaagcugaagggaggacuccacacccccgcacccugcuuugccaggugaggugcgugccugagguacagucuaaaacccggguucccuuugcaggugcagguccugccaugcccguuccauugcucccgauggugcuucgaucgcugcugucccgccugcugcugccuguugcccgccuggcccggcagcaccuccugcccuugcugcgccggcuggcccgccgacugagcucccaagacaugagagaggcucugcugagcugucugcucuuuguccucagccagcaacagccaccggauucuggagaggccuccagaguggaccacucccagaggaaggagagauugggcccccagaagugaggccacggguccuggaaacagcaacgcccaucaaaguacuuuuggagccgguuaguccaggcgucgguccgcacgcacgggcauggacggcagacugcccagugggcgaagacaguccgggcugagugcaagagggcucugaccugaacaguucccacuccccuagcuccuagcaggcuacagauuguguugauugacccuuccucucugcagcucccucugccuuaucucuggccuccaggguggaccugcaaaugcggguaucaaggucaguuaagagaugauguuucacuuagacucaagacaauuuagcuaagaggugguauuuaaauccaaacugucccgucuaccuuaaaauuauaagcccuugcuucccguuaaagaaugaguacuuucaaagcuugguacgcagcagguagucaauaaacgaggacaguguguuguuau

SEQ ID NO: 8630 - RNA, 26740 nt, Mus musculus
gcaaacucacagcuuuuguuuuuauuuuaaaugaaaacaaaaacaaaaacaaaaaaccaacaaacccagugcaaaaaccccauuuuccagugucagccaugccccccuccccccggggucaaccccuggcucgggccugacucuucccccacacugugcaccccucccuucuccugcaucccagagggcugcagguuccaagucccuggaggcccagauccaggggcagugaaggggaggaaagagacugggugacaacuccugaucuugcuuuccccaggccuccagccaugguuccagguacccaccuuggcucucauuaacccuuuccuggccacacuacuggguggugaggcugaucuggggguauucccuccacaccccucuuugccccggggccugcucggggcuguccucacugagguugggggggcucccucucucccuccauggugggagagaguggugaaauccccagguuuaaauaccuuaaugaaagcaggggaugggguaggaggagggggcuuuaguucuaauaaauuauuagcguuuuuuuuuuuuaguguccgugaggguggggggaggggcagggcguggccuccagggccccucccuccccuuacuggugaaucucauucucuaugaggcuguccucgcaugacuggaagucuguguccgugaggccaucaggaggcaucagcaacuccucgucuugggaggaggacgaugggggcucaucgccugagcucccaggagccccaucuccguccccgucccccucugaguccugcagcaccugagcgauguauuucugaagggaaaggaauagggguaaggugacuagcuguccauuauggguggguaggugggagcagguaggaccugccagcaauguagugggcagugccccaggguaggaguaguucuggcauucacugccgugagaucaggaacaggcuggcuuuuguggaggacuacugggauugagucugcaggucaaagccuucccacugcccuccccccugacccuaggcuguguaguaagacacucaccgcagauuuggggacagcgccagcaguggggggccguccauuacuucuggagcucacggcaucugucucuguguguucaaucuuaagggguccauggugaggggaggaaauauuccuguuuuuagccccgaucgugccccaacacccucgccccaccuuggaccuguaugucacccccacagaaaacguucgcucucggccguacuccaccacuuuucuccugccccauaccuuguaguugugggcacugagguauuugaaguguccaaagcagacguggcagagacagaugacgauggugauuaccagaacaacgaaggugaacauagacgugggggcuaggaaaccugggguagggagggacaaagcgguuaucgccuccuccaccacggggcucccgccgccuccuccaaggggcucacuaccucugacuccuucaucccacccacacaaccucacugagacccuuggcauucucuaccaugaggcucuucugucccugacacuggucccaggcgggaugguggcccucacccgugcgcaugguggagaagaagagcaaccagaagaggcagaggaugggcgcagccaccaccugguucacagcccccgaguggaucuucuuguccaguuuggccggcaaguaggcguaguagagauuguaccugucuaccaggugcuucagcagcauguacaugagcccuggggaaagccaacggcccugaccucggaaccagcgcccacagcccuugcguguggaccacaggcuguaccuggccuugagauggcugaagggcuggucccugcucccuguccugccggaacugaaagcugcagcuucucccaugucagucccuucaccccggcagccuccccuucgucuccccuucccccaugacgaccaccagagagccauuuauuuagaugaacaagaagccuuugaaacccaucuuacuuuuuuucuaccccuguuccuaaauaguuggguguaaacuaaagggcagguucuacuccccaaagccaagggggccuuaaacaagggcaaggagguuaguuuaagagucuggagccuucaacagccacagaggguggguagggagucaggaugcuacugggggaagguagaggcucuacugagggaucauggucgacgagaaacuuagcugaacaccuucuaaguggaagagagaccugcccaaguuacauggcuugccugcauugggacauguccgagaccuaccuagcccacucuggaauccaagggguuuucuugaauuuugaaaucuguguacaaguguggauuuuggguacuggacuguguguauaugugccuaauaacucagagggagauauguucauguauacccgaagaaaggccucaauaccaggaaauauugcugagguggguggccugaccagagaccaggcaugucaggugggccaaaccuugauaggacugcucuccccuucucccccaaggccuggcccuagacugagccaggaaccaggcgggaggcccgaggggccggucucccagccggggcccuguccaaucaggguggccugccuuacuagaguggagcggguuaggcccuggguucccccgagcagggcccaggucccggcgcggcggugccuaccgaagggcacgaugauggggcaggugauacuguaggucaugaccaccgugaagacgcacaucauccaagcguaggcugcgccaaacuggaacucguaggccugaugcugggggggacaugggcaggaggguggcucaggguggaggggacagguugcagggaugcagggcaggcaggagguggccaggaacucuagggcuggggauggagccaucgggagugagggaccuaauguggggguagugcggggacagcaaagcaggugggaggagggggcuguggcugaaagggaggccaggcagggcagugaugggacaugggcaggugggggcaaaaguugagugaacuaggggacagguucuccagcgcccucuuguggaaugagggcagaaggacccuagaucaagggagcuacaucucucccaacuccaaguacauaacacuaugcucucagaacucaaggaccucuuaaucaccuauguccacccaucgcuauauaugugggaaagcugaggcuucagaugggaacuaaugucccuaagucccaguauccuuaugcccaccacccgagccugacuguugcuguuucugguuaggccaccagagggcgcugugcguguugccgcugcccuaggcggccauacccgcuucacguugcgucuuucagcggcggagcgcgccaggcagagccggaucauguacaugaguaggccugggaugcgcagcagguccauggcguuaccgauaaaggcugaggcaaugacguaguucacgaagaaagcgccguugucgggcaggaacacacaccuaagggcagcaggugcuccagcacugcacccuuggggugaccugguggcugucugcccacugcuagcaugacagcaccccaugcucuuacccucugugaccuccucuacauguacacacccagcuuagacggcccccccaaauacccgugcccuagucuuuccacaguaugaaccccagaauaucaaaauaauaaagccagcccagagaccuaccuagagauggcaugcccugaaaaaacgaguucaaggccacaaaaggccaccagcaugugcagcaaauaauugcugagagcugagacuuccacagaaaauuucaauggcacucucaagagaucuccagggauguaagccccaacaaacuggguaaguuuuccgacucucugguuuucccacaauagagagagccucagacuccuuccugaucagcuuuagagaccgucucagguaucuuuggugggugcgugcgugcgugcgugcgugcgugcgugcgugcgugcgugugugaguguguguguguguguacaagaaccagcgagucccuaaguccaagaugauuauagacaacuccaucaacucaagccccuggagcuugagcguguaagagccacgguaugccucccuccaagcuagucccucaucugcugcauuaacaucuugagcugucaaucuaagaucucaguagauaaagguaaggguucuagugacccucagggaugcucugggaguccccaagucacccccagauaaugaccaaguccccacuacaaacaccuccccuauuuccuuggggaaauucaagacuccuacagcagaccuagaauaagggcccgagucucucagaacccccacaugugagcucugaagacuuaaaucuaccuucagcacgcgcucaggggcacuccugaucaagaaccccagcccauuucauccucguccaugcccaacaccccgggcugucuuuuggauaacccaggagacucgugacguuaaccccaccccuuacagccggaagcuuggugccauccacccuuguuauuuuccuuuuuccccaaguguccuccuggucacucacucaaaccgaauagcugcuucagccaggaauuucuugucaaagagccagcggaagaagaggucuaggcugcaggaagaaggaugggagccggcauggggcagggcaccucuggggaagcccgggacagguccguagcucucuuccaccccggcuccccuucuguccugaugcucaccugcucagccccagcgagggcagaagcagcaccaugaagaugagaaagguguagcacuugugcauggucguccuguucuccccggagcuaggagggcagaacagaggcagaggucacagcaggccagcccacccggggacagaggcuccucugggugcuggaggcuucuauaggggaggggaccgggcccagggcagggaaccuucagaacgaagggacacgguggguggagugugggcagcucaccgcguccagugugcuucgaagaaggcggaguaguagacaaugguggggagcagggccgagaagcaccacagcaguagcguagggaagaacugggugaugaucggguucuguggggagacaggaagugccaagcacugagggacggacgggugggcgggucuaaaaguucccaacacuuggagggcugggugggggccgaagcuagggcugugggaacgacaacuucuggguguaugauguugauggugagcgucugcugcacaccuacugugugccaagcacuugugcguguucuacauacuaaaccucgugaccauggaacuggcucauuuucccaauccgucgaccgaggaagcagagacuggaugguuuggccagcuagagggcaguggggauuugguuugggcugaggucugcaucuuuacuucugagugcagauuucgaagaaguauacucugaucugagcacggcaggagggcagaggaggccaagcggcaggcaugggugcacccuacugccaucugggcggccuggagaccagaggcucugaacguacacacgaacggcaaggggccaguuuaaaccuuccauuuuuaaaagaaaugagaaaaaggagcuuacccaagguuuugcacccuccuggugugugugugucugugugugugugugugucuaggacauguaaacccaagggcggccuuuccugaggacaggacauggcggguugggauagcagcccuugaccuuagaaagcauccuggaagcaccuggagcacccagagcuauguuagggaugagggggaugcgcauggcacaucauggagagcugggggggggggggggaggcgggcaugggccucacguugagguacuccacaggcuuggugacguugaacuuguccaugguggugaugaugauggccgggguggugaggaagaagagcagaaugaagaggaccacauugaugaccaggcagcgcagccaccagaugaagccucggauggagagguguucccugggaaagugggggaggggucacuuugaagacucuggacugacuggccucuggcagcauccacccucuccccacgcuccuggaaacagccacacccucagucuguaagaagccccgccccaacucuguggcucaccaauagauguucugagggucaggggcguaggucacgguccaguuggagauaugcagugcuucgcugcaggaggaggcucucggcuccccgcggcagguacagcccuggcauuugcacacguugaaguccuuuaggaugcuggggggaacagguacuuguuacuucagcccagacugggguccacaguggugaguacagggcccugugagagggagagggccgaggguggcgggcaggauggggguggggcggggugcucacauggcugugauggucucauuguggaaggugacaaaggccaugcccagagguuucucguucacuuucuccuucucccgccuguagucuuccuucagccucugcuccagcuuuguguaguacucaauggccuccaccugcagacggcagggcggggugggguucugcucagagccgggaggcacccacagcagcagccaggaucagcccaugcuccucgaagcuuuuucugcguaugagucacucuguccuuguucuaaccucacaaggugggcacaacggggaagccaagaacaggguagcuagugaacuuauuaaaaaugaaggggcccgagagauggcucagugguuaagagcacuggcugcucuuccagaggugcagaguucaauucccagcaaccagauggugguucacaaccaucuguaaugggauccaauaugugucugaagacagcugcaguauacucauacacauaaaaugaguaaauuaauccuuuuuaaaauaaagcagaguaugacccugaacuucugacccucccgccugagccuccugaguacugggauuacagacaugcgccauggcugaucaaacccauggccuuguacaugcuaagccagcacugaaagacauccucagcccccugccaugcucgccuuaucgaugguuucaaaaguuaucacaaacaggacaaacggaacagugaggacaggggcuucaaggacaagauggcucagugaguaaaaggagcuugccaccaagccuggugaccagaguuugagcuacagaacucacauggugaagcaaacuggcuaucacaagcucuucucugacuuccacacaggccccaugguacaccuuccccacauaaacagaaauaacuauuuaaagaaagauuugagguuuuauggacgccagaggcaguuggaggcuugcugggguagggccccugucuucuuucucugggagucucuuuaccuguggguuuuacuaucuaccacauuuguuuguccugggguagggguugugacuacccuggggcauccaugucuacugaggccugccuagaccucccagcuuugccagggacuccagccaccuggcagccggcccacacgguaccugcucgcagccucgaaccacacagcagcagaggugaccacacgguuugggguugaucauggcggguacauuuuccuugcuuugcagguucguaaaguagaguuuuccccgcucagccuucuuccugugggauggggagugaggggggggggagguccaccgcuuagcaucuggggcuggcuaggggguggggaagggaaccaagcuuggggugggggugggggaggggcacaacacagagaacccaaagcugcuuagacuguggggucacaaagugggauugcauagcugaaugugagggcuaugaaaaacaucagaccacggucagaugcuucugaaggugcaacaaccaaggauuaauucaaaaugaacacauggugaauccgagguguuucuggccgagcuugccuguauuacagcaaaaaacuccauggcagccuugguucagaacacgcaaccugcacagcucguguggccucugccaccaagccagcgacuguugccagaaacaugcuggcucagggucaggaccaugcuaaugccuugcagugauuuugucauacauacaaagcuuuuggcucuugccgaaaaugaugguuuaauuauggaaaacaaagaguuaagaagaauuaggauuucccuauugucguuucucuuugguaagagugugcccuucaucuuuugcgugcgcguguucacguaugcgugcaaaugucuaugcacguguguguguauacauggaaacaagguuggcgugggauguguuccuugauuguccuacaaguuagauuuuguuugcuugguuuuguuucauuuuugaaacagggucuuucugcacaggcuguccuggaacucacaauguaaaucagagccaccugccaccgccucucagugggucaccgugucacugcaucuuaguuuuugaggcaaggucucucggugaaucuggagcucauaaauccggccaggccaagcgugucucggggacugccugccucugccccagcacaccaggguucuagguguacauggagacugccauguacaggagagguagggaccccaacacagguccuuccucuugugugacaaauguugcagucacugacccauuuuucccagccaggucuuuucauuaaauaauaaauauuaagaugauaugaggggggcuggagagaugacucagcgguuaagagcacugacugcuugcucuuccagagguccugaguucaaaucccagcacccacaugguggcucacaaccaucuguaauggaaucugauacccucuucugugugucugaagacagcuacaguguacucauauacauagauaaaucuuuuuaaaaaaagauuauaugaagacuaaggaauguuuaaaaaaugaguguuugugcacgcacauguacacacacuugaggagaccagaggauaagccgggucuaauccucguucuggucgcccaccuccucugagguagugucucucgucuguguuucaccaacacuaugguuacaaguuugugcuaugacacacgacauuuuuacaugggugcuggagaauaaccucaaggcaaggccaacucagccagcccgacagccccaggaaguuuuaaauuuuucuuucuuuuuuucugagggaugggggugagacaguguagccuuggcugcccuggaacucaaucuguaacccaggcuggcuucggacucagagaucagcuugccucugccuccugagugcugggaccaaaggugucugccaccacccggcuaaaagaaaucuuaugauuuauucucauuaauguucggccuguauucccauuuaugugccuaugggccugaggucauguaaaauuuucucagaugggaagggcuggggagugaacaaggcuugcuuuagcuccguccccaagagcaggggccguacguuagugcuuguuuagcccauaguuccauccaagggucuccuugcccauuuccagagagccaauaauucuuauagucugccauaaaugucuuauauuguagcugaagagaauuagguccuuaaccaggacaggacuguagacccuucccucuuguaacauacacuaagcuccaggccuuggaagcaaccaaggaaggucuaguuauagucaaaaugcccccaaaaccauaugaaaggggagccccauuccugcaaggaggccaagaucccuccaugaugaacagaggacccgggguggcgcccuccccaugcccaacccgguaccucucagcaucaaggaacauaagucgagccacguuguaacagggccgggcuuccagaacugugcaguugggguaggccucccugaaacacaggcagcugucacgcccugcagggccccauccacgcgccuacccucaacuuccacccagggcgcuggcgcuucagccuucccggcucacccgagucucggccuacagugcuccgaaagaacggaacucugaaguccuuacgcugugaauggggaugaggugugccugaagccugugugaaggcagcaggcgaugaggaccuagggugugugaggauacugcuguguggcacuggggacaccaaggcuguggucugauucuuguccgggggcguacacuugaggcucacagaaacuguuucuaguuacaggcugcuuccuuugcccuguuucuggaagaccuggucccgauccaacacuuggccuugacuuuggauuuacuccaaccaaucuuggcccgagaccaacaagaaacucguccugaaucugaccucuaucccgggccaugaccccaggcccagggcugaccuucaccccaacccagaaagauggacugguagggcuugcugcccugccucacuggcacguggcucuggagagcauucacaguccgcuugcugauccacccaguaaugcccuuuccagcugugcugauccuuuccuuaaucuugaccgcaccgcguuuccuccaucuuuuugauguccuauuaagauuuaaugaagggccaccaaguguuagagacgugugucauaaaguuccucaauagcaagaugaacgucacaaaugucacaaaugccaugagaguuuggaaagucgaagcuggcacagggucccugaaagugaacuuccaggcggccacagcuccauccuucacagcucuuugagcuuccucuuugggguggaggugggggugggcaagcucucacccuugugggacuaaggacaaauccuuuaaagcuaacucucugucuucuggggcaguccccaaaccuggaccacgagccccagugagcgcugauguuugcucaguguggacagggucgcugcuaauccucacaguuaugggagucgucgauaccagcccgcccgcaguaagugcucagcacaguuggcugcacggacaguuggaagacugacugacuucauuacgcucucacccuacucaaagccccagagucuaacgaagaccagauccucucgacaccugcuuuuagagugagugugaguucuccuaaacaguuagaacuaacccugaagcacucagccagggcacuucacucuggucuggcuuuuugcuucccacaacacacaguaagcacuucacagaguugaccaggaggggucacccccuccgcugugcugaguucuccguucaaaugugagggucccuuucauacaucccccuccuucgcucaggauggcaccuuagcacccccccccccccaaaucugacuccuaggacuaaugaaaggaaauuuucugguuuuguuuacugcuguauacugagcccucgcccagggcaggucacuagaggucugcaucaggacaugucaguggaagcugauaacuguucaacuggacaaaaugucacccugagcauacacuaguccccaucucgaccuagugugcccuuaagcugauguaagcuugaacucccaaucauucucucauccuguuuuguuagcuguaucagggcagggcuugcuucuaaaauaccuaugccuggauacagaagaugcucaauauauaugugucacaggcauaaggacccacccaucaguaguuagcuccagaucccuguaacacagcccuggaaugugaccuggauacugccucugauccugcugagacauuacugccgaugggaugacaaacugaucugcuccaggacaaugacugaagucugauuugggccaauagcagcagaccuggacuucucaagaauaaaccugggacuggagggauggcuaggguuuaagaccuuccagagguccuuccagaggaccagaguugauccccaacacccacagagccaggggaucugucucccucuccuggcuuccauagguaccacaucuacaugguacacaggcauacagagucaaaauacccauacacauaaaaugaaaauaagucaguaaaaggaaaagaaagaguaagcccagaauccaccugaccccugagcagucaguaauguccccugucauggcuacuggcugacuccuaaccugggucauggauuugacuggucccuugucauggccacugacugguuccuaaucugcgucacagacugacuuggcccaaucucaguugagccugcugaccagcuccuacaguugaucucuaugugugacccuugagcacgggugaguuucauucaucuuuggcuaugguaacugacgagaguuuggcaauaagugaaucaaaguaucaagggccucuaauucugugugcagaccaucccucuaagucucgacagcaggccccuaacuuuuuaaaaccguuuuuguuuuuugagacacggucucucugucacccuggcuacccuggcccucucuuauagaccaggcuggccuugaacucacggagcuccaccugccuuugacucccaagugucaggacugaaggugugagccaccacaccuggcagcucuugacucucucccccaugggcucagcaccaaggugccuguccgggauccagauaccugaacugcagagccagagaaguugaggaacaaaaccaaccuccucagacuccuuuagaugucaccagagcccacgagcuuucccacaacuucuguauaugcaccaaguaaagugcuacugcuaauuuugaggaagcugccaccucaggacccugggcuaaccacccaugacccaguccaagccagagguguaaacaaugccacaggcuguacucuucaggagucccuccuaguccucucauuugcuaacuuacaugggcuguaccccaagugacucuccaguucuccaaggggcuaguuaucacucagugacagugggagaccagccuggcucgccaugugaggucuuccuugaucugcuccccucagcccgugccccggacugcugaguacuaguccaggggugcaaagaucuucuuggggcugagggacaggccaggcucugcgggccugagguggggcgggcugcuuacucacucgaaauguuucuugauuuuuuccgacucugcauauuuggagauuccauugaugaaaagaguccgcuugaccugggaaagagggaagcaggcuuaucugccugugggugggcuccaggugagccagaggauacagggagaggucagggagugggagcaggccuuaggucucagcgggaguguuuguaauagaagacuaaagaagaagggccaugagguaguucuucuaugagggggggugucucggggccaccccugagugugugggugacacuuagaaccuugaggaccuaacacagugacuagcauuugguccaggcuggguaaacggcgauagaagcugagggaauauuucugccauccucaucaaguaaggcgacaacacggccaucugacacuauucccagccauagccacuccccagggccaagcacagcaugggaaggcauugccugcccggguccucuggagaggcacccuuaccccgugcguaggagggaacccagguagcccaacucuccaguggccacccugagggcugaucgggaagccaagacaggcugcacuuccuuaccagaucaucuuccuuguagcgcaucuuagaggugugucuccucaugcuguagacggugagcagcagguagaggaaggcgaaggagguauguagccagagcagguuauuccuguggggagcgugcacaagacacacgugucacugcgucagcgggcucuaccucugcuggguccauccgucucuguggccucccaucgcuugcuucuacccuagaucccaccccacugcagagcugcccggucucacccugauuucaaguuggcaauggugguucucccaaagcuguaggcauuguucucuggagggcgggaagaagggggauggugguggggucagaagggacgcccucugcccccuucuacuccagccaccuggcccucacugaccuagcagguccccugagaaguugacaggcagcacaaugccuacagagaggacgcccacgacaaccagcaacccaaugaugugucuuuggaaggacagguagugcacagcgucgcccccacacuugucccggaucucaucgucccugcaggucacggaaggcagacagaagaugucgguuaagagucacagaggaaaggcuggaaucggccugucccaccccccagccacccuagccaccccugcugauggggugguaaugguguugagacagaacuucccaucccaauuuccugggagggagggagggagggagggaggggaaaagaaggggaagaaaaugaggaagaagaggaggaagagugagaggaacaggaggaggagggagagaaggggaaaggaagagggagggaggaaagggagagaggaaggggaagagggguagggaagaaggggaggagcaggaaaagaaggaggaggagggggaagagggagaggaggaggagggggaggagggggugaagggggaggaggagaaggaagcuacggagcuugagaguagcagcaaaaagaagagcaagagaaaaaagagaaagcaagguugggacuggagacaaaaagagaggaagauggaagacagaaauggguggggcuaggagaagggauguuacgggaggaggaaggaugcuaugggaggagguugggauguggguagcagcagcuccuucuaaggccuuaaggcuaccagggcugagcucccguggucacaggcccagagcgugguuaggggcccagugcugaccugucccagcuuccugccuuucucagugcgcucacugccugccuguggacucuggcuggaucuccugaauucugccugcuggcugcuggcugcuggcuccugccugcggcugucuagcuccuuccagccagccugcugcccucacccgcuggcugcagagaggcugacgugggggcuccgaccccugcucucaaucaagcuguggccagggcugguagaccagggaauggcugaccuugugcagggugucacagaggagacgguggguuggaauaagcauacgggggaaggggguguucagcggaggcugggcccccacugccugaccucuugcaguagggugcaggguacugcaauggcuaggagcccuaaggcccucaaagcugcugggcuucuuuuuagagggaggugacaggugcugagguuucuguuucuuucucuuuagagcgcgcagaccauucacuuacuuuauccugaagauggcugucagccaggaacagaagcccuggggaaacagaggggccacaacuggagaucccagccuaccaacccgaccccccccccuagcuccaccuaucagguucucagaguuaucuccagccuaugaucacauggacacagccccuacacccacccuugcaccugaagaaaaaccccaugaucaccacagaugugucugggagagccucugccuagagcgagacccugguuucuaucucuagcacugaaaaaaaugaaaguauaugaguggggaugagggggguggcucaguuaguaaagugcucgucuugcaagcaaaaggaccuggguucaauccccgguucuuacagaaaaaaagcaggguguggugguacacacucccagaccaggggaggcauagagagagaucucugggguucauuggacagacagguuagccuauuaggaagcucuaggucccaguuaaaaaaacccugucucagaagaaccaagcgagccugucaagauggcuccuaaagguccucacugccgagccugauagcuggagcuugaucucuggaaucuaaggcgguagaaggagagaacugacuuccccaagccgucuucuguccuccauauacagagcuuaguguguacaugagugugucuaugcauuaugguggguaaacaaacacaaaacaaacaaacaagcaaacagaccaagguugauacugcccgaggaacaauagucaaaggugacuacuguccucccguguaccugcauacaugugcacgcacacaugcacacacacacauacacucacgcacaugcacacacacaugcaugcacgcacacacaaucuggagaugcagauaacuauaaaacucugggguuccaugggccagcuggggaugggguucaaggaaggcacugagaucuccuaauuucuagcuaauaagaagaguuugcaggcugccaggcuggcucagaagguacaggugcuugccgcaaaaccuggcaaccugugaucaauccuagggacccaugugguggaaggagagagucaguuucugagaguaguccucugaccuucacacauaaaauauacacauuuccacauacauauaugcuaaacuuauacaaauaaauuaacuaaauacaagaaaaagcagggcugauaagauggaucacucagcaaagucaaaggugcuugcugcuaagguugacgacuugauccuguaaguugucuucugaucucacacaugugcugcuguguuauccuccugcuucucauauaugggugagugggagcgcacacacacgugcacacacacacacacacacucaugcacacacauaauguaaaaaucuacaaaaauaaauaaucaaggcuaacaaaaacagaggggugugcuauggugucuacgcucuucacucugucuccuaguccacuuuggagggaccaaacucaagggucccugggcugcaggucucucccuguccuccucucaguccugucugcagguggguggaugcuuagaaagagggcccacacuacuuucuaccaagagaagguccaggaugggagagugugccuuccggccaagacgcaauacuggcuaucugagcuccauucaagucugggggccaucagacaccucugucuggcagggguaccuugucacguacucugggagucucagaaagcuaacaggcaucucugcuaaggcugcuucaggagccccagcccaaauggggcugaccagggccaccccagagugugaggauuagcauucugccugggaccaagcaggaaacuucugugcaccugaucugauggaacgaggucuggggacugcugugguccaucaggucugaagggaugcucagucagcauuaacccccagcaaggcagcauaucccugugugcauggacaccagccugcaagcucuguguaacauggcggugucugagucuuacugcauagacccucaaggcuuauuauaauuucuaaaaccacauucaaagaaaaggagagcuuuaauaaauggugucuagguuuuauugcacagaccuuugaggcucauuauaguuucuuuuuuuuuuuuuuuuaaagauuuauuuauucauuauauguaaguacacuguagcugucuucggacacuccagaagagggcgucagaucucguuacagaugguugugagccaccaugugguugcugggauuugaacuccagaccuuuggaagagcagucgggugcucuuacccacugagccaucucaccagccccucauuauaguuucuaaagccauguucaaaaaaaaaaggagcuuuaaucaauagcagacaugggcaucaaacucugcuguggcggacaaaguuuggaauggacaaauguuagaagcucccggccugugccacaggagcucuaggccugcugguguccccugaaccuuagcaugucacucccuaugcugagaaguccauacuagugucccugaccuuaaggcugugaacccaaggaaaucgaaagaaggacacucacauugucccuuuggucaaagucgacagagcuggagacggaggugagacgcucauaccggucgugacuguccccaugcauagcugaugccacacugggggguggggagacagagcagaggcaggugagagggggcaugugggccucagagggccagcuaugaacacccagaggggcuaaagaaggcacagaaagcgcagaggcugaagcaagagugaucucccccuacccacgccucucucgaacacgccugcuuuagggaucacugcugagugggccuuaauugagagggugucuucaucacugcccagaauagagguggaagcaagauguuagaggucccugcaguuccaaagaugaccagcagggggaguggggggugggcaacagaaacuguuuuacccccaaagcaaaagggaaaagaaggagggggugggggacggaccagaagaacccauagggguggcaagacuggaagaugucucucgggcaggacccuccccuccauugccccaagccauuagcugucacggcuccaacuccaguccuauagacagagaccacaaggagucaaaaaggccacaaaugggggggcucuuugggcaaggcccagcccaggccuccagacggagcaaggaagccugaaauaugaagaacuagcuguuaggggcugggaagcuguuggugacacccgaucuugucucugcaucacugugcuggggacugucuagggaguucccagagggcgguuccucgccccugccagugaaggcuaagcaugcagggguacacacauuggggauuuucuuaggcagggagccuaagaggaggaacugaaccaggaucgggcagagacaaguugaggugcccccugcucugcaaagcaccaccaccugcguuaaucugaugcaugagccugcagaggagagaacugcaaaagagaacccagcaacuggcgugaagagaagagagaagcgugaaaaaagaagaaaaaaggaaagcagguuuaguguggaugagggggcugaugccccacauacuauuccuguuccacucgcucccucuccugccggcgaagccuggggacagagaacagaaaggguuaggugcagcagaugagaggcccugggggaccagugugggacagaggcccaacuaaagguccucacaccaucccguguuggcccagggucuacuagucccuguccaucccccaacagaggggacggaggaaggcuggcgucucccaaaggcaacguggagugugauguuugugugccgagcagagggagacaggcucgggcucuuucuuaccugucugcaucugucaccaaggccagccgcccguagucccaggccaccuuccggagaauagagaauaagaacagcagggccuaagggcagagguggagacaaguggaacagcugucuacagcaaggggucagaaccuuaacuuaaauggaagcacccuggcuuggagaaagggacaggaguuggaaagcagcaaucccguuuucuugguugggucugggagagagguggaggauaucugcaggggauauccugggcccgggugucaagggugggggacaguacaaggucacucacaagaaagcacaugaaguccagagccagcacgguggggacgcccccgaagggcaggcccugcaggacagugcugcggauccgggcacuguagcaguaguccuucggguugcugcuguugagggccgcggugcccaguguggccagcaagaacggcagcauggcugcuacugccgcaugauccuccugggcaaaggguaagucagucagcugggcucauccccuacccacccuggccuggcaagguagguacagggaggguugaccagcugccucaguggguggcauugcucaugagaaauaggagccuagagacacaugagugugucacauggauuuacaucacggcccucuggcuaugacucuacccuagguuagggcagcacacccugacccuaaccccagcaucaccccuaucuuagagagaaucucuuuuaagcccgagaaaugaggagggguggacacugaagagaggauucagcgguuaagagcgcugccauucuucuagaggucuuggguuggguuccuagcacccacauggaggcucacggccaucauaauuucaguuccaggggauacaaugccuucuucugaucucugcaggcaccaggcaugcauguggugcacacacguacguauguauguauguaugcagacaaaacacucauacauauaaagcaaugggaauagauuuuaaaaugauggguagagaccugucucuaugccagagaauaagaguccagagccaacauugugaucuucucagaagaagcccuaaauucaaucucugugacuauaauaaaugaaagaagaauuaaagggggggggguuacgucucugccuuuuggcuaaguucaagugaaaaauaugaagagagaaccagaaugaucaaaugcgcuuagaguuuuuaauucuguuaaccuccuccacauaaccaccuucuaaacagauguucagcaucaggcugcuccuguguccucggagcagagcacugcgcuggaaggcagguaaacuaaccaaaugucagagucugugucaccacgcuggcccuugccauaccugcuucucuccaucacauuuccagcccagcucuccucccuucucuccaacuagcuguauagggggaaaacagagggguguaaggacuacaacucccagaaugccgugcuucugucaacggagcagagcaggcugggaaugcugugcccuccagccagcuuuuccauuggcaaaagagagggaagagugggcgaggccucuaaaggcccccagcaaccacuguacuacugucuugcccggugccugccuggugcccugccacagccuuugugcccugaguggaugaagggcaggagaggaggcaaggggaagccaguuggagcccugggcucuggaagggcuuggggacaaagcugagcagggcucuggggagguucccaggcugaagaaguguggcugcagcagagacagcuaccacagcagcacaucuccccccggcccuacucuggggccccugggggccccuucugcugacaacauggacagucugccugggguagggccccuagggaagaaaggcaaccagacaaagagagagaacaacaaaucuagaagagauaacuagcagguuggaagcaacugucugucccuuagccccuuagggugaccuagcaccucugggguccccuccucccauucaaacauccaaucacucagggcaggagccaggagcgcgcugugaggacgugagcauuguuuaucuguuucucuugguccaaaggagucuuugcaaagccugcuucagagcagagcagagaauaacucccugcauguguuauacaggcuccuuuuucuggcccaaagcugccuuuaaaaacacaugaguugagccgggcagugguggcgcgugccuuuaaucccagcacuugggaggcagaggcaggcggauuucugaguucaagaccagccuggucuacaaagugaguuccaggacagccagggcuacacagagaaacccugucucaaaaaaaccaaaaaaaaaaacaaaaaacaacaacaacaacaacaaaaaacccacaaaccaacaaaccacaugaguuuaaucacugaagcaaguacuaguuaucuaguguccauuguuuuaagaugacagcacuggcuucucuugaagacaaggauucaauucccagugcccacagggcagcuaacaacugugaacuccagcuccagaacugacacccucuucuggccucugcugguauugcacccacaugguacacagacacgcacaggcagaacacuacuacacauaaaauaaauacuaaaucuuuuaaaacaaaagaauagcauacaugaccacauuuaauccucaaacauccugucauuugaagaugugaguacugggcccagaaaggcuaaguacuuucccacaaggucucacugccaauaaaaugauagaagcuggaauucaaaccuaagucaacuucuaccuaagcugggacccuucucugaacacaaaggcacuuugcugauaggccuagaacaggugaagguguagccuggccucacucuuccaaucuguaacaaagaaacaccaggauggcucucccagagagguaacaaaguauccacaguggggggagggggcacugucucugucucucaccaaggucucuuuauguagccuaggcugaucuccgacuuaccauccucugcauauauggauguuucauaaauaaaaugcuuauuauuuguucuugggccaugaauacaagagcaguccagugcugacauauguucagauuuguaaauauggucauaugugggucuugucugcacaggaugcuagauuacuacaugauagugugcagaacuaaagggacuuguggccucugaauggaggagugugugugugugugucugucugucugucugucugugucuugguguauaaauuaagacacacagaugcugaggcuccaggacugauuaauauagguguuuuagggagggagaccccaacuagcccuucuccccucccccugcccccaccuuuuuuuuuuuaauucuuugagacaaggucucauauauugcagacuggcuuuacucuuguuaugaagcuguggaugaccuuaaauuucugucucuacuucccaagugcuggaaauccaaccuagggcuucacguaugcuaagcauguuaucaaccaugcuauaucuccaguccugacuucucugaacuccaggaacuucagugccuauucccaccccuuguccaaacuccuucgaugacauccuccuguucccaucuucccuacucugaaggaagaugggacacucugggagcuucuacaagauguggcucuguuacugugggugagaguuccccaggaucgaacacacagauccuccccugcacccaaggugagcaaggcacacccagaucacccauccacaggaaggaaacagggaccugagaagggaguggagccaggcaaggucacgggguagguaagagguggaguugggcugguggcuuugcugguugacuucgaugacuucaaguucuuuaacuguaggggugggguugcuggguugugucauucagggcagcugcuuucaaauccagccuagcacuggggagccgaaggauagaaguagcaggugaagguucucccaaccuagacauacccagccagcugugaucccauuucucuauuuggauaaugaaguuuguauuguauagggauggggggcgaauuuuagcuuaaccaaaucaagguugucauuucacuaauaaaaacuguguuauagguuagaaguuauuuuuuguuuguuuguuuguuuuccuuguagaguuuagggcuucuuuagguucuuacaaagccagugaauaagaaauuaacucuuaguaugccauccgggcaucgguccuccaaucuauaacaaauaccaaagguuuugcuuggcuuugguggaacucagagaaaggcaaagguauaucauuguauccauagguggcucccucccccaucuuuuuaggauuuagcgauauagccuccuaggcuugauuccaagucaagacacaaauaaguguuccaccacaccugccugucuugcuuuuauucuguccccggcauuacuccauuaagcaccuugcaaauguugcuauuugccaccccucacaaccccaacaggccacugacacacagagaaggcaaauaacuuggggaaggucacacagcagucugugacagauccagagaugggcggaggcauuucgcugcuccugccaauagggcuccuccacuagcaggcucggagggcugucagcaccagcucugaggaacgccaugcccuaaaucuacagguuugccuuucgucuugcauggagcugauuccuaacucaagugugggguuuguggguucaaguucuaaggcaggggaagaggaccaagagaccuaagaugaagcacacuuggcuuuuauucuggacaggguacuuaaccagcucagggucuucaccuauaaaauagagacaacucaacccugcggcugcuugaaagauuuaauaaaauuaaaaacaaaacaaaacaacacaacacaaaccgccaaaacucuauuucacagcgcuuaaaacaagcaagcgagcaaacaaacaaacacaaaccaccauaagaaaggcccagcuguugaaggcaagcaugcaccuggaagaaggaggcaggaagauuaggaguucaaggccaauugggcuaaaugacaucccaaucucaaacaacauaaaacacaaaaaccgcuguuauuaauaagguauagaccccaagagguugcuuuaguggaggaaggcuggcuaagaccaaaauaaagcaugaaaggaauagaaccccucaguggaggaggagggggagcucccucaauauuagggacucugucaccaagucccagaauauacccccauccaccugcaguagguggggugggacuccagaggaaacugauaggucaggaaguucagagaugugaacccauuauaaucgaucaacugucaggcagagugccaggcuauuuaccugcauuaaacuauuggaucccaaagaugcgccucggaaggaggugguaguaacuaaucacacuuuuagauagacacggagguucagauagguuaaguaacuugccaaggucgcacagcucaaagaacagcggagcugggauuugaaccggguuuucuguuacucugcuguacuuggaaggaauuuguaccgaugccaaaaagggguucuucgcgacuuaucacccaucuucugccucaaaacauccccacccaccuacucgcucacucccuggccaagacuucaacagcaggccccagcaugugcuaccugguacaugccaggacguagacccucugguacccgggaggacaaaggugcuggcagcauacccaccaccugagccuggcagccacuccccuuccccuucucucuuauaucuggaaggcagagggcugugguccccucuucaggaggcguuggguacaaucucauucacccgacuacugcagaccgggaggagguucagggucagggagugguacucgguagagagcagagccccaagccccucugagcaaccggccgccagacuuccgaucaggggaccaaggcggguggcagcacaaagcuccaagggcagccagccccucugaccucucuuccccacuucccgggcauccuugcuuuuucugagcaacacaacgacaagcuuugggacaguccgcaccaggcggucaagacggccgggagggacaaagcgcgcccccucccccucaauagggccuuugccuacuccggauucgcgucugaaucuucuccccaccgcacccuccaacgcaggcccgggcggcucaugaaugaacugcucuguguggggcgcaggagaggacaugcuccccgggccggccgcccucuccagcccgcagaucaguccccaccaggguuggggcagcuacucgucuggugcuaacaccucgagcccugcccuuugcccaagcaugaaccccuugcuugaggccggcuucguccccagcaacaagaaaaagaauuaaaaaaaaaaaaaaagagagagaccgagggcauuggacuuggcgacccuagaaugcaaaacucgggggcggaggcgggugguucccuucagcggcgccggcggcuggggagcagcugggaccggaggagggccgcgcaggggccgcacaccuggacggagcagguggaacuagaguggcacucgagggccgggacgcaggggucccacgccuuggaauauuccugaggggcggggguagaggacggcgcacaucuggagccccgacaggggugggaggacucacaucuggcagggacggugcggguuuggggacaaagcgugccuccguugggucccguggggcccgggcaccucugggucccgcaggagguggaagggaggggacgcgcagcugaguccgggugcuuuuuuuuuccuuccuuggggugguggugagauccuaugagccaaguaaggggugcuggggagggguccgcguacucaccccuaggcgcagacucggcuccgacucgggagccccggcuccgggcggggcggggcuggggagggggagggggagucgccgggcggcuagagcucugggcuccugcggcggccgcggcagcgcgugggggagggggagcagaaggagggagggagggccggggaggggcucccgcaggacccgcccccacgccgcacacguagaaagugcgcgcgcacucacggagaaccccuggcgcgcaggcgcagcgugcggggcggggccuugccaagcggggguccguggcgggagauucccaggcuguuaacgcgguacggugggggcucaggggaacaccucgcaccccucgcgcugcuuuucccgguuucuucucugcaauaagggaggcgcugucggggaggggugaggacaggccuuacuggaaacccagugucaagugagaagggugcucacucuucgcgaggccucagaucuggacccucucgcugccuuuuugccaaaggcuucgggguccgcgccucccacgcgcccccgaugcgcccaccugcuuauccaguucgggauguagagccucggggaaugggggcugagaucuugccuggguuaaguggcuaggccgguugcuuugacgcgucucccgcaguuuuaucugcuucucucucuugcugggccuggagaugaguuugcuagaaacuucugugguguaaagagggagucuuugcuuuugcuucugucaggcugaaugacuccuuuugcaccggggauucccuguauucucaguucaccaaagacc

SEQ ID NO: 8631 - RNA, 26740 nt, Mus musculus
ggucuuuggugaacugagaauacagggaauccccggugcaaaaggagucauucagccugacagaagcaaaagcaaagacucccucuuuacaccacagaaguuucuagcaaacucaucuccaggcccagcaagagagagaagcagauaaaacugcgggagacgcgucaaagcaaccggccuagccacuuaacccaggcaagaucucagcccccauuccccgaggcucuacaucccgaacuggauaagcaggugggcgcaucgggggcgcgugggaggcgcggaccccgaagccuuuggcaaaaaggcagcgagaggguccagaucugaggccucgcgaagagugagcacccuucucacuugacacuggguuuccaguaaggccuguccucaccccuccccgacagcgccucccuuauugcagagaagaaaccgggaaaagcagcgcgaggggugcgagguguuccccugagcccccaccguaccgcguuaacagccugggaaucucccgccacggacccccgcuuggcaaggccccgccccgcacgcugcgccugcgcgccagggguucuccgugagugcgcgcgcacuuucuacgugugcggcgugggggcggguccugcgggagccccuccccggcccucccucccuccuucugcucccccucccccacgcgcugccgcggccgccgcaggagcccagagcucuagccgcccggcgacucccccucccccuccccagccccgccccgcccggagccggggcucccgagucggagccgagucugcgccuaggggugaguacgcggaccccuccccagcaccccuuacuuggcucauaggaucucaccaccaccccaaggaaggaaaaaaaaagcacccggacucagcugcgcguccccucccuuccaccuccugcgggacccagaggugcccgggccccacgggacccaacggaggcacgcuuuguccccaaacccgcaccgucccugccagaugugaguccucccaccccugucggggcuccagaugugcgccguccucuacccccgccccucaggaauauuccaaggcgugggaccccugcgucccggcccucgagugccacucuaguuccaccugcuccguccaggugugcggccccugcgcggcccuccuccggucccagcugcuccccagccgccggcgccgcugaagggaaccacccgccuccgcccccgaguuuugcauucuagggucgccaaguccaaugcccucggucucucucuuuuuuuuuuuuuuuaauucuuuuucuuguugcuggggacgaagccggccucaagcaagggguucaugcuugggcaaagggcagggcucgagguguuagcaccagacgaguagcugccccaacccugguggggacugaucugcgggcuggagagggcggccggcccggggagcauguccucuccugcgccccacacagagcaguucauucaugagccgcccgggccugcguuggagggugcgguggggagaagauucagacgcgaauccggaguaggcaaaggcccuauugagggggagggggcgcgcuuugucccucccggccgucuugaccgccuggugcggacugucccaaagcuugucguuguguugcucagaaaaagcaaggaugcccgggaaguggggaagagaggucagaggggcuggcugcccuuggagcuuugugcugccacccgccuugguccccugaucggaagucuggcggccgguugcucagaggggcuuggggcucugcucucuaccgaguaccacucccugacccugaaccuccucccggucugcaguagucgggugaaugagauuguacccaacgccuccugaagaggggaccacagcccucugccuuccagauauaagagagaaggggaaggggaguggcugccaggcucaggugguggguaugcugccagcaccuuuguccucccggguaccagagggucuacguccuggcauguaccagguagcacaugcuggggccugcuguugaagucuuggccagggagugagcgaguagguggguggggauguuuugaggcagaagaugggugauaagucgcgaagaaccccuuuuuggcaucgguacaaauuccuuccaaguacagcagaguaacagaaaacccgguucaaaucccagcuccgcuguucuuugagcugugcgaccuuggcaaguuacuuaaccuaucugaaccuccgugucuaucuaaaagugugauuaguuacuaccaccuccuuccgaggcgcaucuuugggauccaauaguuuaaugcagguaaauagccuggcacucugccugacaguugaucgauuauaauggguucacaucucugaacuuccugaccuaucaguuuccucuggagucccaccccaccuacugcagguggauggggguauauucugggacuuggugacagagucccuaauauugagggagcucccccuccuccuccacugagggguucuauuccuuucaugcuuuauuuuggucuuagccagccuuccuccacuaaagcaaccucuuggggucuauaccuuauuaauaacagcgguuuuuguguuuuauguuguuugagauugggaugucauuuagcccaauuggccuugaacuccuaaucuuccugccuccuucuuccaggugcaugcuugccuucaacagcugggccuuucuuauggugguuuguguuuguuuguuugcucgcuugcuuguuuuaagcgcugugaaauagaguuuuggcgguuuguguuguguuguuuuguuuuguuuuuaauuuuauuaaaucuuucaagcagccgcaggguugaguugucucuauuuuauaggugaagacccugagcugguuaaguacccuguccagaauaaaagccaagugugcuucaucuuaggucucuugguccucuuccccugccuuagaacuugaacccacaaaccccacacuugaguuaggaaucagcuccaugcaagacgaaaggcaaaccuguagauuuagggcauggcguuccucagagcuggugcugacagcccuccgagccugcuaguggaggagcccuauuggcaggagcagcgaaaugccuccgcccaucucuggaucugucacagacugcugugugaccuuccccaaguuauuugccuucucugugugucaguggccuguugggguugugagggguggcaaauagcaacauuugcaaggugcuuaauggaguaaugccggggacagaauaaaagcaagacaggcaggugugguggaacacuuauuugugucuugacuuggaaucaagccuaggaggcuauaucgcuaaauccuaaaaagaugggggagggagccaccuauggauacaaugauauaccuuugccuuucucugaguuccaccaaagccaagcaaaaccuuugguauuuguuauagauuggaggaccgaugcccggauggcauacuaagaguuaauuucuuauucacuggcuuuguaagaaccuaaagaagcccuaaacucuacaaggaaaacaaacaaacaaacaaaaaauaacuucuaaccuauaacacaguuuuuauuagugaaaugacaaccuugauuugguuaagcuaaaauucgccccccaucccuauacaauacaaacuucauuauccaaauagagaaaugggaucacagcuggcuggguaugucuagguugggagaaccuucaccugcuacuucuauccuucggcuccccagugcuaggcuggauuugaaagcagcugcccugaaugacacaacccagcaaccccaccccuacaguuaaagaacuugaagucaucgaagucaaccagcaaagccaccagcccaacuccaccucuuaccuaccccgugaccuugccuggcuccacucccuucucaggucccuguuuccuuccuguggaugggugaucugggugugccuugcucaccuugggugcaggggaggaucuguguguucgauccuggggaacucucacccacaguaacagagccacaucuuguagaagcucccagagugucccaucuuccuucagaguagggaagaugggaacaggaggaugucaucgaaggaguuuggacaaggggugggaauaggcacugaaguuccuggaguucagagaagucaggacuggagauauagcaugguugauaacaugcuuagcauacgugaagcccuagguuggauuuccagcacuugggaaguagagacagaaauuuaaggucauccacagcuucauaacaagaguaaagccagucugcaauauaugagaccuugucucaaagaauuaaaaaaaaaaaggugggggcagggggaggggagaagggcuaguuggggucucccucccuaaaacaccuauauuaaucaguccuggagccucagcaucugugugucuuaauuuauacaccaagacacagacagacagacagacagacacacacacacacacuccuccauucagaggccacaagucccuuuaguucugcacacuaucauguaguaaucuagcauccugugcagacaagacccacauaugaccauauuuacaaaucugaacauaugucagcacuggacugcucuuguauucauggcccaagaacaaauaauaagcauuuuauuuaugaaacauccauauaugcagaggaugguaagucggagaucagccuaggcuacauaaagagaccuuggugagagacagagacagugcccccuccccccacuguggauacuuuguuaccucucugggagagccauccugguguuucuuuguuacagauuggaagagugaggccaggcuacaccuucaccuguucuaggccuaucagcaaagugccuuuguguucagagaagggucccagcuuagguagaaguugacuuagguuugaauuccagcuucuaucauuuuauuggcagugagaccuugugggaaaguacuuagccuuucugggcccaguacucacaucuucaaaugacaggauguuugaggauuaaauguggucauguaugcuauucuuuuguuuuaaaagauuuaguauuuauuuuauguguaguaguguucugccugugcgugucuguguaccaugugggugcaauaccagcagaggccagaagagggugucaguucuggagcuggaguucacaguuguuagcugcccugugggcacugggaauugaauccuugucuucaagagaagccagugcugucaucuuaaaacaauggacacuagauaacuaguacuugcuucagugauuaaacucaugugguuuguugguuuguggguuuuuuguuguuguuguuguuguuuuuuguuuuuuuuuuugguuuuuuugagacaggguuucucuguguagcccuggcuguccuggaacucacuuuguagaccaggcuggucuugaacucagaaauccgccugccucugccucccaagugcugggauuaaaggcacgcgccaccacugcccggcucaacucauguguuuuuaaaggcagcuuugggccagaaaaaggagccuguauaacacaugcagggaguuauucucugcucugcucugaagcaggcuuugcaaagacuccuuuggaccaagagaaacagauaaacaaugcucacguccucacagcgcgcuccuggcuccugcccugagugauuggauguuugaaugggaggaggggaccccagaggugcuaggucacccuaaggggcuaagggacagacaguugcuuccaaccugcuaguuaucucuucuagauuuguuguucucucucuuugucugguugccuuucuucccuaggggcccuaccccaggcagacuguccauguugucagcagaaggggcccccaggggccccagaguagggccggggggagaugugcugcugugguagcugucucugcugcagccacacuucuucagccugggaaccuccccagagcccugcucagcuuuguccccaagcccuuccagagcccagggcuccaacuggcuuccccuugccuccucuccugcccuucauccacucagggcacaaaggcuguggcagggcaccaggcaggcaccgggcaagacaguaguacagugguugcugggggccuuuagaggccucgcccacucuucccucucuuuugccaauggaaaagcuggcuggagggcacagcauucccagccugcucugcuccguugacagaagcacggcauucugggaguuguaguccuuacaccccucuguuuucccccuauacagcuaguuggagagaagggaggagagcugggcuggaaaugugauggagagaagcagguauggcaagggccagcguggugacacagacucugacauuugguuaguuuaccugccuuccagcgcagugcucugcuccgaggacacaggagcagccugaugcugaacaucuguuuagaaggugguuauguggaggagguuaacagaauuaaaaacucuaagcgcauuugaucauucugguucucucuucauauuuuucacuugaacuuagccaaaaggcagagacguaaccccccccccuuuaauucuucuuucauuuauuauagucacagagauugaauuuagggcuucuucugagaagaucacaauguuggcucuggacucuuauucucuggcauagagacaggucucuacccaucauuuuaaaaucuauucccauugcuuuauauguaugaguguuuugucugcauacauacauacauacguacgugugugcaccacaugcaugccuggugccugcagagaucagaagaaggcauuguauccccuggaacugaaauuaugauggccgugagccuccaugugggugcuaggaacccaacccaagaccucuagaagaauggcagcgcucuuaaccgcugaauccucucuucaguguccaccccuccucauuucucgggcuuaaaagagauucucucuaagauaggggugaugcugggguuagggucagggugugcugcccuaaccuaggguagagucauagccagagggccgugauguaaauccaugugacacacucaugugucucuaggcuccuauuucucaugagcaaugccacccacugaggcagcuggucaacccucccuguaccuaccuugccaggccaggguggguaggggaugagcccagcugacugacuuacccuuugcccaggaggaucaugcggcaguagcagccaugcugccguucuugcuggccacacugggcaccgcggcccucaacagcagcaacccgaaggacuacugcuacagugcccggauccgcagcacuguccugcagggccugcccuucgggggcguccccaccgugcuggcucuggacuucaugugcuuucuugugagugaccuuguacugucccccacccuugacacccgggcccaggauauccccugcagauauccuccaccucucucccagacccaaccaagaaaacgggauugcugcuuuccaacuccugucccuuucuccaagccagggugcuuccauuuaaguuaagguucugaccccuugcuguagacagcuguuccacuugucuccaccucugcccuuaggcccugcuguucuuauucucuauucuccggaagguggccugggacuacgggcggcuggccuuggugacagaugcagacagguaagaaagagcccgagccugucucccucugcucggcacacaaacaucacacuccacguugccuuugggagacgccagccuuccuccguccccucuguugggggauggacagggacuaguagacccugggccaacacgggauggugugaggaccuuuaguugggccucugucccacacuggucccccagggccucucaucugcugcaccuaacccuuucuguucucuguccccaggcuucgccggcaggagagggagcgaguggaacaggaauaguauguggggcaucagcccccucauccacacuaaaccugcuuuccuuuuuucuucuuuuuucacgcuucucucuucucuucacgccaguugcuggguucucuuuugcaguucucuccucugcaggcucaugcaucagauuaacgcaggugguggugcuuugcagagcagggggcaccucaacuugucucugcccgauccugguucaguuccuccucuuaggcucccugccuaagaaaauccccaauguguguaccccugcaugcuuagccuucacuggcaggggcgaggaaccgcccucugggaacucccuagacaguccccagcacagugaugcagagacaagaucgggugucaccaacagcuucccagccccuaacagcuaguucuucauauuucaggcuuccuugcuccgucuggaggccugggcugggccuugcccaaagagcccccccauuuguggccuuuuugacuccuuguggucucugucuauaggacuggaguuggagccgugacagcuaauggcuuggggcaauggaggggaggguccugcccgagagacaucuuccagucuugccaccccuauggguucuucugguccgucccccacccccuccuucuuuucccuuuugcuuuggggguaaaacaguuucuguugcccaccccccacucccccugcuggucaucuuuggaacugcagggaccucuaacaucuugcuuccaccucuauucugggcagugaugaagacacccucucaauuaaggcccacucagcagugaucccuaaagcaggcguguucgagagaggcguggguagggggagaucacucuugcuucagccucugcgcuuucugugccuucuuuagccccucuggguguucauagcuggcccucugaggcccacaugcccccucucaccugccucugcucugucuccccaccccccaguguggcaucagcuaugcauggggacagucacgaccgguaugagcgucucaccuccgucuccagcucugucgacuuugaccaaagggacaaugugaguguccuucuuucgauuuccuuggguucacagccuuaaggucagggacacuaguauggacuucucagcauagggagugacaugcuaagguucaggggacaccagcaggccuagagcuccuguggcacaggccgggagcuucuaacauuuguccauuccaaacuuuguccgccacagcagaguuugaugcccaugucugcuauugauuaaagcuccuuuuuuuuuugaacauggcuuuagaaacuauaaugaggggcuggugagauggcucaguggguaagagcacccgacugcucuuccaaaggucuggaguucaaaucccagcaaccacaugguggcucacaaccaucuguaacgagaucugacgcccucuucuggaguguccgaagacagcuacaguguacuuacauauaaugaauaaauaaaucuuuaaaaaaaaaaaaaaaagaaacuauaaugagccucaaaggucugugcaauaaaaccuagacaccauuuauuaaagcucuccuuuucuuugaaugugguuuuagaaauuauaauaagccuugagggucuaugcaguaagacucagacaccgccauguuacacagagcuugcaggcugguguccaugcacacagggauaugcugccuugcuggggguuaaugcugacugagcaucccuucagaccugauggaccacagcaguccccagaccucguuccaucagaucaggugcacagaaguuuccugcuuggucccaggcagaaugcuaauccucacacucugggguggcccuggucagccccauuugggcuggggcuccugaagcagccuuagcagagaugccuguuagcuuucugagacucccagaguacgugacaagguaccccugccagacagaggugucugauggcccccagacuugaauggagcucagauagccaguauugcgucuuggccggaaggcacacucucccauccuggaccuucucuugguagaaaguagugugggcccucuuucuaagcauccacccaccugcagacaggacugagaggaggacagggagagaccugcagcccagggacccuugaguuuggucccuccaaaguggacuaggagacagagugaagagcguagacaccauagcacaccccucuguuuuuguuagccuugauuauuuauuuuuguagauuuuuacauuaugugugugcaugagugugugugugugugugugcacgugugugugcgcucccacucacccauauaugagaagcaggaggauaacacagcagcacaugugugagaucagaagacaacuuacaggaucaagucgucaaccuuagcagcaagcaccuuugacuuugcugagugauccaucuuaucagcccugcuuuuucuuguauuuaguuaauuuauuuguauaaguuuagcauauauguauguggaaauguguauauuuuaugugugaaggucagaggacuacucucagaaacugacucucuccuuccaccacaugggucccuaggauugaucacagguugccagguuuugcggcaagcaccuguaccuucugagccagccuggcagccugcaaacucuucuuauuagcuagaaauuaggagaucucagugccuuccuugaaccccauccccagcuggcccauggaaccccagaguuuuauaguuaucugcaucuccagauugugugugcgugcaugcaugugugugugcaugugcgugaguguaugugugugugugcaugugugcgugcacauguaugcagguacacgggaggacaguagucaccuuugacuauuguuccucgggcaguaucaaccuuggucuguuugcuuguuuguuuguuuuguguuuguuuacccaccauaaugcauagacacacucauguacacacuaagcucuguauauggaggacagaagacggcuuggggaagucaguucucuccuucuaccgccuuagauuccagagaucaagcuccagcuaucaggcucggcagugaggaccuuuaggagccaucuugacaggcucgcuugguucuucugagacaggguuuuuuuaacugggaccuagagcuuccuaauaggcuaaccugucuguccaaugaaccccagagaucucucucuaugccuccccuggucugggaguguguaccaccacacccugcuuuuuuucuguaagaaccggggauugaacccagguccuuuugcuugcaagacgagcacuuuacuaacugagccaccccccucauccccacucauauacuuucauuuuuuucagugcuagagauagaaaccagggucucgcucuaggcagaggcucucccagacacaucuguggugaucaugggguuuuucuucaggugcaaggguggguguaggggcuguguccaugugaucauaggcuggagauaacucugagaaccugauagguggagcuaggggggggggucggguugguaggcugggaucuccaguuguggccccucuguuuccccagggcuucuguuccuggcugacagccaucuucaggauaaaguaagugaauggucugcgcgcucuaaagagaaagaaacagaaaccucagcaccugucaccucccucuaaaaagaagcccagcagcuuugagggccuuagggcuccuagccauugcaguacccugcacccuacugcaagaggucaggcagugggggcccagccuccgcugaacacccccuucccccguaugcuuauuccaacccaccgucuccucugugacacccugcacaaggucagccauucccuggucuaccagcccuggccacagcuugauugagagcaggggucggagcccccacgucagccucucugcagccagcgggugagggcagcaggcuggcuggaaggagcuagacagccgcaggcaggagccagcagccagcagccagcaggcagaauucaggagauccagccagaguccacaggcaggcagugagcgcacugagaaaggcaggaagcugggacaggucagcacugggccccuaaccacgcucugggccugugaccacgggagcucagcccugguagccuuaaggccuuagaaggagcugcugcuacccacaucccaaccuccucccauagcauccuuccuccucccguaacaucccuucuccuagccccacccauuucugucuuccaucuuccucucuuuuugucuccagucccaaccuugcuuucucuuuuuucucuugcucuucuuuuugcugcuacucucaagcuccguagcuuccuucuccuccucccccuucacccccuccucccccuccuccuccucucccucuucccccuccuccuccuucuuuuccugcuccuccccuucuucccuaccccucuuccccuuccucucucccuuuccucccucccucuuccuuuccccuucucucccuccuccuccuguuccucucacucuuccuccucuucuuccucauuuucuuccccuucuuuuccccucccucccucccucccucccucccaggaaauugggaugggaaguucugucucaacaccauuaccaccccaucagcagggguggcuaggguggcuggggggugggacaggccgauuccagccuuuccucugugacucuuaaccgacaucuucugucugccuuccgugaccugcagggacgaugagauccgggacaagugugggggcgacgcugugcacuaccuguccuuccaaagacacaucauuggguugcugguugucgugggcguccucucuguaggcauugugcugccugucaacuucucaggggaccugcuaggucagugagggccagguggcuggaguagaagggggcagagggcgucccuucugaccccaccaccaucccccuucuucccgcccuccagagaacaaugccuacagcuuugggagaaccaccauugccaacuugaaaucagggugagaccgggcagcucugcaguggggugggaucuaggguagaagcaagcgaugggaggccacagagacggauggacccagcagagguagagcccgcugacgcagugacacgugugucuugugcacgcuccccacaggaauaaccugcucuggcuacauaccuccuucgccuuccucuaccugcugcucaccgucuacagcaugaggagacacaccucuaagaugcgcuacaaggaagaugaucugguaaggaagugcagccugucuuggcuucccgaucagcccucaggguggccacuggagaguugggcuaccuggguucccuccuacgcacgggguaagggugccucuccagaggacccgggcaggcaaugccuucccaugcugugcuuggcccuggggaguggcuauggcugggaauagugucagauggccguguugucgccuuacuugaugaggauggcagaaauauucccucagcuucuaucgccguuuacccagccuggaccaaaugcuagucacuguguuagguccucaagguucuaagugucacccacacacucagggguggccccgagacacccccccucauagaagaacuaccucauggcccuucuucuuuagucuucuauuacaaacacucccgcugagaccuaaggccugcucccacucccugaccucucccuguauccucuggcucaccuggagcccacccacaggcagauaagccugcuucccucuuucccaggucaagcggacucuuuucaucaauggaaucuccaaauaugcagagucggaaaaaaucaagaaacauuucgagugaguaagcagcccgccccaccucaggcccgcagagccuggccugucccucagccccaagaagaucuuugcaccccuggacuaguacucagcaguccggggcacgggcugaggggagcagaucaaggaagaccucacauggcgagccaggcuggucucccacugucacugagugauaacuagccccuuggagaacuggagagucacuugggguacagcccauguaaguuagcaaaugagaggacuaggagggacuccugaagaguacagccuguggcauuguuuacaccucuggcuuggacugggucaugggugguuagcccaggguccugagguggcagcuuccucaaaauuagcaguagcacuuuacuuggugcauauacagaaguugugggaaagcucgugggcucuggugacaucuaaaggagucugaggagguugguuuuguuccucaacuucucuggcucugcaguucagguaucuggaucccggacaggcaccuuggugcugagcccaugggggagagagucaagagcugccaggugugguggcucacaccuucaguccugacacuugggagucaaaggcagguggagcuccgugaguucaaggccagccuggucuauaagagagggccaggguagccagggugacagagagaccgugucucaaaaaacaaaaacgguuuuaaaaaguuaggggccugcugucgagacuuagagggauggucugcacacagaauuagaggcccuugauacuuugauucacuuauugccaaacucucgucaguuaccauagccaaagaugaaugaaacucacccgugcucaagggucacacauagagaucaacuguaggagcuggucagcaggcucaacugagauugggccaagucagucugugacgcagauuaggaaccagucaguggccaugacaagggaccagucaaauccaugacccagguuaggagucagccaguagccaugacaggggacauuacugacugcucaggggucagguggauucugggcuuacucuuucuuuuccuuuuacugacuuauuuucauuuuauguguauggguauuuugacucuguaugccuguguaccauguagaugugguaccuauggaagccaggagagggagacagauccccuggcucuguggguguuggggaucaacucugguccucuggaaggaccucuggaaggucuuaaacccuagccaucccuccagucccagguuuauucuugagaaguccaggucugcugcuauuggcccaaaucagacuucagucauuguccuggagcagaucaguuugucaucccaucggcaguaaugucucagcaggaucagaggcaguauccaggucacauuccagggcuguguuacagggaucuggagcuaacuacugauggguggguccuuaugccugugacacauauauauugagcaucuucuguauccaggcauagguauuuuagaagcaagcccugcccugauacagcuaacaaaacaggaugagagaaugauugggaguucaagcuuacaucagcuuaagggcacacuaggucgagauggggacuaguguaugcucagggugacauuuuguccaguugaacaguuaucagcuuccacugacauguccugaugcagaccucuagugaccugcccugggcgagggcucaguauacagcaguaaacaaaaccagaaaauuuccuuucauuaguccuaggagucagauuugggggggggggggugcuaaggugccauccugagcgaaggagggggauguaugaaagggacccucacauuugaacggagaacucagcacagcggagggggugaccccuccuggucaacucugugaagugcuuacuguguguugugggaagcaaaaagccagaccagagugaagugcccuggcugagugcuucaggguuaguucuaacuguuuaggagaacucacacucacucuaaaagcaggugucgagaggaucuggucuucguuagacucuggggcuuugaguagggugagagcguaaugaagucagucagucuuccaacuguccgugcagccaacugugcugagcacuuacugcgggcgggcugguaucgacgacucccauaacugugaggauuagcagcgacccuguccacacugagcaaacaucagcgcucacuggggcucgugguccagguuuggggacugccccagaagacagagaguuagcuuuaaaggauuuguccuuagucccacaagggugagagcuugcccacccccaccuccaccccaaagaggaagcucaaagagcugugaaggauggagcuguggccgccuggaaguucacuuucagggacccugugccagcuucgacuuuccaaacucucauggcauuugugacauuugugacguucaucuugcuauugaggaacuuuaugacacacgucucuaacacuugguggcccuucauuaaaucuuaauaggacaucaaaaagauggaggaaacgcggugcggucaagauuaaggaaaggaucagcacagcuggaaagggcauuacuggguggaucagcaagcggacugugaaugcucuccagagccacgugccagugaggcagggcagcaagcccuaccaguccaucuuucuggguuggggugaaggucagcccugggccuggggucauggcccgggauagaggucagauucaggacgaguuucuuguuggucucgggccaagauugguuggaguaaauccaaagucaaggccaaguguuggaucgggaccaggucuuccagaaacagggcaaaggaagcagccuguaacuagaaacaguuucugugagccucaaguguacgcccccggacaagaaucagaccacagccuugguguccccagugccacacagcaguauccucacacacccuagguccucaucgccugcugccuucacacaggcuucaggcacaccucauccccauucacagcguaaggacuucagaguuccguucuuucggagcacuguaggccgagacucgggugagccgggaaggcugaagcgccagcgcccuggguggaaguugaggguaggcgcguggauggggcccugcagggcgugacagcugccuguguuucagggaggccuaccccaacugcacaguucuggaagcccggcccuguuacaacguggcucgacuuauguuccuugaugcugagagguaccggguugggcauggggagggcgccaccccggguccucuguucaucauggagggaucuuggccuccuugcaggaauggggcuccccuuucauaugguuuugggggcauuuugacuauaacuagaccuuccuugguugcuuccaaggccuggagcuuaguguauguuacaagagggaagggucuacaguccuguccugguuaaggaccuaauucucuucagcuacaauauaagacauuuauggcagacuauaagaauuauuggcucucuggaaaugggcaaggagacccuuggauggaacuaugggcuaaacaagcacuaacguacggccccugcucuuggggacggagcuaaagcaagccuuguucacuccccagcccuucccaucugagaaaauuuuacaugaccucaggcccauaggcacauaaaugggaauacaggccgaacauuaaugagaauaaaucauaagauuucuuuuagccgggugguggcagacaccuuuggucccagcacucaggaggcagaggcaagcugaucucugaguccgaagccagccuggguuacagauugaguuccagggcagccaaggcuacacugucucacccccaucccucagaaaaaaagaaagaaaaauuuaaaacuuccuggggcugucgggcuggcugaguuggccuugccuugagguuauucuccagcacccauguaaaaaugucgugugucauagcacaaacuuguaaccauaguguuggugaaacacagacgagagacacuaccucagaggaggugggcgaccagaacgaggauuagacccggcuuauccucuggucuccucaaguguguguacaugugcgugcacaaacacucauuuuuuaaacauuccuuagucuucauauaaucuuuuuuuaaaaagauuuaucuauguauaugaguacacuguagcugucuucagacacacagaagaggguaucagauuccauuacagaugguugugagccaccaugugggugcugggauuugaacucaggaccucuggaagagcaagcagucagugcucuuaaccgcugagucaucucuccagccccccucauaucaucuuaauauuuauuauuuaaugaaaagaccuggcugggaaaaaugggucagugacugcaacauuugucacacaagaggaaggaccuguguuggggucccuaccucuccuguacauggcagucuccauguacaccuagaacccuggugugcuggggcagaggcaggcaguccccgagacacgcuuggccuggccggauuuaugagcuccagauucaccgagagaccuugccucaaaaacuaagaugcagugacacggugacccacugagaggcgguggcagguggcucugauuuacauugugaguuccaggacagccugugcagaaagacccuguuucaaaaaugaaacaaaaccaagcaaacaaaaucuaacuuguaggacaaucaaggaacacaucccacgccaaccuuguuuccauguauacacacacacgugcauagacauuugcacgcauacgugaacacgcgcacgcaaaagaugaagggcacacucuuaccaaagagaaacgacaauagggaaauccuaauucuucuuaacucuuuguuuuccauaauuaaaccaucauuuucggcaagagccaaaagcuuuguauguaugacaaaaucacugcaaggcauuagcaugguccugacccugagccagcauguuucuggcaacagucgcuggcuugguggcagaggccacacgagcugugcagguugcguguucugaaccaaggcugccauggaguuuuuugcuguaauacaggcaagcucggccagaaacaccucggauucaccauguguucauuuugaauuaauccuugguuguugcaccuucagaagcaucugaccguggucugauguuuuucauagcccucacauucagcuaugcaaucccacuuugugaccccacagucuaagcagcuuuggguucucuguguugugccccucccccacccccaccccaagcuugguucccuuccccacccccuagccagccccagaugcuaagcgguggaccuccccccccccucacuccccaucccacaggaagaaggcugagcggggaaaacucuacuuuacgaaccugcaaagcaaggaaaauguacccgccaugaucaaccccaaaccguguggucaccucugcugcugugugguucgaggcugcgagcagguaccgugugggccggcugccagguggcuggagucccuggcaaagcugggaggucuaggcaggccucaguagacauggaugccccaggguagucacaaccccuaccccaggacaaacaaaugugguagauaguaaaacccacagguaaagagacucccagagaaagaagacaggggcccuaccccagcaagccuccaacugccucuggcguccauaaaaccucaaaucuuucuuuaaauaguuauuucuguuuauguggggaagguguaccauggggccuguguggaagucagagaagagcuugugauagccaguuugcuucaccaugugaguucuguagcucaaacucuggucaccaggcuugguggcaagcuccuuuuacucacugagccaucuuguccuugaagccccuguccucacuguuccguuuguccuguuugugauaacuuuugaaaccaucgauaaggcgagcauggcagggggcugaggaugucuuucagugcuggcuuagcauguacaaggccauggguuugaucagccauggcgcaugucuguaaucccaguacucaggaggcucaggcgggagggucagaaguucagggucauacucugcuuuauuuuaaaaaggauuaauuuacucauuuuauguguaugaguauacugcagcugucuucagacacauauuggaucccauuacagaugguugugaaccaccaucugguugcugggaauugaacucugcaccucuggaagagcagccagugcucuuaaccacugagccaucucucgggccccuucauuuuuaauaaguucacuagcuacccuguucuuggcuuccccguugugcccaccuugugagguuagaacaaggacagagugacucauacgcagaaaaagcuucgaggagcaugggcugauccuggcugcugcugugggugccucccggcucugagcagaaccccaccccgcccugccgucugcagguggaggccauugaguacuacacaaagcuggagcagaggcugaaggaagacuacaggcgggagaaggagaaagugaacgagaaaccucugggcauggccuuugucaccuuccacaaugagaccaucacagccaugugagcaccccgccccacccccauccugcccgccacccucggcccucucccucucacagggcccuguacucaccacuguggaccccagucugggcugaaguaacaaguaccuguuccccccagcauccuaaaggacuucaacgugugcaaaugccagggcuguaccugccgcggggagccgagagccuccuccugcagcgaagcacugcauaucuccaacuggaccgugaccuacgccccugacccucagaacaucuauuggugagccacagaguuggggcggggcuucuuacagacugaggguguggcuguuuccaggagcguggggagaggguggaugcugccagaggccagucaguccagagucuucaaagugaccccucccccacuuucccagggaacaccucuccauccgaggcuucaucugguggcugcgcugccuggucaucaaugugguccucuucauucugcucuucuuccucaccaccccggccaucaucaucaccaccauggacaaguucaacgucaccaagccuguggaguaccucaacgugaggcccaugcccgccucccccccccccccccagcucuccaugaugugccaugcgcaucccccucaucccuaacauagcucugggugcuccaggugcuuccaggaugcuuucuaaggucaagggcugcuaucccaacccgccauguccuguccucaggaaaggccgcccuuggguuuacauguccuagacacacacacacacacagacacacacacaccaggagggugcaaaaccuuggguaagcuccuuuuucucauuucuuuuaaaaauggaagguuuaaacuggccccuugccguucguguguacguucagagccucuggucuccaggccgcccagauggcaguagggugcacccaugccugccgcuuggccuccucugcccuccugccgugcucagaucagaguauacuucuucgaaaucugcacucagaaguaaagaugcagaccucagcccaaaccaaauccccacugcccucuagcuggccaaaccauccagucucugcuuccucggucgacggauugggaaaaugagccaguuccauggucacgagguuuaguauguagaacacgcacaagugcuuggcacacaguaggugugcagcagacgcucaccaucaacaucauacacccagaaguugucguucccacagcccuagcuucggcccccacccagcccuccaaguguugggaacuuuuagacccgcccacccguccgucccucagugcuuggcacuuccugucuccccacagaacccgaucaucacccaguucuucccuacgcuacugcuguggugcuucucggcccugcuccccaccauugucuacuacuccgccuucuucgaagcacacuggacgcggugagcugcccacacuccacccaccgugucccuucguucugaagguucccugcccugggcccgguccccuccccuauagaagccuccagcacccagaggagccucuguccccgggugggcuggccugcugugaccucugccucuguucugcccuccuagcuccggggagaacaggacgaccaugcacaagugcuacaccuuucucaucuucauggugcugcuucugcccucgcuggggcugagcaggugagcaucaggacagaaggggagccgggguggaagagagcuacggaccugucccgggcuuccccagaggugcccugccccaugccggcucccauccuucuuccugcagccuagaccucuucuuccgcuggcucuuugacaagaaauuccuggcugaagcagcuauucgguuugagugagugaccaggaggacacuuggggaaaaaggaaaauaacaaggguggauggcaccaagcuuccggcuguaaggggugggguuaacgucacgagucuccuggguuauccaaaagacagcccgggguguugggcauggacgaggaugaaaugggcugggguucuugaucaggagugccccugagcgcgugcugaagguagauuuaagucuucagagcucacauguggggguucugagagacucgggcccuuauucuaggucugcuguaggagucuugaauuuccccaaggaaauaggggagguguuuguaguggggacuuggucauuaucugggggugacuuggggacucccagagcaucccugagggucacuagaacccuuaccuuuaucuacugagaucuuagauugacagcucaagauguuaaugcagcagaugagggacuagcuuggagggaggcauaccguggcucuuacacgcucaagcuccaggggcuugaguugauggaguugucuauaaucaucuuggacuuagggacucgcugguucuuguacacacacacacacacucacacacgcacgcacgcacgcacgcacgcacgcacgcacgcacgcacccaccaaagauaccugagacggucucuaaagcugaucaggaaggagucugaggcucucucuauugugggaaaaccagagagucggaaaacuuacccaguuuguuggggcuuacaucccuggagaucucuugagagugccauugaaauuuucuguggaagucucagcucucagcaauuauuugcugcacaugcugguggccuuuuguggccuugaacucguuuuuucagggcaugccaucucuagguaggucucugggcuggcuuuauuauuuugauauucugggguucauacuguggaaagacuagggcacggguauuugggggggccgucuaagcuggguguguacauguagaggaggucacagaggguaagagcauggggugcugucaugcuagcagugggcagacagccaccaggucaccccaagggugcagugcuggagcaccugcugcccuuagguguguguuccugcccgacaacggcgcuuucuucgugaacuacgucauugccucagccuuuaucgguaacgccauggaccugcugcgcaucccaggccuacucauguacaugauccggcucugccuggcgcgcuccgccgcugaaagacgcaacgugaagcggguauggccgccuagggcagcggcaacacgcacagcgcccucugguggccuaaccagaaacagcaacagucaggcucggguggugggcauaaggauacugggacuuagggacauuaguucccaucugaagccucagcuuucccacauauauagcgauggguggacauaggugauuaagagguccuugaguucugagagcauaguguuauguacuuggaguugggagagauguagcucccuugaucuaggguccuucugcccucauuccacaagagggcgcuggagaaccuguccccuaguucacucaacuuuugcccccaccugcccaugucccaucacugcccugccuggccucccuuucagccacagcccccuccucccaccugcuuugcuguccccgcacuacccccacauuaggucccucacucccgauggcuccauccccagcccuagaguuccuggccaccuccugccugcccugcaucccugcaaccuguccccuccacccugagccacccuccugcccaugucccccccagcaucaggccuacgaguuccaguuuggcgcagccuacgcuuggaugaugugcgucuucacgguggucaugaccuacaguaucaccugccccaucaucgugcccuucgguaggcaccgccgcgccgggaccugggcccugcucgggggaacccagggccuaacccgcuccacucuaguaaggcaggccacccugauuggacagggccccggcugggagaccggccccucgggccucccgccugguuccuggcucagucuagggccaggccuugggggagaaggggagagcaguccuaucaagguuuggcccaccugacaugccuggucucuggucaggccacccaccucagcaauauuuccugguauugaggccuuucuucggguauacaugaacauaucucccucugaguuauuaggcacauauacacacaguccaguacccaaaauccacacuuguacacagauuucaaaauucaagaaaaccccuuggauuccagagugggcuagguaggucucggacaugucccaaugcaggcaagccauguaacuugggcaggucucucuuccacuuagaagguguucagcuaaguuucucgucgaccaugaucccucaguagagccucuaccuucccccaguagcauccugacucccuacccacccucuguggcuguugaaggcuccagacucuuaaacuaaccuccuugcccuuguuuaaggcccccuuggcuuuggggaguagaaccugcccuuuaguuuacacccaacuauuuaggaacagggguagaaaaaaaguaagauggguuucaaaggcuucuuguucaucuaaauaaauggcucucugguggucgucaugggggaaggggagacgaaggggaggcugccggggugaagggacugacaugggagaagcugcagcuuucaguuccggcaggacagggagcagggaccagcccuucagccaucucaaggccagguacagccugugguccacacgcaagggcugugggcgcugguuccgaggucagggccguuggcuuuccccagggcucauguacaugcugcugaagcaccugguagacagguacaaucucuacuacgccuacuugccggccaaacuggacaagaagauccacucgggggcugugaaccaggugguggcugcgcccauccucugccucuucugguugcucuucuucuccaccaugcgcacgggugagggccaccaucccgccugggaccagugucagggacagaagagccucaugguagagaaugccaagggucucagugagguugugugggugggaugaaggagucagagguagugagccccuuggaggaggcggcgggagccccgugguggaggaggcgauaaccgcuuugucccucccuaccccagguuuccuagcccccacgucuauguucaccuucguuguucugguaaucaccaucgucaucugucucugccacgucugcuuuggacacuucaaauaccucagugcccacaacuacaagguauggggcaggagaaaagugguggaguacggccgagagcgaacguuuucugugggggugacauacagguccaagguggggcgaggguguuggggcacgaucggggcuaaaaacaggaauauuuccuccccucaccauggaccccuuaagauugaacacacagagacagaugccgugagcuccagaaguaauggacggccccccacugcuggcgcuguccccaaaucugcggugagugucuuacuacacagccuagggucaggggggagggcagugggaaggcuuugaccugcagacucaaucccaguaguccuccacaaaagccagccuguuccugaucucacggcagugaaugccagaacuacuccuacccuggggcacugcccacuacauugcuggcagguccuaccugcucccaccuacccacccauaauggacagcuagucaccuuaccccuauuccuuucccuucagaaauacaucgcucaggugcugcaggacucagagggggacggggacggagauggggcuccugggagcucaggcgaugagcccccaucguccuccucccaagacgaggaguugcugaugccuccugauggccucacggacacagacuuccagucaugcgaggacagccucauagagaaugagauucaccaguaaggggagggaggggcccuggaggccacgcccugccccuccccccacccucacggacacuaaaaaaaaaaaacgcuaauaauuuauuagaacuaaagcccccuccuccuaccccauccccugcuuucauuaagguauuuaaaccuggggauuucaccacucucucccaccauggagggagagagggagcccccccaaccucagugaggacagccccgagcaggccccggggcaaagagggguguggagggaauacccccagaucagccucaccacccaguaguguggccaggaaaggguuaaugagagccaagguggguaccuggaaccauggcuggaggccuggggaaagcaagaucaggaguugucacccagucucuuuccuccccuucacugccccuggaucugggccuccagggacuuggaaccugcagcccucugggaugcaggagaagggaggggugcacagugugggggaagagucaggcccgagccagggguugaccccggggggaggggggcauggcugacacuggaaaaugggguuuuugcacuggguuuguugguuuuuuguuuuuguuuuuguuuucauuuaaaauaaaaacaaaagcugugaguuugc

SEQ ID NO: 8632 - RNA, 1093 nt, Mus musculus
ccuugcauuccccuuugugauaccgacgagagggagagguaagcauggggggagggauaacuauuucugcuucugucuggggugggggcuauaacagcagggacaggagugcagaagcuucuagaucaugccccuauccaaagcagcugguguuuuggagccaggcagagcggcucugcagaagcugaccugauuugccuaagggccccgcaguuacagaaaugaccacuaggugucagccucagcucauacuugaagugaggcuaggccuccagguugcaaaccccccucuggagaguugguugccccacaguugcuuagguggggcagguaguugcugcgggaaggggucugaagugacacaccuuccugggacccggaugaccuggguaagaggcucgcuucagauuuuauguucaacaguuugcauucuccucugucucgggauguauacagauucugcugcacacagaggcaagacgacccaccccaaucccugcaagccagauccugugaagacagcagaccagccaguauccacagcagccccgugcaauaggcaugacuagcaagucccaugcuacaaugagaaaaccagugcucgcaccucuuacccacuuagaggaagacaggguccucugaagccagauucuuuuucucacaacagauggauuucuggaauauucuaggaugucaagcugaggcaggcuuccuguaagguuaggaguaguaugguugaugauauccaaaaugagcccaguagauggaagaggggucuugggggugccuggugucauacauaggcagguuguagacacagggugagugggagccauucccuguccaugucuuccucugagcaaucucccacuccacgcuucuguucccuucaucugugaagugucuacagguggacuuguuucgucuccauucugucccugacaccugcuccuuuccaggacagauacuaagauggacuggacaagccacccccauauaacaccacuucauguuuagaccagcgacuucucaagguguuuuugauuuuguguucuagcaauuaaaaaaaaaaaaacaaacaaagcugcguaua

SEQ ID NO: 8633 - RNA, 1093 nt, Mus musculus
uauacgcagcuuuguuuguuuuuuuuuuuuuaauugcuagaacacaaaaucaaaaacaccuugagaagucgcuggucuaaacaugaagugguguuauauggggguggcuuguccaguccaucuuaguaucuguccuggaaaggagcaggugucagggacagaauggagacgaaacaaguccaccuguagacacuucacagaugaagggaacagaagcguggagugggagauugcucagaggaagacauggacagggaauggcucccacucacccugugucuacaaccugccuauguaugacaccaggcacccccaagaccccucuuccaucuacugggcucauuuuggauaucaucaaccauacuacuccuaaccuuacaggaagccugccucagcuugacauccuagaauauuccagaaauccaucuguugugagaaaaagaaucuggcuucagaggacccugucuuccucuaaguggguaagaggugcgagcacugguuuucucauuguagcaugggacuugcuagucaugccuauugcacggggcugcuguggauacuggcuggucugcugucuucacaggaucuggcuugcagggauuggggugggucgucuugccucugugugcagcagaaucuguauacaucccgagacagaggagaaugcaaacuguugaacauaaaaucugaagcgagccucuuacccaggucauccgggucccaggaaggugugucacuucagaccccuucccgcagcaacuaccugccccaccuaagcaacuguggggcaaccaacucuccagagggggguuugcaaccuggaggccuagccucacuucaaguaugagcugaggcugacaccuaguggucauuucuguaacugcggggcccuuaggcaaaucaggucagcuucugcagagccgcucugccuggcuccaaaacaccagcugcuuuggauaggggcaugaucuagaagcuucugcacuccugucccugcuguuauagcccccaccccagacagaagcagaaauaguuaucccuccccccaugcuuaccucucccucucgucgguaucacaaaggggaaugcaagg

SEQ ID NO: 8634 - RNA, 1993 nt, Mus musculus
uaugcguuuuguuuuguuuuguguuuuagaucuaauuuucuucaugccacugucaaguccaaugacucaggacuagacaucaccauauuucccagccaggucuauaaaguuucaugauggggucuugaacaggugauaaacaaacuucuguaaaacaacccagcguacagccuccccuucggugagucagagagccuuguccaggcaggaaggggcccaagguccuuuuccuuagaggguggcuccuggaagcggggauuccuuuccuuucuugaaaucucucagcauguguggagcccaggggcaggaggcuguuuuuaauaaggguuccugggacagggcagcccuucuucccugggacauacagcugcugcagccuguggauuuuccaagcuucccauuggcugcucuggcauucauuaagaaggcugagggacaagagaggagguggggagugaagcagucaagccaucaagucccccacuccacccuuucuccuuggagguugcacauucuguuuaguaguuaggaagguugcugucagcuaugucagacuggccuuugaggaagccaugugguucuuuuucucuuuugggggggguggcuugagacuguuucucuguguagcccuggguguccuagaauucacuuuguagaucaggcuggccucgaacucagagaucugccugccucugccucuugagugcuggaaucagagucaugcaccaccacagcugaccuggcuuaagaauguaguauuaacuggguuuccuuccuuccuuccuuccuuccuuccuuccuuccuuccuuccuuccuuucucuucccuuuauuucuuucuucucccuuucucuuacuccuccuccccucccccucucuucuccuccuccuccuccucuucuucuucuucuucuucuucuucuucuucuucuucuucuucuucuucuuuucuucuucuguuuuuuuuaauucuccccugaggcugcuaguguagucuuagcaguuccuucuuagagcuaaccuaauuugguaacagcuuaagccuagaucuaaaagaguagggcuucucuccccucuuuaacauauuaacauuucucaagaggcaagauuaggugugugauuucucaauucaaaaaaaaaaaaaaaaaaagccaacccuaaccaggagcaggguuugaugucacaugccuuugauccuagggaggcagaggcagguggaucucugugagcuccaggcaagugagacccucuuaaaacaaacaaacaaaaccaaccaaccaucuugaucagauggagagccacugaaccucugagggcuggaaccaggagcacccuggugguaauucuagaaucuuguuccauugucuguguccuccucaagcagguaguucugccuuugggggcagagucagagcucugccaccagcccuguccaccucugcuguggcaccuccccacagacagcuggggcccuagagugaagcccccuucugagaaggggccacagaagcaaccuccgagaauaaauucuagcccguccacaggcuaugacucuccuuguaagacuucgagucccuucuaagugcccacugugcuggagaugcuuggcugggucucaggguugaggagcagguuuucccagguggcaaagugaguagagcguucucagggcagaauucacaucccagggcuggcagaaucucacaaggucucagacucacccaaugagaagcaggcgugcagagcugguucccuccugugcugaguauccaaguccugggaggugaugggcguggagggaaccacuaagccagucaccucuuccaggccggagagguguuuaugguucagccucuccugggagcacaggagcagagucgaguuuacaguugccuagaacucuauaaacacauccaaugaguaugugcgcaugugaguguccccucaucccuuaaccuucacauccugggcugagcugaccuugauuccacuca

SEQ ID NO: 8635 - RNA, 15387 nt, Mus musculus
cuuugagaucagaauucaauucuuuaauacaaaaugcuuuuuuuuuuaagauauaucuguauuucuuuguugcuguuuaaaaauaaauauguacuacggaauaucucggaaaacugcucuagagacaaagacgugauguuaauaucuuuuucccccacaauuauuacggauaaacaguagcaccaauaaauaaaugauaacaaauauuaaaauuaaaaaaggagagagauuuaguauguagaauucucuauuuuucuuguuuuguuuuuacauauaaaaaacagaauagcaaugucuauuuuaucagaaucacauauauacauaaacauauauauauauauauauauuuauauacaaacacaaguugccaaauauauauauaguauguaaauguauauugaaaccuuauuucaaaggaaugugugguggggacaagggagggcagagcugaguguuagcaaaauuaaauaucuucucaggacaagcuagugacugucaccgaucugggagagagagauuggaaacacagauuucauacacacacacacacacacacacacacacacacacacacacacacaaguacaaauaagagagagcgagagauacaucucauaaauaguugaaauuaaauauuaaccaagaauacugaaaaaaacccuacucuuuaauuaaauuaacuguuuuaauuucuaauuaaaaagggcuauuaaauaaguaccguauauaaaacacuuucucuuuucucugccuccgugaggggcuugcggguccugccccauugcucugugccuugggaagggaagaugaggaaggguaagccacucacacacacagccaagucuccuggggacagaauuagugguuucaauggucugaucacacaagguccuccugggcuguacccaggaggugggguaaggagaggacgaaggggucccaggaggaggggccauuaccaggccucuucuuccaccaccgugucuucucuugccgggacaccugugggaggccuccuaggccccucagaaguggaggagcgagcugaaggcuggccaggcucccgauucuuccaggcagugcccagaggggcggggugcuuuuguagacuaucauggggauccacaaagcaugccauguccugaggcuccccaaacuucugguuggaaccggcaucuuuaucucuuucucugucaucaucugucucucuguccucuugacucagggccaggaauggguuugucguguuucuggaagugagccaaugugcccccgugcccuggccuugcuugcuccccggcaggcaaaaggacuucggccucucucagaccacacugaagccuuucaucccauugucucccgugucggcauccgagugaggacauccuccucccaacacaaguccacagcagucaaacauauccagugaagacaccaauaacauuagcagaguuaauuuaaaaaaaagaauauauauauauuuuauauauaaaacauauauauuuauuuauauauauaauauauauauauguguguaugugggugggugugucuacaggaaucccagaaacaacccuaaucuuccgggcuuggcgauuuagcagcagauauaagaaaauggcgaauccagucccacgagggaccgugcuuggucaccugcccgggaaugcgucugccggagucucgcccuccggacccaaagugcuccucgaagagucuccucuuccuucaugucaggcuuucuggauuaaggacuguucugucaacggugacgaugauggcgugguggugacaugguuaaucggucuuuccggugagaggucugguucccgaaacccugagggaggcuccuuccugcagccuggcucaccgccuuggcuugucacaucuaugggaaauggcaaagagaggcaggggguuagggccacgggagccuggcagugaaggcaagcagccuccccaggccugggagcccacggguccccggagguuggcaccaugggagcagaguucccaaaggugcgggugagacagagucccgguggagagagagagagaccaagcccugccuucuaaagauggcaaaccauggaagacaagacagacaugggaauaaaugcucacaaaagcaacaaaggagugguuaccaaaggacagcccccaugugacacuccacggcacgugggugacagggugagauguacuuagcugggagagaagcucugcaggaggaucuucaguccuggcucuagggcuagguuucggggcuggaaaacuaccuugagcuaagccagugacagaggacugccugcuuuggggauguguucugcccaagggaggacucgggaguuccugaaaaguaggagaacaucuaugcuaccuagaccucucucauccucagcuucuaccuugaacugcccgguggcuacaccugccuuuuaccacacgaugaugucugacuuaggcagaggacagacaacccaguggcuuuguuccuccuguugaagcagaaggaaucuccaaagauguucuccucuugcuccugacccuggcugguggcccugaggacaggcuggaaacacggguccuaaccucgucuuggguucccagacacagggcaguagcggacugagucgggucucuggaagucaggugacuucauuuagcucccagcucacuccagaaacccuacaauaccaaggucuuuaucuuccuuaaaacccuccagugaacugagccccuucacccagcccuguuguugggaagagucccuacacagcacuaacagauacauuguucucauacagccucucagaaacaacuucauaccaaggaccacagagagagagagacccgccaggccucuggugucuuuugaacccacaggacacaagaaugcaggcggggaacaaggcccaugccagagaacccuugcacugccuggaaggaaggcuggcccuuuguuggccagcccguaaaagcuuucccucccucggugauggucauccuugggacaggccacaccgguauaaaccacccugggacugccagucaacagcccugugcucuugagcuccccaguggguguggccauauacaauauuuuacucgugagauugacacuuccuagguccacauggacaaaaaacaggaguacagauaccugggcaucccaacaguuuaugacccaggcuucagguacucauggagucccgucaggaagaauggaucugacucuuuuccugaaacucauuggaagcauuuugaaaugugugggcuggucaggguugucacacuugccuugacugaugagggauaagcuauguaguguccucggauguauguagaaaaaauuuccuagcccaaaccaacagcagaucccugccucuuucaggaagcccagucuaagguggacuccagucugaggugcacauggccuguccuuacagagcuccagucugagggagacagccugucuucaagaagccauaaucuuaagggaauagacaacaggagcuaagccuucaagcccagggaaaauauacugaguggugagaggcucagcugugcugguucuccgggggggcaaaggugcagccaggaaacacuauuagacaucacuccacgccuggaaggagguuuuaacacuugcaccaaugauagaauuaacaacaucaacaccaacagccuccauaagcagcaggaccacaggauacaacacacaacuugcguccacaccgucacauuaagucacagcagccuacccacucaagcaaccagggccaucucagagcaggccugcugggccagacuggagcccgaggccccacagagccccagcaggagagaagguagcagucaccacgcaggcagcuagaagccgagcaagcaguuggccccucacaagugugcucucucugucucucucuuuuucccucucucucucucccgugucugugaugccccucucugacucuugcuugcccucuggagaccaaccugcaaguacguucguuuaacucaagcugccucgccuugcaacgcgagucuguguuuuugcaggaacauuuacacgucugcggaucuuggacaaacaaaugcuuucuccgcucugaacaaggcucacagugacugcaaaaaggcaaaaggaaagacaucuaagcuagagagucagcagagagagagagagagucccaugcaacacccccuaauguguccaccacggcuuccccacccagcucgucggccccuaggcccuuuccacauucuggaaagauccgagcacucuagcagaagacagagagaguggcaaagagacgcagcgcuggcaggacaugugccugcaggaagaggagggcacaggcaggcagagugcagggggaggguaagcuuccaugagggacagugcugugccccacgaagacaugggccuaucuggggccacagggcccccacaacugcugugcccacaacacaccuugacucuucaccugcuggggacagugauaagugacccaggagaccaccaggguaccuucucccuggaaaagggccucugcccagacccuccaccaagggagagggccagcagaagguaauccaaguccaguggcacuguccaccagccaggccuccagagcccacaacagccuauaagcagaggaagaggccaccguaggagaccucugugggugauuucuguugggcuggauagggagggcuuucccauccuggagccucaaacccaggggucaaagcauuuccaacagacgaggacgggcuaccgcacagcccgcucaagcuccaacuucagcccaccacaguccacuucccaccaacagaccccucaacucauuccacguugcccuccacaccaccccuacccuccagacaugugcaagagucuagagcaguggaaaccaguuggaugagagggcccugaugcccagugcccaugccaacaacggccccgccaccaaugcccagugggugagagaaagucggugcccagccaagccagaguccccucccugaguugaguguuccguaucuacucaccuuccacccaccccaacccaacccugggccaacaaugccaccaccaagucuacccauuggugccauuaguggggugagugagagagagagagacugaggcagggcaagagccagaggggagguagggguggggcagggguggggugggcaggguuagaggagcugcaggcgauugucuggagaccaggaaggcuccaaggaauuagacagcagcggcaccaacguacacgcuccaggauuuaaaccgggauuucuugcgcuuucguuuuugacccuuucccuuuccucgaacugauuuucuggaaaauauaaaaacagaaacagacaggaagagaacgagagggaagagaagagaggagcaaugaagaagacagaggcaggagcaggagacccaaaacuacccuagucacuuccuggagcagccucuaggucaaaccucagucacgggugagcagagacagcgugaaccuuccuccucacuuugcccacaguagggugguaaucccagcccuaggcagggcuuugagugauuagcagaaacugugaaaggcacagcuucuaggcuucauguggucccuggucucaggcagggcgcaaagccauaagggcaagccacaacgguuagacccugaaggucaggaggcaauagacugucuaaggcagacuuuaaugagaaaggguuagaagugggcugugcuucagacuaucugccuugacuuccaagugugagaguaggagucccucugggagcccugccucauagcauccuuggugggaaggggcaguugcuugagcgauggcauauaagccagggcaggagauggggcaccaguuauggagcagucaucuaggauaggcagugggaguggcugucaucagagcccagcacugaugguggggccaggggaagaggaacaguguaguaugggugugugauuagggggccagaggcucuuuuuucuagaagccaaagccugcagcuagacucucuuccgagcucgggcgagcccuaccacucuuccuaugggcaaagcagacaucuagggaacagcugggagggacaagcuacagcuugccacccuccagggaaccagcacucucuaggccugccaagucccagaaaagauauggcagccugucuaucacggggaaagcgagacaggaagaagggaccuggggagaagaaggcaggucuguccugcuugggagaaagcacugcaagcauagaaggagaaagcucuccacacagggccacucgccuggagccugcccugcucucucucacugauaaacuccaggaccauugcucuaguagauacaguagucguggaaccugggggcuuaggggaaggcaugaggacuucacauccaccaaaugguagggcagacagaaaggggcguggggugggguugggggaaaggaugggggugcucucucucagucgcuccuucacugcacguuuagaccccagcaaugucagccacccucccguccuaaacugaccuuccccggccaucaacaggaagccucagaaaaugacuaccacuccacuuuucuucccucacuaagagagcugggucugcuaccugccacagcccuacggaaaggcauacacacacaaccaagaaaucuccugggaccuaaaaaaccuggauggccacagucaccacccaacaaggcccaggcuacguccauccccugauacacagaaacugcccuguggcacccacucgcucuccugcacucugcuguggacgcuaguguucauagcacacuccaccacaacgcugagugcuggccgggagggaccugagcccugaagggcagccucuucuucaggcuggguuuacuucaucgcucuagagccauaagcuuaaagcugacuccagcccacuucggucaccauacuacccacccaaccaaugccacugaggccaacagagcacccaagagaggaagcaagaagcccugaacagagacaauuggaaagaaaugcuagcacguggccacuuacuuuucuggcuuuguucugucuuucuuuggucugcaguggguagagaaaggaggagaaaacaagacacagaggaguuagggugaugauaacaacaauuugguaauaauuuuacacgacguuucugauuuagcaaugcucucuuaaucuuuuugcauaacaacaacauggggcccuauaaugccguggaagggcacacugaauuguugugcccauauuccagagacggggaacagcagcacacugggguccaucaccaccaccacccacagaagcucacacagcuagcuggaagguggacccacacuaacacauguaacacgcucagcucugcagccaggcaucagcugugugccaccugagugugaagcucuggccucaccugcauucacaucugcugugcuguaggaagcucaucucuccuaugugcuggcuuuggugagguuugauccgcaugaucuguagagggagggagcagaucacagugguuagugacccagccagccauaccccuaugggacaccccggggcuccugccauuuagcacccagggguucuacugagcagggauaggugguggagauaggaggaccagggcucuaacagaaaagaaccucaggucacuccaacucccccaacccugcuggccucaaggggcucuugcuccucuugagagcagacagcugcaaggguuggccaggcugggaauucagguccuggauucuuaccacccccaucccuuccccuccugcaccccucccaagcuucacccugacccccuaaaugcuaccuaagagcuacccauccagccuguugcugagcuuccucccacucuccaccccgucugggcccagauccacccacuaggcaacagcaccucaagacuggcuuuuaacucugcauagaccagucccucccguccagcuuccccaauagaacccucgagugaggauugggggagcauuuggguucucccagagaaagagaagaacacuuguugcaggcagcggccccccugucgagcccagggagcaaaggucacgaaagcagauggucaaaucguggagagcuucggcagggaaguacagagcgcagagcagacaucuucuucccaaagguagcaaagaagccccagccucgucuucucacccucaaccccaauuuagcuccuccuaccaaaaguuucccaggcagaggcccagacaaccuucuaaugccccuccuuguaccacuguccuccugcccccccugcccccgccccguccccugugccgcaggugcccaccugcauggugauguugcucucugacgugggcacgcacuccagggcuucaucguuacagcagccugcacagcgcaucagcggcacacaggacggcuugaagauguacucuaucucgucgggguacuccuggaagauguccaccagggucucaaucggacggcaguagcuucgcugguagacauccaugaacuugaucacugugugggagggacaccaggcaggauggucagccucuaucgccacccagauuugugagaccacuccuuacagcuccacaccaaacaaguguuucuaaagcucaaagugaagucccucccucauuucuagguccagauccaggggagguggcccugccgcaucuaacuccauuccucauugucacagcaaguuccuaccaacuauggcuccagaugacagccugagucuggguacaccugcuuucugcuuuauggccagaccaccaaccaggccaacagccacucaucaaauacacacuggacaccggggacagcuauguauauacacucuuccccauguucccacuaagcacaaccaggaacccauuuuauaaauggagaucuagagacucagagaaacaccaccauucaucccagaggccacaauacuaguaagaacuaguuagaaggagcuauguuggcuaugccuucugacacugauaucaugcacagacacagaagcuucgagagacaccugccagucccccccuccccagacuucugcccaagacaaaucagcagguggcagugggcaggcacaccaaccaaugcagguccuggcagcacuaagaaccccgcccaagagggcaaacuguuugcaucauggaaagagcaggagcugccuccguacgacgcauuuuuagaagcugaucuagaagacgacaggagagaccauuucccugucagauucugagguacaugagacaggaagguguacuugagggccagggggcgggaacuagagaguacaggacuucuuuggaacaccaaaugguggcucagccugccaguuuuggucacaccccaccgaagccuguccaugaagugagaaaaggaccacaggcccacacaggggcccaaguucuguuagcaguuggaaugaccuugggccugucccuccagucuccaggccucuaucgguagaagcagguuagccugaccucuaaagacacuucagggagcaggaaggugguggcgcucugacucuuugcuggcccugaaaacagcucuucuuuucucauuccaggucacaaaguuuggaaugucaccaaaggcauuuuaagugcaugcuccggagacuacacacccccacccucccaaccugaggacacagccaaaccucccuuuacucuucaaaguuugguuuguuuguuuguuuguuuguuuguuuccagaaagguaaagaagauggaagccagguguaugauagguugucuggugagaaacgggggcacagaagaaaagauggagcaauggccacagaugucaaacagggaaagggguggggggaacuuaagccaccaccccuguacucugcucaagggcucucuuuucuaucuggacaaauaagcaaaggacucuugucuacccucaaaggguuaacauaaaacacagccaaaaaaaaaaaaauguccaugagaucagaucugaaaaauucuucucaaggaaagucuauauugaagacgacuaacccagaauuuuuuuuuuaacuaacccuucaucauggcugggacagagguggcccaggcuaguuagaggagcgauaugacagagcaaugaauggaggugggagcucuguguaaaaagaccuaagaugagaauccuuuccaaaaacuucuuagaguccccaagguccauaggaaguggaggaagugacuuggccaguacccacgggagccuggccccugccccaaagaacacuguccugcugcucgggcgugugcacacauacacuucagcaucgggcuuucgugguuuuccuuauuuauagcagacaagcucuucuccaucaaacaaagaccauuugucuugccucucccagaccacagagcccacuaggaagcagaaggggguggguagcacuuuggaaguaggggccugucaguggccggggccagggaguggcagagagccaggcccugggccagagaaagagcuccugggggaggaggcaaaaccggcuggacaucaccagcuuuccuuggcugcugguuccuccagccacaguggauuugggucagggaaacuagccuggagaaagaccccagggccuuccuaacucugaggaaggacacuuggggaguggcauccggcuggagcagaggccacacucagugcuggggagagccagggcguccccagagaaaugggaggaucccgguacuccaaaccacacuggaacaaaaggcaggcggacucaggguugggcaggggggcggggcggcugagagcuauagccggcccucugcugguccugcagggaaguucacagcacccaaacgcugucuauggaagcugccacacuggaaagccaggacuggggaguccuguuaggauauccuucuguccugccccagccucauaccuccaccucacacaggaagggucacagccccuucgggugggccauggguggguaggaaguggcacugaacauuuaucuuccccugagagaaggggguacaagagacaccucccagaacaucuggaaacccugaacgcugccgccuuccuuccuccacggcugugcucacagcaagcuuuccagauaaaauuucacuagaaaaccuauuagagaaagcaacaaguccuguuucuagcagaaagcagaacagaagacaucuuaagaaacacaaggguuaaguucaacaguacccaugccuccuauuccugugccccaaccccccccccaucugaaaaagaggaguggggcuuauccuugcacuccacugagacaacagggauccauuaaagagcaugagacucaccuucaugggacuucugcucuccuucugucgugggugcagccugggaccacugaggacaaagcaaagaguaaagaccguugacagggacagaggcagccacggggcguccaaggccugaccacugaaucccuugaugucuucuugucucucucucccaacccccagcucccagccuccccaccccccacccccaggcuucugagucacacagggucaggaccauguaaguggucccugcagguccagagcauacccacuacucuggacggcgucaauucugaacccauggaaguuaaagacuaaccaggcgcuagggagcucacaguguaggaggaaaauaccagaauccugcuuuacucaggcccccagucccguuccaaucuugcccucucucuuuucccacugcccccgauucccugguccaaagccauggguaaguauuaaggucaaauaggaggacaaauuuggacuggggcaggaaggaaggacugggggcgagaaaaacaacguggugaccuucuccugcugacaugacaaauaccagggagcucguguugaagagggaggggugcagaggaccgaagggcaccaacuacccucccccaucccaacucuccccaggccucgggaauauucggcauacccacagguugcucaaggggugauuagcugggaggaagccccuaagggagaguccaaguucccucccaccccaucugcccagggccugacugcagcucccaagcuuggcuagccucccccucccacaucuccaagccucucaccuggacugggcacuuggcucgaagguaaccaaggaagcuuucuccucaguauugcccagcccgcaggggguccuccaacccuccucauccccaccagcuccuuucuccccuccccagaagcugugaaggucaccaagaaggccuugugggccugacaguggaagcaagccaaggcuuccaggcaggccuuccugagggucuccuguugccaccuuccucaaccaaccuggaccuccaacugccccagaaggaccaacucccacccuuggucugucucuguccccuaagagcaguucauccagggacccucagucuugccaccagggccaaggucagaggugacccuucucaagagauagcuuccccauuccagcugccucagguuggcccuggauucugcacuguaggcccucacuacccccucaauagccccaugacauucuccuuauucuucugucuagccccccguggagaaagggaacagaaacuuugaaccccuucccagauggggagguucuaaggcagggacuggccagguguccuucucugggggccucugaaggucacacuguggccaagcacuccuauccuccuccccacauggaggcccagaaccaaggccuuugugccagggucuggggaacucuggaugguggcagggacaccugcccuucuccuuccuucugccuccuuuccaagaaggcucuacaacugaagcuucguggaaauaagcaugaaaggacccuuugguaggcaaguugggugggcaaguucgcaguuaaaccaccugcucucugggcaucgggcuuugccaggacaaagugugugagagauacugacugacaagggauccugccaaagguaugggaaagggcugguuccaggcugccccugucagagcaaauaucaagucauguuuccaaagggggggugggggugggaaauggggugaugucaguccacccuucguugauccacccccccccccgcaaaaaaaaaaaaaaaccugaagcacagcugugaggggaggagggagcacaccuucaccaacucaaaacuuaggucagcguuuccacaaagaacccgagggugggccucagcacccccacgccugacagucaccguccuuuuccuggacccuggguccaggaaagguccgaugagucuucgcaaagaaaaggaaaauauaaaagggugggaagggcuucucuuuuuacaccaggcaggaaauggggaaaagggggaaggggcgucgggaaauucuuccuagcgcgaggcacggguagaaguugggaacggaggaaagagguaugggaguuucuccgggucccggagcuggggauaccuccagaggucaccuuccucgcggagggccgguggggggaggggcgccgcucgucgcccgggucuccgggcuccggcagccgcggcuccgggaacacgaggccggccaggcccgggcugauguaaucggcucugcgccgcgcgcgcccggccaggcgggggagggcgggcaccgcgcgggacgcgagcggggacgggaggggguggcgcggugcagguggcccaacaagcuagagcggugggagaggguccccgcagcaauccauccuaaaacuuuccccaaacucacugcaagggccucagagacccaaacggcagugacagcaaagcccccucggucgcccgcgcccugcccccuccacgaucucugcccuccccggguccaagguccgagcacccccaggcaugcccgcugggcuccggacucccgcccccuuugcccggacuuccaguucuccggggacccgcgacccggagcaaacuucugccgccagccucggcacaagcccagcccccucagccuccuccucuggcucccgcccuccgcugcucggcccagaucguacgugcggugacucuggugggugggcagggcccgcgugggcggcgagacgauccuggcgcccucccaccuagcgcgcacccccucccccuccacguacgacgacagagggggacgccucgcgcccggugcccaaggacccgcguggggcacgaagccccccacgcgcgcgcucgcacgcacgcacguccccaagcgggagaggcgcucgccacggcccggcgacagcagacgggcacgaccgcuuaccuuggcaugguggagguacagcaguaaagccaggguccagugcacccaagagagcagaaaguucaugguuucggaggcccguccggggccggcgcggcucgcgcucccucuccggcucggacugcgaggcagcccgcucucuugcgcgccuuggcgggcuccucucccuucuggaaccgaggcccgggccggggccuggggcgcgcgcgcggcuggagcacugucugcgcacacggccgccucacccguccaugagcucggcuccugagagccgagcgcccacugcggcccccucuccucuuccuucucuuccuccccucucuucucgggccccggcuucuccaggcccgagcuagcacuucucccagcuccgaucgguuugucuccugcggcgcagaccacggcuacuacggagcgagaagagcccagaaguuggacgaaaaguuuccgugcaaucccgcgagccccgacccccuccaccccgccuccgggcgcgggcuucgguuccucgcggcucgccgccgcguccaccgucggcagcccgccggcgaggaggugggcgcuggggcugggggcggugucugucugucuguccgucagcgcgacugguccgaugcaagaucccaagggggagggcucacgccgcgcucuggcggucacccccaaaagcaggucagucacuuugccccugucccucucucuguucgcucgccagcgcgcucucucugaccggucucucucucucuuccuugacuucucucuggagcucuugauaccucuuucgucugcugauuuccacaauccgaagugauuugagggagugaagaaccaaccuccucaaaccguuggcacgauuuaagaggggaauaggaagcaaaaauaaauuaaagcguaaaacaauacaguuuaagaaaaaaaaauuaagagguuugaauaucaaaucccagagcacagacucccgggcuggugaguccgcugaauagucugccuugucgcugcgucucgcgacagagcuccgcugccgccgcucagcucgcccccagugccgcggccucgcugcagcucggcugccccaagccucugcgcuu

SEQ ID NO: 8636 - RNA, 1256 nt, Mus musculus
caguucuccggggacccgcgacccggagcaaacuucugccgccagccucggcacaagcccagcccccucagccuccuccucuggcucccgcccuccgcugcucggcccagaucguacgugcggugacucuggugggugggcagggcccgcgugggcggcgagacgauccuggcgcccucccaccuagcgcgcacccccucccccuccacguacgacgacagagggggacgccucgcgcccggugcccaaggacccgcguggggcacgaagccccccacgcgcgcgcucgcacgcacgcacguccccaagcgggagaggcgcucgccacggcccggcgacagcagacgggcacgaccgcuuaccuuggcaugguggagguacagcaguaaagccaggguccagugcacccaagagagcagaaaguucaugguuucggaggcccguccggggccggcgcggcucgcgcucccucuccggcucggacugcgaggcagcccgcucucuugcgcgccuuggcgggcuccucucccuucuggaaccgaggcccgggccggggccuggggcgcgcgcgcggcuggagcacugucugcgcacacggccgccucacccguccaugagcucggcuccugagagccgagcgcccacugcggcccccucuccucuuccuucucuuccuccccucucuucucgggccccggcuucuccaggcccgagcuagcacuucucccagcuccgaucgguuugucuccugcggcgcagaccacggcuacuacggagcgagaagagcccagaaguuggacgaaaaguuuccgugcaaucccgcgagccccgacccccuccaccccgccuccgggcgcgggcuucgguuccucgcggcucgccgccgcguccaccgucggcagcccgccggcgaggaggugggcgcuggggcugggggcggugucugucugucuguccgucagcgcgacugguccgaugcaagaucccaagggggagggcucacgccgcgcucuggcggucacccccaaaagcaggucagucacuuugccccugucccucucucuguucgcucgccagcgcgcucucucugaccggucucucucucucuuccuugacuucucucuggagcucuugauaccucuuucgucugcugauuuccacaauccgaagugauuugagggagugaagaaccaaccuccucaaaccguuggcacgauuuaagaggggaauaggaagcaaaaauaaauuaaagcgua

SEQ ID NO: 8637 - RNA, 4137 nt, Mus musculus
aagaucucgcgacauucaagauugcgggagcccgagcguugcugcggagacgcaggcgcggacucgccuccuuuuacagcgaguggcggaagauggcggcggcucaggcgguggaggagaugcggacucgcgugguucucggagaguuugggguucgcaauguaagagaucggggcgcgggaaggaugagggcggcacggggaaguagaggccuggugugaaggcuggccacacugcccuuucuguuggcucuagguccacaccacggacuuucccgguaacuacgccgguuaugaugaugccugggaccagaaccgcuucgagaagguggguagagcugaaggugcccagucggcccgaggggccagaccucgcagguuggggugggggucgcuguuuccauacaacacgcuugagcuccauggacgggucagacacggugguugcucucggugggauaauggaccacacagacaaguuauuccagaauaguaagauagcggugaagauggcugggauauggucaggaaucauugaugcacugaauccagcuaacugaagggacguaguuaaaggucagugaagggaauggcauuugaauuaagcuuugaacuaugaauaaaaguugaguagugaaggccugauuggagcuucauuauauaugauuuuuuuaaaauucacuuugaaacuguuucuguuuagcccuggcacucucucuauaguccaggcuggacuugaacucagccaucuaccugcuucugucucugccucccaugcacugggauuaaaggcaugagccaccacgcccaauuuagaauuuuugaguagacugauaacauuuugcaaucuugauagccaggagggaaugaauucuggugaaucugccagcuaguguaugcaggcugaaauugggggcauagaugaacuccagacaguacuaacggaguaaggcagggagaacuagacgauuugcaccagugcucuggggaggcagugugugagagaaaggacuuuguaacuugaggacccuaaaacuuucuugauaugcguguuugccugcauguguauuugugcaccacuguguguuagugaucccugcagugugaggagaauguuaggucccaccaggugcugggaaccaaacccaguucuucugcaagggcaguuaagugcucuuaauagcugagccauuucuccaguggcacuggggaacuguugcuggcugugucguuugccaagcaggagaacaagaaugaggguacacucaggugccugcuugugaagucuaugugcuugcuugagccaggagcaugguggaggucagccaggggauuagaaccuaggagacaggaacguuuacuguguggguggaaggggaaauuuagaaagaagagcagauaaggaaauugguguucaaaauccaagggaauguaguugagaaaaguagguauuaaaaaauaacgacaacagacaugcaaguaucaaacggucuaaguagugugggaaguucugcuuuuuguauaguaacuucucugggugguuuguggaaaaucugggaagauugggcauaguggcgcacaccuuuaaucccaguacuugguaggcagagguagguggaucuuuugaguuugaggccagccuggucuacagaguuccaggacagccaggacuacauggagaaaccuggccuuggaaaaaccuaaaaaacaagaaacacacagccuugcccccaagaacaggacuggagacaaaaugucuacugagcaccaugacuuuagggugaggggauagugcaggguaggagccaggcaggagucaugcaggagcuucccuccuucuagaauuuccguguggacguggugcaaauggaugaagacacgcuggaguucgacaugguggggauugaugcugccaucgccaaugcuuuccggagaauccuguuagcugagguauuagaggacgugggcuggaggguagaaauuguaucaauuuguagacgcuuuucucaaagccaucccucuggggcagguagggugguucacaccuaugacagucugggcuacauaguaaacauuguaucaagaaucugagccacacgccuuuagucccagcaccccagcacucgggaggcagaggcagguggaucucugaguuccaggccagccagggcuauacagagaaacccugucucaaaaaaccaaaaaaaaaaaaaagaaucugaagggcaaaaugaaaaagugcugccucuuccuuuuccaggcagggggauggguggaggucaguugucugcuuugccuccuugggcaggugccgacaauggccguggagaaggucuugguguauaacaacacguccauaguccaggaugagauccuugcucaccgccuggggcucauccccauccucgcugauccucgucucuuugaauaucggaaccaaggugaggcugagagcuugggauuaugaguuaggcagaacugaccuggaaugcaugggcucaggucccaggccuacugcuggggcuuuaguuggcaucuuguacaucugccuucgccugggagaacagcuguccccaccccaccucuagucucacuguguacacccucggaacacagcgcuagcagcacucaggcucucuccaccuuuacauucuuccuggggauugaacuugggucuucagguuggagcaagcaugcacccucacucugugagccuucuugucagccugguauuagaguugauauggccaggcacggugguggacagcuuuacuccaagcacuggcagaggcaggcagauguguccugaguucaaggccagccuggucugcagagcaaauugcaggacagccagggcugguaaaacccccgcucaaacccagcccaccccugcugcuucugugcaggagaggaggaaggaacagagauagacacgcugcaguuccggcugcaggucagguguaccaggaaccccaaugcugccaaggauuccucagaccccaaugaacucuaugucaaccauaaaggugagaagcagugggaaggccuagggccgagcgagggucagacuggaucugcggcuucugacuucauauuucccuccagucuacaccaggcauaugacauggguccccuugggaaaucaggcugaugucuucccagagggcacaauccguccagugcacgacgacauccucaucgcucagcuucggccuggccaggaaauugacuugaugaugcauugcgucaagggcauuggugaggaccuagugagcccgcccuggggggugggccagucugauugcagcaaugcagucgaaccaggagcucaacugggauguuagcagcaggcagaaagccaacaugcuuguguugucccaggcaaagaccaugccaaguucucaccaguggccacagccagcuacagacugcuaccggccaucacucugcuugagccuguggaaggagaagcggcugaggagcugagccaguguuucuccccuggcgugauugagguggaggaaguacaagguguguuuggugcgcagugggacuaagacuaagguguuuucuuugaagguagaagaaaaggaaagcucuccuaacaggcaagcuaccauacugucuuccuuagguaaaaagguggccaggguggccaaugcucggcuggauaccuucagcagggaaaucuuccggcaugagaaacucaagaaggcugugcggcuugcccggguucgggaccauuauaucugugaguacuccuuggauaggauuuagaacuagccuguauuagagguaaaauccugcugggacugaauguuuucuuuggccucuaguuucuguggagucuacuggaguuuugccaccagauguguuggugagugaagccaucaagauccugauggggaagugccggcgguucuuggaugaacuggaugcaguugagauggacugaagcuuacacacauaccugggagggcguggcugcucuuggaucuuuugcacugcugugcuguuacuagaggucccuuuccagucucauuuccagucaauacauuuuauuaaaugugccacagacaccuuugccuuuguaaggccguuguuguaaauaaauugcucuuggcaaguucuuuucagg

SEQ ID NO: 8638 - RNA, 3799 nt, Mus musculus
agggauccugccccgugccaccauauugaccaggaagucccuguggacuggaauccccacgcaugcuucgccucgcguuacuggggggcggggcgcgaacggauuacagagccaauggacuucaagcaggacugauugcggggucuuggcgagucuccggauuuagaccuuaagaauggagaagcaccagagaauaaguaaaaagagaacgaagugacaucaaaagcggucugagcgugacuugccuccacccuccccacgugaaacugcauccuucuacuuacuucccgcguuguucggcccucagauccuaguucuuugcccuaagacacgcaacgcgagccagccgcgugguccaugcagggacggggggcggggcgagggccagugacgcaaccguugccauaggaacucgccgccugcuccggcgcagcagcugaagcugagcuucaucccgccccggcuguccccgagagccgugcugccgggccccgggcccgcagagcgggcgcggccuccuaagccgcgagggagaggaccagcgcgggguggcugcagcucuguccccggccgcccccgcccccgccucccgccgcuucucuuccgcgccuccgcacccaggcccgcgccugcuuucgaucccgccgcggccgccguugccuccgcuuccgacucagccucugcugccuccgccuccgccucugccuccgcuccggccgcgaccccaaccgggaccgcgaccugaauccccgccccgcccccgggccaacuucugcccaggccgggacaccggcggcagcccccccgaggcccagccguggggaccaugcugccuagcuccauccagauuucgggggagccgcugucaggcgccgaggugcgggacaucugccgcggccugcgcgacaacgcggugcgccugcucucgcugcgcggcugucgccugugcgaccgcgacuucggccgcaucugccgggcccuagcuggagccacgucccuggcgcagcucaaccuuaaccugggcgucgugucuagccccagccgcaucaagcagcuggcagaagcgcuacggaccaaccgcuccauccagucccucuugugaguguguccccucgcaagggggucccggccacugcaccccucuacacacccucuaccaccuccugugucuccacauuaccuuuccaguaccuguuuucccaccgcccuaccuucgcaaccucuaaugcacaucucgucucuggguccaccacacccucccagaaacgagcaucaguucuagacuuugcuccacaugccaaccuucaaagagcccugccuaguagggaaugcugcccuccccaccccaccccaaccccaaguuacuucauugugaaggcccucguuucugaggaagggucaccucccguggagacuacccgcugaaggaaggaucucagaggagaaugagcaugugugccggcuccgcagccacuagccacacaccccucccugugcaauguucucaucaguaccugccccagaagccaaauucccuucccaucguaucccuucaaaucuaggauuuccauucuuccuucccauucuugucucggggaggggcaacuuucccaaauagauaaggcugguuauacauaauuaaucucaucucaaccuucagccuacaugggagcccacugacagaugcgggacuggccuugcugaacccagcccuggcucuccacccugcccuuguggcucuugaccugggggacugcauguugggugaugaagccaucaaccucaucuguggccuacucccuccagacggggccaagucuggugagcagggcccuacugagugcaugggcuagugugacugauguaggcuaaaugccgagaaggggguguggcccagugccgagagccgggagggugcaguaagaaugccuuuuuacccuucucaggaagggagaugcuuagaaacugagcagaguggaaacugauccaggcaggggaggcgugaguaggucccuaacugcucuagacugcugugguugggggcagaguggcucccugccacuaggguuacccuauagacaacagggucgagaaggaccucaccuuacccauccuggauucucacuaugcugcugcuuaggucugaaggagcuaacacugagcgccaacccuggcaucacccccaaggguuggagccgccucgccauugcuguggcccacagcucccaaguccgcguccucaaccuggacuacaacccccugggugagcuuaagaucaucucucucucucucucucucucucucucucucucucucucucucucucucucucucucucucucuugagacaggguuucucuguguagcccuggcuguccuggaacucacuuuguagaccaggcuucuucucaguguucacugcugcccuacccaauagccucagaccaucaguugccauaguaacaagggagggaggaugaaugaaagugcccaaggaucuuguaagagaaccauccuucaugguaucugaccaacauguagcuuuaaacuuuggucagaaucugggucugacuugcuucaucucacuuaagaugcugcgcccuuucuggccaggcacuggguccugaccuggaacaaggauuaacagaucucuguuuucccaaggcgaccauguggcagggaugcuggcuguagcuguggccucaagccguacccuagaaguccuagacuuggagggcacagggcucaccaaccagucagcucaggugagaagccaucauguuuugaagacaagcuaggggacagggugaguuauugucugggacauacccaaggcuggccuguuuagguccaaggacugcguaaaucauguugguuuuuuuuaauuauuaaguuuuauaacugaauauuuauuauuuuaugugaaugaauguuuugccuguaugucucucaugccugugguggccagaagguggugucagacccccuggaacuggaguuaugugacaaacagugauaugggugcugggaauugaacucugguccuuaggaagagcagccacugcucuuagccacugagacaucucuucuggguuuacucuuuuuugugcgcaucucuccuuucccaagacccugcuggacaugguagaaaauuacccaacagcuuugcggagccugguguuggccgagaacagcauuaguccagagcugcaacaacagauuugugaccuccuaucugagggggaggaagaggaagagauggcaggaggggcugccgacacccaggaaugggagagagggcgggagccugcugcccaccagcggaguggcagcuccuggaugugccccagugguaagaacauggagagaagaugaguuauuucuggaagauuuggauaaagggggugguggugggauuugugauauccacuaaggaaugagugauggccugagcauccuucugcccuuccacagaucccaguucucagauggugcuaaugacaucaggacuaggggacagucuguuggcugagacugagaugugacucuccgcuuggacuucugcacagcauugcauuugucuguguccucacuaccuuccuccacagagcagggaaaggcccuggcuggggcucuggcagcuccugguaguggcacgaggcucuggaagcugucacugggcaacagccuugagggguggcggggggacuugaacccaggguacugacuuugaacuuguuggcagcucuggcugcaacccgcuggcucggaacagauuuuauaaacuccacaaccugac

SEQ ID NO: 8639 - RNA, 3799 nt, Mus musculus
gucagguuguggaguuuauaaaaucuguuccgagccagcggguugcagccagagcugccaacaaguucaaagucaguacccuggguucaaguccccccgccaccccucaaggcuguugcccagugacagcuuccagagccucgugccacuaccaggagcugccagagccccagccagggccuuucccugcucuguggaggaagguagugaggacacagacaaaugcaaugcugugcagaaguccaagcggagagucacaucucagucucagccaacagacuguccccuaguccugaugucauuagcaccaucugagaacugggaucuguggaagggcagaaggaugcucaggccaucacucauuccuuaguggauaucacaaaucccaccaccacccccuuuauccaaaucuuccagaaauaacucaucuucucuccauguucuuaccacuggggcacauccaggagcugccacuccgcuggugggcagcaggcucccgcccucucucccauuccugggugucggcagccccuccugccaucucuuccucuuccucccccucagauaggaggucacaaaucuguuguugcagcucuggacuaaugcuguucucggccaacaccaggcuccgcaaagcuguuggguaauuuucuaccauguccagcagggucuugggaaaggagagaugcgcacaaaaaagaguaaacccagaagagaugucucaguggcuaagagcaguggcugcucuuccuaaggaccagaguucaauucccagcacccauaucacuguuugucacauaacuccaguuccagggggucugacaccaccuucuggccaccacaggcaugagagacauacaggcaaaacauucauucacauaaaauaauaaauauucaguuauaaaacuuaauaauuaaaaaaaaccaacaugauuuacgcaguccuuggaccuaaacaggccagccuuggguaugucccagacaauaacucacccuguccccuagcuugucuucaaaacaugauggcuucucaccugagcugacugguuggugagcccugugcccuccaagucuaggacuucuaggguacggcuugaggccacagcuacagccagcaucccugccacauggucgccuugggaaaacagagaucuguuaauccuuguuccaggucaggacccagugccuggccagaaagggcgcagcaucuuaagugagaugaagcaagucagacccagauucugaccaaaguuuaaagcuacauguuggucagauaccaugaaggaugguucucuuacaagauccuugggcacuuucauucauccucccucccuuguuacuauggcaacugauggucugaggcuauuggguagggcagcagugaacacugagaagaagccuggucuacaaagugaguuccaggacagccagggcuacacagagaaacccugucucaagagagagagagagagagagagagagagagagagagagagagagagagagagagagagagagagaugaucuuaagcucacccaggggguuguaguccagguugaggacgcggacuugggagcugugggccacagcaauggcgaggcggcuccaacccuugggggugaugccaggguuggcgcucaguguuagcuccuucagaccuaagcagcagcauagugagaauccaggauggguaaggugagguccuucucgacccuguugucuauaggguaacccuaguggcagggagccacucugcccccaaccacagcagucuagagcaguuagggaccuacucacgccuccccugccuggaucaguuuccacucugcucaguuucuaagcaucucccuuccugagaaggguaaaaaggcauucuuacugcacccucccggcucucggcacugggccacacccccuucucggcauuuagccuacaucagucacacuagcccaugcacucaguagggcccugcucaccagacuuggccccgucuggagggaguaggccacagaugagguugauggcuucaucacccaacaugcagucccccaggucaagagccacaagggcaggguggagagccagggcuggguucagcaaggccagucccgcaucugucagugggcucccauguaggcugaagguugagaugagauuaauuauguauaaccagccuuaucuauuugggaaaguugccccuccccgagacaagaaugggaaggaagaauggaaauccuagauuugaagggauacgaugggaagggaauuuggcuucuggggcagguacugaugagaacauugcacagggagggguguguggcuaguggcugcggagccggcacacaugcucauucuccucugagauccuuccuucagcggguagucuccacgggaggugacccuuccucagaaacgagggccuucacaaugaaguaacuugggguuggggugggguggggagggcagcauucccuacuaggcagggcucuuugaagguuggcauguggagcaaagucuagaacugaugcucguuucugggagggugugguggacccagagacgagaugugcauuagagguugcgaagguagggcggugggaaaacagguacuggaaagguaauguggagacacaggaggugguagaggguguguagaggggugcaguggccgggacccccuugcgaggggacacacucacaagagggacuggauggagcgguugguccguagcgcuucugccagcugcuugaugcggcuggggcuagacacgacgcccagguuaagguugagcugcgccagggacguggcuccagcuagggcccggcagaugcggccgaagucgcggucgcacaggcgacagccgcgcagcgagagcaggcgcaccgcguugucgcgcaggccgcggcagaugucccgcaccucggcgccugacagcggcucccccgaaaucuggauggagcuaggcagcaugguccccacggcugggccucgggggggcugccgccggugucccggccugggcagaaguuggcccgggggcggggcggggauucaggucgcggucccgguuggggucgcggccggagcggaggcagaggcggaggcggaggcagcagaggcugagucggaagcggaggcaacggcggccgcggcgggaucgaaagcaggcgcgggccugggugcggaggcgcggaagagaagcggcgggaggcgggggcgggggcggccggggacagagcugcagccaccccgcgcugguccucucccucgcggcuuaggaggccgcgcccgcucugcgggcccggggcccggcagcacggcucucggggacagccggggcgggaugaagcucagcuucagcugcugcgccggagcaggcggcgaguuccuauggcaacgguugcgucacuggcccucgccccgccccccgucccugcauggaccacgcggcuggcucgcguugcgugucuuagggcaaagaacuaggaucugagggccgaacaacgcgggaaguaaguagaaggaugcaguuucacguggggaggguggaggcaagucacgcucagaccgcuuuugaugucacuucguucucuuuuuacuuauucucuggugcuucuccauucuuaaggucuaaauccggagacucgccaagaccccgcaaucaguccugcuugaaguccauuggcucuguaauccguucgcgccccgccccccaguaacgcgaggcgaagcaugcguggggauuccaguccacagggacuuccuggucaauaugguggcacggggcaggaucccu

SEQ ID NO: 8640 - RNA, 25311 nt, Mus musculus
uuuuagcuaggcaugauagugcgcaccuuuaaucccagcacucuggaggcagacagguggaucugggaguucagggccagcuagggcuacaugagaugccaucgcaacaauaaaagcaaaaaggggauuaaagugggaaggagaaagaaauuaagccuuaccuguaaaauaaguuuuauuugauuuuaaaauagucauugugaaaacuucccaaaucugggaguaacagucuagagccaagguuaagaauggggccaggccccagaagucacgcccucccucuggaagggggagcccugagugaguccacccuugucucuggggccagcugagcaggccuaagagcagcccacgcagaggcagaggaauagaggucagcagcaccaacgacacccuccccuaccaaccagagcucucaaugagaaaggagcugggaaaggaaaacugacaagcccaccgcccgucccuuacggacggacuggaugguggaagagcuuggggcccaaaugacuuguuaccuuggagaauaaauauuucaaaggaaaaggaaacaaaaaugaugauggcaagcuggcacccauuagugcaaacgcagcuccaaggauugaugugggccccacuggcugagcugcccaggucuguagggagagucugggccaucugcagcccugaggugguggcagaaggcaggcaggucuagcugagcacagugcccugcuccugugccugcgucaggcuguccuugcgguggagaugguguacucccauucucuuggggcugcgcugggggcggcugggacuggggagaggccaggcccugccaucaacaugagaagggccagaggccuccucggugcccucuuuaucaggcagcaggcucugacgcucuuccucggggcugacaggcagguucagcauuuccucuuccucgucuugaggaaagccagagucagguucugcuggcagcacaaguccccgcucacggugcggggaaggcgguggggcuguggaguggcccggggagaaaugcaauuguagcucgggcagugagucucguccaaaggccgugcgcuggaccacggcagcagggggcggggugcgguccacaaaugcacgcugccagcuggccagcagguccuccuccgagcuggccgaacuagcuggggcacucagugcugagggagcuggacuaggcuggugauggggcgacccuugggcagaggcaggacugcuaggcacugagcugcggugggcccgcucacugccguccuccaccaggcucaaggagauggccugccggguggcauagguacaguuggggagggggcuguuccgaggaauucggaucuuguccucagagaauucuaucaccuuccuaccaggguauaaugggugugguggagacgggguaggguagggacucaacuugucgaaggcuggcaggggcagcuccuccuccggggagcccccugcaguacucacugagcaacacuccccauuggggcugcccggggcaggggggcuggcugggucacccccacucauguccacaugcacgaauacauccucagccaaggggcgcccagcacugccagacugagcugaauugagcaagagagacucagguuucuccaacacccgggcaaugacugagguaggcaccacagccccuggggacaggcuggaagaagggcuggggcuggggcuggcaaccuccugcccacugcgcagauguuuucgaaccauguccuggagcucacaggguagcuaagagaagagaagggagagagacaugaaggggccucacuaaggauagccugacccacagcaaaagcgcuggcugggcaccauuuccuagucaacccuguacacucagcuuauaagcaccuacgcaaccucaccucagagagaaaagcaaagguagggauaaaacagcauggagcuaaccagcuccacaccagcccuggagacagaggcucuacccugagaggacuugagggcagguggguuuaacucaaggccgacgagagcucuguccgccaccccuucuucccauacugccuccucagacuggagagcgccagccagacuccagcaacgggcccucagcagcaccaggaccuccgcggggggcagagggaaggaccaguggaaaggggugucagaggaagccagacacaauccugaagcggcgggacagggccagcaggcgggacucacgucagcaagcuugugguuccggaagugggacuuguugcacuugagaagcugcaccgccagguugcaguccagccgguaccgcuccugcagacacacagcgcuuagagcccagcccagcccaggguacgggacaagccaggcugaggagggcaacauacauugagcucuuccaguuuauugaugguguuccuggcauccaguagcuuguuggucagcuccacaaucucccaguccagcgucuuccuguccaucucagccuucuugaucugaggcacagacuuaugguaaacacagcccagagcccagccagcccucucuccuuccacccucuccuagccagagacauaaggccacaggugcuagggcagccaaggcagacagagcagacaaacgacgacagacagaaguacacuuggucggcauuuccccugcucugcaaguugcccaugggaggaaccugaagccguggagccuaggacagaggcagucuaagaaccacccauccucagggagcccgagggacucuaggcaccaggcaagaaagacacugacauccuacaggcaggccgagcuugugugagcagcuguuuccagggucaggcuaagaggggggugcccaugacauuagcuggcugggcagggaagagcugcagauggaaagcagaccugaucuuccagucucguaacauguaccuauagccugggcugcugccaccgcagccaaggcugggacugcugagggcuaucacucagugccucugccagagccaugagcagaaccucagcccuagcccuuucccaggagggaggcacucugggucucacaugacaggaaaagagaggguguggucaaggggcagagggaaauggccaggguccccacaaucccugacauggaccaaggaggccaggaccagggaaaacacacaaacucagacgcaacugcaaaaauccagcuguggcuaagagaggccugagaggagagugcagcagcagcgguggcagcaugagggagggagacggagagagaagagagacagugugagcauuagggcugucccgccuggcgcagcacaccgcgcccuccccaccacugcccugccuucccucuccuccccaggccccagggugaguggcaucccccccggaaguccuagcccgcgcuauguuguggccacaccacccucccagcacaguaccagugcgugcagcuuguccuccaguuccugguugguccgcugggaugccguguagcuguucuguagccuacacaugccaacaaggcagagaaaggcagagcccugguuaaggccuguuccucaggccccaccaacccuccuccacaugggagucuaggaacuucccucuccuuccaagaucuggguuacuaaauaaagucagggggaccugaggcucuucagcuaacguauggacaggaaggugcucccacggaugggagacgauuggccccuuguuccgcaccugcggaauuuguccuuaaacuuguccagcuccucacggcucuguccuaacuccaguucuaggcagucuuguccuauuuccagcucccgcuccaaggccucagugcgucugguagcugaggccaggcguuugcgaaguucuucauucuccugcugcaaaagucugggggguuggaggguggggaggugggggauggaaccaucaaaaacagcuaacccuagggcagcagacaagagugagaaaggagcagacaggcaagugggucccuuuaggcucagucuagguaaggagacgcaauauacaggcccucuggccucgagaacagccuaagauggagacgggaccgaguguaugacgcacaauaguccagauggccccuccccaguauagaaacgcacugggucagaaucaaaggcgauagcucccgacugucuccgguuaccacccaggccagcaggcacuaagcccuacagcuccuguuuccccucacaaucagccuucuccauuauuaaucucuugggaauccaggacagcacugcuguccuccaggaggccucacaugccugacagaaagggcaugcagacgcuggcacaggcuggucacuguuuucuggagccagcagcugggcaaggacucuuuguaagggugggcccucaguucauggagcaaauaaaaccccuuucccugacaugagcccuaaagagccccacccccaagcuuuaccucugcugaccaugaggaguccacgggaugcccguggccaacacaaaccccacaaacucaguuaaaaggaacacuguccugcaaauugcuuguaauuguuuguaauuccaguguaugguucuaacugcaggucacagcacuaugccacaauguuagaagcuggaaggccagaugugaggaggagccugggaguccccagagcccagcagggauugaaagggcacagcacacaguccagggacgggcagccaauacucacuucauccgcucugcgucagucagggacuccuggacaaaaaaagaggggaagccugggacucagcuccagagcacuggccuccugguuggcucagagcccuggaaaaggccacgucacggaaagugacaggcccuccagaaauggaugaaaucuagaaacaucugguaagcuuacaguacccuuuccccugucaaccagaaaauucuagacccuuccaacaucuacccuuaauccuaaagccaucuucaaaggggaucagguacccaugucaccuaucccccaggauaaagcaccuagcugucggucaagcuccuuacaagcauggcacagauuuuccaaggaagugagggagucaagccaaacugaaaguuccgaguuuugacggaggccucucaggcccuccagaggaccucggagacugaggagccaaccugaauggcuggagggccucuagggaacaagaugcuaaagggcuuuguggauggugagugagugcuuguucucagacagucuagguugaauucaaacccaccaaguaacuacagcuuccugccuccaucuuccaauauaacuuuguaccacuaaaccauuuugugucuugcauugauccccugccccaaugacuuuggaugucuagcgcaggucaugaagaagcacagaggcaaauggcucagaucagacucuagagccugaucacuggaucugacccuacucaacaauacacagugaaggcuccaucucauggaaccucuguucccucacuaauagcccugauccucaacagcugagaccacucugugcacagggagggggacggcgcuaggaacaagcugauuaaccgcccagucuugagagccaagcuagagugucuggcaguggcccacaggccgucugagagcaagccuagcaugguucuugacagagugugaaguuaucaagguagcuaaacaaaagcaagcugguggaagggcgcacagagacgcgcagcugcggugggcagcaguuagagcacugccuccuuagaggccaaagcuggacgccuuuccuccaccagcaccugggacuggcugugacaguucuguugagcugcaaagacuaaugcucccugacgugugaacacauacacacagccccccacccccacccccaagcacaacuacagcucuaucagcaaugugagucucucgccuuaacccaugcccagcaccucaggccugagaggccagcugacagacaccuucaggggccugcuucugccagccagggccagaccccagccuugcugaccucuugcucgagccgggacacgggaaucuccaggcguagcucucggugcucuggaggcgccuuacgguaagguuucuuagcaggggcagcacugcucauccuggaagguaugggcucgucuccugcugagagaagcagagacaggcucagagguguagucucgagccuuggaagggccacugagauggcucgguggguuaggcaccuccugcuccugaccaccuuaggagcagauccuacauuaggagacaacugaacccccccgccaucccuuucucuacaguggcacuauggcacaugcaacccgugccuacccacuuccucacacagaaaauaaacuaacgagaggcguucuaaggugucucuggccugaacauucaaagaugaccagggauguguacugaccccacaggcagauagaccugagcuaccgcugggucauuagagggcugcucucuggugagucaggccggauggaucaggggagugcuggagaugagggcuagaauccaauggagaacagacaggugagaagggcucccagcugggccccaggaggagcacacuuggcuaagugggguggagagacucaacagcagcccacacugucccuuguaggcagagagcugcacagcauccaucuugcucaaguaggugaggguauaagcagcagcaguuccuaggcugcugugcagacuccauugguccacaagggcacugccacauuaggccggcagaguggaccucuggaagcuccaggacuggucuacagugcaccucaggccaauccuacacacuggaacucugccucaacaaacaaacagagagacacugccagugacacacaguugcaaucuaaagcacugggaaggcagaugccagccugggcuacauagcgagacugucuaaaacaaaaacagugcucagcacuaggcaauguuaaguucagguuuuccuuccauaaauugugaacaaaucuucuaagucuggggauagcgacccagcccaggcuccuggauaagggucuccaagcuugagagugcucucuggacacugccaacaaaggccaagccccuuuggccacaccuccuuucugugcuggcucccacuggaagagagcaccuauauggcugcucaccuaccagccucccagaagagaacaaaguauagaaugcaggccucaucgggacauaccgucuguucgcuggcagcucucuguucugcucuccuggaaucagccuucggcucuccacaucccacggccccucuacuuccucuagccaagagcuccugaaaccagagaaggggagaaaguggaaacccggugucagcugccugccuguccagucugggaccugaaggcucccagaaaacaguaagcaaagagaccacagcacagugggucuuaggagcaagcgacagagguaggaagaucaauagucugagaguagccugcuuuaugaagugaaaucaacucaaaaaggaaaccagcuagcauuaacgaguaccuggcuuccccuaacaacgccugcguguuuauguauguacuucguacgcugccuccgcucagcacauacccugcucuggaauaggccgguacuggucugugucccauucacuccuaggcuucucagagucuacagagagcugggaauccuggggaaugcagacuacaaaugagacuacaaagggccuggcaaaggagcaagaugacgaugguacggcagacccccuagcaaugacuaaaugagcccagagaccauuucuguguaccacaguguacaauaaacuugccaaugagcgaaggcagacccgagaaacaaaauccaaaccucagcaguucagagcagugauucucaaccagggugaguuuacccccugcuucucccaggguuaacaggcaaaugucuagagacauuuuuaauuuucacaaucugcagauggggagguacuaccggugagucaaagucagaauaucgacuaaaccuaccacacacagggcagccagcauaccggagguggcaaggcaaaggucaccagcccugaggccgagaaccgcuagucuauaaaccguaacuguggggggcuggcaagaaggcucaguagguaacgaugcuugcugcaaagccugaugaccuccacaagcacacugugcuuaaguaaguaccgacacacgcucaaaagagaaaacauuuaaccccgagcccggggagcugaggcccaaggcugcuccagcaucuccaagcgcuuggauaacgugcuccccacugccaaagccugcucuacacacaccacugccaauggcugggccaagugagcugccaaguccccucagcuucccgggauugaggcguaccuguaauaagcugggcugccgcaugggggcagcagccgccagugaucagugcaaacaguaacccuagguggcuuucugagcauuuaaaaaaaaaaaauacaaaccucuuccuacccccaucaacccaaacagagcuacagagcugggggcugaaggcggucuugcgggcuaaagcauguguuccuacuguugggacaugcccuggccaugacuccugucacauuccagcaggccuggggcagcagggugggggcagaggagggcggggaagcaggaguaggacucuccucucuaagguuccuggccuggauuugggggagagcuuguaauagugaagcacgagccaccagccuccgccccguugacaggaggcagaacguguccccacagggcacaagcagcaugcugucaggcugacucccugcacaggaaucugggagggccagaaaggacaccacauuccuggggugagagaacaaacaacauacaaccacaggggcuguccuccagagggccucgccccaguaggugcucaaccuggaguagggaucuaaccacagagacuccuguggccugagggaggggaccuagaaaagucccagagcacuguagguuaaccagggccuaacauuugaagguguggauguguggguguguaugccugggaaaccagguaggaccaaggccguugacuaaagaggagccaggcaaagcuucuagaaacugaugggagcuuccaggagcuggccuucuccccacagggccagcucucgauggcacuuuuuguuugucuguuccagaaggcagaggaacccuucacuuggcaggcucccuggugugauuugccaccuuagccuguuuuacuuaccuacccaacuccugccaaggcucgcauucucuucuagggaccagggcacuugugacaacaguggacaggcagggcggacugagacacuuucaggguaauucuauaugugggcagacaugccucacugaggugccauauccuauagcuugcccugccgugacgguaagucagggcugcaacuaugagcacauuuuuucuucucugaggcuagaggcaaucaaacagaugucuggguugggggaugguguggguguggcgaggacacaaagagcagaugagacucuaaggauggagguggggugaaagguuacuucuagcagugucacgaggggagaaacauuccugacuagagaagcaggggugauccacugagaacacugagaaccuacuggguuccccaaccccacaccucgaggcagaucugugccacucccugucccagguccauaaauaucagggcauguugggacaccugaaccucugcuuccauuuccacaaucuacugacuucccuggaucuugcccgugagggaccgcacuggacagacuaugggccuagcaucacuacccuggacuauaggacaggccugggaagaacaagguccauuuggaccuggugguccccagcugggagaggauaacacggugaguuagaagccaucagagcacuuacaccaggagccucagcuaccaguugcugcgucgacugagcauaacucuaccuaaacguuuuccagaguucagcccugagcugagaaggguccuugggucaucacuagcaagccacggccaaggccagccucguggccucuauucgccaaggagauucucugaggaagaucuggcaacaaacagggaagaauucuacucccugucccucccuggucccuaggagucaggaccaggugacucaggauagaggccacagcuugcuugcuaggucuauacuaaaggagcugugcccaagcagaaccccuggcugacccaacagugggagacacccaaauacccugaagcaagaggagaaggggcucuccucacccucaccuccccuaccccucccuagcugacccugucuccuuccucugucacauagcauucauucuucacuauucaaaaucaguucagaggaaagacuaccucauaucugcugaggaggagggugauagcacuuacuaauugcuauguugcaaucugccagucaauguggccgccuguugccaccugcccuguauuaaauaccuucucccugauuacagcccauggggcacgauuagcugccuucagagaacaaagucuacuuucauuagaaaugggacucagcacgcagaggaccugcacugcgaacccacugagcagcugagcagaguacugacagauaagacacagggcaccugaccggaagcagcccaccaacugucagccagggaugggacucacgucugucccccuuucuggguggguaccaccaggggcuuccacugaugccagaggccacuguugcuggagacggugggaaaagaaaccgauucagauccccaacucacucaaacuucuacccuuguucuaacaaauauccccaagggacacuagccagcagagagagcccaggccugcaacgcucuguucccggcugccuagggcccagcaaggucaaggggcagaagagaaaggagucagagaucaccauccuucacacacacacucucucacacacacugacacacacauacucacacacacacauacacacacugacacacacauacucacacacacacacacucucacacacauacucacacacacucucacacacauacacacauauucucucucacacacacacacacauucucucucacacacacacucacucacacacacacacacauacucacacacauacacacacauucucucucacacacacacauacucucucucucucacacacucacacacacacacacacacacacacacacacacacacacacacacacacacacagagcagaggaagcaggacagacuccuucguagaugcugcucucugccucuuugccugccagccuugccccaccagaagccuccuccagcuccucagguucugcacuaucagugugaacaaguucacugacccagagcagcacccuacccacugagacuaucucccuacuacccacgucacagacaccuccuuuaggagaggguaucauuaaugugggcucagacaaccguuaagcccuacugaaaucgucugcucacagcugccgaugaacuaaguuagugagcguccuugaaggggcagugagccuuuuggaucaggguagagcccacacuacaagaaucuuuaaaguuuuucuucagaacgguuccaagagaaguuaguaaucgcuguugcuuucuaagugaaaggaaaacugaucccgacuugagaagacagcugagcuauguauacagccuuaauuccuggaccuagcaggauauaaauagguaauaaacacauguccuucucaaagcccccaccagcccaaaucacagcauccugaucacacaggaaacaagguaccucuccuugacuuucuugagccuuggagauccaauuucugacaucugcaacccugggaaguugcacaucacagaaguagacaucacgcuugccgugcaagccuggaugguucugcagcuucugaaaucuaggcucugccuccagugagagcguccaaacacaaaccaccaugcugcaagggccaagccuacggccuacagacccaacaguauagcccuaagaauugcccaugaagauccucaccucuccacacuacaauacagccccacccugucugcucagaagagagcgguccuuaacacaauucaugauccuaccaaagcuggauuuagccuuccccacugcaccccugccccgucucguuugcucagcccccaguuuccggcaugcagcuguccccgagguacaugagcaaagcccucagcaauccugggcgcguggcaggcaggcaggcagccagcagcucacaggguggguccugggcaaaggugcugcucugggcugaugagugcgguagacgaugccagucugugcccagaccagcccugcugccccuccaauagcuauucaugccugugggcaaguacaaccucacccuguugggauaagcugccugcagcugagcuggcccccugccuacacuaagcugaauacacugacagggcucugaaggccaaaagggagagacucguucuaaccagaguagccaugcagcucagaacuagugcuggugaccacgagaacucaccuggcuccccaccugaacaaacagacuaucugucgggccucauccagcaaacacgugacaagaacaaaggaguaaaagacugcugauggagagccaagcgucccccagcccacgccugcccuugccauuggacgcugugcccucucuaagggggggaagucaagccauggcccuggccagugcuccucuuggcuuucuagucagagucgaggccaaccccguccagcuugcucacucccuacuccauuuccucagcacccugaaguaccuaugccccucauacccacacgcccuucccacacugcagccucagcccagucuucucccucucagccaccaggaacagaaucugccgggagggcucaccucccgagccuggagacaguuuguguagagcuacccacuggacugccaggagagcaagguaacuaacaggucuagagacugucaggcaucccaucucugucccaagcaugaaggaucgagccuagggagcagcuccuuaccggaccacacucaccaaucacccacggaggccaggaccuuuccugggccucaagaauccaaagccagaucccggccggucuagccgagacgcccuucccgauucucggcuaaaguccaccugagacuccauguggacacagguaagggaccaagcuccaccucagagcaagggugacugggaacugcaucaucacacacagccccgacccuaacguucauuuuacuucacacucuggccaagaagucuccagagccagaccaagggaagccuuaaucucccaaccaagaagugaaccucacuuuuuauucugaguggauaaugggggggaccagccacacuugcccucuaggguauucucagaccuccaccugccuccaaggcagggacguacggauagugugguagcugagggagucuccagcucaugcugcuaaaagcacagaacagaacagagccagcagccaauucggguuugugggaagcugagguguccagugugaaagagagagagaggcaugaguccuguagcaggccucuuucuucugcccaucaagaguguggcuguuugaaugagacuggcaugcauuugaauacuugguucccaguuggugggacuauuugggaaguaugaggugguguggccuugacaacuaccgggugggcuuugugguuucaagugaaucucaccauuccuagaggcuguugcuguguguuugucuguuuaccucuuugucacuccccgucucccuccccucgagguuggggaucaagaucugagcucucagcuguucuuucacuccacagucauagacuccaacccugagacuagagccucaaccaaaugcuuucuuccccgaguugccuuggucauggugauuuacgcagcaacagaaaaggaacaaagaccauggagguaucuauaucuccacaugagggaaagaugaaaggaaaagacccagaaagcagagguggcaagccuaagcaaaggaggcagucagucugguagagacacugcgggcagccccccagggcagguuagcuagccaaggucagacucacaggguuagugucuucuccucagccagccagcuuuccugguuagugguguuagcaacagacucauggcagacgcccuccaggcacuccauaaaaacagacagcuuggugugugagcagcucaacuccggagcugcaaagagagagcacagaagaccaaacugaaggaugccucuggcacauacaguacucuuuugugggcgaaagcaucucaggggcuucccgccaccagaaagcacuccggaggaagaccaacaccccaccuugccaacagugaguccagcuuacuaauucacacaaggcucucugguugaucaagagaaggcagcuauuguguggaaagcagcucccugucucccuaauucccaacugcacugccaggcugcaccaggacucugagcacuggcuuauaagaacaacccccugcccccagaugcaguugccacucauccaggccuaugccaacagagugcacuccaccccccaaccccacaggcucugggcgaagaacuauaagagaugagcuggagucagagccuggaggagagcugcaucagaauacacaaguacaauggagcagugugugacgaagccccaaaguggggccacucaaggaaaaggugacacacugccagacagaugaccuacagagcccucugaggaccccacagagugaggaugaccaggcacagcacaacuccccaggcucugacaggggcucuuccagucugucagaacccuaguucuuuuuuuuggggggggggggguguguggguuuccagacaggguuucucuguauagcccuggcuguccuggaacucacucuguaaaccagacuggccucgaacucagaaaucccccugccucugccucccaagugcugggauuaaagguggugcgccaccaugccgggcuagaacccuaguucuaagaagcacaaaaaaauacuuucccaaagccugaagggacauccuggggaagacagugcuagccacaacaguggagucuagagauguguccccuggggcagcaggacaggaaacucacuuccaacacaucaggaaaggguggggagguccccggcccugcuucagaagugccaggcagagcagugacuggagcgaaaugggaaggacagucucuguccgcccccagugugggucuggaaucacccagugucuggcacacugaagcaggaaggcucaaggucagccugcacaacuuagacucugcuuccaacuuaaaaaaaaagggagauggcccaagguuagaguacuugacagcaugugcaagacccuagguuuaucccccagcgugcaccacaaaaaugcaaacgucaaaagauuccugaauugcccauuaacugagacuccccauauuacucugacuacugccccugagcuucaaaagccaacccuugacuguggagaaaagacaauggucucaaagugugguucugcaccuuccugaugcugcaacccuucaauagguguggugacuccacuaacaccaaccguaaaauuacuucugcuacuacuucauaaauguaauuuugauaccauuauggauuguaauacaaauauccaugucuuccuacaguggaaggcagcccugugaaaggguuguucaacuugacaaaggggucuugacccacagguugagagacacuguuuaaggaagcuaaaucauauagccgggcgugguagcacacgccuuuaaucccagcacucgggagacagaggcagguggauuucugaguuuuaggccagccugguagacucagaccuucccuuccgcagaggggagacagguuaacagggacucaguaaggcgcaugcuucgagaucacagaggacaaacaacuggcucaggcaggaaucuguggccauacagagaauagggaguccuguucaucugacugcaggcucaggcuggaguaccaugcauaccguucaugagguucuaacugcuaaaaccaauuccuuugguauuuguucagaagugguaccuacagaccauucccagcaacuacaguagaaaagaacuggaagaauagagggugacucagccaccagccauuucagaggaggaucaggggugagccuguggcacaagaccaaagcccuaagaccacaggggccuggaagucuggcuuacucaauagcugcauacauuccucugguuucccccggacauuuuucagucccuaagacacuaggaaacaugagucccaaagcacucugugcuggcuagcuuguuaacaugacacaagcuagaguaggagagggaagcuaaauuaagaaacugccuccauaagacuggagcaagccuggagcacauuuucuuaauuugugacugaggugggaagggccuaggcuccuguggguggucccaccccugggcugguugucuguauaaguaagcagguugagccaggcaguaguggcacacuccuuuaaucccagcacuugggaggcaaaggcaggcagauuucugaguuccaggucuggucuacggagugaguuccaggacagccagggcuacacagagaaacccuaucucgaaaaaacaaaacaaacaaaagaagaaagcaggcagagcaagccgagaggagcaaccgaacaugccccuccccugugacccugcaucagcucuuaaccuccaggucccuagucugcuugagcucugaccuucuuugaugaugaacagugagguagaagaguaagucuuaaauaaacccucccuccccaggcugcuuuacucaugguguuucaucacagcagaguaaaccugaaugcgacaagcuccaugcagucacuuacuguaugugacccucuuguccauccaaagcccuaguaacuacaauccaccauccacugaucacaccccaggacuggggcggcucgguguggccggagaguuccccaaggagaugugggguugcagugcaauccgauccucacaagcugcucugggauagcacuucuccuccucacacugggauucccacuguugcugcaucacaagaaaggagucacucuccauuuaccacacuacucaaaacgucccuggcuuccagacagaaaucaaggggccugaaucuuucaaaaaaccuuuucuuauccauagagucucaaaacugggauucaagaaauagguaaggccuguucuucauaugccaggcacacaagcggucagaacacuauauacauaauaaaaaaagaaaucuuaaaaaaauaaaauagaaagcuuaaaaaaaaaaaagacaagaauccuccaggugaagaaacuuguuaaacugcacaguuggugaagucauaauuuaaaacaaacccaccuagcuccaaaagcacccucccgcacagcccacagcacuccacccgaacgaaauguggucaacagagugcacuccccacagagugagcacuggaaaagagacucuuaacaaaguuccagaggaggaggagagcagggaagacggcgugggccaggcauguaguggaugccuacaauccggacauuuagggaacagaggcugaagauggcaagcuuggcucacuaugggcuacacaacaagacccuggucuuugucuuuuucuuuaagguaguagggagaaaaauucugauagaagugucaaagaaguuauuccuggcagauggagacacauggacuggguacaguguaaaggccaggaaugacagcacuaggugggaucacggagccaugaagggcgggacacauggaacaugguggcagugacgcuggcuaaugguggcugagcugguuugguuuuuuuuuucuuuuuuuacgaaagcuugugucaucugggaagagggaaucucaaugaagacaaagccuucgucagacuggucugcagccaagucuggaggcccacucucuugauuaacacaugacgcagaagggcgcagcccccuguagauaacagacugaccacaguacaaaugagucccuccacgaucucugcauugccuguugcucuggcuucccucaaugacagacgcuaacacgcaaguucaagugaaaugaacccucuccuucccaagccacucugucuuaaguguuuuaucacagcaacagaaaacaaaccaggagccgggcgugguggcgcaugccuuuaaucccagcacuugggaggcagaggcaggcggauuucugaguucgaggccagccuggucuacagagugaguuccagaacagccauggcuacagagaaacccugucucgaaaaaccaaaaagaaagaaaagaaaggaaagaaaggaaggaaggaaagaaagaaaggaaagaaaggaaggaagagagacaacaaaccaggacaaggaguaagcuuaggccagggccagaaugcaaaguacuuuuugcacaccgaaguaaagaggaggagcuuaaaacaggggagaaccacaguauuucuaaaggcagagccccacuacacagaccaggcuggucuggaacucaaaacacugccuugggacccaagagcuuggauucuugguucaccauugugcucagcuagggcagagcguuuacuaggaaaacauuuuaaccgcagcaugguagauggaagcaagaagagaaaaccuggcuacuucauucauccuacagguaccacagcaugguaaguaaccacacuaccucaagugcuggagauacaaaaggcaaugagacaaguccuuguucucagaacaguuacgguccugggacaaccagacaaaacaaaacaagcaaaugcagccagugucagagucaagcacaggcggaugagaugaaggagaggcggagucuuuaaaaaaaaagacauugaagacaaaaucugaaggacaaaaaaaacaaaaaaaaaaaaccaaaacaaaacaaaaaaaucacuaaagggagcaaggagagggauccagaaaugcaggcaagcaccugugugugcaaaggcccagaagcuaaaaaggaugcaucacguccagaugucugguaaaacgcucaucuggccaggcggugguggcgcacgccuuuaaucccagcacuugggaggcagaggcaggcggauuucugaguucgaggccagccuggucuacagagugaguuccaggacagccagggcuacacagagaaacccugucucgaaaaaccaaaaaaaaaaaaaaaaaaaaaaaaaaaaaccaaaacaaaacucaucugccaggcgcugaggcacaggcccuuaaacccagcaccccccagagggcagagcuccaggugaggcaaugcugcauagggaggcucugccucaaaaaggaaagagacagagagagagaagaagaggaaggaggaaaaagccaacgccaccgucuucuggucucugugggcaucugcacucaagugcacauaccuacacauaaacuuuuuuuuuuuaaaucuuuagaaacugaaagccuagccagaugagacaaagacucaguuuaucaagaggcucuucacauaagagccaauaugaaggcaauaaacggauaagauaugaacauaguacuugaguauggggauuucaagagaaaacuaauuuacagaugguaaggcaggacuagcucaaauccuccagugcuuacccugggauucggcuauucaguaagcuguaacgugaacucggugaguccacagguuucuauagcacuauguguucuauuaggagaacgggucgcagcacgcuuugacggcugcacaaaucaaaucaaagcaagguaugucacucugggauguguggcugcuaagacaaaggaggagagaauaagucugucagugucacaacaaauagaguucauuauggggccaggccagaguucucagggaaaaguccagaccugggccuccaaguccccucaaauccguuuauauagcaggcacauucacuuacugaagaaaagaugggcccugcggcuguguuaaauagacaggacaugacucagauguaagaguaagucuuaagcacucugcccucaggcugcaggcugccccugccuggcacacaggagaagaaacucacacccuacaccggggccuucaccaggcagcacagcuucaggacaggaacaucuguuuuccauuuucaccaaacgcugagagaagaagcuauuuaaaaugucaccuauuuuuuucucugcauagguugcuauuuuuaaaagaaugauuacauacagucuaugaauuuaauacuguggguacuuuaucuccgcaugucaguaaucaaaaccaaacaccauccuuaggguuuaugucuaaauuacacaaaggaauacaucccucuuuaaucuaugcuagagugcagggcugcuuugagauguggcccuggcuagccugucugucucuggccagggcuccaccaccaugccugagucagaguggaucccaaugucagucugcucgcucacaaaggcccaagguuguguaaagggcagucacuaaacugaguucuggaaggagaggaccggccuuccucugcacuggcucugcaugguguauuauuucuaagaguaaacagaagguaagggcagagucccagaaaagaugucuauacacccaaacuccgucucccauggguguauacggagccaacaggacaggcaaacacgaacugagggagacagugaagcaaacaagagacaggucuccucuaggcauaucuaaauuaacugcacauacgccaugcccgcggugcggccacccuggaagcugaggcgaagggaucaacuuuaaaacccaggaggcacuggggauucaguuggguggaguacaugccuagccuaugugaaggccaaggguucagaaccaccuaucaaugagcacaggaggcuguggcuagcugggccacaaaaaagguaacgucacauaaauacaaaugccugaguggggaggggcuagagagguucucucagcaguuagggguauguacuguucuuccagaguucaagucccagaaggcacagcaagugguucacaaccacgcguaacucuaguccaggaugaucgucaccucuaccuucuaauuaaaaacaaaacaaauaguuuuaaaaauaguaaugaugaugacuaugcagcccuggcuggccuggaacuugcuaaguagaccaggcuggccucaaaaccacagagauccaacugccucugccucuugaguaccaggaauaaagauguacacaaggccuagccccaaaacaauuuuuuuaacuuauuacacacacacacacacauauuacauauauauccaaauaaacuaguucauucaauugcugaaacaaguuauccugaguucacauccugcagggcccugccacuuacuaacuggggauccuugaauaaaugacucaaccacuguacuucauuucuuuaucugugaaauaggacgguaaacagcagaucuucuucauauaucugcuacucaaaaaaguagcuauugcacgcagagugcuuccagaagagaacguccucaguauuccugcuccccagcaaagacaaaaacuuccagccucagcauccugacaucgccuuacgcagcuuaaaagguggcacugcaucuuuguagcaucaggcuagcagcccaccgguacaaauccuccaucaaucacagggccaaucgcagggauccgacgagcauaacaguauuuuaucaggcgucagggagaguugaagcacauucaugaaccuuuacaacacauaugagauagguacucuuacuaccuccacugagcaaugagaaacugaggugcauagaacuaugcaauuaagaaaggucaaacaagucgggcagugguggcgcacgccuuuaaucccagcacucgggaggcagaggcuggcggauuucugaguucaaggccagccuggucuacagcgugaguuccaggacagccaaggcuauacagagaaacccugucucuaaaaaccaaaaaaaaagaaagaaagauagauagguaagucaaacagccacaguugggauccaacuagcaagcuagcucuguguaucaguuuuuguucuuuuguuuuugaaacagguuccaaguagccuaggcuagccucaaauacguuauguaacuuaaggacaguuucgaacuccugauccuucugccuccauggucgaauacuaaagucacuaguguauaccagcucaauucucuuagcugcucaacauucaacguacugcucuuuucccccuuuuuucucucucuuucucuucuuuccucagaaacagggucuauguagacaaggcuggccucaaacuaccaauccucuuuccucagccuccugcaugcuagaauuauaggugugugcuaccgugccuggcuaucacacaauucuaacugauuacaauucccaaggaaccauacacacaaauucucuucagggggaaaagaaaaaggguucccaaacuucuagaaaggaaucugaagcugaaucuccucaguccuugagccccugggcacacugcagcuagacuagcggcucugacugaaggccuccgccucgagugaacguuuggugguaggaauaugcaugcagcgaacaagacaugauuagugagagcaucucgacaaagccagaccucccgauccacucaucacacacaagcaggcccccacauacacuuuaauaagaaagcugauuccaccgggcacagugcugcacucccguagacccagcuacuugagaugcugauguagaaggaucacucgagccccagagucugagguuagcccaggcaauacagcaaaacugccucaaagaagaaaagagaaaaacagaccaaaaaaaaaaaccucacaagcuggccacagucauuuaugucuauaaucccagcaaccuggaggaagacacaucaggaaaugaacggccauuaaguucaagaccagccugaguuuuacaauggguucgaggcuagacugggucagagugaaacugucuucuuaaaaaacaaaaaagcuaauugggggcuggagagaaugcucagcaauuaagcguguuuacuguucugcagaagaccuggguucaguucccauaaggcagcucucagaugccccuuucugcagucugagagcuccugaaaacacauggugcacauacauacucaggcacacacaaacccaugagaaauggcuuagcaguuaagggcacuagcuggucuucuagaaguggguucaauucccagcgccuacauggcaccuuaucaccaucuggaacuccagauccaagggauaggauaccucuucuggccuucaugggcacuaggcacacaucugguauacaaauauaucugcagccaaaacacucacaaacauaaaauaaaaauacuuuaauuacaauauuuaaaauaaacuaagcuaggcauuguguguucaugaguuuaaggucagccugaagaguucuaggccagccagaacuacacaguaagacccugacucaaaaacaguaacaaacaaacaaaacaaaucaaaacaaaaaaaccccacuaacaacaacaaaaaccucaaaugucagaggcaggcucacaacucuaucugccccggggcagcaacauagugaagacuguauuaauacucucagccuucaggccccuuucucuccagcaguaaguucacuacauggaagaccaggcucccucugaguacagagauugccuuuucuuuuuuaaaugagaucugcuaaagcacauagaaaagaugaagagaaugcuaaccagaaaagggcacguucuguaauuuuuccugccucuagcucaccaauacagcugcaaagugacauguuuaugggggauugucagggauaaagaguguucacaacuuuccccaggucacacugaccccugcccauggaagcucaucugaguccuagcccgacuuucccucaccugggacacagcucccccaggccacaaccaaggaacaccaauaacaucuucuuaccaaaaaggaaaaaaaaaugccaaagcagacaugcaccaggagugaauucgggagcugcucauagaaaugaccuaaacgucggugaaccccaucagaaaguugauugugacuccccaucgucugccacccaccgcaggucuacuacuuccaggcagaauggcacauuugacaacuugagggggaaaauggaagaagacaugguaacacaaacagggagcugcuuugugacaagaauccgccagaauacuuucagcucacucugcauagagaguuccaggccaggaagagcuacccugugagacccuaucucaaaaaacaauaaacaaaacaauuaagaaaggaagacuauuuuuaguggaccgucuacuugcccagaguuguuuauacagcugaaggcaagcaacacucaacucuacaccagcucccacaagguagccagcagucuuaccaaacaccaacuaaagaucacagucaaaacaaaaaacaaaaaaacaaaaaacaaaaaccucuguagaagagcaagcaaacuucucggauuaacugauucaccaaauccauggauccucucccagggagauuaucgcucaaaacccugccucugcaaaccaucuuacccgcucugggguugggcuggggcaaguugcuaccucuucuuuccaagcaggcaaugugauuucuuccagucccuggggcccuugggucuucaagcugaaaugggggcagacguugcuauaggggcuauggguaaggcuaaucuaagccuggaagagggucacacgacuggcuucgguccccuccuugggagacccgcccugcacgcuccacaucucacuccuaccccuucccgacuacgagagccaucuccccucccaccggccugggggagucaggccucugccucgcgcuccaggcuuccuuacucugagagaaguaacuuuuucaauccgugagcgauugcuccuccagaagccgaaccacaccuauuucuggcuaccccccacccccgccccaucuccuccccuagggcugccaccaaauuccaggcucccuccccuccgcccccaucggcauuuuuuuuucuuuccgccuccaacccuccuccauccuggcauccuaguucuccaccucggagcuguucccucccuccaucucuacuccaugcuagaguuccgcaaacccccucaacucucgccacccagcgcgacuacucaaaaaucccacaacaaacuuucugccggggccucuccuucaggcagccaucuugccgcggggcaggccggguaggggccuggaccg

SEQ ID NO: 8641 - RNA, 25311 nt, Mus musculus
cgguccaggccccuacccggccugccccgcggcaagauggcugccugaaggagaggccccggcagaaaguuuguugugggauuuuugaguagucgcgcuggguggcgagaguugaggggguuugcggaacucuagcauggaguagagauggagggagggaacagcuccgagguggagaacuaggaugccaggauggaggaggguuggaggcggaaagaaaaaaaaaugccgaugggggcggaggggagggagccuggaauuugguggcagcccuaggggaggagauggggcgggggugggggguagccagaaauaggugugguucggcuucuggaggagcaaucgcucacggauugaaaaaguuacuucucucagaguaaggaagccuggagcgcgaggcagaggccugacucccccaggccggugggaggggagauggcucucguagucgggaagggguaggagugagauguggagcgugcagggcgggucucccaaggaggggaccgaagccagucgugugacccucuuccaggcuuagauuagccuuacccauagccccuauagcaacgucugcccccauuucagcuugaagacccaagggccccagggacuggaagaaaucacauugccugcuuggaaagaagagguagcaacuugccccagcccaaccccagagcggguaagaugguuugcagaggcaggguuuugagcgauaaucucccugggagaggauccauggauuuggugaaucaguuaauccgagaaguuugcuugcucuucuacagagguuuuuguuuuuuguuuuuuuguuuuuuguuuugacugugaucuuuaguugguguuugguaagacugcuggcuaccuugugggagcugguguagaguugaguguugcuugccuucagcuguauaaacaacucugggcaaguagacgguccacuaaaaauagucuuccuuucuuaauuguuuuguuuauuguuuuuugagauagggucucacaggguagcucuuccuggccuggaacucucuaugcagagugagcugaaaguauucuggcggauucuugucacaaagcagcucccuguuuguguuaccaugucuucuuccauuuucccccucaaguugucaaaugugccauucugccuggaaguaguagaccugcgguggguggcagacgauggggagucacaaucaacuuucugaugggguucaccgacguuuaggucauuucuaugagcagcucccgaauucacuccuggugcaugucugcuuuggcauuuuuuuuuccuuuuugguaagaagauguuauugguguuccuugguuguggccugggggagcugugucccaggugagggaaagucgggcuaggacucagaugagcuuccaugggcaggggucagugugaccuggggaaaguugugaacacucuuuaucccugacaaucccccauaaacaugucacuuugcagcuguauuggugagcuagaggcaggaaaaauuacagaacgugcccuuuucugguuagcauucucuucaucuuuucuaugugcuuuagcagaucucauuuaaaaaagaaaaggcaaucucuguacucagagggagccuggucuuccauguagugaacuuacugcuggagagaaaggggccugaaggcugagaguauuaauacagucuucacuauguugcugccccggggcagauagaguugugagccugccucugacauuugagguuuuuguuguuguuagugggguuuuuuuguuuugauuuguuuuguuuguuuguuacuguuuuugagucagggucuuacuguguaguucuggcuggccuagaacucuucaggcugaccuuaaacucaugaacacacaaugccuagcuuaguuuauuuuaaauauuguaauuaaaguauuuuuauuuuauguuugugaguguuuuggcugcagauauauuuguauaccagaugugugccuagugcccaugaaggccagaagagguauccuaucccuuggaucuggaguuccagauggugauaaggugccauguaggcgcugggaauugaacccacuucuagaagaccagcuagugcccuuaacugcuaagccauuucucauggguuugugugugccugaguauguaugugcaccauguguuuucaggagcucucagacugcagaaaggggcaucugagagcugccuuaugggaacugaacccaggucuucugcagaacaguaaacacgcuuaauugcugagcauucucuccagcccccaauuagcuuuuuuguuuuuuaagaagacaguuucacucugacccagucuagccucgaacccauuguaaaacucaggcuggucuugaacuuaauggccguucauuuccugaugugucuuccuccagguugcugggauuauagacauaaaugacuguggccagcuugugagguuuuuuuuuuuggucuguuuuucucuuuucuucuuugaggcaguuuugcuguauugccugggcuaaccucagacucuggggcucgagugauccuucuacaucagcaucucaaguagcugggucuacgggagugcagcacugugcccgguggaaucagcuuucuuauuaaaguguaugugggggccugcuugugugugaugaguggaucgggaggucuggcuuugucgagaugcucucacuaaucaugucuuguucgcugcaugcauauuccuaccaccaaacguucacucgaggcggaggccuucagucagagccgcuagucuagcugcagugugcccaggggcucaaggacugaggagauucagcuucagauuccuuucuagaaguuugggaacccuuuuucuuuucccccugaagagaauuuguguguaugguuccuugggaauuguaaucaguuagaauugugugauagccaggcacgguagcacacaccuauaauucuagcaugcaggaggcugaggaaagaggauugguaguuugaggccagccuugucuacauagacccuguuucugaggaaagaagagaaagagagagaaaaaagggggaaaagagcaguacguugaauguugagcagcuaagagaauugagcugguauacacuagugacuuuaguauucgaccauggaggcagaaggaucaggaguucgaaacuguccuuaaguuacauaacguauuugaggcuagccuaggcuacuuggaaccuguuucaaaaacaaaagaacaaaaacugauacacagagcuagcuugcuaguuggaucccaacuguggcuguuugacuuaccuaucuaucuuucuuucuuuuuuuuugguuuuuagagacaggguuucucuguauagccuuggcuguccuggaacucacgcuguagaccaggcuggccuugaacucagaaauccgccagccucugccucccgagugcugggauuaaaggcgugcgccaccacugcccgacuuguuugaccuuucuuaauugcauaguucuaugcaccucaguuucucauugcucaguggagguaguaagaguaccuaucucauauguguuguaaagguucaugaaugugcuucaacucucccugacgccugauaaaauacuguuaugcucgucggaucccugcgauuggcccugugauugauggaggauuuguaccggugggcugcuagccugaugcuacaaagaugcagugccaccuuuuaagcugcguaaggcgaugucaggaugcugaggcuggaaguuuuugucuuugcuggggagcaggaauacugaggacguucucuucuggaagcacucugcgugcaauagcuacuuuuuugaguagcagauauaugaagaagaucugcuguuuaccguccuauuucacagauaaagaaaugaaguacagugguugagucauuuauucaaggauccccaguuaguaaguggcagggcccugcaggaugugaacucaggauaacuuguuucagcaauugaaugaacuaguuuauuuggauauauauguaauauguguguguguguguguaauaaguuaaaaaaauuguuuuggggcuaggccuuguguacaucuuuauuccugguacucaagaggcagaggcaguuggaucucugugguuuugaggccagccuggucuacuuagcaaguuccaggccagccagggcugcauagucaucaucauuacuauuuuuaaaacuauuuguuuuguuuuuaauuagaagguagaggugacgaucauccuggacuagaguuacgcgugguugugaaccacuugcugugccuucugggacuugaacucuggaagaacaguacauaccccuaacugcugagagaaccucucuagccccuccccacucaggcauuuguauuuaugugacguuaccuuuuuuguggcccagcuagccacagccuccugugcucauugauaggugguucugaacccuuggccuucacauaggcuaggcauguacuccacccaacugaauccccagugccuccuggguuuuaaaguugaucccuucgccucagcuuccaggguggccgcaccgcgggcauggcguaugugcaguuaauuuagauaugccuagaggagaccugucucuuguuugcuucacugucucccucaguucguguuugccuguccuguuggcuccguauacacccaugggagacggaguuuggguguauagacaucuuuucugggacucugcccuuaccuucuguuuacucuuagaaauaauacaccaugcagagccagugcagaggaaggccgguccucuccuuccagaacucaguuuagugacugcccuuuacacaaccuugggccuuugugagcgagcagacugacauugggauccacucugacucaggcauggugguggagcccuggccagagacagacaggcuagccagggccacaucucaaagcagcccugcacucuagcauagauuaaagagggauguauuccuuuguguaauuuagacauaaacccuaaggaugguguuugguuuugauuacugacaugcggagauaaaguacccacaguauuaaauucauagacuguauguaaucauucuuuuaaaaauagcaaccuaugcagagaaaaaaauaggugacauuuuaaauagcuucuucucucagcguuuggugaaaauggaaaacagauguuccuguccugaagcugugcugccuggugaaggccccgguguagggugugaguuucuucuccugugugccaggcaggggcagccugcagccugagggcagagugcuuaagacuuacucuuacaucugagucauguccugucuauuuaacacagccgcagggcccaucuuuucuucaguaagugaaugugccugcuauauaaacggauuugaggggacuuggaggcccaggucuggacuuuucccugagaacucuggccuggccccauaaugaacucuauuuguugugacacugacagacuuauucucuccuccuuugucuuagcagccacacaucccagagugacauaccuugcuuugauuugauuugugcagccgucaaagcgugcugcgacccguucuccuaauagaacacauagugcuauagaaaccuguggacucaccgaguucacguuacagcuuacugaauagccgaaucccaggguaagcacuggaggauuugagcuaguccugccuuaccaucuguaaauuaguuuucucuugaaauccccauacucaaguacuauguucauaucuuauccguuuauugccuucauauuggcucuuaugugaagagccucuugauaaacugagucuuugucucaucuggcuaggcuuucaguuucuaaagauuuaaaaaaaaaaaguuuauguguagguaugugcacuugagugcagaugcccacagagaccagaagacgguggcguuggcuuuuuccuccuuccucuucuucucucucucugucucuuuccuuuuugaggcagagccucccuaugcagcauugccucaccuggagcucugcccucuggggggugcuggguuuaagggccugugccucagcgccuggcagaugaguuuuguuuugguuuuuuuuuuuuuuuuuuuuuuuuuuuuugguuuuucgagacaggguuucucuguguagcccuggcuguccuggaacucacucuguagaccaggcuggccucgaacucagaaauccgccugccucugccucccaagugcugggauuaaaggcgugcgccaccaccgccuggccagaugagcguuuuaccagacaucuggacgugaugcauccuuuuuagcuucugggccuuugcacacacaggugcuugccugcauuucuggaucccucuccuugcucccuuuagugauuuuuuuguuuuguuuugguuuuuuuuuuuuguuuuuuuuguccuucagauuuugucuucaaugucuuuuuuuuuaaagacuccgccucuccuucaucucauccgccugugcuugacucugacacuggcugcauuugcuuguuuuguuuugucugguugucccaggaccguaacuguucugagaacaaggacuugucucauugccuuuuguaucuccagcacuugagguagugugguuacuuaccaugcugugguaccuguaggaugaaugaaguagccagguuuucucuucuugcuuccaucuaccaugcugcgguuaaaauguuuuccuaguaaacgcucugcccuagcugagcacaauggugaaccaagaauccaagcucuugggucccaaggcaguguuuugaguuccagaccagccuggucuguguaguggggcucugccuuuagaaauacugugguucuccccuguuuuaagcuccuccucuuuacuucggugugcaaaaaguacuuugcauucuggcccuggccuaagcuuacuccuuguccugguuuguugucucucuuccuuccuuucuuuccuuucuuucuuuccuuccuuccuuucuuuccuuucuuuucuuucuuuuugguuuuucgagacaggguuucucuguagccauggcuguucuggaacucacucuguagaccaggcuggccucgaacucagaaauccgccugccucugccucccaagugcugggauuaaaggcaugcgccaccacgcccggcuccugguuuguuuucuguugcugugauaaaacacuuaagacagaguggcuugggaaggagaggguucauuucacuugaacuugcguguuagcgucugucauugagggaagccagagcaacaggcaaugcagagaucguggagggacucauuuguacuguggucagucuguuaucuacagggggcugcgcccuucugcgucauguguuaaucaagagagugggccuccagacuuggcugcagaccagucugacgaaggcuuugucuucauugagauucccucuucccagaugacacaagcuuucguaaaaaaagaaaaaaaaaaccaaaccagcucagccaccauuagccagcgucacugccaccauguuccaugugucccgcccuucauggcuccgugaucccaccuagugcugucauuccuggccuuuacacuguacccaguccaugugucuccaucugccaggaauaacuucuuugacacuucuaucagaauuuuucucccuacuaccuuaaagaaaaagacaaagaccagggucuuguuguguagcccauagugagccaagcuugccaucuucagccucuguucccuaaauguccggauuguaggcauccacuacaugccuggcccacgccgucuucccugcucuccuccuccucuggaacuuuguuaagagucucuuuuccagugcucacucuguggggagugcacucuguugaccacauuucguucggguggagugcugugggcugugcgggagggugcuuuuggagcuagguggguuuguuuuaaauuaugacuucaccaacugugcaguuuaacaaguuucuucaccuggaggauucuugucuuuuuuuuuuuuaagcuuucuauuuuauuuuuuuaagauuucuuuuuuuauuauguauauaguguucugaccgcuugugugccuggcauaugaagaacaggccuuaccuauuucuugaaucccaguuuugagacucuauggauaagaaaagguuuuuugaaagauucaggccccuugauuucugucuggaagccagggacguuuugaguagugugguaaauggagagugacuccuuucuugugaugcagcaacagugggaaucccagugugaggaggagaagugcuaucccagagcagcuugugaggaucggauugcacugcaaccccacaucuccuuggggaacucuccggccacaccgagccgccccaguccuggggugugaucaguggaugguggauuguaguuacuagggcuuuggauggacaagagggucacauacaguaagugacugcauggagcuugucgcauucagguuuacucugcugugaugaaacaccaugaguaaagcagccuggggagggaggguuuauuuaagacuuacucuucuaccucacuguucaucaucaaagaaggucagagcucaagcagacuagggaccuggagguuaagagcugaugcagggucacaggggaggggcauguucgguugcuccucucggcuugcucugccugcuuucuucuuuuguuuguuuuguuuuuucgagauaggguuucucuguguagcccuggcuguccuggaacucacuccguagaccagaccuggaacucagaaaucugccugccuuugccucccaagugcugggauuaaaggagugugccacuacugccuggcucaaccugcuuacuuauacagacaaccagcccaggggugggaccacccacaggagccuaggcccuucccaccucagucacaaauuaagaaaaugugcuccaggcuugcuccagucuuauggaggcaguuucuuaauuuagcuucccucuccuacucuagcuugugucauguuaacaagcuagccagcacagagugcuuugggacucauguuuccuagugucuuagggacugaaaaauguccgggggaaaccagaggaauguaugcagcuauugaguaagccagacuuccaggccccuguggucuuagggcuuuggucuugugccacaggcucaccccugauccuccucugaaauggcugguggcugagucacccucuauucuuccaguucuuuucuacuguaguugcugggaauggucuguagguaccacuucugaacaaauaccaaaggaauugguuuuagcaguuagaaccucaugaacgguaugcaugguacuccagccugagccugcagucagaugaacaggacucccuauucucuguauggccacagauuccugccugagccaguuguuuguccucugugaucucgaagcaugcgccuuacugagucccuguuaaccugucuccccucugcggaagggaaggucugagucuaccaggcuggccuaaaacucagaaauccaccugccucugucucccgagugcugggauuaaaggcgugugcuaccacgcccggcuauaugauuuagcuuccuuaaacagugucucucaaccugugggucaagaccccuuugucaaguugaacaacccuuucacagggcugccuuccacuguaggaagacauggauauuuguauuacaauccauaaugguaucaaaauuacauuuaugaaguaguagcagaaguaauuuuacgguugguguuaguggagucaccacaccuauugaaggguugcagcaucaggaaggugcagaaccacacuuugagaccauugucuuuucuccacagucaaggguuggcuuuugaagcucaggggcaguagucagaguaauauggggagucucaguuaaugggcaauucaggaaucuuuugacguuugcauuuuuguggugcacgcugggggauaaaccuagggucuugcacaugcugucaaguacucuaaccuugggccaucucccuuuuuuuuuaaguuggaagcagagucuaaguugugcaggcugaccuugagccuuccugcuucagugugccagacacugggugauuccagacccacacugggggcggacagagacuguccuucccauuucgcuccagucacugcucugccuggcacuucugaagcagggccggggaccuccccacccuuuccugauguguuggaagugaguuuccuguccugcugccccaggggacacaucucuagacuccacuguuguggcuagcacugucuuccccaggaugucccuucaggcuuugggaaaguauuuuuuugugcuucuuagaacuaggguucuagcccggcaugguggcgcaccaccuuuaaucccagcacuugggaggcagaggcagggggauuucugaguucgaggccagucugguuuacagagugaguuccaggacagccagggcuauacagagaaacccugucuggaaacccacacacccccccccccccaaaaaaaagaacuaggguucugacagacuggaagagccccugucagagccuggggaguugugcugugccuggucauccucacucugugggguccucagagggcucuguaggucaucugucuggcagugugucaccuuuuccuugaguggccccacuuuggggcuucgucacacacugcuccauuguacuuguguauucugaugcagcucuccuccaggcucugacuccagcucaucucuuauaguucuucgcccagagccugugggguugggggguggagugcacucuguuggcauaggccuggaugaguggcaacugcaucugggggcaggggguuguucuuauaagccagugcucagaguccuggugcagccuggcagugcaguugggaauuagggagacagggagcugcuuuccacacaauagcugccuucucuugaucaaccagagagccuugugugaauuaguaagcuggacucacuguuggcaaggugggguguuggucuuccuccggagugcuuucugguggcgggaagccccugagaugcuuucgcccacaaaagaguacuguaugugccagaggcauccuucaguuuggucuucugugcucucucuuugcagcuccggaguugagcugcucacacaccaagcugucuguuuuuauggagugccuggagggcgucugccaugagucuguugcuaacaccacuaaccaggaaagcuggcuggcugaggagaagacacuaacccugugagucugaccuuggcuagcuaaccugcccuggggggcugcccgcagugucucuaccagacugacugccuccuuugcuuaggcuugccaccucugcuuucugggucuuuuccuuucaucuuucccucauguggagauauagauaccuccauggucuuuguuccuuuucuguugcugcguaaaucaccaugaccaaggcaacucggggaagaaagcauuugguugaggcucuagucucaggguuggagucuaugacuguggagugaaagaacagcugagagcucagaucuugauccccaaccucgaggggagggagacggggagugacaaagagguaaacagacaaacacacagcaacagccucuaggaauggugagauucacuugaaaccacaaagcccacccgguaguugucaaggccacaccaccucauacuucccaaauagucccaccaacugggaaccaaguauucaaaugcaugccagucucauucaaacagccacacucuugaugggcagaagaaagaggccugcuacaggacucaugccucucucucucuuucacacuggacaccucagcuucccacaaacccgaauuggcugcuggcucuguucuguucugugcuuuuagcagcaugagcuggagacucccucagcuaccacacuauccguacgucccugccuuggaggcagguggaggucugagaauacccuagagggcaaguguggcuggucccccccauuauccacucagaauaaaaagugagguucacuucuugguugggagauuaaggcuucccuuggucuggcucuggagacuucuuggccagagugugaaguaaaaugaacguuagggucggggcugugugugaugaugcaguucccagucacccuugcucugagguggagcuuggucccuuaccuguguccacauggagucucagguggacuuuagccgagaaucgggaagggcgucucggcuagaccggccgggaucuggcuuuggauucuugaggcccaggaaagguccuggccuccgugggugauuggugagugugguccgguaaggagcugcucccuaggcucgauccuucaugcuugggacagagaugggaugccugacagucucuagaccuguuaguuaccuugcucuccuggcaguccaguggguagcucuacacaaacugucuccaggcucgggaggugagcccucccggcagauucuguuccugguggcugagagggagaagacugggcugaggcugcagugugggaagggcguguggguaugaggggcauagguacuucagggugcugaggaaauggaguagggagugagcaagcuggacgggguuggccucgacucugacuagaaagccaagaggagcacuggccagggccauggcuugacuucccccccuuagagagggcacagcguccaauggcaagggcaggcgugggcugggggacgcuuggcucuccaucagcagucuuuuacuccuuuguucuugucacguguuugcuggaugaggcccgacagauagucuguuuguucagguggggagccaggugaguucucguggucaccagcacuaguucugagcugcauggcuacucugguuagaacgagucucucccuuuuggccuucagagcccugucaguguauucagcuuaguguaggcagggggccagcucagcugcaggcagcuuaucccaacagggugagguuguacuugcccacaggcaugaauagcuauuggaggggcagcagggcuggucugggcacagacuggcaucgucuaccgcacucaucagcccagagcagcaccuuugcccaggacccacccugugagcugcuggcugccugccugccugccacgcgcccaggauugcugagggcuuugcucauguaccucggggacagcugcaugccggaaacugggggcugagcaaacgagacggggcaggggugcaguggggaaggcuaaauccagcuuugguaggaucaugaauuguguuaaggaccgcucucuucugagcagacaggguggggcuguauuguaguguggagaggugaggaucuucaugggcaauucuuagggcuauacuguugggucuguaggccguaggcuuggcccuugcagcauggugguuuguguuuggacgcucucacuggaggcagagccuagauuucagaagcugcagaaccauccaggcuugcacggcaagcgugaugucuacuucugugaugugcaacuucccaggguugcagaugucagaaauuggaucuccaaggcucaagaaagucaaggagagguaccuuguuuccugugugaucaggaugcugugauuugggcuggugggggcuuugagaaggacauguguuuauuaccuauuuauauccugcuagguccaggaauuaaggcuguauacauagcucagcugucuucucaagucgggaucaguuuuccuuucacuuagaaagcaacagcgauuacuaacuucucuuggaaccguucugaagaaaaacuuuaaagauucuuguagugugggcucuacccugauccaaaaggcucacugccccuucaaggacgcucacuaacuuaguucaucggcagcugugagcagacgauuucaguagggcuuaacgguugucugagcccacauuaaugauacccucuccuaaaggaggugucugugacguggguaguagggagauagucucaguggguagggugcugcucugggucagugaacuuguucacacugauagugcagaaccugaggagcuggaggaggcuucugguggggcaaggcuggcaggcaaagaggcagagagcagcaucuacgaaggagucuguccugcuuccucugcucugugugugugugugugugugugugugugugugugugugugugugugugugugugagugugugagagagagagaguaugugugugugugagagagaauguguguguaugugugugaguaugugugugugugugugagugagugugugugugagagagaaugugugugugugugugagagagaauauguguguaugugugugagagugugugugaguaugugugugagagugugugugugugugaguaugugugugucaguguguguaugugugugugugaguaugugugugucagugugugugagagagugugugugugaaggauggugaucucugacuccuuucucuucugccccuugaccuugcugggcccuaggcagccgggaacagagcguugcaggccugggcucucucugcuggcuagugucccuuggggauauuuguuagaacaaggguagaaguuugagugaguuggggaucugaaucgguuucuuuucccaccgucuccagcaacaguggccucuggcaucaguggaagccccuggugguacccacccagaaagggggacagacgugagucccaucccuggcugacaguuggugggcugcuuccggucaggugcccugugucuuaucugucaguacucugcucagcugcucaguggguucgcagugcagguccucugcgugcugagucccauuucuaaugaaaguagacuuuguucucugaaggcagcuaaucgugccccaugggcuguaaucagggagaagguauuuaauacagggcagguggcaacaggcggccacauugacuggcagauugcaacauagcaauuaguaagugcuaucacccuccuccucagcagauaugagguagucuuuccucugaacugauuuugaauagugaagaaugaaugcuaugugacagaggaaggagacagggucagcuagggagggguaggggaggugagggugaggagagccccuucuccucuugcuucaggguauuugggugucucccacuguugggucagccagggguucugcuugggcacagcuccuuuaguauagaccuagcaagcaagcuguggccucuauccugagucaccugguccugacuccuagggaccagggagggacagggaguagaauucuucccuguuuguugccagaucuuccucagagaaucuccuuggcgaauagaggccacgaggcuggccuuggccguggcuugcuagugaugacccaaggacccuucucagcucagggcugaacucuggaaaacguuuagguagaguuaugcucagucgacgcagcaacugguagcugaggcuccugguguaagugcucugauggcuucuaacucaccguguuauccucucccagcuggggaccaccagguccaaauggaccuuguucuucccaggccuguccuauaguccaggguagugaugcuaggcccauagucuguccagugcggucccucacgggcaagauccagggaagucaguagauuguggaaauggaagcagagguucaggugucccaacaugcccugauauuuauggaccugggacagggaguggcacagaucugccucgaggugugggguuggggaacccaguagguucucaguguucucaguggaucaccccugcuucucuagucaggaauguuucuccccucgugacacugcuagaaguaaccuuucaccccaccuccauccuuagagucucaucugcucuuuguguccucgccacacccacaccaucccccaacccagacaucuguuugauugccucuagccucagagaagaaaaaaugugcucauaguugcagcccugacuuaccgucacggcagggcaagcuauaggauauggcaccucagugaggcaugucugcccacauauagaauuacccugaaagugucucaguccgcccugccuguccacuguugucacaagugcccuggucccuagaagagaaugcgagccuuggcaggaguuggguagguaaguaaaacaggcuaagguggcaaaucacaccagggagccugccaagugaaggguuccucugccuucuggaacagacaaacaaaaagugccaucgagagcuggcccuguggggagaaggccagcuccuggaagcucccaucaguuucuagaagcuuugccuggcuccucuuuagucaacggccuugguccuaccugguuucccaggcauacacacccacacauccacaccuucaaauguuaggcccugguuaaccuacagugcucugggacuuuucuagguccccucccucaggccacaggagucucugugguuagaucccuacuccagguugagcaccuacuggggcgaggcccucuggaggacagccccugugguuguauguuguuuguucucucaccccaggaaugugguguccuuucuggcccucccagauuccugugcagggagucagccugacagcaugcugcuugugcccuguggggacacguucugccuccugucaacggggcggaggcugguggcucgugcuucacuauuacaagcucucccccaaauccaggccaggaaccuuagagaggagaguccuacuccugcuuccccgcccuccucugcccccacccugcugccccaggccugcuggaaugugacaggagucauggccagggcaugucccaacaguaggaacacaugcuuuagcccgcaagaccgccuucagcccccagcucuguagcucuguuuggguugauggggguaggaagagguuuguauuuuuuuuuuuuaaaugcucagaaagccaccuaggguuacuguuugcacugaucacuggcggcugcugcccccaugcggcagcccagcuuauuacagguacgccucaaucccgggaagcugaggggacuuggcagcucacuuggcccagccauuggcagugguguguguagagcaggcuuuggcaguggggagcacguuauccaagcgcuuggagaugcuggagcagccuugggccucagcuccccgggcucgggguuaaauguuuucucuuuugagcgugugucgguacuuacuuaagcacagugugcuuguggaggucaucaggcuuugcagcaagcaucguuaccuacugagccuucuugccagccccccacaguuacgguuuauagacuagcgguucucggccucagggcuggugaccuuugccuugccaccuccgguaugcuggcugcccugugugugguagguuuagucgauauucugacuuugacucaccgguaguaccuccccaucugcagauugugaaaauuaaaaaugucucuagacauuugccuguuaacccugggagaagcaggggguaaacucacccugguugagaaucacugcucugaacugcugagguuuggauuuuguuucucgggucugccuucgcucauuggcaaguuuauuguacacugugguacacagaaauggucucugggcucauuuagucauugcuagggggucugccguaccaucgucaucuugcuccuuugccaggcccuuuguagucucauuuguagucugcauuccccaggauucccagcucucuguagacucugagaagccuaggagugaaugggacacagaccaguaccggccuauuccagagcaggguaugugcugagcggaggcagcguacgaaguacauacauaaacacgcaggcguuguuaggggaagccagguacucguuaaugcuagcugguuuccuuuuugaguugauuucacuucauaaagcaggcuacucucagacuauugaucuuccuaccucugucgcuugcuccuaagacccacugugcuguggucucuuugcuuacuguuuucugggagccuucaggucccagacuggacaggcaggcagcugacaccggguuuccacuuucuccccuucucugguuucaggagcucuuggcuagaggaaguagaggggccgugggauguggagagccgaaggcugauuccaggagagcagaacagagagcugccagcgaacagacgguaugucccgaugaggccugcauucuauacuuuguucucuucugggaggcugguaggugagcagccauauaggugcucucuuccagugggagccagcacagaaaggagguguggccaaaggggcuuggccuuuguuggcaguguccagagagcacucucaagcuuggagacccuuauccaggagccugggcugggucgcuauccccagacuuagaagauuuguucacaauuuauggaaggaaaaccugaacuuaacauugccuagugcugagcacuguuuuuguuuuagacagucucgcuauguagcccaggcuggcaucugccuucccagugcuuuagauugcaacugugugucacuggcagugucucucuguuuguuuguugaggcagaguuccaguguguaggauuggccugaggugcacuguagaccaguccuggagcuuccagagguccacucugccggccuaauguggcagugcccuuguggaccaauggagucugcacagcagccuaggaacugcugcugcuuauacccucaccuacuugagcaagauggaugcugugcagcucucugccuacaagggacagugugggcugcuguugagucucuccaccccacuuagccaagugugcuccuccuggggcccagcugggagcccuucucaccugucuguucuccauuggauucuagcccucaucuccagcacuccccugauccauccggccugacucaccagagagcagcccucuaaugacccagcgguagcucaggucuaucugccuguggggucaguacacaucccuggucaucuuugaauguucaggccagagacaccuuagaacgccucucguuaguuuauuuucugugugaggaaguggguaggcacggguugcaugugccauagugccacuguagagaaagggauggcggggggguucaguugucuccuaauguaggaucugcuccuaagguggucaggagcaggaggugccuaacccaccgagccaucucaguggcccuuccaaggcucgagacuacaccucugagccugucucugcuucucucagcaggagacgagcccauaccuuccaggaugagcagugcugccccugcuaagaaaccuuaccguaaggcgccuccagagcaccgagagcuacgccuggagauucccgugucccggcucgagcaagaggucagcaaggcuggggucuggcccuggcuggcagaagcaggccccugaaggugucugucagcuggccucucaggccugaggugcugggcauggguuaaggcgagagacucacauugcugauagagcuguaguugugcuuggggguggggguggggggcuguguguauguguucacacgucagggagcauuagucuuugcagcucaacagaacugucacagccagucccaggugcugguggaggaaaggcguccagcuuuggccucuaaggaggcagugcucuaacugcugcccaccgcagcugcgcgucucugugcgcccuuccaccagcuugcuuuuguuuagcuaccuugauaacuucacacucugucaagaaccaugcuaggcuugcucucagacggccugugggccacugccagacacucuagcuuggcucucaagacugggcgguuaaucagcuuguuccuagcgccgucccccucccugugcacagaguggucucagcuguugaggaucagggcuauuagugagggaacagagguuccaugagauggagccuucacuguguauuguugaguagggucagauccagugaucaggcucuagagucugaucugagccauuugccucugugcuucuucaugaccugcgcuagacauccaaagucauuggggcaggggaucaaugcaagacacaaaaugguuuagugguacaaaguuauauuggaagauggaggcaggaagcuguaguuacuugguggguuugaauucaaccuagacugucugagaacaagcacucacucaccauccacaaagcccuuuagcaucuuguucccuagaggcccuccagccauucagguuggcuccucagucuccgagguccucuggagggccugagaggccuccgucaaaacucggaacuuucaguuuggcuugacucccucacuuccuuggaaaaucugugccaugcuuguaaggagcuugaccgacagcuaggugcuuuauccugggggauaggugacauggguaccugauccccuuugaagauggcuuuaggauuaaggguagauguuggaagggucuagaauuuucugguugacaggggaaaggguacuguaagcuuaccagauguuucuagauuucauccauuucuggagggccugucacuuuccgugacguggccuuuuccagggcucugagccaaccaggaggccagugcucuggagcugagucccaggcuuccccucuuuuuuuguccaggagucccugacugacgcagagcggaugaagugaguauuggcugcccgucccuggacugugugcugugcccuuucaaucccugcugggcucuggggacucccaggcuccuccucacaucuggccuuccagcuucuaacauuguggcauagugcugugaccugcaguuagaaccauacacuggaauuacaaacaauuacaagcaauuugcaggacaguguuccuuuuaacugaguuugugggguuuguguuggccacgggcaucccguggacuccucauggucagcagagguaaagcuuggggguggggcucuuuagggcucaugucagggaaagggguuuuauuugcuccaugaacugagggcccacccuuacaaagaguccuugcccagcugcuggcuccagaaaacagugaccagccugugccagcgucugcaugcccuuucugucaggcaugugaggccuccuggaggacagcagugcuguccuggauucccaagagauuaauaauggagaaggcugauugugaggggaaacaggagcuguagggcuuagugccugcuggccugggugguaaccggagacagucgggagcuaucgccuuugauucugacccagugcguuucuauacuggggaggggccaucuggacuauugugcgucauacacucggucccgucuccaucuuaggcuguucucgaggccagagggccuguauauugcgucuccuuaccuagacugagccuaaagggacccacuugccugucugcuccuuucucacucuugucugcugcccuaggguuagcuguuuuugaugguuccaucccccaccuccccacccuccaaccccccagacuuuugcagcaggagaaugaagaacuucgcaaacgccuggccucagcuaccagacgcacugaggccuuggagcgggagcuggaaauaggacaagacugccuagaacuggaguuaggacagagccgugaggagcuggacaaguuuaaggacaaauuccgcaggugcggaacaaggggccaaucgucucccauccgugggagcaccuuccuguccauacguuagcugaagagccucaggucccccugacuuuauuuaguaacccagaucuuggaaggagagggaaguuccuagacucccauguggaggaggguugguggggccugaggaacaggccuuaaccagggcucugccuuucucugccuuguuggcauguguaggcuacagaacagcuacacggcaucccagcggaccaaccaggaacuggaggacaagcugcacgcacugguacugugcugggagggugguguggccacaacauagcgcgggcuaggacuuccgggggggaugccacucacccuggggccuggggaggagagggaaggcagggcagugguggggagggcgcggugugcugcgccaggcgggacagcccuaaugcucacacugucucucuucucucuccgucucccucccucaugcugccaccgcugcugcugcacucuccucucaggccucucuuagccacagcuggauuuuugcaguugcgucugaguuuguguguuuucccugguccuggccuccuugguccaugucagggauuguggggacccuggccauuucccucugccccuugaccacacccucucuuuuccugucaugugagacccagagugccucccuccugggaaagggcuagggcugagguucugcucauggcucuggcagaggcacugagugauagcccucagcagucccagccuuggcugcgguggcagcagcccaggcuauagguacauguuacgagacuggaagaucaggucugcuuuccaucugcagcucuucccugcccagccagcuaaugucaugggcaccccccucuuagccugacccuggaaacagcugcucacacaagcucggccugccuguaggaugucagugucuuucuugccuggugccuagagucccucgggcucccugaggaugggugguucuuagacugccucuguccuaggcuccacggcuucagguuccucccaugggcaacuugcagagcaggggaaaugccgaccaaguguacuucugucugucgucguuugucugcucugucugccuuggcugcccuagcaccuguggccuuaugucucuggcuaggagaggguggaaggagagagggcuggcugggcucugggcuguguuuaccauaagucugugccucagaucaagaaggcugagauggacaggaagacgcuggacugggagauuguggagcugaccaacaagcuacuggaugccaggaacaccaucaauaaacuggaagagcucaauguauguugcccuccucagccuggcuugucccguacccugggcugggcugggcucuaagcgcugugugucugcaggagcgguaccggcuggacugcaaccuggcggugcagcuucucaagugcaacaagucccacuuccggaaccacaagcuugcugacgugagucccgccugcuggcccugucccgccgcuucaggauugugucuggcuuccucugacaccccuuuccacugguccuucccucugccccccgcggagguccuggugcugcugagggcccguugcuggagucuggcuggcgcucuccagucugaggaggcaguaugggaagaagggguggcggacagagcucucgucggccuugaguuaaacccaccugcccucaaguccucucaggguagagccucugucuccagggcugguguggagcugguuagcuccaugcuguuuuaucccuaccuuugcuuuucucucugaggugagguugcguaggugcuuauaagcugaguguacaggguugacuaggaaauggugcccagccagcgcuuuugcugugggucaggcuauccuuagugaggccccuucaugucucucucccuucucuucucuuagcuacccugugagcuccaggacaugguucgaaaacaucugcgcagugggcaggagguugccagccccagccccagcccuucuuccagccuguccccaggggcuguggugccuaccucagucauugcccggguguuggagaaaccugagucucucuugcucaauucagcucagucuggcagugcugggcgccccuuggcugaggauguauucgugcauguggacaugagugggggugacccagccagccccccugccccgggcagccccaauggggaguguugcucagugaguacugcagggggcuccccggaggaggagcugccccugccagccuucgacaaguugagucccuacccuaccccgucuccaccacacccauuauacccugguaggaaggugauagaauucucugaggacaagauccgaauuccucggaacagcccccuccccaacuguaccuaugccacccggcaggccaucuccuugagccugguggaggacggcagugagcgggcccaccgcagcucagugccuagcaguccugccucugcccaagggucgccccaucaccagccuaguccagcucccucagcacugagugccccagcuaguucggccagcucggaggaggaccugcuggccagcuggcagcgugcauuuguggaccgcaccccgcccccugcugccgugguccagcgcacggccuuuggacgagacucacugcccgagcuacaauugcauuucuccccgggccacuccacagccccaccgccuuccccgcaccgugagcggggacuugugcugccagcagaaccugacucuggcuuuccucaagacgaggaagaggaaaugcugaaccugccugucagccccgaggaagagcgucagagccugcugccugauaaagagggcaccgaggaggccucuggcccuucucauguugauggcagggccuggccucuccccagucccagccgcccccagcgcagccccaagagaaugggaguacaccaucuccaccgcaaggacagccugacgcaggcacaggagcagggcacugugcucagcuagaccugccugccuucugccaccaccucagggcugcagauggcccagacucucccuacagaccugggcagcucagccaguggggcccacaucaauccuuggagcugcguuugcacuaaugggugccagcuugccaucaucauuuuuguuuccuuuuccuuugaaauauuuauucuccaagguaacaagucauuugggccccaagcucuuccaccauccaguccguccguaagggacgggcggugggcuugucaguuuuccuuucccagcuccuuucucauugagagcucugguugguaggggagggugucguuggugcugcugaccucuauuccucugccucugcgugggcugcucuuaggccugcucagcuggccccagagacaaggguggacucacucagggcucccccuuccagagggagggcgugacuucuggggccuggccccauucuuaaccuuggcucuagacuguuacucccagauuugggaaguuuucacaaugacuauuuuaaaaucaaauaaaacuuauuuuacagguaaggcuuaauuucuuucuccuucccacuuuaauccccuuuuugcuuuuauuguugcgauggcaucucauguagcccuagcuggcccugaacucccagauccaccugucugccuccagagugcugggauuaaaggugcgcacuaucaugccuagcuaaaa

SEQ ID NO: 8642 - RNA, 1249 nt, Mus musculus
auguauguauauauacuacauauacauacauuauauacauaccuaaauauaauuauauguguauauauguacauacacauauacacauauacauacaugcacauauauuauauacauaaugaaauaaauguaauuauauauguacauacauauacauuauauauaucauacacacaaacauauauauaaugcuuuuaaagagacuauucaagauuguggacagaucugacugccuuggagaaaagcagcuggagagcacuguggaaaggaacuggagaacaaccgugggaggagccauuucacuauacccuuuaguagaugcugaauauauuaccuaugcaagcaaauauguuaaauuuaaaaaucaaaugaugacuagaaagagaaacauaauguagucauuaagaauaugaagaaaauaaguaauaaaucaaaucacuuuucuuauguguccuggaaagccugugcugcacauggauaaagcagacaguaauuucuauggagugacagaaaggaauaagaucaaauauuccuaaauugccuaaaagucaccaguagaaguuaacaccuuugaguuaacaauucuauuuuuuggugagaguugauccagucucugacugugagagcaagcagccagaagcagacuccuuaauuccaggggaccuagagcuagagccuacagcaauggccugggaccuaaaggugaagaugcuggggguaacaauuuccuggugucugugacuaacuccaugauggugucagaacugaagaagcagauugcccagaagauuggugugccggcuuuccagcagcgccuggcccaccaaaaugaagugcuccaggacagucuuacccuuuccaggcugggucugggucccagcaacacagucaugcuagugguacagaacugcagugacccucugagcauccuggugaggaacaaaaggggccacagcaacauauaugaggucuuucugacacagacuguagacaugcuuaagaagaaggugucccagcgggaacaaguccaugaagaccaauucuggcugagcuucgagugaaggcccauggaggacaaagagcugcugggggaguauggccuaaagucccagugcacagugaucaagcauuugcgccugaggggugggggaggggaccaauaugccuaaggcccccauccagagccaguguugguuauaaaagaugaugcaauaaaaagcucugccucuuguuugcuugucccucucca

SEQ ID NO: 8643 - RNA, 6297 nt, Mus musculus
cuucacuguggcacagcuggaaucagagcugaggaucaagucaaugacuuccccaaaugccacagcugccccaacccaugagcaucuaucuuuauuuacagaagucccccacccaccgccaccaugagaggggugcccaggauccccaacagcccagugcugcaggaguuguccuguuuuuggagacuggauaaacacaggcagacagcaccaguagcagcuccauccuuaggcagaggaauuugaugucccagucacaagagccugccuucuauuuccagcuacuuggugagcugucccuaggcuaauucagucccggaucugucuaucuuccuccugagauaggacaauaaggaaggugucaggaacacggucaggacuuaguccuggaccugcaaggacuggcucagagcugucccagcuccucaaauauaagcacacauacucccacaagucacuugacaauuucucgguguauaagcauagcuuauguguaucacauuuuugagcauuugagacuacauaaagguauggccauacucagguaugauuuuauauaagcaauuuauacauaccaggguauucaccccaaaacacucaccuguuuacauauguacaaguguaguucugcaacuguguuccccuuuauaaacuaaguguccggaguuuaggcaucugaauccacaaauaccacacacaaauacccuccucacacacacacauaccccuccccccuacacaaauaccccccccacacacacauaccccuuucuuuccacguccuggauggucucuggcagcugugcuuucuucgucucaggcagcaggaguacagugcaggcagccaggaaagaaauccccccauaagcaaguuugggcaguaacagccacacuccauccagcaagaccaccaguggggccagagaggccccuagccggccuaugagugcagugaaucccauuccugucugucuguugaggaaagguugaaggagccauacauuacaaggcugcccucuuaggcgggcaaccucuaauacuggcuucccaguacagaagauaaaauuccuugugcuagcccggcaugguggcgcaugccuuuaaucccagaacuugggaggcagaggcaggcggauuucugaguuugaggccagccuggucuacagagugaguuccaggacagccagggcuauacagagaaacccugucucgaaaaacaacaacaaacaaacaaacaaacaaaaacaacaacaacaacaacaaauucccugugcucuccaagauuugggcaaacagccacaauguaucuggcuguagcuaaagaaugggugggcaguguguacgcacagacgcuuagguuaaggcaggccagucgccuggguccccgacuuaccugagcacaguaggguacaacucagacgugaacagguaggcuguaguaaaggcugcuucagaaaaagcuuucccuaucaccaccagagcagugauccaagacuuggugucuggagggaaagggauuccucagugaagggaugacccugggagcccccuagaugugagaccccacagagggcggagcugagccaccggaccuccccacagagggcggagcugagccaccggaccuccccacagagggcggagcugagucaccagaccuggcuuacccgaggacaccagcaggcugaugccgaaggucagagcaguggccagcagcaucccagccucugugaggcggcgucccacgagacgcacaaggaagaagaccguaauuuuggaaggcaccuccacagccccgaacagcagcugugucugguacacggucagccccagcccggacgcguccagagucaggccguaguaagaaaaguucacuccaaaccugaacagagucgcagaaaaagccccucaagagcccccucucccgccacuuggcucuuuagagacugcagccuaggaucauuccccgccccccgcccagacacccauaauccccaaguagguaccaguggccaaagugccuuuacccccaucuuaguagcaauccugugacacgggaacgaacagcaacccguucguuucacagaaacagauauuaaggaucagagugguuagacgguuguccagggucacacaguaagaagucauggagccuaaagucgagucaacaugucucugcugccuacuccccauuggaccugugguggucagagucauccccacccccccacccccccaccccggcucucagggugauccuccugcccuccccagucacacccuuggcccacgcccuucucacacucagccccucccucccucccacaaccccucacuccaucagacacaacucccccccccgcuuaccacaucaucaugcagcacagugagacaugucggagcugcgauguccggaacaggucuaaguacgagggucuuugcgacacccuuuccauggugaucacuuuguucagagccucguugggagagaaagcaagauuucaaucuuagagcuugucucaggggccagugugcucgcucucugcuucucuggguucgaagcacacauggagggaccagaaaaggauauggccgggcaaagccaggcgcccaggcgcuccaauggagagcuggcguguauggugggcccaggaggaggagcacucagacacaaccucuccacccaucccuguguacucucaccuccuggcucaggcuguccucacuuaugggccgcccauugagcuuggcacagauggacagguacuuuuuugccuccuccacacgacccuggguuagaagccaucgugcagacucagguacccaccuaggggagaagccagaggaccuucagucagaagccaccucugccccaugagaguccaggcucucagucguccuuccccccagucuccuucugccccauuaacucuugcucaggcccaguuuaaaagcuaccucuucccuuacugcuugguucaggccuggacucccccagaccuccgugggucccuuccuaacucagcugcacugcuguuagccucaaaaccugagcucccagcaccagccacacguuuggcagcaggaugcagaguggaggcagggcagacauacugauacacagaucaccauuaggagguaauggaguacccaccuugccaggcccucccuucuccugcuuuaguucccaccaccacgcuggcuguguucuaucccugccccuuaaagacaaacccuggucuccuccagcugacaaagucuggcucuccaucacugucuaucacugucucuguuuccgguggaaacagaauugccuuuccguucccaucucuguuacugccucucucuggucagucucugucucuucgcaucuguucccuguuucugaguccugugcugucgucuuucuauugguuuccauuuuucugacuucgacuucucuugauaucuuuuugacucuuggucccugauucuguuucugcaucucuuaggacucucucucucucucucucucucucucauauggauauauacauguuuguaaauguacacacauguacacaggggaucaggugacaucaugggacuuccuuaguuccucuccaccuuagauuuuugagacagcgucucacugaacccugaacuugccuauccagguagacuggcuggccagccagccccagaucuuccuauugccaccucugaaggagcucuacgugcacaucucugugcuguacuucuguauaggggccuguauaggguccuaauguuuggauggcaaguauuuuaucaacugagauaucuuccaagauguccauaguuuuucuuuuauuuucuuuccucuuuuuuuuuuccaggcaggaacuuacauaacccagacugccuuuaaauuucauuguguagcugagcaugaccuagaacuucugacuguuaugccucugccuccugaguauuguggauagagguaugcaccaucgccacugucuacuaaguacuggagauaaacccagggcuuuguguauggcaggcaagcaccaacugaaccaauccccagccugucucuuggucuucuuguucuuuguuuguuuguuucuauuauuuuuaguuguguggguguggguuuggauguauguaucuguguucgggugugucugugugugucuguguaucugccuguguguguuucucugucuggguguuuagauguauguaucaauguuugggugugucuguuucuaugucugugucugugccuagguguauaucagugucuguguaugugccuaugucugugugucuuugaguaugccuaugaguauaugaguguguguguguguguguguguguguuuggguguauguaucuguguuugggugugucugugucuaugugugugucucugucuaugccuauguguguuaucugugucugugucucugugugucuuugaguaugagugugcguauguauguguggcccacaggagcuagaggugucugaucucugagagcuggacuuacauaucuccuccagaagagcagcguaugcuaacagcugagccgucucuccagcccccacuuuugcaucuuagucucuaacuaaccgcacagcugcucgccauucucaccagaugcuaaugaugcccggaacacauggcagaguggcagcuagcagaagccaccgccagcuccguaucagguacccaaccagggucagcagcagcaccccuccuguccagaagguggugcugaugaccccagccacagugcggugcuccacauccagccacucuaacucuggggacagagagaccauuagcaggggccaaauggacccaucuuccuccacccccccaccccaccccacccccgcagccucccuccaggccucgccucacccaacggaaguacaaugaugguaaaaccagccagggcugagccggugagcaugcggguggugacaaacaugauguaguugaccgaggcugcagacaucaggcccagcgccagggugcucacguaggccaccagcagaagccggcgccggccaaaccugccaagggccaugcgaggucagguccccacagggaugcccagauacaggugaugaggccuguccccaacaccggucccuuauuucaccugucagacaaguauccguacaccacagcccccagcagcacgccgaugaagaagcacguggauguaacuuuguucaggccucucugcugacacaccagaucccacugcagagacaggcggguaaguugucggaucuguaagagccccucuccagccacgaugucccuccucuccagacucccaggcagcccugaccguuucagaagauucccccaucccuagcuaucaaccucagcacuagaaagggaagacuuugccucucccuaguccuagagcucagugcuuucccacagagguccaucacggccaccaaggaauccuguugucucuccgcagggagacuccacccacccuuccucucgggaugacucagguaaaucucagaccugggacaggaaugaggcagaggggagaaaaggauggaggcuuccacaguuucucuaucuuuuacuacagagauguccuuuucagccucuguuccaacucccuggagcugccuuagcccuuggguaaauuauaguaaacgaacugaacccagcuuuaaagcuacaggcuggucuccacacgggaaugaaaguccuuagagugcaagaagguucucuccgguccccugcccccaagguaauggcuggcucaacccacucacauaucccgcacccucugggcuuggguaccucaguugcaaugguggaagagaauucugagcggucguacucccagcccugggagcagggcacugugaggggcucacccucaggcuccccagaguuguacaccucuguucccaaggugacauugggaagagccuggggauaggcaaagcggaggcaggaacuaaagcugccgucagucucccgggguagauggguuuucagccacaaguccuggugacugagguuggcuggggcaucaggcagggcacaaugaugggcaggcacagcagccaugaagaugggcaggagaaaaugcaucgggagcaggaaucggggcagggccagcagcaccagauuccgcaguuggaaaggcccaaagccacccaccuugugcagcagcucuucgaagcccaugcccuccacccaccaggugugccucuauaguaccuaggaucggucaaccugcuugcuacaugugcccuuggacucuggaggugggaaua

SEQ ID NO: 8644 - RNA, 619 nt, Mus musculus
auuauagaacaacaaaauaacuuuuuuuuuuuuugcauuucugagaaaauuuuauuggcuuuuuggaaaaaguugauuuuccaggaaggaugaucccaucguacuucugcuggaaccagcgcguggccuccuccuugcugauucuguguuuggccccaaugcagccuguucugcgcuucuugucugcgaugcugaacccuggccuacccaguaccucauagaaguccaggccguagaucccaaugcuugggucguauuugaugcccaggucaauguguuccugaaguccaaaaccaaaguuuccaguauccgagaaguuauuuuuccacaacucauacucccgcaccuucagaccuuucuccagaauuuccucugccuuggcuccgcggacugugcagugaacggcaaucuucucauuucuccggaugccaaaggaccugacaguguaucuagcuuuggagaacaccggggucuggccugugagcugcuccaacaccuuggcugcccgggucagucugucuccgcagauauugaggcagagcuugcggaugcgcgguucccgcaagggguucuccuuuuccccuugaucuugcgccaugguggagaacaggaagcacaa

SEQ ID NO: 8645 - RNA, 619 nt, Mus musculus
uugugcuuccuguucuccaccauggcgcaagaucaaggggaaaaggagaaccccuugcgggaaccgcgcauccgcaagcucugccucaauaucugcggagacagacugacccgggcagccaagguguuggagcagcucacaggccagaccccgguguucuccaaagcuagauacacugucagguccuuuggcauccggagaaaugagaagauugccguucacugcacaguccgcggagccaaggcagaggaaauucuggagaaaggucugaaggugcgggaguaugaguuguggaaaaauaacuucucggauacuggaaacuuugguuuuggacuucaggaacacauugaccugggcaucaaauacgacccaagcauugggaucuacggccuggacuucuaugagguacuggguaggccaggguucagcaucgcagacaagaagcgcagaacaggcugcauuggggccaaacacagaaucagcaaggaggaggccacgcgcugguuccagcagaaguacgaugggaucauccuuccuggaaaaucaacuuuuuccaaaaagccaauaaaauuuucucagaaaugcaaaaaaaaaaaaaguuauuuuguuguucuauaau

SEQ ID NO: 8646 - RNA, 14039 nt, Mus musculus
acuggagggcugcgucguccagguggcacccgcuacuccgcccgcugauggcccccggcccccagcuuuccgcuaaaucaggcggaagcgagcgguggcuggagcaggcggcggagccucggagcgccuggagcaccagccaggacuaggcuccacccugcagcaggcagugcgccggcgcgccucggaggccucugcuggucacgcccucugcccgccugucuccugcagaggcacgcccccuccucugcgccuagaccccuucagggggcccaggcggggcccaaacacucgccagcgccgcagccgccaucguguuccgcgcgucccuagcucugcaaaggacaggccucgcgccaggaucccggcggacuucugagguggccagagccccaccgcagccccugccccuauucugggcuuccgaucgaccgcggagccucgcgucuccuucccaaccgugcuucgggacuauccuuuacugggccuaccuccccauccuaucccaccacgcccuuuccggaccuucucgggucuugauucccauccaccaagccucgcgccgcuuauccaucggaccccugaugcacccuucucccggccucgcgccucuggucauggaugucucccauaccuuccccuucucccagcccaucgugcuuugcugauggccauuucugugcccuuuccuuugggccucacaauccagugcuucaauuuagagaccgcaucccccuccgacacaguucugggcccccacacacccguuucccuaaauuacuuuuaucugucccaggaccuugggcuucauuuguaaauccaacacugcucuaugccacugcccuuccggguguuccgaaccaaacccacucgaggcugcgagccuuagagaccucuuagcuccaauauuuugcucuugaauaacaaacuccgcaauguucuucuguccaguccaggucucaccggccgaagcaggcccaacuuuaccccacccagaauaacagcuguugcugcuuucgcuccuccaacuccuggaugcccuuguuuucugaccucccucucacucuagcuugccuuuucucucuuccuugugugucucaggugccacgaugguaggggagcuacgauacagggaauucagggugccccuggggccuggcuugcacgcguauccggaugaauugauccgccaacggguuggccauaaugggcaccccgaguaucagauccgcuggcucauccucaggcgcggggaugauggggaccgggacucuacaguggacugcaaggcugagcauauccuguuauggaugucugacgaugagaucuaugccaacugccacaagaugcugggcgagaauggccaagucaucgcaccuucccgggaguccacugaggcaggggcccucgacaagucugugcugggggagauggaaacagaugugaaguccuugauucagagggcccuucggcagcuggaggagugcgugggcaccgugccuccugccccucuccuucacacgguccauguacucagugccuaugccagcaucgagccccucacuggcaucuucaaagaccgcaggguugugaacuugcucaugcacauguugagcaguccugauuaucagauccgcuggagcgcaggccggaugauccaagcucuguccucccacgaugcuggugagggacauuuguggugggggagggagaacaggagagggucugggucggcucagggauucagaggacacugggacaggaccuucugaccucaucaguacggaauggcucaguuguuguucacuuuuaaguuggaagaaaaaaagagggggcgggguagggagaauguuuguuguggaaggggaugggacggaggggggaaagacugcauaagcaagaacauauuaacccauuagcuuuuuaugcagaagagcuuagacuguugcagugugugugugugugugugugugugauaguaaacguuggcucuugaagcaaaucaacaaaauaugucauucccagcgagugcuggcaaaggauugguagugaguagaaagcuaggagagaucccuggaagacugcgcuuagggaacuguuucugauuggagguguggguuucagggacccggacccagauccuucugucauugagccaacaagaggccauugaaaagcaccuggauuuugauagccgcugcgcucugcuugcacuguucgcccaggcuacucucacggaacacccgaugucuuucgagggcguucagcugccacagguaucuuaugaggguccgagguagugggagcuguggacuugccacagaggguacuguggaaagagggcagaagaugagacaagaugggugagggucagagguguaucccacaggucccaggacggcugcucuucucccugguaaaacgcuaccugcacgucaccuuccuccuggaucggcugaacggcgaugcaggggaucaaggagcccagaacaacuuuauuccugaggaguugaauguagggaggggccggcuggaacuggaauucaguauggccaugggcacucugaucucugagcuggugcaggccaugcgcugggacggggccucaagcagaccagagaguucuuccuccuccaccuuccagccucggccagcacaguuccgccccuacacccagcguuucaggaggucgaggcgguuucgcccccgugccucguuugccaguuuuaauaccuaugccuuguaugugcgggacacgcugcggcccgggaugcggguacggaugcuggagaauuacgaggagaucgcugcuggggaugagggccaguuccgacagagcaaugauggcguucccccagcgcagguaugggcucuacagacugugacacugaauuuucauucugggugaggcauccaauacacacugggcauucuauacugcggcucaguuaaguuccaaaggacacggagcccuuggaauaugggagcaaaggugcgucagacccaagaagaaaccgauggauuagaauuuggaagaugggcuuucugaggccagauggaaguacugagccaugguaucuaagacagagaggauccaggccgugguaggaugcuuguaaucccagagguagagagaggcagaaagauagggaguucaaggccagccauggccacauagcaauguugaggucaguuugggacccccgucugaaagaaaggaaaaaugaaauuagacuaaagggcauaaggaaguaaagggcauugcugaggaggaaggugaggcugucuguauacuguauacauuguugcauauauagucuauauagucuauagacaguggucaccuuaugggccuuagcuggucaauagcagguccucuuccccuucccuuuccuccugccuccaacccuccagguguugugggauucaacaggccauaccuacugggugcacuggcacaugcuggagaucuugggcuuugaggaagacaucgaggaugugauugauauugaagaguuacaggagcuaggggccaauggagcacugagcaucggugagcucugggcuggagguuggcucugagcagagagagauagaccuaccugggcaggccgugacuuggcuguugccacauaccauuuacuacgcagucccgccgucccagcgcuggaagcccauaacucagcucuuugccgagccuuacgugguacccgaggaggaagacagggaagagagcgagaacuugacccaggcugaguggugggagcuccucuucuucauccggcaguugagugaggcagagcgccuucacaucguggaucuccugcaagaccaccuggaagaggagguaggcaccccucagaagugucccccgcaagucugcaucggaacauucggacgcucgggaggugaagcacggaggucggacagcuucaggggcccaccacggagggaucuggaauguucagagaugcaagggucggugggcugccagccacaagagguucagaaugguugauguguguguguagagagacccccauucccaccgaggaucugcucgcucagcugcgacaggcugacuuuucuuccccguagcgcguucuggacuacgauaugcugccugagcugaccgugcccguugacuuggcccaggaucugcuguugucucugccucagcaacuugaggacagugcucugagggaccuguucagcugcagugucuacaggaaguaugggcccgaaguccugguagggcaucuaagcuacccauuugugccaggugcccagccaaauuuauucggagccaaugaagagucugaaggugagugcccugcagacagcagcagagagaccugccuuugggaaaguguccuccaagaggugucuccucuaacagugugccaucuugucugaaagagauacccuacccacaaucccagaaacuuacgaugugcaugugugugugugucuguauguccagacccaaggauaauuacagaugucauuccucagcugucauuuaucuuucuuuuauuuaaauugauuuuauuuuggcugaguguggugauccacacagauauuugaguuugaggucagccuggucuacagagcaaauuccaggauagccagggcuacacagaaaccccuuucucaaaacuaccaagcccccucccacucuccccacccccaagaaaauuauuuuauuuuaucccuauggaugcagugcccacagaggucagaagagggcacuggcucuccuggaguugaaguucuagauccuugugagcugcgcuguggaugcugggaacugaaccuggaucccucccuucucucuuuuacucuuucucucucucucucuuucuuucuuucuuucuuucuuucuuucuuucuuucuuucucuuucuuucucuuucuuucucuuucuuucucuuucuuucuuucuuucuuucuuucuuucuuucuuucuuucuuucuuucuuucuuucuuucuuucuuucuuuuuucgagacaggguuucucuguguagcccuggcuguccuggaacucacucuguagaccaggcuggccucgaacucagaaaaacgucugccuuugcugcccaagugcugggauuaaagauguaugccaccacuuuuuggcagugcugccaauucuuaccacccucuuguuccuucagccaaagaucccccacuucagagugccagcccugcccugcagcgccugguggagagcuugggccccgaaggggagguccuuguggaacuggaacaagcccucggcuccgaggcuccccaggaaacugaggucaaguccugcuuguugcagcuccaggagcagccccagcccuuccucgcucugaugcggagccuggacacuuccgccagcaacaagacccugcaccucacugugcucagguggggggcagugaggggcaggcuugggcaccugaaggccucacgccaaccugaucuccuucuaccuuuccggcucugucucucccucuagaaucuuaaugcagcuggugaacuucccagaggcgcuguugcuacccuggcacgaggccauggaugccugcgugaccugccuucggucccccaauacugaccgagagguaacccugucccacucuggggagaagcugggggauggggaggacaccagugagguagaccccauuucccugcuccgggcgaggcuuggaggacgcaacagaaucuugguguucucgcuuuuaaaaugaaaaaaaaauuuuuuuuuaaaauagguaguacauucacaaaguucacaaguccaaauggcacaagguagucaguccuugagaauccuggcucuucaccgauuccuauugucucaguguccuugcugguaacccacuguauuaauuauuaguccaucccgugcuuccuuaugcaaacaggaacaagcucuguggacuuccuuccagccaggcccucaagaggaaggggaggggguccccugcucuugcagaggacgcagauuucauucucagcacccacagggcaguucacaacugucuguaacuccaguuccagggaaucagauaaccuccuccuagcuccaugcacacacauggugugacacguacgugcaaggcaaauacucagacacauaaaauucaaaaaaaauuuuaaaaagcuuuuaagugagggagugagggacucccaggacuuuccuuccuaucagagguccuggggacaggagguguuagaagggucaaaggucgugauguuaaugaguuucccaaagugaugccuucgguuuccaagcuguucuuacugagggucagcaaaguucaggccuucucuauccccugccagcccucuuaagugucugggcugggggcguacacaucucaacaccaacccugcaacugguucuugggggggccacagcugaaucaaagaaguaaggguuuuuuaccugcuccgcacacacucgguggcugagagcuccaggggccaggaaggcuuuucccaucgguuuggccucguuucucuaacugcgccugguuuuuauauuacuucccacacugucuugcucagcucccagcacagaguggccaugaaucaccaccgcugucuguguagcccaggcuugccccuuucuucacugaccccuugacauccccucucaggugcuccaggaacuaaucuuuuuccugcaccgccugaccaccacaagccgggacuaugcggugauacuaaaccagcuaggagcccgggacgccaucuccaaaguccuggaaaagcaccgagggaaacuggaguuggcucaggagcugcgggauaugguguccaagugugagaagcaugcccaccucuaccggaaacucaccaccaacauccugggcgguugcauccaggucaggagggaaggcaggagggagggcaggagagagagcaggagggagggagggcaguggagguucugagcuaccuaagaacguggaugcugagcaaugccaggggaucgggugccugcucgugugagccuggacacguucauccccuuacgguuugaccuuuccuccauuugugucuugccugagccuuauguccucuuuucucugauguuccggcuccagaugguccugggucagauugaagaccacagacgaacccaccggcccauccaaaucccauucuuugauguguuucucagauaucugugccaggguuagugucuguuccugaccuguuuaauuuagcaucacugguuuuccccuuuguuuguaccuggacuaugaccuuccccccuccccccuucccccaggcuccagugaggaaaugaagaaaaacagguacugggagaagguggagguguccuccaacccacagcgggccagcaggcugacggaccgcaaccccaagaccuacugggaguccaguggcagggccggcucccacuucaucaccuuacacaugcgcccaggugucaucaucagguaaggagcucccacaggcacucauggauggcccugcacuguguugguccugccagucaccugggcucuugagcgugggcgcgauggauuccaauucccauuggugcuuccuccccggcuccaggcagcugacucuacugguggcuggcgaggacucaagcuacaugccagccuggguggugguaugcgggggcaacagcaucaaguccguuaauaaagaacucaacacgguaaggagcccuaugccauggcccaccccuguaggcccucucuucccuucuaagucuaagcuccuaaccccuacauauagugaaccccacacaggcuagccuguuauccuugugccuaugugagggcaugacgcaaugggagaggcacugaagccccuuugucaggagcccugugugucccugggguggaagauggagggauuugcaagagagcuagagcugauguggcugauauuaguagcucugucuacacauaagguggugauagccaucucugccccucaccagguaaacgugaugcccucugccagccgggugacccuccuggagaaccugacccgcuucuggcccaucauccaaaucagaauaaagcgcugccagcagguggggugugaggacugcugcaggucucugagccccagccagacgucugucaccaaacuaccccauggcagcccugagccugaugaugccuuuagauuuugagccggggccugggggggggggcugguuuaaagggcaaagccuaugccaaggaggauguggggucagcuacaggucuuguguguaacaggguggcauuaacacgcgcauccggggccuagaggugcugggccccaagcccaccuucuggccaguguuccgagagcaacugugccggcacacgcgccucuucuacaugguucgggcccaggcauggagucaggacauagcagaggaccgccggagccuucugcaccugaguucuagguaugugagagcuugcauguguguuuguguggcaggucagguucauggacucugucuggguggguccugaggaggccuggagacgggucuguucuagggcuuggggaaggucaaagccuucugaggggaggggaugacggaaagagaagauagaucucuccgagugcagagggaagcauccugcuaguccagggcuccucuaaaagauugcccugggugcuggcugcgugcugagucaccuaagccuuagggcccgaacucuuccuucuccuccccaggcuaaauggggcucugcgccaugaacagaauuuugcagagcgcuuccuuccugauauggaggccgcccaagcacugagcaagaccugcugggaggcgcuggucagcccccuggugcagaacauuacaucucccgguaaccacccacacccggccccgcuccucagugugugugugugaccuccauccccgugugugugugugugugugugugugugugugugugugugugugugugugugugugugugugugugugaccuccauccccacaucgucugggccagacugcuccucucccugcgugggaguugugugguuggcuuuucgcugucccuuggugagcucaaccucucgacuuccccagagaggcaagccauccuuagguguguuauucucacccuccagaugaggacagcaccagcuccuugggcuggcugcuggaucaguacuugggaugcagggaggcugccuacaauccccagagcagggcugcugcuuucuccucccggguucgccgccuuacccaccuccugguccauguggagccccgugaggcagcaccuccggugguggccaucccucgauccaguaaguccuggggacuccaacaggagcuccaccccgcucaugaguccccacucugcuccccacacccccaugcccacaugucuggcuguccaucuucuguguguuacuccauucaugaacaccauagcaugcugggaaaggucuucagggcucauccuccggaccuugaggggccgucgguccuggccuucugacacuuuucucacuccacagagggcaggaacagaauccaugacuggagcuacuugaucacccggggccuuccaaguagcaucaugaagaaccugacccgcuguuggcggucugugguggaggagcaggugggcagccacagguguggaguugggggugggacucugugguggccccacauuggaugccuccucaugccccuuccccuuccucucagaugaacaaguuucugacugcguccuggaaagacgaugauuucguaccccgcuauugcgagcgcuauuacguccugcagaaguccagcucagagcuguuugggccacgagcugccuucuugcuggcaaugcggaauggcugugcugaugcugugcugaggcucccuuuccucagggccgcccauguaagucccuuccuggcccucucccuauaaacucuccccugccuucccaaaguggaccacccagucucucuucugugaugagcggauccuuuggaucugaccauacguugaaaacuaggggaaaaaaaucauugcaugcagcagauagagagagagagagagagagggagagagagagagacacucaacauguaucucugguuggucucucggccuugaacucagagguccaccugcauaggcuucccaagugcuggaauuaaaggugucgagcuaccaugccacuucuuucaaagccagggucucauguaucccagucuggucuuuuuuuuuuuuuuugguuuuucgagacaggguuucucuguguaucucuggcuguccuggaacucacuuuguagacgaggcuggccuugaacucagaaaucugccuaccucugccucccgagugcugggauuaaggugugcgccaccacaucugcccccccagucuggucuuaaacuuagaguguagcccaacaaugacuguguacuucugaucuugccucuauuucccuaagcaccagcauuucaggcacguaccauucauuaucccuguuuauguggugguauuagggauugaacccagggccuuagcaagcaagcacucuagcuauacucccugccccucccuaauuccuaauccuucugccuccaucucucaagggcuaggaucauagaugugugccaccaugucuaguugauuucuuugauuuugaguuauuugauuuguagacacaguuuggcagggugggggugggggcugaauuuucaguuguuaauacuacugaccugcacaacuguuaauguaagugucugucaggcugcagcggcuguagcucuguaggacugugugugcuccuuaguccugauuccuuccaguaccucuugaagagggugguggaggaagaugaccgguggaugacggagguggucauccauaccugcuuucucugcccuucuccuuucuguccccuggcucacucacccgugguuuucuuacacucuccgcucaggugagcgagcaguuugcucggcacauugaccagaggauccaaggcaguaggauggguggagcccggggaauggagaugcuggcacaguugcagcgaugccuggagucuguccugauuuucucuccccuggagauagccaccaccuuugagcauuacuaccagugaguuuagaucuuaucuuccugccucuaugggguagaacauggggaaggcaggcaggcuggcuguuuuggggcagggccagcucacauggccugagucuaauauacaggcaggccagagugagaaccugggccaugcuggcgcccacacugagaccuggccuggcuuugugcgcugcaggcacuacauggcugaccgucuccugagcguaggcuccagcuggcuggagggggccguacuggagcagaucggucccugcuuccccagccgucuuccccagcagaugcuacagagccugaacgucucagaggaguugcagcgucaguuccacguuuaccagcugcagcagcuugaucaggagcuccugaagcuggaagacacggaaaagaagauacaggugggucccagggaagggccaugcggggagcaaguagccuugaacauccugugaacuccguuccccuuccagguggcccaugaggacaguggcagagaggacaagagcaagaaggaagaagccauuggagaagccgcggcuguggcuauggcagaggaggaggaucaagggaagaaggaggagggagaggaggaaggggagggagaggaugaggaggaagagcgcuauuauaaaggaacaaugccagaaguguguguacuugucgugacgccacgcuucuggccugucgccuccgucugccaaaugcucaacccggcaacgugccugcccgcauaccugcgggggaccauaaaccacuacaccaacuuuuacagcaagaguaagugucugggaagaaggccuuggccugggcugagggacaggguaggcuccuaagaaagggaccugaaguugggguagauggugagguuagaaaccuggauggcuauaaacauggccucucagccugccuauguucaggagguacaagauacaggagauacgauucccuuuugggggacagaauggcuguguggggaaguggaggggcuguaaauuuuagcuggaguccagacuaaaggaaucucuuaggaauugggaggaauagucagacuucuucugagagaggccauaagagugagcuuagggguggguguguggccgggcaugauuccagagguagucaguuggaucuuuaagaguuuugagucuagccuggucugcauagugaacuguaaaucagccagagcuacauaaagagacccucucagaaaauagaaagagugggugugagauuccuuccugauuggucacauuuaguucccaaaguauucacugggcaucagauucuagccugggcaacaagagcaggugaagagcagagcaccacccccccuccccccaggagucaccagacaagcaggagggcaaaccuuccuggcucaauucugucugugcauaauucagagggcauggcugcagccugcuuggcacagacugacuccuuguuagccaaggcuuuuuagggaagcugagaucagaagccaucgugcccagaaguccugccugggucucuacacugcggagaccagcaaggcaaagcuugaccaacagagcaugcccuccccccuuacccuccccccuucucucaccuggcauuucuccaggucagagccgcuccagcuuagagaaagagccacagaggcggcugcaguggaccuggcagggccgggcagaagugcaguucgggggucagauucugcauguguccacaguacagauguggcugcugcugcaucucaacaaccaaaagguggccuguccugucccucugcuugcccugccuauucacuucuguucucuugccuccauccuccccagcucacccccccccccccccgaggaucuaaacucuuuguaucucuucuaaggaggugucugucgagagccugcaggcuaucucggagcucccuccagaugugcuucacagggccaucgggccucucaccucaucaagaggucccuuggaccugcaggagcagaagaacguaccaggagguaugcacucagggccaaggcagacugcucugagucaggaaucggcuuccccgggcccuccccaggcaagugaccaauguuccuuacaggggugcucaagauucgagaugacagugaggaacccaggccgaggaggggcaacguguggcugaucccaccucagacauaccuacaagcugaggccgaagagggccggaacauggagaagagaaggaaucuucugaauugccuuguuguccgaauccucaaggcucacggggaugaaggcuugcauguugaccggcucgucuaucugguaggcaguggugggcauggccaugggggagaugcccagagguaaugguaggcauggccaugggagagaugcccacaagugauggugggcucguauuugaagugucuaacucauggugcagccucucagugugugacacaugucccagaaugugugacuaacacagaagacagugguaaggacugugguuuugaccuguccuuuccuucugauccugcuaucaggugcuagaagcgugggagaaaggcccguguccugcuaggggucuggucagcagccucggcaggggagcaaccugcaggagcucugauguccucuccugcauccugcaccuccuggucaagggcacgcugagacgccaugacgaccggccgcaggugcuguacuaugcaguuccuguaacugugauggagccccacauggagucccugaacccuggcucggcaggccccaauccaccccucaccuuccacacccugcagauucgaucccggggugugccuuacgccuccugcacugauaaccacaccuucuccacuuuccgguagcccuggauaugggguuggggguaggugaggcuggggcuuucuacagaaaauaaaaugcuggaauuugaagcuaugaccuguau

SEQ ID NO: 8647 - RNA, 4450 nt, Mus musculus
cucccugcugugccuguuuauuuccugguuucugcugacgcugggcugggcggguccucaccuguacccucuaggcgcucagaaacaaaagccuggggagggcuggaccaggauucaggagcacaggcgguguggcuucuggcuguguacacagggugcuuuauucuccacagagugauacaugcuaaggugggcugggcuugggccgauguccccauauguacagaacugaauaaagugggucucugagaggucugagucgccuuggugugaaagggacaugggaaggaggaggcuguuaagaccagaguuguuaguccugugcugguccugacuuggaauguagggagguaaggcagcucgcucucuggucacuuccaggcaggggaugccugccgggcuuggagggcuuucuguaccacaucuucccacugagcguccgagaucucccgagcccaggcaggaaccccuggugcaggcaggcuuacuccagccaucguccuuuucaccagcucuacauguucugaaagcacagccagacugguuagggaauaaagaacgggaccagcagccgggcgugguggcgcacgccuuuaaucccagcacucgggaggcagaggcaggcggauuucugaguucgaggccagccuggucuacaaagugagcuccaggacagccagggcuauacagagaaacccugucucgaaaacccaaaaaaaaaaaaaaaaaaaaaaaaaagaacgggaccagcuccucucucccuagugccucagucagcccaagacccccaacacaucaucacgcccucauuauugccaggucugcccauucccaagucuagugagacagcauuucacuuagauucugaaguccacaaaaucucagguaacgaaauuuuuaggaauaaagugaucuuguuugggggugagggggagaauggggggcauuguauucgguuuuucucugugcagcccugacucuccuggaauuugcucuguagaccaggagaccaccagccugccucugccucaugagcgcugggauuaaaggugugcaccaccaugcccaguucuuacuaguuuuugguaauuauuucuaaaugaaggaaugagcuuugguuguuuuuguaccuggguccauggggauagagcuguggcugcucaaugcggcggcucccuccucaucuucauccucacucuccaauggagggucuggcagaugaagccccagggccugcagaaccagagaagauaauuuguuaggcgccccucccccugccauuaugauaaacagcuguugguacauuccaucucaucugcuuaguaacagcauccuccaccauaccuggauccgaucuuggaugucagcagcuccaucuucuccuucacccacuggugccaauuccaccucuucuuguucagggucuugauugaggggcugguacgaguagccugcugggccugcuccuguuuccuccugcucuuccucggguucuucacugcuccaauccccaguuccuucuguaggacccugauguggcccuaaguccucagucugauuggggaagauacgcucagggcccauggugucucccccuagaacuacugcugccauccgggcaggggcugcagggacagaaaggcgggauagggaugggaugaaaccaggucuccuuucacguucagccacccacuucccucucgcauggaacuugcaucuuccucccgucucuccugccucccugucucaaguuuggguucucauauugagcuggagcacacacgucuuuaacucgcccgauuccuaaaugaaccgaccaccggaggguuucaccucuuccuaaaagccucuucccagaaccucgccccucucaccacgccccuccucuggagguaacugcuggucgccaggcuacccaccauagcgcguccccgccccucauucccucuauuccgggggaguguaguaccgccuggcaaaaaccccuucaggcccagggucuccccuucaauggccccagcuacagaguccccuacccgccccacugauucucggcguugguauuuccucgcgccucacccucucagagcccacagccggacccgcaccuucacuuccggcggggcaggacaugcuggggcucuuaguccuccagccccgccccgugcccgagacugacgcaagcgaggacaaguccgccucuugccccgccuccgccauccccugcccggaccacaaagaacuacauuacccagugacccucaggcgugcgacgugaacugguguucugcgcaugcgcacaaaccggccccgcccacccgcuccccaucuuucggcccugggguaauucguggacuacaagucccugaagcugucgggccggcaauucucacugcacgugcgcgucccgcugcccgccggaaggacgaagucuggcaguguuuaucucguuggggaccgaggaaucgguuggcgggcaacggguucuaggcugcuggcagcgcgaggacccgcggccccaccccggcccggccuggcagguagccugggauggguuggggggaugaggaaaauugaagggacaggcgacgcccauugccuacggcuggggccgcgcgggaggggcugagaaggcugagcuggggguggggagggagcuagggggaugcugggaaagaggaguguuaaugguccgcgaaaggguuaggggaaaauggccuggagacgggugggagagaccugguggcuggaggaagcgcugagagaaguggacgaguggguuccgaagagaaucaggaagcugagcauaauggcagggggagggggcaguguggcgucgugggggaggggcggcugagaaagguggacuacaaccggagaccagucucauucacagagcgguaugguuggcaggggauaagaauggcuugcuucccuucgugaacuuagacgaguuagagggcucugguguggaccuugaaguggugggaggaggaacugcaaggcucucgggaaauuaagaagggaaggggcgcgagcagggaggggaagccgaccucaggggcugggauguugaaaauggccuauuggugggaaaugcuggagacccagagauaacguauaaccuccugccuccgaguucuccuuaggaagauggagucuuccuccgucugccacugggauuguagucuuaucuuugugcauuuucguuuuaucuggacuuacuuucaaaggagaguaaaagauaugaaggagguugauaggcucuccaccaccacguucuuuccuuucuuucucuauuuuuuguuuguuuuuuuuuuuugagacagguucuuguagcucuggcuaauuugggacuuacuguguagacccagguggcugaccuuaauuacacagacaucccccugccuccaugccccagcacgagugccuuggacuuggauucuuaagcuuucaguccucuuucucugauaagcaaaaauugaagagccugaguaaugaaggaacaguuuaacuuuuggcugcugcuguuucacauugagagagauggcuacuuaaaguauacagugaaagguugugggggcaguugauucaugaaagcugcgucuguccccuugaagggaaccuccuuugcuugaggugcacccaccccacccccgagguuuuuccucccugccaaggauuuuugaacaggaagugaaugaucacccaaacccagcagaugucuccuggcaaaggcaucgcuaguugcaaaaagauuugccugaaagagcucucagauauaccuguuaucacuaggcuggccggcugucuuuacaaagccguggccccucucaucuuuggggcuuucucuuguccugcccaaagguauuuuugcuuucuuuccucuuuccaaucuacacuccuaccccaucucuccucuagagacccagacaggggcagggcugcuggaaguggcguguucgcuaacaauaguccggcugagaaaguugagggcgcuccucccugcccccgacucucaguauacacauaccuuucugguuuaaguuucuaguccuggcagcauacgagccacagcugucaaaggaacuccucgugccuguagacacccugggugaccccagggacaacggaucagcuugacaagaacgcucugugaggggcuaaucaaccaugguuacauggaguucccuguccuagguagggacacuguucuccucugaaagccuaaagcuccuuuuuacuuuaaagcacccaugccagcucucaguggacugucuggggcuggcugggcuauuaauagcugugaguauuuugagaucccuaccuuuaagagauggagggaaauucuuagagagguggcaguaaacagagccagaagcaagaacacacccaguauggaaaagggcugggaggcugggggcuuggagcuuguuccaagccgggggca

SEQ ID NO: 8648 - RNA, 16506 nt, Mus musculus
cgcagucccggaagcggccgggggaagcugcuccgcgcgcgcugccggaggaagcgccgccggguccgcucugcucuggguccggcugggccauggaguccaugucugagcucgcgccccgcugccucuuauuuccuuugcugcugcugcuuccgcugcugcuccuuccugccccgaagcuaggcccgagucccgccggggcugaggagaccgacugggugcgauugcccagcaaaugcgaaggugagggggcggggccgcggggcguagccaagcccgaggggcgggagggggcggggccugugggaagggucugggccuggcaggaccugggcuggggucuccuuggcccugcugugugcuuugcggcaaugcugggugcugugacucucggauaaccuggagaucccugcuuuugggcgaauccggggguaguugcucaucaagacuagagguggggguggagggaaggcuucauacaggaagccugcugcgaaaugaagaguuggccagggaaagcauggcgugcagaggaacucacuccgcagaaaccacagaaacagaggcagaugaggaggcccugccggccuagaagccagagggcgaauuugaggaacugaaaagguccauaugacguagaaaagggaaccugaaaauuuucccguggugcuuucacuacaaccuaauuuguguaugguuuuggcuucuugagaacagguacugaguugcaaauauuuauuggcagaccaaaaaaaaaaagggggggggcuuuacauaggauuauauggaggggcggugaguguauguggagagaagagacucacacucaaaggaucaagaggucacuuuuuugaaagcaucgagcgcagaggagacugaagugaaggagguagauuuuaaaaaucgaaggacaaggaacugagaccucucuuuugcccugcucaucauugcucaguuuccucucagaccuuugcagccaucgaccuucuuucuaaguccucgaaggccccccucccccgaguauucuggauauccauuuuaugcaccaagcagauguacacaggccagauguucccuaagcacuggaugcugggcuggugguuugggacacauuaauccucccauuugagcuguuaaauguguggcgaaugggggcaggggacucggcucaguggguagagugauugccagaggaucugaguucagauccccaagacagauauaaaaagccagacgcugcaauguuugugcaccccugauccccgcaccuccgcaccuaaagagaugcacaggagaccagccaguccaaccaaaugaucacgcuccagguucaagugagaaaccuugucugaaaaacaaaagaugaagaacaguaucagaaaggaacucuggccuccaugugcauauccacauauccacacacgugugugcacacacacacuguaacuacauaggacuuuuuguuuuuaagugagacucccuagaguuaaugugaguucacuggaagauaccuguuaaaaggucucaccuguucuaggauggucccuuaccuccccaccaguccugggcuuuuguuuucuuuguuuuguuucuuuucuuuucuuuuacucuuucaagacaagguuucucuguguagcccuggcaauccuggaacuugcauugcagaccaggcuggccucaaucucagaaaucugccugccucugcuuuccaagugcugggauuaaaggcgugcgccaccacugcccggcuucuuuuaaaguuuuguaagguuuuuauuuauguauuuuuguauacgagugcucuauuugcauaagugccucaugauggaagagggcaucagacagaugagagcaucagaucucauuacaggugguugugagccaccaaguggguguugggaauugaacucgggaccucuggaagaacagccaggacucucaaagcugagccauugccccagcccccaucuuucuccuuuucuuuuuucuuuugguuuuucgagacaggguuucucuguguagcccuggcucuccuggaacucacuuuguagaccaggcuggccucgaacucagaaauccgccugccucugccuccugagugcugggauuaaaggcaugugccaccacgccugucucuuucuccuuuucuuaaucacagcccaggaagcuccuuucuuuuccuuaggagacauccauagaugcagagucauagagcuggcaaggcucuuauagcccauugaggccuaaacucauuuuguaaucaguagagauuauuuucagucacggagugauuuggcaaacuuugacucuuaggcaccucuuaauacuuuauuuauuuauguuuauuaguauugcaucuuuauuauuaauugcugauuauuucuggcucacagagccugccuucaggcuuaguagucuuaaguggaacaggccucagcacagagaauggagaaccugcccagagaaagugggugguaguccaugggggucuggggucuaugccaugagucucccacaagucugcuuuaugucuaaacuggaucuuauagggauaaugguucccugagaggcccagggaaggcaggacuuucuugaggauauuuaaugcagugucgggagacagggucagagaagccucuagaggguuuucccagagccaggggcacaucacgcccugagagugguagccuccuuuuuaguugcugucacgccuuucucuuucacucugagcaucaggacagguggagcuuagucaccauccuccuguccccagugcucagcacaggccucgucucagugacugcuugaggaggggagggagaaguaagaggacgcuugcacacaaacagugagccucucuggagcacauuaacuuggcagccagagagaauugguaggaaacacaugaagucaagaaauaagacagccagcugggcaugguggcgcacgccuuuaaucccagcacuugggaggcagaggcaggcggauuucugaguucgaggccaaccuagucuacaaagugaguuccagaucagccagagcuauacagaaaaacccugucucaaaaaaacaaaaagcggggcuggugagauggcucagcaguuaagagcgcugacugcucuuccaagguccugaguucaaaucccagcaaccacaugguggcucacaaccauccguaacgaaaucugaugcucucuucuggaguguuugaagacagcuacaguguacuuagauuaaauaaauaaauuaaauauuaaaaaacaaacaaaaaccaaaaacacaucucagggacaaguagggaaauuuacuaugaauuguuggaccauucccauucauuuucugauugcauacuguuuguuuguuuguuguuuugguuuuucaagacaggguuucucuguauagucuuggcuguccuggaacucacuuuguagaccaggcuggccucgaacucagaaauccgccugucucugccucccaaguacugggauuaaaggcgugcgccaccaccacccggcugcauacuguuuuauggcuacacagaaguuuguauucacaggaugcacauuaugauauauaaucguuuauaauguauaauuguugagauuauuaaaaauuagauaccucagggguaaacauuaauggcuguucauugugaguggaaggcuaacaguuuucauuuuguucugucagcuuaaugugauggauauuuuauuaguuuuauucuaaaauuuuguuugcauuuacuuguauuuguugggcagcuggaaggguagacgggcacauaccacagugcgcucuggaggucagagggcugcuuacaugaaucucuucucccaccuuguugguccugaagacagaacucuggucacuagguuugggagugacccccguuaccuccuaagccaccucucuggcccguuauuuuuauuauuuuuuucaaaagguuuauucaguguacauguauguaucuacaggcauguauguauguauguauauauguguauggauauauguauucucuguguguguuuguguguggugugugcaugugugugugguguguguauguaccuucuucauugcaguguuugcagaggccagaaaaggcauuggauccccuggagcuagaguuaacuguuaacugugggcugccaugugggcacugggcacagaagccagguccucugcaagagccagugcucucugccacugagaccuuuuacccagcccuacucauuguuuaggacuaauuuuucgagacaaagucucaccacguagcucugaaguccuggauuuuguuauguacagaggcuggccuugaacucagauacaccugccucuguuuccugagucaccacucaggauuccaggugugugccaccacaccaggcuaugauuugacauuucuccuugucuccuguguugcccaggcuggccuugaauuuacagcccccuugccucagccucaucaguagcucggauuagacauacuggcuuuuucuuuuuuuuuuuuuuuugguaaagcgaugggaguucggggaucucauuugcaaacagaacacuggugugacccaggcuaggaagggacacccagcugguuagucaugcugccugcuggccucccagaagccgcucugugcacacaguggccacugugucuuccuucuccagugugcaaguauguugcuguggagcugaagucggcuuuugaggaaacgggaaagaccaaggaagugauugacaccggcuauggcauccuggacgggaagggcucuggagucaaguacaccaagucgugagugcagggugacucagggggccuggcugcugcuugucuggcuuuguugaagagggauuggggaagcaggguugugguuccuauuuucucccacccagccaagcccacaacaaggucuuugucgaaauaagggacucaguuucuucgcugauuacaacauuggcaggcuaggugaccuucaucaacccuuucucugugcuuuaaauuucucauccagaaaagugagaccaacaggaguccugauggaucccagccacuugcaucucacgauccagugugauuuauuuaaaaauugcuaacauggagggcuggagacccucagggguuaagagcacugguugugcuuuccagaggucaugaguucaguucccagcaaucacaugguggcucacaacuaucuguaaugggaucugaugcccucuucugaugugucagggacagugugcucauauacauaaauaaauaaauagaucuuuuuuuaaaaaaugggacuaccagaguuuuguuuuuuacauacuuaagugagacagggucuuucuguguagcccuggcuguccuggaacucacucuguagaccaggcuggccuggaacucagacauccgccugccucugccucccgagugcugggauugaaggcgugcgucagcuggauuaccagauuuuuauuuugcccgauacaaacauaaaaaacaaaaacaccuugugccaguuaagaucauccuuucaaaaugccaugaggugggcuggggagauggguuagcacuugaaagcacugcuuggucuucgaggaguccugguucaauucccagcaccacacaaccaccuguaacuccagccccaggggaucuaguauccuccccaguccuguucaggcccugcaugcaggugguacacugacggacagacaagcagaacagccaugcacauaaaguacaaaguuagaaaaguugaaaugacgcaaggaccagauugugaggcaagcagaucucugcaaguucaaagcuggccuagucucguucuauacaaagaaacccugucuugaaaaauaaacaaugggacagugcuuucccuuuccugacauugcgacccuuuaauacaguuccucaugcuauggugagcccagccauaacauuauucucauugcuacuucauagcuguagcuuugcuacugucaugaaucauaguguaaauaucugaucuguagaguauugguaugcaaccccugagagaggguuguuaaaccccugcaaagggguugagacccacagguugagagccgcugcuuugagaaugcuugcugcuccuccuggagaccgaaguucaguuccuugaauccauguuaggugacucucaaccaccuguaacucuagcuccaggggauuuggaugcccuuuucuggacacuuugggcacacccauaaaugugacacacacauagacacacacacacacaccaccuaaauuaaaagcauuuuuuuuaacagaagaaaaugcaaaggacauguuuugccgucagaaugauuccugucuagguacaguguuccuacccauugcccuucacuuggaaaaaggcagaggcagugagguuugaggccuccuuguuuggccugaugaguuuugcaucucccagagcacauagcagaacaggaggguagcgggauggaaggggaugugcuggggacagcaccacacaccuggugucccagccagaaccgugacaagucaguacuuaugcccuacuugcccuaccaauuugucagcaaucccugaggacaagggccucugggcaggucugugaggauuaucuggauuaagguuagccucuaaggaugucuguggagacugugauuacaaaacacuaauuauuauguggcuagacucucucucuuucucucucucucccuccuucccuccuccccuccccuccccuccccuccccucccucccuuucucuuucucucucucuuucuuucuuuucugguuuuauaagacaggguuuaucuguguaucccuggcuauccuggaacuugcucuguugaccaggcuggccuucaguuaauggaucugcuagccucugccuccuaagugcuggaaccaaaagugcacaccaccacaucuggcuauauuuucagucuuuuuuuuuuuuuuaagauuuauuuauuauauguaaguacacuguagcugucuucagacacuccaggagagggcaucagauuucguuacggaugguugugagccaccaugugguugcuggguuuugaacucaggacuuucagaagagcacuuaacugcugagucaucucuccaaccccuauauuuccagucuugagugagaugaacuauuaagcauacaguaagcuaaaguaagaaaauaaauaacggauaagaaggaagggcggaggaagccagcaagcacaacauucaaucaggugucaaagcuuccaggagaaauggaucggagaagcccuuaaagugaccagcuagaguucuccaucagaaguccccugcaggcggcuguccccucaugcuaggcuuccacguaaauaaacaaacaccaguaaucaaaucaagcucccaccagcauccaggaggaaacagggaaguugaggcagugagcuggacuuugcagcugagcacucuggccauggcugagcugccaugucugaacuuccagcuucccuuucccacugcagacauccucauuucaugagacaagcaguaauagcaucuauuggaaguaguuuaucuccgugcucagagcacauagugcagaauccccuggagaggagucucuaggccuucccacuucauugcuuuuccucccucccacagagucgggggaccgucccacccccaaacaaggcaccuugaggacacuuugagaaacacaugcugacaugagugugaggugggagggacaaagcuacucucaggguuagugucucagugagcucagacaacaccgguuugcaaguguauauauauuacacuuggauuggugcucaccuugaugucucgacuacucaguguuugcuuccgugugaugcuacuaaaacagucaaacaaccagauagggaagucacacagccugacagggaagcucggccgugcucagaauagacaggucugccagaucccaaaggaaaagaugaggucaugacccaggagaugcaaacaaauggcuugagagaaauggggugcugggugcucgccuuuaaucccagcauggaggaggcagaggcagguggaucgcugaguuuaacaccagcccggucuccacacagcagaaagaaagagaugguuaacaguugggcgauggcugugggcuuugauucugguccucagcaccuacaugaagagugguacccaccucugaucccagugaugggagggcugggcuggagggaggccugaacuuggcuccuaccucagucuaguucagaaggugagcugcagauucagagaaauccugucucaaaagacccaaagagaucaaagacacauccgccugauggcgaucuccaccagaaaguaggaguagucaaggacuugucugucaugccugaugucccagauuugauuccuaggaccacagauuuucuaaaaaguaagagcuggagggauggcucagcaguucagagcacuugcaacucuucuagagcaccuggcuuuagugccuugucaggcaccuuacggccaccuguugcucugacaccaggagauccaaugccuucugcuggccucuaccagcaccuaccugcacacguggugugugugcgugugcgagagcucacacaugcacaaacacacacacacucagagauuuaaaaaugauugauuuaguaagguuagacucagugaucgcuuuugcucuagacaaaccaagauacuggguuugaccccacagacacacacacacacacagacccuugccuuagaucuguuaaaauguugucucucuggucuguguuccagcauuucagagaccccaggccagaugaccuaucuuccuuccagcucugccuucccauuggugagaugugcaggugucgggcagcagggcuggagggaaaagaccgcugcuccaugaggaggggaggggaacuuagcgccucuccugcugcugucuuggcagggacuuacgguuaauugaagucacugagaccauuugcaagaggcuucuggacuacagccugcacaaggagaggacuggcagcaaccgguuugccaagguuggcuuugugcuugcgccucauucccuuuggggccgggcccucgugaaucuuaagugugucugcugguaugugugugauuggcaagucaugccugggaccagccuccuuuuccucccuuagguucugggauaccgcagcaguguaagguacauuucuccaugucaggcacaggcagaaaugccccaugauggcagcucacaugggugucaaacacacuaggagucagcgagauucucacagaagugugaggggagaugccagcagacagacuugaagguacuacaacccugucuuuaaaaaaucgauaggagacagugauuaccacguccuucugugagccacccagagccaccuccucagacccguuagguaccugugugugcaguggcuuucccugcagaaggagcugcuuacaguaggcuccugcuugucuccgcccacauuugcccucuguccgaggauguccaccauagcccccaggccacuaagcaguucaggcagauguuuuggauuugucuuuaaagcuuaguggguauaguuaguugauccaugguugcuuccauaaaaaguguuucaaaguauuuucucuugcucaagugcaaugugacucaccuguucauuccagaauugaggaggcaggaugaggguuuuaaaaaaauauuuauuuuauguauaggaguacaccauagcugucuugagacacaccagaagagggcaucagaucccaccaugugguugcugagaauugaacuuaggaccucuggaagagcagccagugcucuuaaccacugagccaucuccagccccggaucucugaguuguaacccagcauagucugcauagcaagcucuaggccagaugaggccagagugggauucugucuccagaacagugggagaccacgagcuauaaaaucuaugacauauauaucacugcuuaugcagggggcauuggaguuucguuuuucaugguguggggaugagagccacggcucugcauaagucaggcugacguguguguguguguguguguguguguguguguguguguguguguguguguaugugugaauuucuuuccagggaaggggaaauguggguagugcauuaucauuaucucugggacaaggacuacccaggaagccugcccaauuuuucacagaauaaagaauccuuuaguucucagcugagcucuguucuugccaaggaaagacacaagcuaaggagaaccuggauccaggaagggccuggguacggaggagagcgccuuaagaguagugaacacuggagcgauggccuggcaguuaggagcacuuacugcucguguagaggggucaggcuugauucccagcaccagauaggaaccaggcgugcacacggggcagacaaaacacacauaaaguuaaugaggcugcucuaaaaaaauagaaagggccagguguggugacgcacaccuuuaaucccagcacucgggaggcagaggcaggcggauuucugaguuugaggacagccagggcuauacagagaaacccugucucgaaacccccaccaccaccaaaaauaauaaacagaaaggaaggaaggaagaaaaggcacuugcagcccuucuuacccaaguguuuacgccacccuagguauacagcaacagugagcaagugcagacaccagauaacgcuuaggccagggaggugggucaguggggauaagguccugacuuuggauccccagcacccauaaagccggaugcaggagagugugccugcuaucccaggguuccuguagcaaggagggaggugggcacaggagacuccccagaacuccagagccagcaagucugccauauacaucggcaaaugagagacccugucccuaauaggguugagggggaggggaggcccagcacccaagguucccucugucuccacaugcacagccaccaacguaaaacaugcaacauacacagagauuaacaacaaagagguaaauguuggccgaauguuugguacuguagggcaccccaucuuuaguguuuuguuuuuguuuuguuuuuuuuuuuuuuuggagucagugucugucuuagucaggguuucuuuuuuucuuuuuuuuuuuugauuuauuuauuauuuauuauauguaaguacacuguagcugucuucagacacuccagaagagggagucagaucucuuuacggaugguugugagccaccaugugguugcugggauuugaacuccggaccuucggaagagcagucgggugcucuuaccugcugagccaucucaccagccccuagucaggguuucuauuccuacacaaacaucaugaccaagaagcaaguuggggaggaaaggguuuauucagcuuacacuuucauguugcuguucaucaccaaaggaagucaggacuggaacucaagcaggucagaaagcagguguugaugcagaagccauggagggauguucuuuacugacuugcucagcuugcccucuuaagaaccaagacuaccagcccagagauggucccacccacaggggccuuuuccccuugaucacuaauugagaaaaugccuuacaguuggaucucauggaggcauuuccucaacugaagcuccuuucucugugguaacuccagcugugucaagaugacacaaaacuagccaguacaauugaccccuugucaacuugacacacaaacacaucacuaguaagccucaacccuuacauucuuauucauccccaaggucuaaauaacuuuaaacgucccacagucuuuacauauucuuaaauuuucaaucucuuuaaaauauccaucucuuuuaaaauccaaagucuuuuuacaauuaaaagucucuuaacuguggauuccacuaaaauauuuucuuccuucaagagggaaaauaucagggcacagucacaaucaaaagcaaaaaucauucuccaaccauccaaugucugggauccaacucacgaucuucugggcuccuccaagggcuugggucacuucuccagccaugcccuuuguagcacacgugucauccucuaggcuccagaugccuguacuccacugcugcugcucuugguggucaucucaugguacuggcaucuccaaaacacugcaugaccgcuucaguccugggccgucaauugcaacugaggcugcaccuucaccaauggccuuccguggccucucacagugccgagccucagcugcucuucgugacuccuucaugccuucaaaaccaguaccaccuggugacucuuacacauuaccaaguccagccacagcacaagguacaaccuuggcuaucucuggaacacagccucugugcuuucagaaaucacuucccagaagaugucaccucaacgaugcuggucucuucuuaaucaccgcuaauuucuuagcuccagcuaaccagcaucaauagucccaguaaugcaaaguuuuugcuuuaguaguucugguaucuuguuaaucacagcugauucuucagccccagcuaaccagaaccacagaaucuucacaaucaaaguaauaauggcgcugaaaagagucuuuaauuuucccucugaaauuucacaagccuggccuccaucuucugcacuguuuucaacauuaucuuccaagcuccuacacaacaucugacagagcucuuaacaacgaguggaucuucuagcccaaaguuccagaguccuuccacaguccuccccaaaacauggccagguugucacaggaauaccccacucugcugguaccaauuuaucuuagucaggguuucuauuccugcacaaccaucaugaccaagaagcaaguuggggaggaaaggguuuauuuggcuuacaccuccauacugcuguucaucaccaaggaagucaggacuggaacucaaacaggucagaaagcaggugcugaugcagaagccauggagggauguuacuuacuggcuugcucagcuugcucucuuaagaaccaagauuaccagcccacagauggucccacccacaaggggccuuuuccccuugaucacuaauugagaaaaugccuuguuggaucucauggaggcauuuccucaacugaagcuccuuucucuuugauaacuccagcugugucaaguugacacaaaacuagccaguacagugucuauuuugacuuugggucaugggccugagagcuucugcuuuaccuauguccaguguggcaagaguuuguguagagccguuuuggagcauugaaauuguguccugaaaccaaguuagccucuacugaacgcuuucuauaaaacucaggucaggauucuaugaaacucagacagcagggguuuuguuuucuugguuugguuauuugguuuuuuagagacaggguuucuccguguagcccuggcugaaacagcaguuuuuaaaauuuauuuacuuguuuacuuauuuugaggcagaggcucucugugacauagcucugacugccccgaaacucacucuguagacaagacuagccucaaacucccagagauccaucaguuucugucucccaagugcugagaauucaucaccacaccaaccuuauuucuauuuuuuuuaauuuugagacaggaucucacuauauacuccugguuggccuagaacuaaauauguaggacaggcuggcuuugaacuuucaagagauccaucugccucugucuguuucugaaauccugugauuaaagguccuagcuggcacucccagccucaaaccaaaauuaaaaauaaauaaauaaauaaaauaaaauaaaucaccccaagauauuuguuugauacuuagaagauaaagaauggugauaggaaaauaucuggggcuggugagauggcucaguggguaagagcacccgacugcucuuccgaagguccagaguucaaaucccagcaaccacaugguggcucacaaccauccguaaugagaucuggcgcccucuucuggagugucugaagacagcuacaguguacuuauaauaaauaaauaaaucuuuaaaaaaaaaaaaaaaagaaaauaucugaagucuucguuuuccauaauuaaaccauucuguuugaugagaaugucuagccauuagagaaggagccaaggauagcuuauauucuggaaaagaaaucuaaguucacaagaccagagagcaacuucauacaggggggaaaagacagguuggggcguguauauaguugggugguggaaagccagccugaggaggaagagaggucagggccaaggaagagcagccuuagauguaugcacacagaugucaaaaaccagaaagagggagguggaggcagagauggugcugcauccugaaucugguggccucuuccaggguaugucggagaccuuugagacgcugcacaaccuaguccacaaaggggucaagguggugauggauauccccuaugagcuguggaacgagaccucagcagagguggcugaccucaagaagcagguaauggccccucagccugcacuugguggggugggcaggacuggcugcuaaugaggagggccauccagaaccaauccuuuguuuauuagagauagguucuuacuauguagcucuggcuucucuggaacucaguaucucucccuaucuaucuaucuaucuaucuaucuaucuaucuaucuauccauccauccauccaucuaucuauccauccauccacccccccacacacauacacacacagacacacaccagguugaccucaaacucacagaaauaugccugccuuuacaucaagaguguugggguuaaaggcaugcccaacauaccugguaccuuuguacuuuuguggaucaugguguuguagccaagcgcccuugagaguguugagaguguugggugccuggcccccccagucccuagugcuaucuccacagugugacgugcugguggaagaguuugaagaggugauugaggacugguacaggaaccaccaggaggaagaccugacugaauuccucugugccaaccacgugcugaagggaaaggacacgagugaguuggggcagggcgagguuuaucaucugcugucccucaggggaggucgaaagcauggggcagggaaguggggggucaucuuaucccagggagcuugaggagaugaggugagguugccccaggaauagaugggagccugcuggccaguuaggcaagggagugagcggcaaggagauagauggguugaaggcugcuccccuaagccccuuaccgugcugcuccuaggcaagcugguccugaggccugucugcaccuucccucagguugccuagcagagcgguggucuggcaagaagggggacauagccucccugggagggaagaaauccaagaagaagcgcagcggagucaagggcuccuccaguggcagcagcaagcagaggaaggaacuggggggccugggggaggaugccaacgccgaggaggaggagggugugcagaaggcaucgccccucccacacagccccccugaugagcugugagcccagcuuaguguccuugaaucaagaccccugacuucagagcuugggacacgcacagcgcagcgcagcgcagcuccagcaaggacagcugcuguccagcaucaggucuccucccuuggcugugccccuuuccuucccuugaacaacagcaagagguggaaggaucuggggugcugggagacggcaccccaaagggaagaggaggaggagcagaaggcagcucucuuucuacacagucccccucacgagcuccgggguccacccagcauccccaggcugagauccaggcuccugacauggaagcugaagagcaugaggcacauaagaugcucaccagcgcccccuucagccaggaaggacuccgugcagccucagcagccaggccugccucuuccuuccaccaagcauucucuucugcugguccuugucggaugguaaauucgagaacuuccaggacaaacucggguguggcacaaaggggcuggacgccagagccagagccacgccagagacugcagagagggcaccugaccuaaccccccuggaaagccaaucugcaguucccguguccacccacuccuccugaggacgccucaugcucugcccagcccuucucccagggcuaccagaguaaacaccuuuuggccuuucgguuugguuccuggguccucaucagccuccagaguguccccucaucgaucuuuuuugccuuugucccccaaucccaggggcuggaaggccaucaccaucauuggaggcuuaaccugucaguuacuaggaggugcugggagcgcccgggguugguuugggguaaucacucacuggcucucagccuucuaacacugcagccccuuaauacaguuccuucuguuguggugacucccacgcccccacacacacaccauaaaauuauuucgaugcuguuucauaacuguaauuuugcuacugcuaugaauuguaauguaaauauuuuuggagaua

SEQ ID NO: 8649 - RNA, 8779 nt, Mus musculus
acggcucuuuuuaaagauuuauuuauuuuauguaaguacacuguagcugucuucagauacaccagaagagggcgucagaucucauuacagaugguugugagccaccaugugguaccacugagccaacucuccagccccugggcgaacggcucuuaaccacugagcccaccuugggcccccucgaguguuuuuggagucggggucguuaauacaucgaucuuugucugccuucauagugacaccaagcuugccagcaguccuucuuucuaaauaggcucgguggcuacuucuccauaggccccaauggcaguauacuagcugccagaaugucuauccauguagucaagguccuaauagaccugggucaucuccagcaacauggacaaccccacuuguuucuugagucucuguaacccuggcuggccucaggcucacaauaagccaucgccuuuggggcuggaggcacaagccaagugcaccugcuuucucagagggccuagaauuggucccagcauccaccucugagccuucauuugccaguaauucuagcuccagggcaagugacacuuccuggcuacuuuggcauguacucacacgcaaaaaucuuaaaaacaaucuuuuacuauauagaaaaaagcuuguuuuaaauuccaagcaagccagaaauggaagccuuagcucugcucgcccaggccucucuccaaugcuacagugcuucccuacuuaggaagaugcaggauucugcaggaucccagaauguuaaauagccaugcuguuuguccaagguugcgaugcauuuuuggucaccucauuucccaaugaucaguuaacacugauccaggugaaauuuagugggcauuuccuggguacaugugguuuaggaaacaacaaucuaucacugcauugguuuuuguuuuguuuuuuuucugagacaggguuucucuguguaguccuggcuguccuggaacucacucuguagaccaggcuggccucgaacucagaaauccgccugccucugccucccgagugcugggauuaaaggugugcucccccacuguccagcuuuuuguuuaucuuuaacauuuucucuauguguagcccuggguauccuggaaaucuguagagcaggcuugccugucccugaacucaugaagucugccugccucugccucccaagcgcugcaacuaaagguauacacaccaggcccaggcaaacacuaguuuuuaauagaagacaagugauuaaacuucaguccccuccgguagcacagaaugcaacuagcuuaacagaccaaugugcauaaaaaugcaggcuguagccgggcgugguggcgcacgccuuuaaucccagcaccuaggaggaggaggcaggacugcuguggaguauaaggccagccagggccaacagggagacccugcuuugaacaaagcaaacacaagacugccuacccugacaaaaauaaaaaguaaaaccgggacccucuugauccauguucaagugcgccgcuuggucuggcccacugcucuaacagucuuggagggggugggagggagguuugugcuuguugcccacccaacauuaaacaccaagauagaaggcaggaugagcaggguaauucuuuccuccacagcuugcguggauuucgagacaggcagccaaugagggaacucguccuuccauggacugagcuguguuaagugucuccggugcucgcaccuuacugucguucucuaggcccaagccuuccuucaguuucugaaggcagaaaauaaucuucucugaagauacuugauaauuuuaaacgacgacaaaaacacuuccgaggggugcuuuuggaaaaccuaaggagggaaaacacagcugugucaacaaaccaaucucaacuugggucugagagaacagcgacagaguguuccagucgcgauccuucagcagaacagguaaccaaccggccugcauaguccuucugaaaucaguuucugaugugauuccuccuccacugcaggcuaaaaguccacagcaacauagacauuuucuagcccgugaccuaacagagcuguaucaggcauugucccuuuccaacaggucaacacacaggcuuguuccuguuuucacacagaacaacucucauucuucaagugccagggucaacugcuaacuagcucuccagcguacagagggacuucuaguugacaagcauggcccaccaaaagucagacaaggugccaacaagauggcucagugaguaagacugcuggccacaaagacuacccaguaaagauucucagaaccaauagaggagagaaguguccucugaccuaccccagugcuggguuuggcauggccucagcaggggacagaaugacauggcucucggcaccuguauagggccagcaggugugagccuccaugaguguugacggcugcuaugggcauaaggccucuuuguauaauaauguuuguauaaugacuuacauuccucaggaauguuaucccaguuagcguuaaugcuagugauaaccagucagcaugcaucaggggugaagguauggauggcugaggucucaacaaaaagggaaaugcugggacauucaugacagcacuuaaguuugugaaaaaggacucuuaaaaacauggguucagggcuggcgagauggcucaguggauaagagcacugacugcuuuuccgaagguccugaguucaaauccagcaaccacauggugggucauaaccacccguaaucccauaaugagauuugacauccucuucuggcacaucugaagacagcuauaguguacuuaaguaagagauggcucagugguuaagagcauugacuguucuuccagaggucccgaguucaauucccggcaaccacacaguggcucauaaccaucuguaauggggucugaugcccucuucuggugugucugaagacagcgacaguguacucauauaaauaaaaauaaaaaaacugcugggcuugguggcucaugccuuuaaucccagcacucggaaggcaggggcaggugaacuucugaguucgagcccagucuggucuacaaagugaguucuaggacagccagggcuauacagagaaacugucucaaaaaaccaaaauaaguaaauaaauaaaauaaauaaauaaauuuaaaaaaaaaaaaaaaccaccgggcgugguggcacacgccuuuaaucccagcacuugggaggcagaggcaggcggauuucugaguucaaggccagccuggucuacagagugaguuccaggacagccagggcuauacagagaaauccugucucggaaaacaaauaaacaaaacaaaaaacaaaaaaauaaaacggguucaaaaauauauaauuucuggcuggugagauggcucagcgguuaagagcacugacugcucuuccagaggucuugaguucaaaucccagcaaccauauguggcucacaacuacccauaaugagaucugccacccucuuguggugugugugaagacagcuacaguguacuuacauacaugaggggcuuaacaaaucuaaaggaacaaaagcagcugcgcugcgagccagcuuguuugucagaaagauacuaaggaaggagauaaagagauuuagggaguggugaccacuaaguuguuauuuuuguugcuguuuaugcuuacaaaggcagacagauuccugaguccagggugacuugggacagagcaagguuagacccaggugugauacaagugguaauuucaggacccggucccacaaacuagcucccugucugugauaacagaggcaggcagauaucugaauucuuuugcaaaguuaaaagaaaagguccauuugcagucuccuaagaauuaaggagcuguggucaagggaggcugauucauaggaaccuggaguaacuaucuggauugauuuguaaaauaaaaagcugugccuauaaucugcaagagacgagcuauccagucucaagcagaacagagaggaggcuggccaagugucuggagcagggcacaggcugccagcuuggacccagcaccugacuuugagcuguuuguuuccccgcucccagucaccccuucucaggcccucuccgagccgaggcuggugucuggcgacacaagcgcugugcagcaggcagcacacacucgccucaccugcuccugcucuaguugagcugccgaaugagcugauugauccgaucuccccgguagcccggggagcccaucucuuugcggaagcccacucuguuccugguagcauggcgggccacagagaggaggaaagggcacagaaaugaagagaccuccuggaaaugcuucccagggaaggcaauuucauggaugaggucuuccaggcaaaugacaccaaaucucccugaaaaacaagaggguguagauuucuguguucaccaccuagccaguauaaaggggggaaaaacccaaaaggcugggacugucagguccaagaauacacccuggaucgcagccaccaagcccaggccacagcacucacccaggugcuccucgaucaccguguuguccgucagagggacugucuuauuguuaaucuuugcuuggccacguuucaagaugagcucccggacagacuucagauuuggaaaucuacauaggcauaacagggacacuaagaacugacugagcagagagcuacaggacccucccacacccaccucccacaagcagggaguagacuauugggcgacccaacugagaagauggccgaaaagcagagcagcuaaugccuacagagcagcuaaugccugcaacucuagacacugaggcuggagggcccugagcuguacaaagucugaggugagccaccuaagcagucaaccgaaaaucccagcaugggcuugaguauauaauuagaaauuuagauauuuuuuugagaccagaucuuauuuucauagccuaugcuggccucaaacuugcagcaauccuucugccucagcccuugguguacagggauugcuggcccaaagcaccaugcucaguacuaaaauccgguucuguuugagucuugcagcagcauagcucaggccggccugggagccacagcaccucccugccauagcuucccagugcugggucuuaggugugagccaccacacacagcaauggcuucaagcauuacauuagucuccauauuguucauuuuaccgagucauaacauacagacgaauaagccggcagcucuuggaccauugacagcaucacuauccuccccuaggaccuaagguucuuuauuucuggugacugccacagcaaagugcccaacacacagcaugaaccuuggaaaacaauacccuguguaucuguuuuacacacucugaguacgagggaauucacauggaaaauggcacucacccccaggucacauaaggcuccaccgugcgcagcauucuuacacucugaggggugaccuugacaaagacaccacugaacaauuucuucaggccaaguuucaugauggugcucuuuaccaauaaacucacuccuucaauccugaaacaacagucaaggugucugaccccagucuaugcugucuguuugcaagcaauucugaaaugcuagaguguucacuggguacacagaauuuaccucagagcucaauguugugggaggcagaguagaaacagaccauguuccacugugaggagcaaucccugcaugcuacaggacaguuccugaaugauggauugguggggggaguguuggggacaguggggaugguaggcuauauggacaaguaugucuaccuagggaagccagacugcgucaguggguggguagugaaagcauggaacauauucacagcaggucugagucuggcgucaaagccagggaaguccaguucaggaagcuugaagagagcagagcucagaaguuucaaacucagagguuuucuaccaaaaggcacacggcugagggcaaugaagccugcuaaguguggacaaugcuucuagcacggugcccugugucuuuaaaccgucacaggacacauggccaugagcaauccuaaccuuuacucugugcuucauugcuggguuuaacggcacguggcacaaugccgggccuacuuucaugucuuuugucaaguugugguuacuacuuuagaaaggguaucacuagggggcuggagagauggcccugugcuuaagaguacuggcugcucuuccagagguccugaguucaauuccuagcacccacaugguggcucacaaccaucuguaaugggaucuaaugcccucuucuggugugucugaagacagcuacaguguacucauauacauaaaauaaaucuaaaaaaaaaaaaaaaaaaaaagagccccaccuucacccugaguguccuuaugucacccaugguccuaauuccgaauccuagccaaucuucuguaguagguuaggcuuugucucccuacagagccaucugaaguugaaccaaggacucugaaaacacacugguacuguaccuuuccaugcguauaacgaaggccaagggauguuuaucaggcaccuccaaagcacgaggcuucaccuccagccgcuggacacgcaccuugucacguugcugucgccaggaaucaugcacgaaagauucuagucgucugaaccugaauugcuuuccuuuucucuguggcagagaagacacgcaucagcaucucuuccccuccacaguuaacccaggaccauuaguaagagagcucagcucucaaacguucugcaaagugggcagaccauuaccuaaggggcacaugaagaggccagauggaacugagagauguaagagcagucagugcucuuaagggcugaagaaaaguuuguggugagcucauaugcugguaacauuuaauacagguguuuaggaaacucaacacuauauuaggcaucauuaaacaagaggauuuucuucucuuugcguucaaaaauccuguacauacugugugcagaaucuacacauugguuuuucgagacaggguuucucuguguagcccuggcugaccuggaacucacuuuguagaccaggcugaccucgaacucagaaauccgccugccuuugccucccgagugcugggauuaaaggugagccaccaugaccaggaauuuuuuuuuaauuagauauuuucuuuauuuacauuucaaauacuaucccgaaaguucccuauacccuccccccaaagauuuauuuauuauuauauguaaguacacugcagcugucuuuacacacaccugaagagggagucagaucucauuauaggugguugugagcuaccaugugguugcugggauuugaacucaggaccuuccgaagagcagucagugcucuuaagggcugagccaucucuccagcccacacgugauucuaaauaaacuuuuaaaauuguuggauacuuuugguuugagacagguucucuuuauauagccaaacucuccauuuuccugucucaaccuucuagaaugcugaaaagugugccacagauagcaauuuaaucgcagcauucuagaggccuaaguaggcugaucuguuaguuugaggccagccuggucauacaguauuccagaccauauguacagaccccaucuaagaaacaaaccaaccccaacaaaacauuuuuaaaauaaucuauuuuuuucccugccaaauuugguuuuaccacuaaauuugaauucagaaaaugucuucacuuuucccuuaaaggcuggucuaacauuuugcucacagaaagaugguggguaaaucuuugcuaaauggaggacuaugagggagaaaccugugagggaucugauaacaaaucuaguucaacgaacaccguuuaguaaaauccguccacuacaaauccuaacccccccccucucagaauuaccucucucuuugccaaaagugccugcuuugccugaguggcuuugagggcuugauaagccuuccucuuuuucagaagauuuucuggaaccaaaggaauuuuuuuucuuucccugauaaaggaacaaauuugacauuaaugaaaauugccaaaccaacauuugguggcuuuccaaaccaauucgagauccuggucuucccgggaccuaaaguuucugaugagucuucgccgugcuccuguaaugcucacucgucccgagagccuuuaaaaaucaggaaaaaccuuugcucucuggguucguuuugguccguggagcuuuaacaacuguaggcuaugaccugucacuagcggcaaggaaauucuaguaaaauccagaaaggggcuaucacagauccaucaagaagaguaaugauuaagucgagcuaggaugagguggggggggggggcacaugaaagcaggagggggaauuggggggaaagagcuugguggaagacgcaggggaauaagagaugauggggaggugauacgaucaaaauacacuguacguguguaccaaacugugaaagacaugacagccaagcugagcgaacucaacucuggcgcuacgcagccacucgccccuccgaaccucaguuccucuucucgcugcuuccaaagucgucccgaucccuggucgcggagcccuacagcaucucagcccccaccuugacuucauacuauggagccuuuuucuuuucucuccacagcccacagcuuccuuuuguaucaccagaguacaaacagaaaggauggcaucggauccucaaagccccauagagagauccgaagacacacucacccuuccuccgccaucuuuccggugcuucagcuacugcgcuugcgcagccucaccg

SEQ ID NO: 8650 - RNA, 644 nt, Mus musculus
aagcuuguuuuaaauuccaagcaagccagaaauggaagccuuagcucugcucgcccaggccucucuccaaugcuacagugcuucccuacuuaggaagaugcaggauucugcaggaucccagaauguuaaauagccaugcuguuuguccaagguugcgaugcauuuuuggucaccucauuucccaaugaucaguuaacacugauccaggugaaauuuagugggcauuuccuggguacaugugguuuaggaaacaacaaucuaucacugcauugguuuuuguuuuguuuuuuuucugagacaggguuucucuguguaguccuggcuguccuggaacucacucuguagaccaggcuggccucgaacucagaaauccgccugccucugccucccgagugcugggauuaaaggugugcucccccacuguccagcuuuuuguuuaucuuuaacauuuucucuauguguagcccuggguauccuggaaaucuguagagcaggcuugccugucccugaacucaugaagucugccugccucugccucccaagcgcugcaacuaaagguauacacaccaggcccaggcaaacacuaguuuuuaauagaagacaagugauuaaacuucaguccccuccgguagcacagaaugcaa

SEQ ID NO: 8651 - RNA, 644 nt, Mus musculus
uugcauucugugcuaccggaggggacugaaguuuaaucacuugucuucuauuaaaaacuaguguuugccugggccugguguguauaccuuuaguugcagcgcuugggaggcagaggcaggcagacuucaugaguucagggacaggcaagccugcucuacagauuuccaggauacccagggcuacacauagagaaaauguuaaagauaaacaaaaagcuggacagugggggagcacaccuuuaaucccagcacucgggaggcagaggcaggcggauuucugaguucgaggccagccuggucuacagagugaguuccaggacagccaggacuacacagagaaacccugucucagaaaaaaaacaaaacaaaaaccaaugcagugauagauuguuguuuccuaaaccacauguacccaggaaaugcccacuaaauuucaccuggaucaguguuaacugaucauugggaaaugaggugaccaaaaaugcaucgcaaccuuggacaaacagcauggcuauuuaacauucugggauccugcagaauccugcaucuuccuaaguagggaagcacuguagcauuggagagaggccugggcgagcagagcuaaggcuuccauuucuggcuugcuuggaauuuaaaacaagcuu

SEQ ID NO: 8652 - RNA, 1409 nt, Mus musculus
uauauccgggauuguggggugaguugcagcagcggcagcugcacauguggguuuguuuauaagaacaagguuagaaacucgcaggccucccccuccccccagcuccucccugcuacccccuuacaggccggagaucugcugcagggugguggggaggaaucugugcuugugguguugugggggacagguagugcgagaaagauggagggggggguuauugcaccucccggaccgcgucggaggaagcugcagcuggaacagcuggccagggaaccgcuugcaugccucuggguuuuuuucuuucuuucucucucucucuuuuuuuuucccuuucccuuuucccuuccaucaccucuuugcucagccggucccugccgccccgguaacccucauccuuccugcccucccccauccacugcagcucggcgcggccugggggcgucuggguccccgugggcaguuacuggggcgggaagaaagcgcaaaucaccgcuaugggaaagacuggguuccucgcuggagcgggcuccgggguuccugggggagucuaaaaacagauuauuuuuuuuaauggccaauugcugcagucggagggggggcgggggaggaugacaugccacccccaccgucuugcucccugacgcgguggcagccacucccugcgcagcuggcaaccgcuggccgcgcggggcuaagacccucagccggagcgccucgcuucucccuauagggccggcggucuuuaggaaggcgauggggaaacgguacauuauuucuagagguggugggagggauuugucaccggaagugaacgagccuagccuaaaguccagaccaacccgaggugcgagugggcagccaagaccgugcagucccuggcagaagcccaaggcggcggccgccgaggacucggguggcauccucgcgugcugccuucagccaccgugccuucuggacucgguggcccauacaguucucgguuucagccccaucuccgcccuuguugccaaccuccauuuuuguucuuuuaauugggauuuuuuuaacugcccaaaauacucauuugaaaauuuaccaauaugccugcguuuuccugcagauaaagaugggaggaaacgagagccauucaauuaaguuggcauuaagacuugaguugcaagccucacgucccauuugccuccuuuccuaaccauaaaaaaaaaaaaaaaauccaaaccucaagcacaaaaucuugauugaagagaaagcauuacacuacagaaucaaagacaagugucacuggguggcaaauucuuuccuagguggaggguuggagugggagaucacauguuacuguguucuugucuguauaccugcuguaacagagcgccgaugaggggggcggucgguggucacuuaugcaggcuccu

SEQ ID NO: 8653 - RNA, 605 nt, Mus musculus
uacguuuuuuuuuuuuuuuuuuuuuuuuuuuacagaucuugccugaguuuauuuguaagaacagcauaggacacuggucaucugcaaauaguguguggggaagugugucacagcaguccgucugucuucacacugguaggagccuuuucuauggggccuucacaggggccuggguaccuuugggggccugagcaccuuuggaagccugggcuggagcugaagccugggccuuagcuggagcuuuggccccugccuugguuuggacauuaggcuucgguuggcagagccucugacccuuggccaugcagcuucgaauccgcuucccaagcuuagggugagcgaugaaagacagccgcuugaguuuggguccuuuuggcaucuugggcuugauggccucuacacgcgcacucgcugccuuugcauuguuggccugcaucuucuucaggccuuucuuguugugcuucuuggcagggcgcauguuccucaggaacuuggggucaacccccuuaagagauucguagcuuugcgacggggguuucuugaugccauuucugugccauuugcaggacugguuguguguggugugguucuuggacuuggccaug

SEQ ID NO: 8654 - RNA, 2725 nt, Mus musculus
gcucgcauucaaacaaugaauguauuuguuccaagucacuuaccaaagcgauuccagacuucucuaagcuacauggcuuugcucuguccccgacagcagggggcgccauuuguacuugaaggcaauaaaccugcaaucccacaaaacggucauugccuaggcuuucccugucaguuaggcugacccccucccacugcuagugcacagucagacuggaccacugccccuggcacaguggggcgccugucagccucccuucugugaucauggccuguggccuccaggugucuucaggucuuaacccuccuugaguagacuagcuccccagcucuguguaagcguagcuaucauacugggcucugugcuggcccgugaucagcguggcauuagcgagcauccuaguggaggaguaggguuggacacccuucacauuggauucuacaaaaccauuuggcacauacucggggccagggcaccguggcccaccacagcccccacucaggcaguggcuucugagucucaggaaagccacaaacagaagacucuuuaccaagauucuauuccuguccaucacuguuuuuagaacucucuugagguccuuccuaggugggguggggguauauuuuccucgcuguuguuucagaggcuugucguaguagccugugugugaucucagcagcguugcuuuaagaacucccugggcaucuugcaugcgcuuccuuuaaaaccauuccagcggccucuccucagcagaccccaaggcccugucugucguggcgucugcuuagcuacagaaaagagcaaaugcccagagaacuugaggaaggaagcugguguccucccgcuuggggauuugcccaguuugaaaccuuagaaacgagcugaccugccaccgccgauauccaaggcacaguucauuuugauuugucaugcagaauagcauaaggaauauuuugacuugaaauaaccaaagaacuccuccuuaaugagacaguucagauaccuguguuuguauuuccuaucagcuuaaaguuuaauugacuuccgauuaaaauauugcacuuuuuuuuuuuccugaaaugauuuuaccugcaugugcguguuguguuucagcugccccuccucccaggccccaaagaacuuuucuuccuaaugguuaaugucuucacacggcucccacugaugcgaugguuuuucaguaauggauuuagauuuccuuugagaaagccuguauauaaaaaguuaacagauauauuuuauggaaaaaaaaacccaucuuauuuucaaauauauuuaacugcuguuauauuuuauuagaggaagguuguaaauauuuucuaggaguucuauuguaaagaaaaguauuuuugaaaaaaauuaauguaauaaaaaggaaaacguuuuuacauaguggcugugccugcuuccugcugugcuuugguucggccguguucucggccagugacugcaugccuucagaucaggaugugacucagauuugcacuauucuaaguuagcaucgucguuucuaaugugcuuaacuguacguuuccggaaugcggcucccucccucugcaccggcaagugcuguguggagucuucucauguauuuuuaaugcguguauuuuuaauaaggauuuuauguaacauuuuggcaaaaaaaaaaaaagaaaaaagaaaagagaagaggacaguauuuucuagugaauuuuauaauaacauuuugcuaaaaaauguuucuuccuaggucaguuuuuuguuaaggugaaucaaacgucuuauuuuccagggguuuuaaaaaagaaaaagaaaaaaaaaaguuugaagcuggaaagcaacauucuauuuaaacaccacauguaacaaaugaauaaagauguuuuguagaccuguccuuuagaggugcauuccuuaaauuaagaugaugauaauggugaugauggugaugauggugaugaugaugagaugaugaugaucuggggcauccuagacugucucccaucccaaaauguuccgugucaugcuguuuuagauuugguuuguuguuguuguuguuguuguuguuguuguuguuguuugaaugaucacaagacuuuugcagaugagaacgggagaauauuaaggacagucgagccaaucagccuucugagaaacugcugguucccacagguggccaguccuccacuagaaguguaauaaauagcccaauacacagugggcucgguguuucguuagcuguccugaauaaaccgucaccuuuaugguucucucucaguccuucuuucgaccugguggcauagucaaugguaacuccaauaucucaccugcucuguggacaguggguuuagagcugcuggucagauccuauugccguuaaaguguuccuaugccuggagaaaccaggaccaggacuuccaucuuggcuccuccagugauagacauggcauuccccagacugugccaccccagaagucucuggucccagcccuugggaagcagaggcaggcagagcuuuuagaccuuaaggcccucuggucuacaaaguccaggccagccagggcuacacagugggacccuucaccgcccccacccccagcaaaagaaaucuuacuguaaguccuccacaacggcuguguugacccugauuuauuugcauuuuaauacgaaugucuaaaauuuauuugcacuuacuuuuuaguagucacaaauaaauuuaggaagaaau

SEQ ID NO: 8655 - RNA, 3323 nt, Mus musculus
cuuggaauuaaaucuuagguucugaaugaagcuucaguuaagcucugaaagcugucaugucuuaaguuuuugucucaucuggcuuuuaacuuaaaucuugucauuaacugcucaauuaugggaucauggcacacuuuaagguuuuauuccuccagaaaucaguugcucuuuccuaguguagccaaaaucauguggguucuaagucucacacacuguuuacaaggcugcuuccuggucaccuuuuggggcucugcaaguaauggcuucaaacccaagcuuuguccucgaguucauacucaugacccuggcuccccagcccuauuguuuuuuuuuaaaaaaggaagucucaguguguagcccuggcuaaccuggaacucacuauguaggacaggcuggccuuagagauacauagcuucugggauuaagugugugccaccaggccuccagccugccucuucagaguaucuguaaucccaggguaaauucuaggccugaguucccucauaggguguuucuccuagccauccccacucagguccuaccugcuaaagauucacaagagaauggcaacccccguccuaugcaugacuaggcacguggcucaguagggugcuugccuagcaagcauaaagcccagagucugaugcuagcaccacauaaaaucaggcauaguaaagccuugaauccuaaccuguaccugugauccuaagagucgguucauggaaacagcaaaauaagcaguucaugaccaucuucaacuauguagcuaaguuugaggccagccuggacuacagaccagcacaagaaccagauaucucccccucccccccccccccccgcaaaagaacaaaaaacaaacacuuuuaauuaugccucccccaaccccaauuauuuucuggaggucaaauugaagccuuuucugcaaugagcuauacugguaggccucagagaacugacuggaugagcuaugugccagcagguccaggaaagcugcuuugucuuuuuccuuuuuuaaguaacaucuguaacagucaugcagcuaugacccagacacacuaauccuuuccgacgcaugcugugacccacaaccaguuccaaagcggcuggugcauaaaaaaaguuuuaaaauacccagucaauugacuacaugaaacuauggagaccccgucucuaccgccaccugguucccugguacaggagucuuucugugcugguuucugcgugccuggaagaacaccagacagcagcaccagugugaauuucaggguagggagcaccuuuguuugugaaggaagcugcuuccuugugcucccugacacguuugucuccacccacacaucacuguccacuccugccaccaggucucacucuaucccaacaaugccucccuggucccuggagaacccaccuggcaaacuaaaacgacaaccaccaccuucuuccuacaggaagacucagcaguaggaacugcucaagaaucagcuuugcggcacgugugcaucccugggaaguggguggucccauucccauuucaucuccacugcagaucauguuuggggcucaugccugucucuugagugugaaauacaagucauguuuauuugauuuuuguaagcggacuuuuuacaccuuguuuuuguaauaaguuucuuauuaaaagaauaaaauaccugucuuuuaugugcaggcuuuauuugaaaucuuuuucaagaaccauuacuacucuucaggacaagggcaaggaccaucuucugcagaaaguugggaacugcacacagaaccgugcagaggcaacaucucagccgacacugggggaugggggggcaguggggggggguucaggcaaggagagggagucaacuucagcugccacucagguaggaucuuguggucacagacaguaggcugucuuuggaaagucugaauacacaggaguuccauucucuguaagcagauaacagcaucagaaacggggaaacacaggagaacugcucucaccuagaaacacaagggcaaggcuuuaccccaagaaucuucccuacuucugugacuagcugacagaacauacugcugucuucaucuuuuaggauuccugaaauaggcaggggaaagugaagucuuaccuggcuacaccccuggcugaggggccaucaaaucaaugucacucaaguuccuggccagccagacucccgcagcaaagagucccaaauugaggaucaaguuccugggucaagaauacauuucauuaacccuacaguccgagagucucaugcagcuaaugacauacuauggcaaguuuccucucagcaccaccuucuggaggugcugacugacaccugauacagggguauguccuccuaauaugcacaugagaauuuuacguucgcaucuacuaacacaagccaaggccaacuuaguacucugcgggggcuaaaauuugcuuaugcguuggcaccccuucccugccuucuagguuagggcgauuucuuuaaaaauaugacguucuuuaauuuguguaugugcgugcgcgugcacgcgacacagcgcacguguggaggucaguacaacccgcagggguuggucucuucuuguacccugcgggucucauggaucggcgggucccauggaucccaaauccucaggcuuggcgucugaacuaucgcuguagcccggagcgucauuccuugaaagccacgugacagggugucuuuugccaccacgagaccacaagguucucaaagcgauaaaaccucuggggaugcaugccagacucaccagguaaggaaauacaaguuuaaguuuaugaggaccagagacggcccgggcuugguuaccuccggaagucguuucgaucgguggcgaagcggaagacaccgcggagccagucucccacguugucuggaaccucugaggccucgcuggccgacccggcggcgcucaccgucacuccgcuggaagccauaccagcacuaagcacguaccaaccgagcgucgcaccgggucgucgcaagccgauugcgcaacuuccgaucuccgcacuuccgccgaucagcguaagaaaugagcgagaaggcccgcccccaccuccuccaggaguucguagagccaggacgccugaucggaggcggagccccgcggccccgccucccagggacgggggucgguucccagugcugcucuacaacccaguuaguuuaagcaaggugaugacggugaggcuagcccagccucugcggauagggguuagcucacccuguaggcgcugggcagugggaugcucccaagaaagugucuuucaggucagagagcgugcaguaccaaug

SEQ ID NO: 8656 - RNA, 2030 nt, Mus musculus
ugucugcuucccaaccaucaguugacccaaggcgcaggccucugcagcuccagcuugagucacccaacuggcccugcccaggacugauccauccucaggaaugguucugacgacagaagacuguccaggaaggcuggcucaccccagcucucccguaccugcuccuuagcucguguguguauaugacagggugacugggguggggucucucaccagcgggcugugggggcccucgaggcagguccagcucugguggguggcugcuccgcgugaugaugaccggcuccuccgucacguugaugcuguuacacugcaugagguccugcagcagguugaagauguccucugcccucgaacacuugaaugcaaagaugccuggggaaggugaggaagcagugagggccuccaagacccgguuuuccuaaggauaggugccuucugggguggggagaaaaccauggguaggugccccaucuuccuguacccaucacucugccucccagcugcccccacccccaacccuucauccagguauagccaucucuacuaucucugaagacaauugggucugaccuacuuccagcucauucacagacuauucagaccagaggcaaaggcccacuguuuccacacagguuccucucagcuugggagaggcagagcaaggcaguccaguacuccuuccugcagcaggucucuaagcacuuccaagugucuguccacaaaguggcaacacuugacugagcaccugcaacucaauggcucugaagaugccagccuggggaucuguaacacaggccuaugggacucgggggcagcugagggggaugugugaggucaugcacacauccacagcaaagauagauguuaccagguacgguaccacauacccacaguuaaucauuaaguucaaggcuggccugagcuacccaugaaaucccugucucaaaaagccaggguauguauauauguauguaugcaugcaugcaugcaugcauguauguggguuccuagcauguacacaguccugaguuuaguccccagcaccacacccacaggaugauagauacaauuaaacugggauauggacaaugaacauuauauuacucuuauauacugcuacccauuagcuccaguacaggguaacugaaguuuguauaaacaggacgagaaagacggcacgauaugugaaagcuggacaagaccagaaggacagaaguggugauacguggcuguaaucccacacuugggaggugagacgagaauccccgugaguuuggagaccagucaggaacacauauaacaagaccaucucacagggguggggagggaagaggaagaggaggaggaagaggaagagggaaggaaggagaggggaaggaggaaaggaauguggagugguggggggugcagcaaaagucuggcauuaggaggagcccugaacugggagcucagacaaccccucucaggugccaagugcggaucaaccucaccaggaggaagguggccucugccucaccucucugcucacacgccaugcuugccuguaccacagggaugaggugcaugccaggaaaggcccuucagcaaucaacccggaacacgcauugcuuugugcugucucgggagagacagcucugucugcgugcagcacagucccaagaaggacuccucgugcugagcauguguggaccuaagaagcaaggccagaccucaugucccaaccucaagcucaugagcagccugccagccccugagcccugccuguagagggcacaugggcaggggauacaguauacuccacugcccacaggugaagguggacaaaggucaggcucuggaagguuacgcuguauaugagagacccaaaauccugcugcccaagucucugugcaagcuccucagcccugaguagccauucuccugccugacuucucuuccacugugcacggaggccaguguguagggccuggcagcucaggagggguuuuccuaugcaaaggcaauaaagaccuuggaaccauggcaac

SEQ ID NO: 8657 - RNA, 1551 nt, Mus musculus
cccuucuacuccgaguggauaggauggaguggcaugggcaugucccguggccugucagccacuggccaagugacuuuggaggucugucucauggacagacaugagcagaaauaaucucaaccccaaaucuauacagaaguacugguuagaagugugugugcgugcgugugugcguguuccugugcauguguguguguguguguucaaggaagaaagccccacuauggcuuaguaaggcucucuguaagcgucccugacgugccagguacaaacaaagguaaugguagccaucggaggagagagggacugaggggacugauucaaagcaucugucaaagugaugaaugguccaggcuugggccuugagucaccuaacugguagaguuuuugucaggcagaggggacugagagccagguguagccucacaaaucugugauccagcacuuggaagacugcaucagucaggggaauugagaguuugaagccagcuuggacuacauagugagacacugccucagaaaaaaaaaaaaagcuagggggguuugucacuauauucuaaguggcaagauugccauccaaauaguccagcguugguaggccuaaggccuaaaucuggggugagagugugagcuagggaaggaauuugguucuuccccaacccugaaucugucaauccuggauucucuugauaugagguuccuaccaucccccccccuuuuuuuaagaggaaagaugggugaauucuaucuucaguccuauguccaagaucucaucauuggaagauauuuggaacaaaauaaaacuugaggaagaggaggaagaagaagaaacagggaaggagaauguagaccaagagcaagagaaagaagaacaaaacagguguguugagacacagcgccuuccuucuuccuccugucccucccggcucuggagagccucacucuaugaccauaucgguccgcugccccucuaucuccacucccugacuccacucuuccuuccuuuugcucaggaucaaggcccuucuuggaguacccaagcagaacucaguguggggccugauggcuuggcccaggcccuccccagagcaagcccaguggugggaagauuucucccugcccucacuccguggaaccugccucugcggcugcagauugagcucaaagaugaggcuccacccccuacccuccaugacuuccugccccaccccuaaaaccuugcccucauugggaucuagagaagagucuagcuggcuaagaaaccagccucugauggagccucuaucagcguccagauugaagaugcccaaagcaguucccagacuuccacccaaggucuccccuaagagaucuacuaugcccaagacagggcaacagcagaccgcaaugucaauguggccuccgguuauuaucaacccucccuccaagagcucugcucuuaagggacaacacacacccucugccaaagaggucacccacaccccaggugccuggggcaacccuuugccucaucuuccuucaaaauaaauauuuuuuuguuacaccagcaac

SEQ ID NO: 8658 - RNA, 23318 nt, Mus musculus
gcggugucaaauccaggaaguggguguggccucuggaacgccugcgcggugcucuuccuagggggcggggccaggcuggccgggguuauggggcguggucucgaaggcgcuugcgcgaaggcgguuggagggaggcccgauuccccuuuguucagauucgccauuuugcgaggcagcggcaguggcggcggcagcggcggcuggagccucugauuggguuucgggguccgguacuggagccaaucagcgcgggcagcgaaccgggggagcgaggcacggugaguaugaggagccaauauccagcggcccagagccggccccagcgccccgauuggcgggucucgcugaccacucaggagaggcccaggcguccgucgagcccgggagucgagccgaggcugcccgagcuggguagccaguagccccggcucggaguugguggaggccugcaggggccguccagcguugggacggcguccuggagccaggcuuuucgggaucuggaucgucuccgggggccgguggcggaugcgccaccgguccccgauccucggucccgagaggucagguggcugaccgcccagccacggaccguggcgguuuccccacgucguuccagccucauccuacggccuguccuuguguguccccacauuccgggccccgacgaggcccguguguccugagcucugcacaguuggggcuacagauccggagcgaggccagacugagacgcgcggcgcggccucccaagacccaccccggggccguuggcgcgccugccgcgccccuccucucggcccgccaccggggcucccgggccggcgccguuaccaccccuuucuggcucgucauuuccuccccgcucagcccgcggugccggcacaccuccgugcuggagcccaaccaagcacucuuccucuuuuugcucagugucucgguguuugaaacgccgcuguugcagaacugauaacccuugugcauccuuaaugauugggggcacacaucucgcaguuccuauuaucccugucuccucccuugaucuuuucucccuuggaugcucucugguuuuguuuuccuuuaaucucuccacucaauagcucggcccacucgugucucuuuuuucuaauacaccuugaaaucccgcgcgaacguuuucucaacugauguuuuaaaacuuacacgugcuuagauuuucuuucccccuucgggggacaggaagucuuccaaggacugcuagcuauuagucuuuggcggacgucacccaagugcugcaagcgaguagggcuaggagcuaugucugcucgguggagauugacugguguuaguguuucauagggaucugauccaguacccagaagugcacuuuacaugaggaagccuauuuucagcgccacgcuuuugauuggugauggagggugauguccucagagaggaaagacugaaaagaguaacuggaacagauagugcgguuggacgcagaaaggccgggaguacugaguuuaggcgggaaaguccaguugguaaaaaccuuugcaggucuuacaaaggaauuuuuugaaaacgguuuugacuggagguuaaaaguuaaucuagaguggauuucuccccuaaccuugggggugaagguugcugaccugaggauucuaccccauagucuuguauuuggacuggguguucuaacuuugauugguauuuaaaaaaaaaaaauggaugcauauguccaccucaaaacugccaaauguuuuuguggacaaaaggcaguucuccucagucacugugacucagaccuguggagccuccacugguuccucugcaucugcacuuuaagaaaaaguagugcagacucucgauuucucuaaucuaaucacagcccaggcaucucccuuuguuugaaauacuucacccuauacuaccuucaucugggugagaucucagacuuaaaccuaacucacaugacacccuuucccagugcuuuccuugguuuguccccaguggaaaagccucugucccccaaacuccauuuacuguauuucccuuuaggagucuaauacacauuuuuguuccuuuuuagacuuaaaagccucuuugaaguuaacuuguuuuguuauuuaguucaugcuaucuccuuaguggagacaaggagcacacuggagccuucaaaggcccuagcugggugugugugugugaugccaggucagauggacugcggugaucagaugcuuauuguaggagcauuucugggcauuucagcuuuugaagauucuaagugcuggccagcuacuucugugccauguaaaugggcaggaaaugcuauggaagagaaugucucagaggccagaauaaacccauucucauuccuauucauucauauucucacuuucaaaaacacauucacaagucuguagaagagcuagacagacuaaauccagcuggcucaauucugucauaaacuugggcacagaaagcguaaggaaaggaagugugucagguugugucacaguucugcuggcugaguugauggaggaaggagcauauggccgcacuggagccaagaagucggcaccaugggcaaccugaggguugugcuccaagcgccaccacucccuuaucaaugcagaauggcugcuggguuugaagcugccuccaaagcccaguagguuucaauggccuaagaguggagcauuuguaucagcaagauaacugagucaacuccaaauguuccuuacagcuauuccagcccucuugcccacuucaggcuccauucugcauuuaaucugagacgaugcagacuuaggacauuuagccaagaagaaaguuuuauaggaaagcgucuuggggcuaguggaagcgguaaaauacagagguuguuaauaucuuaaaaaaaaaaacuuuaaaaucuaauccuuguauaucuguauuuuggugaguuuuuaaagcucuccacaccuguacagucccacuugaaaaaaagggugagaacuuuggucauccccaaaauggucguagagcuagcucaucuauucagucucucccaccuccuucccucaggcucaaggaacuccaguuugcuuucugucuaggcuucugaugucagaguuucuuaucauggggccaugcuugcuuauauuguagcccuacuuuauuagucuggagacagguacauuguuagacaacaagguaaaauucagaaacauuggauggacuguaguaguacaggcuuuuaaucccagcaaucagaaggcagagucagguggaucucugaguuugaggucagccuggaccaccuguuagcacccucaagcccccucacccccaguaaggaaaacauuggugcccuaguggagccacuuaguuuggcugauuuaccauauuggaccugaggucucaagaaccagcucaggcaacuggcuccaacaggcugguguaaaaucugcaaacuuagccagcuuuucagcugaugggauuaauagucagaauauagaaagagcucagaaauuacaaacaaaauaaccuaagcuauaaauacucaaauugauuagacaguucucaaaauaauacacauggccuauaguuguauuuaaaaauaacauacugagccaucaggaaaaugcagaugaaaacuauacuguaauuuccuucucacaccagucagaauaguugucaucaagaaaauaaagagugccggugagugaggauaggaauagcucuuaaauaccaucgguugggauauaagucagcucugccaccguggaguguaugcacauugguguauuaggguucucuaggaacaggacagagacugacguguguguguguguucagcuggucuucaguauaugacagaaucuagaaguacuaggcuguacagccagugaaggaaugaacuugccagcaagggcaaguaggcgaagggcaaacacuuucuucuuccaguuccuuuauauggacugucaccagguguagccagauuacagguagaccuacccacaucaaaugauugaacuuagaacaauuccucacaggugugcccagcugcuuggguuuucgcuaauaccaaauguaucaaguugacaccaagaaaagccaucacacuguagacauacccccccagccccccccccccacuauaugaucccgcuauacugucuugggaguacacuugaagaagcuagagucaacauguacuaaagacacugcacuucauugcugugccuucaucaccaaguuagggaaucuguaggcgccaaucagugaguaaacugguaaagaaaauguauguauacucaguguaguaugcauuaugguguuuguagggaaauggaugauacugaagcuauauaguaagguaacaaagguauauucagaaagccaaauaccaaauaugcauaaucuaaagacaagaagggaucauuuguaaaauggggucaguaguucagacagguuauguauauuguuaaaacauacagauaaaaaccauuauuauacaaugaacacaugccaguaaaguagcaaucaaguucgaauacauugcuaaugagguagugauuaaauuuaguuauguugccauucauauugucuucccuuugcaagucuuuguaaguucaagucagagccagaaaucuguguguugaguagucaguccauuggaacccacaauaaaggcauagugaucuauuuugguuacagguaaugaaugagccugauuauuuuuauugaauauuucccccuacauuguaauguagcaauuuccagacagugaaguugaaaaaaauguuaugauggauacccauguaccuauuacuuaagacucuauaauuaccaucugccaaauuaaaugcuggcuuaucucuccacaaacucauuuuauuuuuuaucacuauaagaguaaguuacuacuggggggcagggagagacacuuaagacaccuagaaaagaacacucccauccaaguacugaggacugaccaaucaauucccaccuugcuuggcuugugagauaagacaagauggggcuuuuccagggugguguggcagaaaaggauaugaacuuucugaguagggccgcauucuuaagcauuaacagaggggggcuggugagauggcucagcagguaggggcacugacugcucuuccaaagguccugaguucaaaucccagcaaccacaugguggcucacaaccacccauaaugagaucugacacccucuucuggugugucugaagucagcuacaguggauuuauguauaauaauaaaucuuuuaaaaaaaagaauuaacagagggguuuugugaaguuaggauuuagcaaaguaaguagcuacagaaucaaaguuuuugccugcauaccauuaguguguuugucuguugaaggaaaccacucauccucuggguaacugcccuccuuugagacaaggucucucguuguuugagggcucaccaauuaggcugaacuggagacccagaaguugugccgucucugccuccccagcucuggcuuuauaaacaggccagcacacccaguguuaugggcauucuagggucaagcucagguccucuccugaggcagguacuuuaccaacugagccaucuugccagaacugcagauacuagaggacuagaacugccaggcaugagaugggcucugcaguucucagaaggacacaaagggccagcauuuuuaaaagugacugacauacuuauccaccagagccaugcaaauuaaaauuuaccccaccccaccucccuaccugagucaacagcucaucuagaagggcaacaaaugcugcugaggaugugggaaagaggagucuucacuauuuacacuguugguguguacaaaugaauacagagcuuucucaaauagaucuaccaugugacucagcuacauacauacucaaaggauccuaugcuaccucacaaguacuugcacucuccuaugcacaauaacaaggaaguagaaccaacguagauguuaucagcagaauggguaaugcaaauaaaugucaugcauauguaaaauggaauuuuaauacagccguaaaaaugaacuuuacaagaaaacauaaaucuggaaaguuuuagguaauggcugcucuugguugucaacuugaccacuucuagauuuaacuaaaacccaaggagcugaguacaccugugaggaauucuucuuuuuuuuuuuuuuuuuaauuuuuuauuagguauuuagcucauuuacauuuccaaugcuauaccaaaagucccccauacccaccuacccccacuccccuacccacccacccacucccccuuuuuggcccuggcguuccccuguacuggggcauauaaaguuugcguguccaaugggccucucuuuccagugauggccgacuaggccaucuauugauacauaugcagcuagagucaagagcuccgggguacugguuaguucauaauguuguuccaccuauaggguugcagauaccuuuagcuccuuggguacuuucucuagcuccuccauugggagcccugugaaccauccauuagcugacugugagcauccacuucuguguuugcuaggccccggcauagucucacaagagacagcuacaucuggguccuuucagcaaaaucuugcuaguguaugcaauggugucagcguuuggaugcugauuaugggguggaucccuggauauggcagucucuacaugguccauccuuucaucucagcuccaaacuuugucucuguaacuccuuccagaggaauucuucuugauuggaaucauuugaggugggcagacacaucuuuaauccagaucuuuugaggugggaagaucugccuuuauuuugggccacaccuucugcuagugacaacuuauauaauggacaugaaagaaagaaacuuucucacugggucuuggccugcuugcccuugcuccuucacuggcauaaggccuacuucuucagguuccugaccuauacugaaggccaguugagaccuccaaccucauggaugaauaaacaguuacuggauccuuggacuuuguguugguagacagucauuguugaacucgcuggaccacagccuguaagccgucuaaccuucuccacauacacacacacacacacacacgcauauauauauauauggauuuauucuauucuguuccuccagagaacccugacaaaugcuuguuagguuaagcaagauaaauuggacucaaaaaacacauguguuuuucucucgggcauaggcaguccuagcagaggcaauucuaacuuuacuuucgugguagcggguaaguagauguuuguguggauagagauuguauaccuagaaauggggccacaagauggguagaagagguuuugaagaagguauaguagaacauaauaaguuuuauaugucauugucuauuuaggucccacuugaauguuguuagguaccuguacuggcuggguuugugugucaacuugacacaggcggaguuaucacaaagaaaggagccucccuugaggaaaugccuccacaagauccagcuguaaggcauuuucucaauuagugaucaagggugggagggcccauugugagugaugccaucccugggcugguagucuuggguucuauaaaagagcaagcugagcaagccaggggaagcaagccaguaguaucauugcuccauggccuccgccaucagcuccugcuuccugaccugcuuggguuccaguccugacuuccuuuggugaugaacagcagcauggaaguguaagccgaauaaacccuuuccuucccaccaacuugcuucuuggucaugauguuugugcaggaacagaaacccugacuaagcuaguaccuuucaguuucuaagaagcaaccugaaguaaucaaccaagaaaagguucauuugggcucacaguuuaggcuucgcugcaggguaaauaugcaaagaauagucucuaugggauuugguacuaaaccagguuuuagacaccccguguguguauugauccaccacguggaaacaggcugugcucuaucaggcuuuaaauggcugcuaucauugauaccauuucauugcagccacucuccuggacuauagcacaauccccagagcuuugcuaaaguguucuacuuagugcuacuuaauggaguuugaaacagggucucacuguauagcccugguugaccuggaacgaacucccaguagagacuugaacucagaucuaucugcugaguuuaaggccugcaucacugugcaaaggaacuuuggggguuugguuugguuugauuuugucuuuaauagacaugauucuguaaaguggaguucauuuacaggcaaagugucucucauucaagcauagguuguccugaacuuacugugucguccaggcuggccugacacaggugguccucaucuucucuuugccaagugcugugauuauaagcauaagacccccaccccacccccaggcuuauguaaaguggagauuuugauaagcaaaauauuugaacuacuuaguaacaacccuccagccugaggucguuugggacuuauguggcucaagagaguagcacguuugggcccgcuuguauacaaauucucugacguacgucugcugcauugaaaguagaccuugcaacaagagauggucugacagugcuccuaaguguuauucuggcaauguugaaagguggucaguuuuauuagcuuaacuggauuaagaaacaggaaguuaguaaagcacacccgggccugucugugaagauguuguuuauaggaggaguguugcauccugaggguuccaaucuggguggauuuauaugauaccauuauugguuaggaggggccuagcuagaaguggguuacugugagguguguuuguuauuugggacuaaaucuugcccuagccauuuggaguauuuauucucuauguccuggccaccauggugugaaaauguacuuuucaacaccacacacccucacagugcaagugaaaauaaaauacuguggcuugcuugucgguuagucucugaggggaguagguuuaaguagcccaggcuggcucaaacuuucagauucugccucagccucuccaguacugguauuagagauccccacuacuagccugacugugauuuuuuuuuuuuuuacgacugugcuguguaauccucuuuuauuuaaaaaacaaacaaggacgaugagcaucucccaauggugcucauuuauauugaaaauacugcaaauaauuguguguguguauguguguguguguauguauaguagguaucuuaagagggccuuuacugauugacucauuuuagguuuuuuccuucccuuuuuauuaggagucccuaccuggcagcugccugggaucuguagagugaagcuucaggacucuuaacguggccgggccauggagcaguauacgacaaacagcaauaguuccacagagcagaucguggugcaggccggccagauucagcagcagguaugggagcaagugugcuuugacuaucacaauagcacagugauggagaccucuguggaaggacuuagaccuagucagaccuuaggaaguccucggucucaugacuguugcugugcaaugaaucagucuguugccaccugguacuuguucuuggugaaaaucacuuuaaaaguagauugcccucuuuuauuugacucauugaaaugauaccuacccugcuuuucucugcauuaagucugcuuauuucccuuguuuuaugcuaccuugugauaaaguaaggauuuggccacaacagacaauugucaguuuccagccagucuguucagaauuaauucugaacaguuguaguuuaauauuagaacaauauugggcugcuacucuguggauaaguacauacugaaagagagcgucugccacuggugucuuccacaguaguugcucagauguuuggauuaaugcacagauaccauuuuugaugcuuuuaccuagguuuauauuagcaaaucuccucccacuccccucuccugcacuuuggagaaaaagacauuguuucuauuugauuauaggucaagacuguuguccucgguguguuuucuccugaguacagagguucacuaguacagaauagcagggagggugaaaggaguagugacugugagucccaagccacugaugagggagagaggcuacucugcauuaaagggggagaugggcugaguaugguggcucccuagccgccuuccuguccacacucugcuauagcacuggcggcuuccugaagugccuuagcgaauagaccuuggaggggccuucuaacuauggccagagccucguuggugggucucucuucugugaggacuuccccaggauaggaaauaagguugacuuucugaaaacagucagguggauaggaauaaaucuucauuuggggauguaaaagcaguagccuccugaggcuggcgucuggaccaguccccauggcuaguuccuucauccauggugaugcuuuaaagccacagcaagucuucauuguaguuucaaggcuuuaaaacccgguaguuuuguucuugugacccuaaggaaaauaagagauccuuaacauauaugucuagcagaagggaaaaauuauuagggaguauugcauuauaaaucuuuguauuuuaagucauagaaguguguugugagguccacuccaggaacugcugaugcagcaugacagcuugaauauaggaguccacaccuuugaaaguucccguguagggugaggugcuuuagaggcaucccacccucucccucggagugaucugcugucuugggcuguauauuuccauccugauacauuucaagcucuuccucuuccuguucucagcagcaggguggugucacugcuguccagcugcagacugaggcccagguggcauccgccucaggccagcaaguccagacccuccagguaguggugcccucucugauucccugugagcacugcaugaacgcugccugucugcugcuguuuguguuuggaucucaaauugaauggcaaaaucgcaugccuuuugugcugcuaaccugucucugaggccaguaugccagugucccaugccaagacauguagugauugcugugucuauuuucucagaaguaugcacuaaguguguugcuuuagaaagaccaggaagcaacaggaauaaauucuacagguggcuucagaucuuucucaguccucagcucccaauccaagcgcaugucagaguuccaugaauuguguuccaugaacacuggagaagggagagcacacaugggaagacucggcuacgcuguuuuguuuuugcuaaaagugcaaaaugacuacugaacagccauugcacuaagcaaaguuuaucugagaaccauguaccucucguguuucauuacaagcgcuauacaguugauugcauaucucuaaguagcagcauagcacauggugauacaugugucuuguccagcaguugggauauggaggcaggaggaaugagaguuugggacaacacaaaaaguuauuacugguuacacugauauucauuuaaagacaaacacuggaguuaaccaaugcuguucuucaguauuauguaugcuuguuaaauauccuaaauuccugugaaaaaaggguaacagcauuggucuuuucugggucuauuaagaacuaaagguuuggagaaauuggcaagacucagauacccguccucccuuucuuccucuguuaaauuggauggacucaguaggcccuccagaguccucugacaucuccguuuacugccaauguugccaagacccuccugcagguaaccacccuuuccuguaagucaggguuuucugauggucuuaggcagccgcugugagaggaucuuucggccuccaaaggguugcagcccaccaguuaagaaccauugcuguaagcacuugacccucucagccugccccaacccugccacuuuggugauggcgcacauaauuuacauacauaauuuacacauaaaugaaaauaaaagaaguuuguuuugucuuccugcacaguuugaguaucaaggagagcagcagcucucuguuccugcuugcuucaucuuuuuaauacaugaaauggugucugggauugucauuaaccacugugugaaugggauguaccaugcucuuaacuguguggcuuguugucucaugcaugagucccuguggucuuuguuguagacacaugagcuccucagucucaaacccuuuauugcaugcauacguagcauguuagugcaggaggggggguggggugggcagagaugauggauaaccagaaaaguaagugguuuuaaauuugugucgacuuuggggacugaggcaauggcucgguguucccuauuugcuaugcaagugugaagaccuaaguuuggguccauagaagucauuuaaaaauauguagguuuauccuauaaucccagcacuagggggcagaaacaggaagaaccuguggcuagcuggcugucccuguggcuagcuggcugucccuguggcuagcuggcugucccuguggcuagcuggcugucccuguggccgggagcucuaggagacugucucaaaacaagguagcaagcaguagaagauggcauccagugucagcuucuggcuuccacuuugacaccaagaacugcacagccuuccagggcacugcaacaacacaguuguuguugaucuuacuuagaucuagauugcacugaagagaaauagaagugaaggggacuucucaugagccgccucauguuaggagaacucaaacaguucuuucucuuacucugcaguaaggcuccuguuaacauuuccuaacaccgcacaaaaaaccauuggugcagcaaagggaauuuauggagacuugagagagugugaauauaggccauaaaguuuugggacagcccugagguugggcugaugguucugauggagaaugguggagagcucgccaccauacacaucuaggacacaguaacugcacagguaguugaugcuguuggaauugacuucugcugggacuaaggagagugucagucuguucuguuacaaaucguuccuucaagcagagacacgcucuacaagggaguuugggauuuguccuguuacgccucgguccaaagcagcuucugucugggccucugaaggcuuucuugaguuuucacacugggguucaaaguguggcugagcauucguaucggcuuccuuucuagagugucuguugaugcggaagacugaaaauuggacauucuauuuacauacaguagcugucugauuucaggguuucacugcuccugauaauuaaaacaacuaugcaaauauuuauggugcaguucgaagaacucuaccuugaucacaaacuagcuagauaauguuucugaccagucuuggcuuugcuuugaaauggggucucaucaggcucaccuggaacuagcugaagcccacugcuucuauagccuuuaccagaaccgguccugaguaucggcuugagcaggcaagcgguacugguaacuugacugcuuucuagaauucagccuguguuuggugaugagugccuuacaucuuuugggauuuuccagacucuacauagguuccauuauauuugaccuuugacuauccagcuuggcacuuaaucaaaaauaaucagaagugucugaagaacacuagacuuaucuucuuggagcuguagugauggcucgauaguuaagaguacauauugcugcugcagaggcuuugauuucagucagcaccaugucagacagcucuuaaucaccuguaagucaggcuccaggggaucugacaucccacucucuguaguauaugcacauaaccuccacacagagagacagacagagagagaauaugaauauuagaguuuacaaacacugucucaggccaggauuucaucucugcacuugggaggcagagggaggauaucugaguucaaggccagcuagcacuacauagagacccugguggggagguggaagacugaccuuccuaaaucugccuugccuccccucuuccaggcagcaggauaguugcagugauugaucaucuuugugaagcugcuugugucugacacuauuucauuguuauuuuauuucuuucuagguccaggggcagccguuaauggugcaagucaguggaggccagcuuauuacaucaacaggccaacccaucaugguacaggcugugccugguggacaaggccaaaccaucaugcaaguaccugugucuggaacacaagguuuacagcaggugagcaguguuuuuaaaguauuuagguuguaugucagaguagaagucugguaugaguguggaugguguauauaauucauauguguacagguuuguacacacaugcuuucccuuaguuuuugagacaacaucuuuuacuagcuguagucugggagccugcugcugucuccugccuguccucugugccagggcugccaugaauuccuguggaugccaagguuccagucagacccuugugcugugcaccacaugccuuaccucugucugagcugucuuccuagccugcagagcagauguuuugaagaagaaauugcugcaaaaaagacaaaaaacaaaacccagcugcuuuugcuugaguccuaccccuuacuuugugcuuagucuuucugccuuuguuguacuguacugcauaacaggaguacagcaaugugguggaaacggguauuccuugcuaccugaaacccuggagcaaaacaguccagguggaaccagguagauuugcgaccuagucagcugccaacacuuuuaauugaguuaaguaguauuccagucuuuaagaaaauuugggcaguguauagcccaacaaaaagguccacagaugucucuaagacacggggccauccauggucugguuuccuucccuuucccucccaccagcagucaguccagcuggagaguggugggacuugaggcucuagucauguccuucacagacucaccuuuucaagagugaccucccaggcugcuagaucugggaaugcuccagagggucaaaggaacuguaauagaugcuuacaaagccagugagaaggaaggcgggucuaggggugggguugagggguggaggccagacuuuagguagcugggaccauggcuuggauuggggauauucuagaguauaaaguacuagaaauuuugaguugugggccuuccuaaaugcuuucccaucagaucuuuuaagguuuauauaucaguacucaagaaaacaggauuuuguuccuugagcaaaguguuaaggcuuuuuuguuuugucaauuuacaagauuucaaagaaaaacauuuaaaacuucuugucaagauucugauaagugguuaccucacaggaucucuugcuuuccaucuuuguagugugaguuuugcacucuaaaaccugcaggguagggauaggaagagcuagugaacacugccagcagcgacgagugacagugagggauuuggagccuugucuguguuacuccuguggaucaucauauccuagagguuguuggcugaaagcaagaagcauuuugugugaguuacuguucugcugacucacagguuaagggugcugguacagcaugguggggaaaagguggcagcaggaggcagagugacuacugcucugcucacugucuccuucuuaguucaggcugccaccucuguuaauuaaucuagaaacagacaugccuaguguuuguuuucaugaugauuuucugucuaguuaaaugggugguuauacauuucaguuucuguggaucggaagguugacagcugaucugucugucuauccaggaucuaaucaaaguguugccuuugcugccaucagcauaacguuuaacuuggaaagaauguauuuuaaaaguuguuugauucguugauaacagcacuucagaguauguuuaaguaaauauacuuuaaaaaauaaccaugccaccaacgauuauuuuuuuaaagggacacuuuugugucccuaacacuggccuugaauuccuaauaacccuaccucugccucccaaguuguagaauugcaggcauauuccucuggguauuuccuggucucuaguggaauuuguucagcuaauuuucagaaaucaaagacugagacuggagagauagcuuaucaguugagaacacuagccauucuacuagaggacccagauuugauucccagcaccaccuuguggucacagccaucuguaacuuuaguuccagaggaucccucgucuggccucuggacaccaggcacgcauacaccuaaaauaaagaacagaaacaaauaaggagccagaggaguggugucaguguggugccaagcuguuuguguauucucuuccacagauacaguuggugccuccuggacagauccagauucagggugggcaggcugugcaggugcaaggccagcagggucaaacccagcagaucaucauccaacagccacagacugcagucacugcuggccagacucaggugaguccaccugcuccucugucaucaggacagcaagccaccugguucacaugggaugugaaugugaagaacgucaucaaaauggggucuccgugagucucuggcaucuguuaaauaugucauuguuuucuacagacacaacaacagauugcuguccagggacagcaaguggcccagacugcugaaggacagacuauugucuaccaaccaguuaaugcagauggcacaauucuccagcaagguaagcugccgcuauugcaguggcccuuuuuagggcauuaguuucagccuuugaguaccugagagugcuucagagucauuaugaaguccauguccuguuuaaacagcaacaggauucccaccacaucugcagugaccgaccgucagucagcacauagaccagccugaugcugcuuagucacuagaguuccuuccauuucacuuugggccucuacaucuauucacauagguguuuacuuagagucacaagaucgaagauguaaacaccauacagagugcaaaggcuuagagagguacgcccuaggaagaggagguauguaacaggacuagacuuggcuucagggaaaccaugcucaaaguagacuuaaaugcuuuggaagcuaaguuuagaaaggagauggcagccagauucugugauggugggcggaaguagaauuuauuuggaauugggcccuagacuguuagacuuuuagaaaugaacugaacuuagcagaacacagugaagcagcagaaggcacuugcuuucuuccauguguuugccaguuauccaggaggguauacaggagccagguagaagggacuaacucuuuccccuucuuucuguuccguguaccugcuuauuuuauuuuguuuuguuuuguuuuguuuuuguuuuauguuuuguuuucuuaaaguuacagucccuguuucaggcaugaucaccaucccagcagccaguuuggcaggggcacagaucguucagacaggagccaauaccaacacaaccagcaguggacaagggacggucacugugacacugccuguggcagggaauguggucaacucaggaggaauggucaugguaaggaaagugucccuggcacuggagcuucccgugggguucucuugucuuugagcugcaaguuggugucuccugugaagucacuuaugauguuaacuucuggauuugacgcuaacgucauccuuaaggcacuagcaguggucugcauccacaggaagccuaguucauucugaugccuaccaguuagcagacuagucuggauguuggagaugcagcaguaugggugugaaugggcaauuuuauuuaggguuuucaugccaguaauaaggucuggucuccuguucaugcagaugguaccaggagcuggcucugugccugcuauccaaagaaucccuuuaccuggagcagagaugcuggaagaagagccccuguaugugaaugccaaacaguaucaccgcauccuuaagaggagacaagcacgggcuaagcuagaggcagaagggaaaaucccaaaggaacgaaggguaugugugcccuggggagugcuaagcaggaagcagugcaguucugcaucaagcguguguguuuccuugucccaaacacuggaaugcaggaagguuuacuauaagacuggugacaaaaugucuuggaaacaagggacuuuguccuuucuacaguaaaguccagagaaaacguguccucuggacuuccucuugucuuaaggcugcagugcucauguguugauuguacuuugaaguggcaguugggcucuagccaaggagccaagggaauaagaaagcggccuccucauuuuaaaggagucagucugucugucugucccauuagccagcauccacugacccagucuaagcuauagauagcauaaagaugggaucuccuccugaccugccauuugcucaaccaaaccucggucaguucccggagcagaggcccugauugcacugccugaacuuguagugauggacucugcaguaggugacugcuaggucuucucacuaacagugggggcucuuauuucucuucucuagaaauaccuccaugagucucggcaucggcacgccauggcacggaagcguggggaagggggccgcuucuucucuccaaaagaaaaggacaguccucacaugcagguaaggacauugcauccauccuuucacuguugccgcccuucucuccaucaacaaugggcuguccuccguuuaaggaagaaacacacucugugcagcaugugaugccuguugcuuagcuuccuuccuuuagaagcacugaaagcuccaacccacggccuuuuuuacucuugguuucucaguucuuuguuaaggaaaaguuuuacuuucuuguagcguucgauuagagucaguaucauuuaaugcuguguggcaguucuugugucacgcauucuaauaagcuuuuauuuguuguuguucaacugacugagaaccucagguccauagaguacauagcauuuuuuacauuugaauaggaguucuugagaucuuagguaacuugccuaaggccgauccuugcacagcugaaucagcccuggaagugcaguccacaucccaguuacccuggaagcugaggcaggaagauaacaaggugaggccaugccugggcuagagaugaauucaagcccagcuaauuuagugagacccauucucauaaagggcuaguaguguagcuagcucaguaguguagaguauuugacuggcauaugaagccuuggguucaaauccugcuuccuccacaaacagacucaucaacugaauucaaacucagguaguagaaucucacuaauuaucucacaugcuucugaauuuguccaaaauggagugcuuguucauuauucuauuaccuaaacagguggcuugucaccacccaguuauuacaguuuagaugguucugauucugaaguucuuuugguucuguuucugaaacauaauuuuacauguuuacauguuuauuguacccuccugacugaugccagccuggccuaguccucuuucuugguuuagauuaauauauccacugucaugccucuugccucccuuugcauuuuccacaucucaggaugguggucgucaggcaccacaucacaccuucuccuaccuuuguucucucaccccaugguuaguaagcauaugucugggucuagauucauuuguucacuguuuaccuauuuaucuguuucucuugccugguccuugguccuuacacuuucuagucuguaauguucuuuucuccaucauuuccaugacuaucccuucuucucucuguguagccuaggcuguccucagauuugcacuacuccuaccccaguuucccaagcacugggguuacugugggagcaugccaccacagacuuuggucugccuuacuuuuaggccuggcuuaggucugagaggcuuugagccugcucucaucucuccuggagcucucugaccucuuauacuuucccauaauuccauccuuuaccugguaagaaccaacaagagguuuucucuauuugguccccauugcuuccuuuauugcagaguaagugacauuaaaauagaaagcuuuguuguguuguauuuuggggguuaacuuauuuuccaguucuaagugguuggguucaugauucuuuugcuggcucucuucacuagcagcagcauggaauuccucuacacucacagggccccauccgguggccacgugcaguucugaucagauagugaaggcuuuaauagucuacccacggcagucugcagguuccuucuccuuagugaaccacacugcgaacauccugacaacccucuguucuuagugguaucugcgcaugucugugaauaggaacugccagcuguaggccaugguguggaaggcuuuccuuguucuccaugcugacaugggaaguucccucaccucuuuucaucucauauaaaaauaaugacacaaaauuacaguguaucauggugcuugcucuggggcuuuguccuagccacucaagcaccuaaguguugauguaaaggacuguugugcugucucucucuguaggauccaaaccaagcugacgaagaagccaugacacagaucauccgaguuuccuaaccacaggaggguggcagagcugaucagucacgguccucuccacuguucuggaaauggacugacuuccaguggggcacugacagucucacucugcccuuucucaggacagaaacuacuuagcucaguauuacagcugcaaugauggcugacaaacugaaguggcaagcuuuugucgcaccccuucauugaggaucuguuucagacuguuggacacugaccuuuugcaaauuuggaugauuaaaaagagguauuugccagcccagcauuacaaacacagcacuuauguugagugguaaagccauccagucagccauugcaguaggggagagcagccuucucaaccugguccucagucgaggcagccacagccccugccucccuguggguucucaacagcauccaugcccugguggggugccgggcugccugaugcauagacacuuggcacucagguggcucccaagcaaagaagcuuccuguuaggacuuggagcaacagaccaagcugcugucuucugaccugugcugauaagaaucugucugcccacaugcuagguugguguuuacuucagccaagaaaguacaaaaaggauauuuggacucaggauaaaaggauagauggaccuaaaagguacauuucuagcuuugacuguggucugcucauuucuauuaacagccaucugggucauaguucauacuguggccacuuuagagacaguuuagagaguaaagaacaaaacuucaaaacaucugugcugaaguguugaggacauucacagucguucuccaacagaggcgaaccuaggguauucaaucaugggcuuuaugacagcaaguagcaaauggaaggaucugugcauuucaaucuagagagcaagggcccugcuggcccuagugcugcuguagagcgugguucuccaguggauggauagauaccaggcaugacucuuaggcugaagaaaccaagucacauuuacauugacaccuucuggcgugcacuaaaagagaauccuuauauugccugaagaagcacuguugagcuagcugucuuggcugcaggcuggagcacugcuggagcacagaguggaggagagagaugugcuucaucccugccugggugcugacccagagggugaaugcucuucccauggcagcugauucucuggugccaguuuccacuuguuuucuccuuucucuguaggccuugcagcaagguuugcucacugcaucagugcuguagggaccaacuacagccugcaaggauuccugcagggucaggaauugggccucagaaauguguuuucuggacaagcacucuaccacugagccacacacacauacauacacacacacacacacacacacacccuuccccugccccagccccagccccaaccccagccccagccaaugcugaggucuggaagaaaagaccaauguugauacaucaaaagaguuggcugccuucucugcaaucaaagucaaacgcagucaauccaaagacuaaaauacccgucaagucuagagacuggcccuuugacuuuguucuguguuaaagauaggaaagacuuuaaccuuauaaagaaauaucgcagggagaccaguuuaauuggagaaccaugagguaagccaucucuuccugcucccaggaaucuugccauuucuccuggcuuccggaggucagagggggcugauccuuuuuuuuauaaacucacuacaaacuucuggcucuucacaugagcuuccguguguuacugaaagccgggaggaauuucucccuuugagguggacaggauucuaaggggaggcuucagggauuccuccgacuuaacaguagcgcuucagccagcaguuguagaaugcuauuuauucgugucuguaaguuuguacauaacccuaaccucguaggcaaguuugaguuuucuuuccuuugaugcagaugcuuggguuuccacucuggcugcauugcagucggcucccagcccugccggcgugggcacagaggccagaggggcucacuuggauuuauuuuuguuuguuuguuuauuuguuuaacuuaguucuuuuuacuuguucucgugauuguagugauggcuucaaagacacagaguaaguggaggagugggcugcuggucuacugggcacucuacuuccuguugcaggauaacuguaaauguauauauuuuaauugcacuggucuagaccacugcaccaacagccucuccuggcuacagggugccugauaauaaugucuugauuuuccuuugggacucaaccauguacgucucucuucacaccccucaccccucagccccuucccccaguaggggaguacaggugaucacugaugucauugcaauugcuuuucuuuuuuaauaaauuuauaaaaauacuagaaaaagugacuggauuuuugguguuuguuuuaguuugggguuuuuuguuuuuguuuguuuguuuuggcuuuuuuuguuguuguuugagcccuccagcucacgaucuuccugccuugccugguaugcauccccacacccagcauggaugacaacugaggaaucugcacgcccugugccuggaaacucauucccaauguugaagucaugacuuuuagacauaaacaugugaugucggggucaggccucucugcuuugugcucuuaguuccccuuggaaauggacauuaaaauaagugauccccugaguag

SEQ ID NO: 8659 - RNA, 3569 nt, Mus musculus
uaaauuugcuguauagucaaggaugaccuggaacuccugauccuuccaucuccguuucccggaugcugcugggguuacaggagugcaccgacacgcaugcaggcaugcacaggucccaugugcacaccuguauuguguguaucucugugugucacagugcucauguggagguucaaggacaguuuuugcaagucauuuuuuuccuccuuuaaccuuguggaucccagugagagaaaucagguuucuaucugucuugcuggcaagugcuuuaccugcggagccaucuugcuggcccaggucuguuucuggggaaguacuaagugcuaagcccuacaguggccuggggaggcaugugagaggggagguggugcucacccuccccagcgugugcucccacaucugcucaucacucuuacuggggaagcuucuacucugcagcccugcaagccaugcauccacuuccaccuuacaccaggcccucaaggucaacagcaggacuuuauuauacggcagaaagcaccccuucuuuucuaugucuaaggagaaaggacaacaggaagaugcaggagagcggccacaucaaguaucccuagcuccccagcuacuccagcuucuugccguccucccuucuucugcauccccgugccucaguuuguucuccucggauggcuaaggcugguacguuggacacaagcugucccuccacaggcgguaggugauggcgguggucacagugagccaggccagguagggcaggaggagcagagcagccagcuuguugauuggcugccagauaaacaccaggcuugcuaccaguccauagagcaguaagagguccaggagggccuggguggaagcauugaaaggauguagccaugcuuucucaagagucgggacccucugccuuucuacaguacucugacccaagacaucccaucccuggggcacucugcacacuguggaaauuuugaauguaucaccugaugguuccugauaucaacacuaugacgaggggcccuacgguuucacauucuccucccagcauggggcugccaugugccuuaccagcccagggcugucggcugccaggaagagcaccaagaaaguccagcugagggccagcuggaaagaguagagaccaaggggcagugcuaggggccaccggaagcccccuccgaguuccuuccauaccagguaggaggcauagcugcagagagaggguguucuguagaauaaagguccuucggcauaagggaguaagcugccucugacaugugggcaagugagugugagcauugucugaggguuaaaggagaagcuagagagaugguucagcagguaagaauaguuccugcuggggcuccauggcucagugguuaagggaacuggcugcucuaccagagguccugaguucaauucccacaaccacaugguggcucacaaccaucugugaugagauccaaugcccucuucuggugcaucugaagacagcgauaguguacucauauacacacuauauauauauauauauaaaagacuucucccugcucuuccagaggacguaaguuugguucccagcacccucugaaggugguuuauaagccuccguaucuggagcucagggagagccaaugccuucuucugaccuccguaggcacucacacaagcacacagagagacagacacacagacacacucgcacacauaaagcacaauaagucgggagagcuugugggaagaagugggugggaggaguuggguguccuggagagaagacaggaaggggaggcuuggaggaggguuguuggaaccuuagguauacaggacauauuugcuuguggggaccccuacuugaagagaagccagaguacagcccagggucacacacgggaggaucugcuccuaccuuugcaaggccacauacucaccccaugacagaguagauggucacccacacaagcaauaugaccuugugaggugggcaccaggguaacuuucucucauccucacaccgacuggauggcugaugaaugagcauacaaaucaggaugggccccagcaggggcacaccuacaaagacagguccuugaagcugcauucuccagaaaggcaagaucuggggaggcagagagcaugcugggauaagccuuccucuguccccuuggaccuccaaaccuuacagucaccuagccagaguuucucacuggaggucuagucauggagaacccccugccuggagcccaguucuaguccugaccccugaaccaucucuaguaagcacuacccugacucuucucugggccuuaugcuuuucuucuacaccacaccgcggagcagcacuucagugugguuacucugaaguggucacacugcucucucuagggccaucugacuccuggaagucaggaccagguuuagucuuuaucuuccuccgaaggcaucagcuggccuccaggagaaaaacaagccuuuggugucucaaggacucugccucacugaagcugacagugaccauccuggaaguaucacuguuguguagaaguuuccucugaauugaaacauucuuuuccuggaaggaugagagaggagagaagugagggggaggagggaggagggaagagggaggaaggagaagggaggagggaagagggaggaaggagaagggaggagggaggcuuaugaggcuuauuuguugguucaccaggcuggacuuagcugggaccauuucuuuaguuucccaucagugcccuuucuggggugaauagauguuuguccgcaucuccccaggaaaucacauggcagccauguucugaauguaggagccagggauugcuaggucagucauagucccaacagcccugcucauuacccccaaucuuaucucuuuagagcagacuggcacacgcaagaggcccacccagguuggucugcccaauucaggcguggccaacggucuccgugggucccuuucucugaagccuucucucucagcugcucccggugucugagggaugugcuccgcaucgccccauucccacaggucaggucugaaggcacagguguccagauuucugguggucugauucucaaggacacaacagccuggucuuugauuaaaaaaaaaaaaguuguugcauuugcaucucauuuacauguugcuuucuuugugugccauuugcucguaggccgaugguuagacucuccuccccgcuaagagcccagccaguaucaauuucaccugcucaggguauuccagccucugucuuaagaucaaugcaacuugacagaaauaaaaacccaauuguuuugguguucuagagugacugacaggucacgggcugaucugccucucacugucuaccgacucagcugccuccccaucuccccaucucuggguguuuaagccagugcuguaaucucccucauugaccgugcccacucucuuucauccugcuaucuauccaucacuccuccuguccccaggccuuccugacuuaccucaggcacacgccucccagccugaugauauaggauguguauaagguagaagauggcgagggacuggaaag

SEQ ID NO: 8660 - RNA, 2343 nt, Mus musculus
gcagucaccagagccagcccugcuugcaguuuccugaacuaagugcuucugcccacccagagcaacugauucuaaggccugacucuagcaauggccuucgcaaaucugugcuaaguacucaucagugacagccuggaccccugcuacccgaagauccugcaagauggagggcugcaggugguggagaagcaaaacuugagcaaggaggagcugauagcugaacuacaggacugugaaggccucauuguccgaucagcuacuaaggucacugcugaugucaucaaugcagcagaguagcuccagguggugggcagggcuggcacaggaguagacaauguggaucuggaggcugccacgaggaagggcauccuagucaugaacacccccaacgggaacagccucggugcugcggagcucaccugugggaugaucaugugccuggccaggcagauuccccaggcaacggcuucgaugaaagauggcaaauaggaccggaagaaguucauggggacagaacugaacgggaagacacugggaauucuuagccucagcagaaucagaagagagguagccacccgaaugcaguccuuuggaaugaagacuguaggcuaugaccccauuaucucuccugaagucgcggccuccuuugguguucggcagcugccgcuggaggaaaucuggccucucugugacuuuauaacuguccauaccccacuccugcccucuaccacaggcuugcuaaaugacagcacauuugcucagugcaagaaaggcaugcgauacauaugcagcuagagucaagagcuccgggguacugguuaguucauaauguuguuccaccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguccuuucaauaaaaucuugcuaguguaugcaauggugucagcguuuggaugcugauuaugggguggaucccuggauauggcagucucuacaugguccauccuuucaucucagccuagucggccaucacuggaaagagaggcccauuggacuugcaaacuuuauaugccccaguacaggggaacgccagggccaaaaagggggaguggguggguaggggagugaggguggguggguauuggggacuuuugguauagcauuggaaauguaaauaagcuaaauaccuauuaaaaaauggaaaaaaaagaaaaaagaaaggcaugcgaguggugaacugugcucgaggagguauuguggaugaaggugcccugcugcauacccugcaguguggucagugugcuggggcugcauuggauguguuuacagaagagccaccaugggaccgggccuuaguggaccaugagaaugucaucagcuguccccaccugggugccagcacuaaggaagcccagagccgcuguggggaggaaaucgcaguccaauuuguggacauggugaaggggaaauuucuaacagguguugugaacgcccaggcccucaccagugccuucucuccacacacccaagccuuggauugguuuggcagaagcauuaggcacacugaugcacgccugcgcugguuccccuaaagggaucauccaggugguuacacaaggaacaucucugaagaaugcugggaccugccugagcccugcagucauugucggccuucugagagaagcaucuaagcaggcaaacaugaacuuggugaacgcuaagcuacuggugaaagaugcuggccucaaugucaccaccucccacaacccugggguuccaggggagcagggcagcggggaaugccuccugacuguggcccuggcaggugcccccuaccaagcugugagcuugguccagggcaccacaccaaugcugcagaugcucaacggagcugucuucagaccagaggugccacuacgcaggggccgggcucagcccuccaacccugugaugcugcccacuaugaucggccuccuggcagaggcagguguacagcugcuguccuaccaaaccuccauggugucugacggagaacccuggcacgucaugggccucuccucccugcugcccggccuggaaacauggaagcagcauguauuggaggcuuuccaguucugcuucugacccuggggcucagcacucucagccccacaggcuuuucugaagaaacccacuccugugaccuauagggagagaggaucgcagaaccagggcaucugccugaacuaauagcuaguaaagaaccuuaccuccaaaa

SEQ ID NO: 8661 - RNA, 33521 nt, Mus musculus
ugugcacaggacccaauacgacauaagaaaacugugauuucuaagggaauugauauaagaauuaucuguaguccuaguuaaauuuaaguuuaaaugguauaucuacaauuggccucuaccuacuacuucgaaaauacuaagagauuaaacgcuuuuaauacagcaaagaguggggauuauuguuuggggaagaguauuuuuauuuuuguggguuguuuggugcuuuguuuugcuuuuuggcauuuaguaaguaauaaaccuuugaaaagagccaacagucacauaaaacuuuggaaauaacccaacagggagaguauuauaaagaagcaggucuaagugauuuuaauaugaauaauacaauuuuauuuuguuuauuucucagcuaaaaagcugccaaagaaugaaccacagaauccuggugcaaacucagccagaggacgaggaguagaccuuacugagccugcacagccagccagaagccaguguuguaguaacugagcuccagugugaacuuccugaauggcaaaaaccauggaguugggagcauuuagccggcccagugugacuuccaaaaagagacuaugguagaaucaaguuucuaauucugaauuauuuugaguguuuugaacuuaauuuuuaauaacaugcaugugcuccuccagcaguagaaaggaaaaugaggacuguguguacacuuguuccaugugaaagugcaggggaacagcucaucuccaguggguauggacccacucuuaacccacccagucuccaaacugggauaauagucaggaaugacauguucaaaauuacuaauguaugcuuuagaaaacauuuuuagaagacuuacgcuuaacaauaaaacccaagcaaaugguguaauuugauuuucuuaaaaagucuacauuucacauauuaauaaagcaaucccaacaaaacagucuugcaucuccagaaagaaggaaugaauauugaugacaucuuaauuuuauucagucccauuacuucuuaaaauuugauugaaaaaauuaagucacauguaaccccaugcuguuuuaggaauaugaaaccgauaaaugcauuuuaaugauaguggucccuucauaugagcuucuuuuaaaaaguggaaacaaaccagguaucugcuuucuaguuaaucacuguuggcuauuccauagaggugugucuggaacagggagggggcucugcuucccuuugggcauaauuagucagugcacuaacaauuauguacauucaaacuugauuauuuuaaauaugaucuucagcuguacuguaaauagaguacugcauuguagucuccauauguuuauuauuuccuauaauauuuaagaauugccuaaacauauacaaaauguacaguuacuaaaacagcuaauuauuucuuucuuccccuaugaaaggaaggggcuuugcuguucuuacauggcuagaaccauaauaaacaauguacuugcaauuguaacauaaguauuacaauguuauuaguaauaaucuugaagccuuguuuuuugaaguccauuuuauuuuaaucaguauauugcacuaauuauuuuagguauuuucauuauaugaaaucuaccaugugucagaugauuuaaucuauuuaaguguugaucugcuagcagaacuuguacauuuuacaguaacucaaaacuaguaaggagaacaguucaccgguguuuaguuuuauauugaggugcucagguuggaauaaagugauguaaaaagcaacacugaguuuucucugucuuugacauaaaguauacaccauaauacgcaugauauauaagcugcagcuuuuguauuuccuucccggucuaaggaaugguuuucacgggagucuuuguagcacuguuugcuguucuaggucauuggaauguuuuuaugucagccugugauacucgcucccauugagaaacauuaccauaacagugaugcugucucuggaacccccuucuauugcagcacuuacaaguucacagccaauguacucagcugcaccuuuguagaaauucuuaauacauaguucuuucucauuuuccugcuuacugucuauaguggguaagcugcuauuuucuuuugugcuacaagggucauaaggggucacuuuuggagaaaauguacccugaugaguguaagcuucagcauauauugagucagauagcccuuucgucccaucugcaguugacauaaugucuucauuuucaggcugguacuggaacagcacucggauguuacugucugguggggaaagaaggccuauagguggccaggguuugcuuuuagggcgaggaacauggguuucuuuauaugcaugaaacaaggugauuaccagugcagugacuuccuucuuguccaaaacuugccaaaguccauuaguggcuaagaugagaaacugacauagaucaucuauagggacagagauuguuugcggugcuggaauaauggacuuuuuuagucugagguuuccauggaauccaagaccccgggugguuuugaugugcccauccaggaggccauaggggucaucugaacugaucacugcuucgcuguaaaggacucuucuucuuucuuugguguuucguguacuguguuccuuggucaggcaaaacccuuuuccauuucugcauaagacugcuugcacguuuccuagacaaguguuuuguuguuuaagagaaagagaucaaaagauuaaucaucaguucauauuaacauaugcaacuuacuaauucuguuucaaugcuaaacacaaaguaugacauguaaauauuucuagaauauguaagcucaacacuguacacauccuaauucaaaucucagugauaaccaguagacuuuaaaacacuuaacaaaacaaaaacaaaaaaaaaccuacaggucaugaaaaauaauuucuaaauuaauuuuuuuaugaaacuguuucaaagaaugguuuuuacuguuuuuuaacaucuauucagauuuuuaaauauucaaauaaaggguuuuuuuaauguuuaaauuauguguaugugcacaugagggugggugucuguagaguccagaagagagcauuggauucccuagagcagaaguuaguuugccaugacccacccaaauggacguugggaacucucuaggggagcaccaaguauuccuaaacacugaaacaucuucccagcaccaaguaauuaacaaacaacaacaaaaucuuuggugggguuuugagaggugacccagcaauaaagagguccucuagcagaguaccugaauucaauuacuaacaucauguagguuagcacacaauugcuuguaguuucagguauaaggagaccugaugcccuuggccucuguacuugugugcacaggaccacauacacauaaaaaugagaaauccuuaaaggacaaaaacuguugggggcuguuaagaaaguuaguuaaagacagcugcuaccaggccugcuaaucuugaguuccauucuugggucucacauggugaaaagaauugucuccuacaaguuguccucugaccuucauauacagguauauacacacacaaucaaucaauaaauaauaaauggaugaauaaaugaacaaaguauguauacauauauauauacauauguauauuacuggucaaaguuaaaacucaaauguauuuaggauauggaugauaaaauuccacuguuaaguguccauccuagguuuccuuaauguguaauuaaacaguucuauaagaauucauguuggggaaauaggcagccacauuaaacucuugacaguuguuaacugaagucuucaguaagagauggcaguaugguaugaccauaguugagauaaaccugggauauuugcaacauuuugcuucauuaauguccugaagucuaaaucugguccagacagauuaaaagaugcuguuagaagggguuuggauuuuuuuuguuuguuuuccccaagauuuuagaaucaucauauguuuaagaacaagcaguaguuuuugguacagcauugugauucacagcauaucucagguggcauugguaucugaauacucugccccugaaaauuaaaauuccuacuuuaauaugccaguucuaaaagcaaaauuuggugggggcagugagaugguucagugugaagagacacuugaugaccuguuugagcuagaccccauaugguggaaggagagaaccugauccccaaagcugcccuugacuucaacaugcaugcuguggcauacaugcacguguaccacacacuuuaaaauaagaauauucugucagguggggguggugugccagcacucaagaagcagagaccugugaguuccaggacagucaggcuacacacagugaacccugucuacaaucaaagaauauuuaggccucuaacagugcuauacuuggaaucagaauuuuguugcuaauguguucaauucuguuucuucaacuuuuaacuuauuuuuguuuuucuuuugauuaauuuugaaauagaguuucaauauguagcccaugcugaccuaaacuugagaucuuccugugucugccucauuucagaaaaacuuuuugauuuguuuagcaaauaagaaucuaggcuuaaaaggcugaagucuguccaacugguaugauuugacagaaagccuaaccugaugugagauaaacaguagucuugccucauuaacauaauagaaugaaugcuaauugagguccuggguugcuugcaaaaugugacccugugcuaugcaaauuaugcucccgcagucugcacaaauuucuauuuucauucuucuuuuauccuaacuuguggaucuuuuacuuugaucuguagcagguaagucaguaauuauugaguggggagguuugguuugguuugguucgguucgguucgguucgguuugguuuugagacaaacuucauauagccugagcuggccuugaacugucuuuguaguugacagugucuuaaaauucccaguccuccuucuaucaggugcuaucaugccuucuuuauggguuuuaggagacauucugaaaacugagcaaugucaccagcaaagcaacacauugcauuuaauguggcaacuggauaaacuauuaggauguaguucagcaccuuucuuaaaauagagaaaguguauguauguguaaguaaugcuacuauagguuuaaaacuauguggggggaguagcucaacuuucuaauguucuaugugacagcuugaauucacauacuagcuuaagcaggaagaugguaagcaagcacuuuggcuuuauacacuucuguaauauggcagauacaugugacuauucugguuuuuaaaaggaguaguaacuugguaguauaaggcagguggauugcaagagugaggccacuguguccaaaaaacaaagggggcaguaauagucacuguggaucagggucuagcccaucucaccaaacacgauccugggcaauguacuguaauguuguaaacaacgugggucuccacguguugaugaguugaugcagaaaaaacaaaguucuuaagucagaagaugauaaugggcuggagagauggaucacugguuaagaacacuuaguggggggcuggugagauggcucaguggguuagagcacccgacugcucuuccagaggucuggaguucaaaucccagcaaccacaugguggcucacaaccaucuguaacaagauccgaugcccucuucuggagugucugaagacagcuacaguguacuuacauauaauaaauaaauaaaucuuaaaaaaaaaaaaagaacacuuagugaccugucaggugguucacaacugccaauaacuacagcucugggggaucuaaugugcucucuucaaacuccacagguaccugcacauacguuacacucacaaaaacacauaagaauaaauucuuuguaacuucuagcuucuugucuuuagugacugacuaaaucucagaaaaugggagaggaaaacaaaacacuaaaggugagagaaagggggaagaacggaaagaugagaagggaagagaaaggaagaaaauuugacaugguggcuaguaucuguaaccucaguacucagaaugaggcaggauugccacaaguuggaggacaggcuggguuagagugagauccugucuccaaaaggaagaaaauggcuugccaguauggaguuuauaacauccaguauguugagaugcucagaaugaggcagaaggauugccacaaguuaggaggacagccuggauuagaguuaaaaagaaagaaaagauggcuugccaguagaaagaaaacuaacccugaaaguugucuggucuccacacaugcaccaugaucuuugugagcucaggucaucugcauuuagaaaaauauuuacuucaaaaaaggaaaaaaauagaagagugaaacaaagcacagauuaaaggagcauuuguaggcagcugguaggguccaauggacuaacacaaaugaugugagugaucuuagacaggagccuuaaagagaaauagauccaucagucaaauaaauggcuuaaaaucugagaaagagaaaaucuuucaaguagccacaaggaggagccacauucugaacaagagaggcuuagacagggaugccagccaggccaaacagggaaacagauuccaacaacugagaaaaaucugccagucuguaauuccacaccaauugauuauuuccuuuaaaaucaaggcaaauaauaucuuaaaauucaucacuagccuuguaugggugguguauuccuuuuuccuagcccuuaggagacugaagcaaguggaucucagugagcuugaagccagucuggauuacagagcuacaggucagucagggauacauaauagagacccugucucaaagaaaggaaggaaagaaaacaacaggacauccacaugguagaaaccaaggaauuuuccggguaggaaacaaaccaaaugaauaggucagcauaauggaauuaagaacaaaaggaguaggaguuccugaaagacguaaauacaaaaugaugcauauagaaauacauauauaaacaucauuguaugaucaaaauagugauugagccagauuacacaccuguaauuccaguacucuagaaugagaacggugaaagcaggggaggggggcguuugccaggcuaacuauacugaccuaguucuggugucaacuggaugcugauaagagucaucagagaggaaggagccucuaugagauccaggauuuucucaauuagugaucagaaugaaaggcuccagcccaugguagauagugccaucccugggcuagagugguacuauaagaaacaggcuaagaaagccaguaaacagaaccccuccaugccuucugaguuugaguucauguccugacuugcaaugucuaugaucuggaaguauaagcuaaaucuugcuuuuugcauuucucgcagucauagaaacccugacuaagauaacaacuagcuuaaguuaccuagaaagaccaucucaaaaggggggggggggguggcgcuaaaaagcugguucagggguuaagugcaaauauaccaaaugaaaugacaauacugaaugaaggaauguagagaaaucacuuuuuagccauugcuaaguggauaguguccuguagacaccauucugaaaagcuguggcaauuccaccuacccccacccccaccccugcagacaugacccuguauauguauauguaugaguguaaguacuuuaaucccauaaggauuuaaugaaguaaagaaguaaaagauaaaggagaauugucagauagaauauaaauuagaaaggauaaggacgagaacuuagccagggcugauugcugacaccccaguuuugagaggcagaggaauuccguguugaaaguaagaacaacaaagugggccuugugagaagaguuugcccaguaucuuagccaguuuaaagcucagaaaacugaaggaaaaaugguuccucuauuaggaaauuaauaccacauggucacugagaaugaaacaacaaucuguuacacacgcguuggucucuccuuaggaaagucacugcaguuaguagggugcuuggcaagcauucagucuagcagccccaagaguuaggguacaugucuguaaguccagcucucaauaggaaggaaggcaggaugaucagaaguucaaggaaacuccccuggacuauacagugagucugaggcgaaccugggaaacaagaguccuguccccaaaaguauacaagauugucuuagcaguuauuaaucaacuuuccacccucaaaaagaguggguuccuuauguccauuuuguuuggaucuaggcauaguuacuguuuuuaaccuguacgacaucucuguuaugucauuuggaauuguuuuaacuuacugucuacacacacagagaaggagggaauaagagggaggggggagaaauaugaaacauacuauaaauaaaguaaguaaagaggcccuggccacaccagcugucuagaagaugcagaaacuaauuuaucugccuggaagaccagagucacccagaaaggacacucuccaaccuuuugaguggccugcaggaugugcagugugcuccagguucccagccuuugugaacugucacccaugcuggcaaugggcuuuagugauacagugucuaagaguuauuucugccccuguaaguaacccuccuccauaaucagcuaaguagcuccaguaaaacucaucuguuccccacauuggacuuugauggucuccauacuuuggucuaucaugggcuccuuaucuggggguacuuagaaguguguauuuugucuucccaggaaaaguuucauuacacaauucauaccaguacccauaaaaauaguugcuugguuuuugugucugcagucuauuuaaacuggaauuuuuguuuguuuguuucuuaguuguucagugcaauuucugcacauuagcaaauugcuaaauaacagugguuuuagcagcaugaguaggcauuuacagauauuuaggaugcaaaugaagauacauaccagcauuugccagguguaguacuccagauaugaucuguggagucuucuggaagggaagacugguggaacccugcugauagguuuuuucccagucuuuauuagcauguggguucuuaaucccacccucuaauauacaagugagugccgagcagccgcuccagcgaacccgggaagucucauuccuuccaagccguagaagccuauccauucuccaaaaugccuuugcaaaggcuuuguguguauccucauacucccgucuacuaguucugaagguuuuguauguggaagagaaggccucuucucuggcucuguauuccucccugaacaccgugucaaaggaauugaugaguugcuucugcucagcugucauuugguaggaaggauccuguauagacaauugauggagaaguaaaaccugaaacuccuuugaugccaggucugcugcugcauaaccguaauggcuaucaaauaaaccgaaaaagcacacauuggccuuaucaccaaaaucguucacgaccgugaauuuacaguucggcuccgcuuuccaggcugaauuauuauugcuacagauggcuauaccuuuaaucaucagaugguugcuguuuggagaauacguagaagucucgccaaccuuaucacaaaguuugaaguaugauggaacuuguuucuuccaaagaaacucaaaugcguaguucacauugugaaggacuuuuucauuguauguagaagaucucaaaagguuagagauuauacacucucuaugaagacugaccaguuugggcuuugguugccucccucccauccacuggaaacccagcauacucagagcauugugauguuucuuauggagaaaauuccuagcuuuguucaguucucgguagcagacagagcaggggaaugugaccaugucaccagaaaucagcugcucaguggaauccuccaggucgauggagcgcuuuggucuaggccuucuccuuuugccaaccauuuugccaaucuugagauucucaucagaaguaaauguugaaguuuucucaucccacacuuuugaucuccaaaacacucugggagaaagaugaaaugugugguucagugguuaagagcaccuguuguguuugcauaggacccacaugaggcucauaacaccaguaacucauuccagaccugauggccuuuucugaccucugucuaccacugcgugcacaugcagacaaaauacuuauacacauaaaauacauuuuagaauauuuuaagaugauuccugaaagaaauaguacacucucuuugcacagucuuauucaugauuuuauagaaaccuacaguugaguuuuauaaagccccccaaaaagguccuuaacaaaucacugauuguuccauguuggccuaagugaaauuaagugcccaguccacaaauucagcuagacaucugaacaaauacucagagaaauaauauuuuacuccagcuaugaagaaacauuuuauuuuauaagugugugcgugcacgugcagaugauagaggccaaacgagaacauucgaugcccucuuccaccaugcuucuccuauuccuuugaggcagaaucucuccugacacugaagacagaaaaauagcuggacugggacuuccuggcuaccagccucaccaaaaagaaaaaagugaguuccagauccaccaaggaccugccucaaaggauuaaggcuuaaaugauagaagagagcccagcacacacucucauauacaauuuuaacauaaaauccauuuguaauuuuuaaauguuuucaauauaauuuauagcccaaaacaagguagcaaugagguugagguuggcuuuggcuacauggugaguuucugucugggaaaaagaaaaccaagaaaaccauagaguguuaccaacuaaccuccguuaaacuagucaggucucaaucucaauaauaacguuuucuuuuccauuuuggucauuauugaucccagggcuaggcaaaugcagugucucugaaccauagcuccagccuguaauuaacuauuauaugucuuuacaaaugaauggaugacuagagaguagagggagaaaggaaaaauauuuucuacaagccaggagugaugggagcccaacacacuuauaaucccaguacucaggaggcugaaacaaaauugagagcuugagaccagcucuggauauguacugagaccuugacuuuaccacacacauauccaaauguaaacuuucugagaguccuaaaaccuaucuacaggagucccacagauugcccuauagccauuaccugagcacacuuccaucucuuugugaugacccagggucauccuaacucuuuucuacuuaacauauuuauaucaucugccaggucacagacauacuuucuacuagggacccuaaguggccauacuggggcugacacaaguaggugguuuucacuacucuuccuugucaggagccauccagaaaaggcuaaaggcaaauaaguuuucuggagauggcccaccauuuuuuacauggcuuaugaugagugaacucugagaggcaagaucccaauagacuucaucccaggaucacuucuuacugcugauauacuuuuuccuaucccuauuacacagcuuaaugauuccugggcaucagccuaccuucuugaccaaauuuucugcagaucaacaugaagaugaacuuucaugagcuaaugcuguuuagaugaaugaauggcuuuauagaauuccugauuuggucaguuuaggggaaaaaaaaaaguauucaggagaugguuuuaucuguuuuaccagaaagauguaauagucagaaucaagaauagaauguacucacuccucauagaggaaaggaaggaaaggcugcauaguaaggaauacaaugagcuuucacaauuaacacuaaaaagaaaaauaggguugggacaaauuugugaucaagguaaaacauccaugcuaggucagauccaaggaugaagccacaggugggcacugugaucaagugaggccauggggaagugcugcuuugaacuuaacuaucaacauccuucuauaguugcccccuuuguauaauguguuaucuaugagguaauuuucuaaaaaacuuuugucuaagaagauauaaaaaggccagagaaaaggugguagcaucugguaccauccacuaaauguauauacauacauacauacauacauacauacauacauacauacauguuuguucaucaauacauauauguguagguguauguguauguuuguaauaugcaugaaccacuuauggaguugaugagacagguggucaggccugacaugagugagugagugagugaguguguguguaugugugugugugcaugcaugcauugccuauguaaaagauuuucuuuucuucucuuuucuuccugguucacaaagaguuaacaagcuccagaguuucuugccuggccagcaaggggcuccugacuggcuugccagagaaaggagcccuaccaaccaauaaauccuuuauuuaauuccccacuguaaaaagcagguguuaaucacaagaggucagcaguuuugggucuuaaaauagcaaaguuaaggaaagaaaaaauauuaccaaaaguaaauuacuuuugcccuaccagucacaauauuugccacugcagucaccagagucucugccacuuucccugagaaacccccgaaaucuucuuuccugcaaucugccugcaggagccccucuucccaccccacuuccauuucccggggauuggauuacucagugcucaccaaggguucccuauccuauuuggauacacauuuuuuccuagcccaucuucauuccuuuguaucacacagcaauccaaugaaacauuucugugucagggaccacauaggcaccacacuugcaugagugggcagcagcagccaaagaaaagaucaaccacccaacaaagacaagaaauacauauauaccaaaaaaaaaaaaaaaaaaaaaaaaaaaaaaaaaaaaaacccacaucaaucgucuuagcaacccugcaaauucuaccagggaauuccuaacgcugaaaaacaccauuagugaaguggcuggauacaagauugacaaaaacgaaaacaaacaaacgaaaacucaauaacccuccuauauaaaaaugacaaauguacugaaaaagaaucagagaaacaauaucuuucacaguugccaaaaauaauauaaaacaucuuggggccacucuaaucaagcaagagaaagacuuguaugacaaaaauuuaaagucuuugaagaaauuaauugaagaagauaucagaagaagaaaagaucucccaugcucuuggaucaguaggauuagcagaguaaaaauggucauccuaccaaaagcaaucuacagaggcaaugcaaucccaaccaaaauuccagcacaauucucuacagaccuugagaggacaaugcucaaguucauauggaaaaacaaauacuccaggauaucuaaaacaauccugaacaagaauagaauuucagaggggcuggagauauggcucagagguuaaaaguacugucugcacuuccagagguccugaguucaauucccagcaaccacauggugacaucuauacugagaucuggugcccucuucugggccacaggcauacuugcagacagaaugcuauauacuuaauaaauaaaucuuaaaaaaaaaaaaaaaaaagaaaagaaauagaauuucaggauguaucaccauuccugauuucaagguauaauacagaguuauaguaacaaaaacaguaugguauugguauaaaaacagacacauuaaucaauagagucaaauugaagaccuccacauaaauccacacacuauggacaccugauuuuuaauaagccagaaauagggguuguggggggagcaucaucaagaaaugggguuggucuaacuggguaucugcauacacaauaauacaaauagaaccauauucaccacccugcccaaaacccaaguucaaguggaucaaaaaccucaacauaaaauuagauacacuaaaucugauagaagagaauuugggaaauagccuuuaacucauugguuaaaaaaucauaacuuucugaacagaacaccaauaccacagguacuaaguaagaucaacaacuaauaaaugggaccuccugaaacugaaaggcuacuguaaggcaaaggaaucaucaauagagcaaaaugaugaccuacagaaugggaaauauuaucaccaacuccauaucuaauagagggcuaauauccaaaagcaaauaguccaauuaaaaauggggcacagauauaagcagagaguucucaauagaggaaacuaaaauggcagaaaaacaaauguucaacaucuucaccuaucagggaaauacaaaucacaccuacuuugagaucaaguaaauaauaaucauaccacaaucacagacccagaguggcuaaguaacaaggagggcucugggggaaugcaugugucucccugggaaggggaaauggauuuuagagguagaguagaguucuguggggaugggacuaggagggaucagguugggggauggggaaguggauauggcaagggaauacugaaauuggaggccuuugagggggcaauguagaaauauacugcuauucaacuuuccuggaaucugugaguaugacccuaggaaggucucucaguaauggaagauauagggcaagaaccaucuauccucuguaaucaggcaagguaaccauuguaggacauguacccagcuauagaaccuuugaccuauauuaauacagccugccugcaagaugugcugaagcaauaguggugcagaguuuguggaaguggccaaucaauaacuggucugauuuaaggucuaggccacaagaaggagcauauaccucacacugcuuggguuggucccuccccuuggagcuuggggaauccugcaguaaagggggagaaggaauugugggagccagagguguagcuggagagcacugcugcaggaaucaacuaagcagggcaccuugggggcucacagagacugaagcugcaauugcagagccugaaugaaucuguaccagguccuugccauacauguuaugguuguuggcuugguguuuugguggggaaugcugacggugggagugcaggugucucugacucccuccuacuggauugccuuucccagccuucaugugaggguuugugccuggucuuauuauaucuucuugugccauguucaguugagguccguggaaggcuugcucuuuucuggaagauauuaggggguaauucugagggagaggagagguagggaggugacugguaggaguagagggagggaaaguuguuguuuggauguauuauaugagagaagaauaaauauuuuuaaaguugucugucugucugucugucugucugucugucugucugucugucuauaugguucaggccuuuaaucccagaacuugugaggcagagguagguagauuucugaguucaagcccagccuggucuacaaaucgaguuccaggauagccagugcuacacaaaguaacccugucucaaaaaaguaaaaccaaaagaaaccaagccaaaccaacaacaaaaguggguauggugauuugaaugugcuuggcccaggggauggcacuauuuggugguuuguucuuguuggacuagguguggccuuguuggagaaaguauguagcugugggagugggcaaugagaccuucuuccuuaccaagugggagccagucuucuccuaguggccuucagauguagaacucucaguuccuucuacacuaugccuggugcauggucucuguucacagcaguaaaacccuaacuuagauagugaggaauaaccccuccccccaccuuccccaccccucaucucccacccgugccuuugauuuggguuuccuuuuuuuuuuuccuuuaugccuauuauacuagguuuggucuuuucacaguguuccagauuugcugggauuuuuuuuuuuuuuuugugccuguaaauuuuuuuauuuaacauuuucuuuggcugaauuucucauuuccuuuaccuuguuuucaaggucugaccuuucgucuuccaucucuuuuaaucuuuuggugaggcuuuccucuuuuguuuuguuuuggguuuugacauauuaaguuuuucauuucuagguuuacuucuuuggauuuuuuuuuuagugacuauuucguuguuaaauucuacuuacauaucaagaaauauuuuuauuauuucauucaaguguuuguauucuuagucuucguucaggaauuugcucagauccucuuuaugguccuugaacaaauucacacugcuuucugaagucuuugucuugugcaugagcuaaauugcuuuucuuauggcucaguccaaaggguugcuggcuucucgaagaggcauauugucuugacuguauuugugguuuugcacugggauauaugcaucuaguuagaacuuaaauaauauauugaacagauauggauagaguguuuacccuugucuuuuuccuaauuuuaauguaguugcuuugaguugcuauaaauuguucuuauuaugauuccuaggucaccuauuucccuaaucucuccaagucuuuuaucaugaaaagguauuggauuuugucaaugguuuuuuuuaggcaucuaaugaggugaugaugugacuuuuuuuuuucaguuuguuuauaugguggauuacaaugacagauuuguuuuguuuuguuuuguuuuuuguaugucgaaccaucucugugucucugguguaaagccuacuugaucauaguggaugaucuuuuugauguguucuuggauucagguugcaaauauuuuauugaguuugauauauauauauggucauaaguaaaauuggucuauacuucucuuuuuuguugagucuuugugugauuuccauaucagggugacuguggccucauaaaaugaauuuggcuauauuccuuuguuucuauuuuuguggaauaauuuggggaauauuagugucagcucugcuuugaaagucuggugaaauucuucacuuuggcccuaggcaguuuuggggguggguguuagaaaguuuuuaauagcugcuucuauuuccuuagguguuauaggucuguuuaaauuauuuaucugaucuugauuuagcuuugguaagugguaucuaucaagaaaaucauccauuucuuuuagauuuucccauuuuguauaguacagauuuuaaaguacgaccugaucauucuuuggauuuccucaugucuguuauaccacucuuuuuguuucugguuuguuaauuggaauauucuuucuucguguuuuauuuuguuugaauaaggauuugucuauguuguugauuuuucucaaagaaccaacucuuuguuucuuuuuuguuuguuuguuuguuuguuuguuauuauguauuguucuuuuuuauuuuauugguuuuagcccucaguuugauaaguccuugccauauauuuuucuuggauauuguaaaugucuuuauuuucagauggaauugucaucucagaggcuuacugaugaauaaguucauccuuucuaguucuuugucagaucuggcugccugguuuggcuuaaaacuccucucuaagcugacugauucaaacuagcuucuguuaucugccucuaacugauuuucuuugguuggccucaaacuaacucuggcaaucugcucuaagcuucucauucucuucucuuuuuucaccugcaaccugucucuguaaaaauuuccugguaaacucucucuccuccccuggucucuuaaauagccucucuuuccuuucuguuuucaugagaguugaguguauuuucuuucuuuuuuuuuuuuucaauuuuuuauuagauauuuucuucauuuacauuucaaaugcuauccugaaaguccccuauacccucccccgcccugcuccccuacccacccacucccacuucuuggcccuggcauuccccuguacuggggcauauaaaguuugcaagaccaaugggccucucuuucgagugauggccgacuaggccaucuucugcuacauaugcagcuagagacaugagcucuggggugcugguuaguucauauuguuguuccaccucuaggguugcagacuuuugauucauucugucaaaucuuucucugauucaucacuuugucuguuccucaguuagacuucacuuucaaacauggcugcuucucucuacaaacuagcuuuaccuucauuguuugggacuaaauguguguacuuaugggcaugccuguauuauagccagagggauuaaaguuaugccaugccaucuggaccacacagaccuagagaguguuuggaugugauaccuuucuagagcagccauguugcugaauuaaaauuccucuacaggguaugcauacuuuguuguuguuguuguuccagagcuuucagguaugcuguuaaguugcuaaugugagaugucuccuuuuuguuuuuuuuuuuuuuuuaauguaggcacuuagugcuaugaacuuuccucuuaacagugcuauguuugugucacacaaauuuguguauacuauggauucauuuucauuaacuucuagaaaguuuucauguggcucccccaacaacuggagugggggaugucccuaaagauguugucuuucuguggaauacauuccccaacugagcugucuugucuggccucaaugggagaggguaugucuagcccugcagagauuugauaugccagaguggggagauauguaggggaaggccuccacccacucagaggagggggguguugaggaagggacugugggggagacccagaguaaguaguaucuaucaagaugugaagugaauuuuuaaaaugcugaauagaaaagaaaaugccuccauuuuggaucccuuaagacuaaggauaggaguugagggggauaaaagucauugcaguacugugaccaagagccaccaaaguaaaucccucuauacuuucaauugcaauauuuauuuccucucaaaaaaaaaaaguugaaaaaaaacuguacaggaaaaaaaguccaaaaacaguuugaaaaauaaagaaucaagauagacagcccauugaaauuaccucaccaccucuuaaagaaauugaggaaaggcaaccagcccaauuaguuuucucaguuaacugggaacaaaugccagagaauggugaaaauucacaaaaugaacaauuagucuggaauccuguuaaaauacaaaaucuugagcugggugugguggcgcacgucuuuaaucccagcauuuggaaggcagaagcaggcaaauuucugaguuugaagccagccuggucuacagaguaaguuccaggacggccagugcuacacagagaaacccugucucggaaaaaaaaaaaaaaaacuuaaacaaucaauaguaacuuaugggaugcacucacccuaugcuuugauaaguuaauuaccuggacuucccaaaagaggauuaucaccccaaaaugggaaguuuuagaagcagcugaaccagaagcugguucucaauuacaauggcugacaugguggcaagaagaagcugcaguuauaggacaucaugauagaucuguuguggccugccucacuagcauagcuguagccccugugggucaagcugcccauauuauuauuggaaauuccccaaccauagccuucaugcagcaagauagagaucaacuuaaacugcuaugugugaaagaaacuuggggaaagccuaaacaugcuacauuucccccaacucccuauaucugcuuaugagcgcauuauuauuuuuucccuauauaaacugacccugguaguguuuguggucacaguugccagccccugaaucugaucugugauucugaucuuggcguguacauucaauaaaccagcccuguuuaacugagaugggugucugaauggauuguguggcaacuccuggaccguaacagaucuaaagguguuaauaugaaagaccaauuguuagaugaaggccaauuugaugguuuaaaacagcagaugcauaggggacugauauccaauauauacaaagaacucaagaagauggacugcagaaaucaaauaacccuauuuaaaaauggggaacagagcuaaacaacgaauucucaacugaggaauaccgaaugacugagaaacaccugaaaaaaauguucaacauccuuaaucaucagggaaaugcaaaucaaaacaacccugagagccucgccaaugggaagagaggccccuuggucuuacaaacuuuauaugccccaguccaggagaacgccagggccaagaagugggaguggguggguaagggagcagggaggggggaggguauaagggacuuuugggauagcauuugaaauguaaaugaagaaaauaucuaauaaaaaauuaaaaaaaaaacaacccugagauuucaccucacaccaggcagaauggcuaagaucaaaaauucaggugacagcagaugcuggugaggauguggagaaagaggaacauuccuccauugcuggcgggacugcaagcugguacaaacacucuggaaaucaguuuggcacuuccucagaaaauuggacauaguacuaccggaagauccagcaauaccucuccugggcauauacaccagaagauguuccaacuuguaauaaagacacaugcuccacucuguucauagcagccuuauuuauaauagccagaagcuggaaagaacccagaugucccucaacagaagaguggauacagaaaaugugguacauuuauacaauggaguacuacucagcuaacaaaagcaacgaauuuaugaaauucuuuaggcaaauggauauaucuggaggauaucauccugagugagguaacccagucacaaaagaacacacaugauauauacucccugauaaguggauauuagcccagaaauuuagaauucccaagauagaauuugcaaaacacaugaaacucaagaagaaggaagaccaaaguguggauaccucauuccuucuuagaauggggaacaaaauacccauggaaggaguuacagagacaaaguucggagcagagucugaaggaaugaccauccagagacugccccacuuggggacccaucccauaaacaaccaccaaauccagacacuaggcagaugccaacaagggccugcugacaggagccugauauagcugucuccugcaaggcucugccagugccuggcaaauacagaaguggaugcucacagucauccauugaauggagcucaagguccccaauaaaggagccagagaaauacccagggagcugaagggaacugaagccccguagaagaaacaucaauaugaucuaaccaguacccucaaagcuccuuggaacuauaccaucaaucaaagaaaacacauggugaaacuugugguucuagauauauuuguaauaggggauggccuaguuggucaucaaugggaggagaggcccuuggucuuauaccccaguauaggggaaugccaggaccaggaaugggaguagguggguuggggaacacggggaggggggaggggauaggggauuuucggaggggaagcuaggaaaguggauaacauuugaaauguaaauaaagaaaauaucuaauaaaaauaaaaaauaaaguaggaaauauuuauacaauagcuaauuuauguacauguuaaauauuugucguaaaggaguaaaaaauuaagaaaaaaaaguuaaaaaaaacaaaacccagcagaugcaacuugaugccucuauuauuauacaauacacuuuaauagcuuuaagggccuggaagaagguggaggaacaaggaaaaaagucuaugucauucacaaagaguaugcaaagucccagaaagacuuuuucugacuucuuacauagaucaacauccacuaaaaacaaggcaauaucaaauccagaugcaaggcuuugaaaguuuagcugucaaaaaugcaaaugcagagaguauaaagaaguucuuagaccuuuaaaagcucgaucagcacucacagaugaauggauuagaauuucugcugauauugaccccuaaugacccuaauggcauauaauccuauauauaaaaauauccauuguuuuagcugugggagaaaggucauuugaaaagagauuguagacaaggcauucccagacacuucuccagaaaaccucagccuuccgugguuugucgaagguguguuaaggguuggcauuggacugacuaauguauacagaugagcaagagauuugugaggucauuccuuaccaaugggaaacuuccugcaagacacuccuuuaaacaugggaaacuccauaagggaguucaauuguuccuuggcaauaaacaauauaagccagucauuuccagucagcagugcaauagcugaguauuugagacacaaugcaggauacagaagaaugcagugcccuagauuuagccaccaguaaaaaucuaacacuaucuccaaacauuccaugcuauaaaauacccacuggaauucauggaccucucuccccaaagacaguaggaauggauuuaggaagaaauaaccuaacaucucaaggacuuauugugcaucaggaauuauagaugaagauuuuaagggagagacugcgauuauggcuuacauagcgaaaaaugugcaguguacaguggaagacaggauugcucagcucuuacugcuccuguaaaugucugugauuugagaagaauuauaccccagacucaaauacuaugcaacagcaaaaaauguuuacuguggagagaaccugcaugcaggggucugccauacaucaggauggaagacagaagugugggauuugcggggucaauuuaaagccuauuaggguaggagugggugacuuuuacguuucuuucucuugguugguuggcuuuaucucugggguauggaugccuugcgauugguuaaggcucugggggauuuuaagagacugaaggugauuaacuauauuuggcucaggcuaggugguggggcagcuuccugauuggcugccugugaggguaguuuuucauggaauugauuguguuucgauuuuuccaguucuggggaacagaaacuuaggccuagucucucaaacagccaguuugcugcccuccauggagucagccuggcucuggauaacucagcccucucauccccuugucugauuuguaacugaauccaaucauugauuggucaguucuuuuucccaagauccaagucauuaaccaaaacgucaaugggaaccuaagaaucauaaguuauucccggaaauaggggccuuugugacuuagcaucucagccuguaguaaggugagacaauggacauuguauuuuuuuuuucuucuguaauugcuuccugcugacauuagcacauugucuuuugggggcccaggaaggcugaaaugcuaaucgaaggcaauaggguauuuaucaaaagcuucugguuaggugauccgguugaaaagagggaaccaucauauugacuagaccgguuaacaucagcuuucaauaaacaaguauucagcaguuuccaguacacagguggucccuggaugucagccagaugaaaaucugagacaaauauaaacuagagacagaaguuaaaauuugucuaguaauaggggaagguaagaaaaccccaagaccaagggaaaaaucccacucacaagaacaggcaggggaagccgggcgugguggcgcacgccuuuaaucccagcacucaggaggcagaggcaggcagauuucugaguucgaggccagccugaucuacaaagugaguuccaggacagccagggcuauacagggaaacccugucucaaaaacaaaacaaaacaaaaaaacaaaaacaaaaacagaacaggcagggggcuggagagaugacucagcgguuaagagcacugacuguucuuacagaaguccugaauucgauuccgagcagacacgaucagugaugcccucuucuaguguaucugaagacagcuacaguguacucaaauaaauaaaaugaauaaaucuuaaaaaaaaaaaaaagagcuagagagauggcucaguggguaagagcacugacugcucuucuagagguccugaguuuaaaucccaccaaccacaugguggcucacagccaucuguagugggaucugacgcccucuccuggugugucugaagacagcuacagugcucucacauacauacaauaaauauaaucauaagaaaaaaaagacuuacuuuacccagcaccugaguucgaggccagccaggucuacaaagugaguuccagggcagccagggcuauacagagaaacccugucucgaaaaaccaaaaaaaaaaacaaacaaacaaaaaaaagcaggcagguguacgcaacuuaaauucaucuggcuugugguaaggagauucaaaucuuaugacuuuuuaauucucugaagcuuaccguaguuacaagaggauauacauuaguauuuaucauugcauugaaaucuguauuuuagaaaaagcagcuaauggguaaggcaacaauagaugaaugucuuugagaccuagcaaaagcuauaguuuugaguuaaaagacacgccuuuaaucccagcacuugggaggcagaggcaggcagauuucugaguucgaggccagccuggucuacaaagugagguccaggacagcuagggcuacacagagaaacccugucuugaaaaaacaaaaaacaaaacaaaacaaaaagacacagaacauuuuuuucucuuaguccacagagcucgauacacagauugaagaaagauguuuuuagcaugaugagaaacaucuuuaagucuacacguagaagacaaccgaaggcaauuuaaaccuugagcuugugauugaacuguaagcagccaaugcuccguuugcuuaucagaauucuauugaucaaugcuaaaauuuucaacuuuugaaaucuuaguauuauaauagcacagaugagggaaagaaaucuaagauauuuuccauuuuucagauaccuuaaauuacuuuuucauaccucuacagcuggccuuuacacacuguaaagaauuuucagauccucagaaauuaccuaagcuuuuacauccucagaccuuucuauaccuuagagcacucaggauuuccauaggcuuuaaaccuuuuuguuuccauccaauugauuaucagagacacgaguaguuauucuaagaacaguuaauaaaguuaauaaaguuaauaaaaguuaauaaaguuaauaaaaguuaauaaaggaacaguaaaaagcuacaucugaaauaauuuggaagcuguuagcaaagcaaaccugucugccuguuuuguuuuguuuuguuuuguuuuauuuuguuuuuaagauuuauuucaugaaugugaguacagugucuucagacacaccagaagagggcgucagacccccauuacaaauggucgugagccaccaugugguugcugggauuaaacucaggaccucuggaagaacagucagugcuuuuaaccucugagccaucucuccagcccuaucuaccuuuuuaaaaaaaggaaccuagugguucaaauauaaaccaacccaguaguagauuaccuugacauaaagagguaguucccugauguccagcuguuaagcuacaaguagccaucaaugcaaucagagaacuugaacaaauuacaauaaauuacaauaacuaaauagaauaaauuacaauaaacugaauaaauauagcaauuaaaacugucagauuuacccauuauccagacagccaccccauuaaguuucugagauguccauugcuuuacuggggacacaggucucaagguaggaucaaucuucagcugccaggccuggcaaaucugagaggcucuccugaggaggacgaggaacuuggggaaauaaccucaguuugucaaucuggguguccuuuguuuggucucaguucaaacuagguccuggcagugggcaaggcauucaggcaguuaugcccaguggguaguguaccacaauuccggcagugucuuucgucauugugcccuuuucuucuuggagauuuggggggcgguuguuagguuuugggagucuuugucuguuauaguaaguuuaaaaauauuaaaugcauaagccaggcguggugucgcacgccuuuaaucccagcauuugggaggcagaggcaggcagauuucugaguucgaggccagccuggucuacagagugaguuccaggacagccagggcuacacagagaaacccugucucaaaaaaccaaaauaaauaaauaaauaaauaaauaaauaaauaaauaaaaugccauauucagcaaaucucugguugguuugagggccacuaucuacuuagcauaucuaaguuaaacaaccuuuaucuauuuuaguuaucugcucuguccuuugcaaacauaaaacaggagaguaaauaaagcuuuaaucuuacacuuaacugccucucagucccugcuaaguuugaggcucaggagucaguuuugaaucgaaacucaacuaauguuaguauaaaacucuuuaaucccaaaagcauacuucaugaaaagacucacauaacagaacauaacaguuaugguuuaguuuaggcugaagccagugucaggacaggaaaagguuaaaauagccgagugcuugacugagagaacucuuaucucucuuuaggcugcuggagccuugccagggcuuagucaaagugaaagaaggagggcauagauuuuaaaagccagugaauuuuaagcuuuuugguuugguuugguuugguuugguuugguuugguuugguuugguuugguuugguuugguuugguuugguuugguuugguuugguuugguuuuuugagacaggguuucucuguauugcccuggcuguccuggaacucacuuuguagaucaggcuggccucgaacucagaaaucugccugccucugccucccaagugcugggauuaaaggcaugugccaccacugcccagugagcaaaaauuucuuaauuacuuuuacaaagcuauuauuacucugauaccaaaaaacacacaaagacccaaccaaaaagaaaacuauaccccaauauccccaauaaacauagaugcaaaaaauuucuaauaaaauacuugcaaacugaaucuaagaaaacaucaaaaagaucauccaaucugaucaaacuggcuucaucccagaaaucuccaccaugggcuggcgagauggcucaacugguaagagcacugacugcucuucugaagguccagaguucaaaucccagcaaccacaugguggcucacaaccacccguaaugagaucugacgcccucuucuggggugucugaagacagcuacaguguacuuacauauaauaaauaaaucuaaaaaaagaaaaaaagaaaacuccaccacauaaacagacugaaagacaaaaaacacaugauuaucuaauuagauaacagaaagacccuuugauaaaaauccagccgggcagugguuuugcaugcuuuuagucccagcacuugggaggcagaggcaggcagauuucugaguucgaggccagcuuggucuacagagugaguuccaggacagccagggcuauacagaaaaaccuugucucgaaaaucaaaaaaacgaaaaaaaaaaaaagaagaaaagaaaaaaagaaauaaagaagaaacaaaccuaggaacaaguaacagggaaauuaagauaauauuuggguagcacagagaaacugugucucgaaaaaccaaauaaauaaauaaauaaauaaauaaauaaauaaauaaauccaguaucccuuuaucccuuagggauacaagggacauacuuaaacauucaacaagcccacagccaaaacaaagagaaauuugaaacauuuccucuaaaacuaggaacaagucaagguugucuacucucuccauaccuauucaauauaguucuuuaagucuuagcuagagcagcagcaagacaacugcaagagacagagaggcuacaaauuggaagaguacaggaaagucacgguagcuuuauuuguagaugauaucauuuuauauguaaaagauccuagaaacuccuucagaaaacuucuacaguuaauaaauguuuucaacaauguaguaggaugcaaaauuaacaacaacaaaaaaaucaguagccuuccuaaauaaaugaaagacuaggaaagaaaucaaguaaauaauaccuuugauaauagccucaagucuugaaauaauucuaacuacacaugugaaagauauauauaauaaaaacuaagaugcugacauaagaaacugaagaaaacugauagcacagacauuaagaccaacaauaaaugaaccucaugaaacugagcaaagcagcagccuacagaaauggaaaauaucuuuacgaauuauauaaccaauagagaguuaauaucgaaaauauaagaacuaaaaaaaguggacaccaagaaaacaaauaacccaauuaagccaggcaugguggcacacaccuuuaaucccagcacuugggaggcagaggcagguggauuucugaguucgaggccagccuggucuacaaagugaguuccaggacagccaggccuuuacacagcaacccugucucgaaaaaccaaaaaaaaaaaaaaaaaaauggagcugguggcuacgaagagcuuuuaucuauacuggcuacuguucaugguaguagaacauagucuucauacuaccaaaggacaaagguaaaccaaccaagcuacaaucacuaagaucuacagcggugaccugccugcaugauacacggauacaaaauguuguggugguaauacugauuguauuuaagucaccuuccaugagauugaaccccugauaaagugauuaagaccugagacuagauagcuauggacguaggagugaauaaaacacuacuauucugcuaaaggaacauagcaauaaaaugauuccuaagggcacugggcuauacgcauagaucagugucucauuuggccaucaucaaacagcuuuuucugcaauagauggaaccuaauauggagacccacaaaugagcaaugugcagagagcaagagacuuuggaauacucggucuaaaacaggaugccuucauuaaagcgcuuccuuugauguuugggaauguauauggaagagguguagagaaugcagaaguuggagguaauagacaaccccaaggaaacagugucuuacagacacaauagaacugacacauauacacaaauucacagagauuggggcagcacacucagguccaaacccaacaggguuccagugcuaagagcggggaguugacaagagcucauacaacccagaugcuaugucuaaaugacaaccguuugcaaagggaaaauuaccuuucuccagugagucucacugggaguauaaaccacauuuaagggcagagcccaugcccaacauuagauagccaagacuaccuuauauauuauuguuucugauuuuguguuuuuauggguucauguguuucuugagcuuucuuuuuuuuuuuuuuuuuggugcccauuuucuaaagagaaaagucauggacuugggugguuagggaaggugggaagaauauagaaaguagaggagggaaaaccauaaucagaauacacuguauaaaauuuauuuucuguuaaauauuuuaaaaagaauacuguggguauaauuaucuauugacugaauauauuauccaaccauauuuuuaaaaaauauauuuuuaaaagauuuauuuauuuuauguauuugaaugcaccauugcucucuucagacacaucaaaagagggcaucagaucccauuauagaugguuguaagccaccaugugguugcugggaauugaacucaggaccucuggaagagcagccagugcucuuaacugcugagccaucucuccagcccgauuacaaaguuuuuaagguucagacucuuagaaucuuuaauauauauaugcaugugcauauauauguuuauauguauauauauguauauguacauauauauguauacaugugcauuuuuuuaguucaaaaauauuuauuauuuauugugugugugugggcaugcauauaacagaacccuaguacggaaguuaagaguaaaaucugcaguaauuucuccuucuaccauguaauguagguuuuggguaacaaauuuaagguagaccuucgggcuugguggcaaaugcuuucacccauuuugcuauuuuaguggcccuuuuuuaacuuaggaauuuuguuuguuuugguuuugcaacaagaucuuaaacagcacuaguuuaguagcuucucucuaacuugcuagguagucaagucuggccuugaacuucuguguagggagguaguuacaaugcuuuaucaggaaucuguguuuacugacacugaagguccucacucuccauuaguuuuugaucuaucaauaaagaugccacuggccaaugguugggcagaaggaaagaggcgggauuuccagguucgcacaggcuaggagaaaggaggagaauggcaguacuugggggagagagacagaacagacugggagcuguagggaagaucagacugggagcuguagggaagaucagacugggagcuguagggaagaucuuccaaaacuguaggcaauaagggaaaacagcugaaaacaucuugggcagcaagaccaaugggcuucauagaagguaauugggcaacuaaguugagggaaaacuuagggguguugagcuaggagugaagguaaaacucuagccacagaaggcuuagaagaacccagccacagagccaauaagccagguuuaaaaugagcgugugugugugugugugugugugugugugugugugugugugugugugugugacuguguagacaaaacuacacacuacacgucugauccucuugugauuccuuaugcuuggccuucgauuuuucauuucauuucauuucauuucauuucauuucauuucuccucucucucucucucucucucucucucucucucucucucucucucuccucucucucucucucaaauugccagacaucaccaauggcuaacaacuguaauccuagcacugaguaugguaaacuaccccacaauaacccaggccgaccuggcgaauagaauggggaauguuggaaagauagcuagaugauuacagguaccuaguguucuugcaaaggaccugaauucauucauuuccccacacccacacuauaauuccacuucuaaggaaauuucacauggcuggucuucguggguaccuguauuuauuugcacacacacacacacucaauuuaaaauguggguugcgccaggugguggugcauaacuuuaguuccaucacuggggggcguggggggacaaaggcaguuggaucucugaguucaaggacagccagggcuguagagagaaaccuuguaucagaaaaacaacaaaaaauauaaauaaauaaaacaaacaaaaccacaaacaaauagacaaacaauaugagcuaggcaagaugguacuuaucuuuaaucccagcacucaggagguauaggcaaauagaucucugugaucucaggccaaccuggucuacauaaugaguucaaagucagacaagguaccauagugagacacuguuucaaaaaagcaaccaagcaagcaagcaaacaaaauaaaaauaaaaauaaaacaaggacugaaauguuaacucagagguuauacuugauacucuucagagagcuuggauucaacucccagcaccuaccuggcucaaguaggggaucugacacccucuuuuaacuucugagggcaccaagcaugcacaugugugcuggaagcauccauacacacaaauuuuaaaauggaaaauaagggcuggugugauggcucaguggcuaagagcacugacagcucuucugaagguccugaguucaaaucccagcaaccacgugguggcucccaaccaccuguaaugagaucugacacccucuucuggcgcgucugacgacagcuacaguguacuuauguauaauaauaaauaaaucuuuuuuuuaaaaaaggaaaauggaaaauaaguuggaaugaggggauaaaugugcaaauggcaagaugacuugguggucaguggugcuucccacacaagcaugcuaaccugaaguccauucuagaacugcaaagauggaaguuaguccucugcuccccacaugugcacauaaguauucaaacacacaucaugaucacacaugcauacuauaauaauacauuuaaauggauggacauagugggacaugccuuucaucccagcacucaggaugcaaaggcaggacgaucugaguucaaggcugcccuggucuacauagcaaguuccagcacauccaagacuacagagagagacccugucucaaaacgccaaaauaauauaucuuaauuuuuuagggggcuagaaccguagcuuagcaguuuaaagugcauauuacucuuguagaguuccugaguucaguucucagcauccauguugaguggcuuacaacuaucucuaacuccagcuccagcuccaggggaucugaugccuuccucuggacuccuuggggaccugcauucccaggugugcucucugucucucugucucugucucucugucucacacacacacacacacacacacacacacacacacacacacacauguguacccaccacauauacauggaauaaaauaaauauuuuaaaaaguuaaucaaaauagauuacucagagaugaagugcacucccugagcggucgcaaggaccacaguucagaucccaucacaugcaacugaguaucacaugcauaccuauaaccccaacuccaaggaaagugaagacaagaaaaccacuagggcuuagggcuugcaguccagccacgaagcacaagccucagggucagucagggaauaaugccucaaaagcaauagacaaagugauagaggaggacacuugauguucucuuuuggccucauagguauauacacacaaucaaucaaucaaucaaucaaucaaucaaacaaacaaucuuuuuggguuuuuuuuuuuuuuuuugagacaggguuucucuguguagcccuggauguccuggaacucacuuuguagaccaggcuggccucgaacuuagaaauccgccugccucugccuccccagcgcugggauuaaaggcgugcacuaccacgcccggcauacaaacaaucuuuuuaagagucaaaauaaauaaauaccuuaaaggagaagaauacaguucccaauucauguuccuuuggauggaauacuuuucucuguccuuacuuuacucuauuugcagagccuuugucuaucuugagcacaggugagaugguauaggagagaaaauaggaagagaaggaagggaggaagaggagggagggaggagggagggaggagaggugaagcagaugugguuauggcaagcagugaaggagguaguaaggaggcagaagugggccuucugauugauggagguucccuguuacagug

SEQ ID NO: 8662 - RNA, 3495 nt, Mus musculus
uaacuucuuccacugugaccagaagggagauuucccaugguaguagugguucuuuuuaagcaaagggaaaacuuuuuuuucucuauugagaaauuaucuuuuuuuuuuuuucuaauaaccacugagguaacuggcuguauucugaguuaauaugguuaucuagcuucauuaacaugcugcauuuccaucuuuucagggugugaacaacuucgugcaguacaaguuuagucacuugccaucgaaagagaggcagacaacgaucgagcuggccaagauguuucugaaccgcaucaacuacuggcaucuggaggcuccaucucagcggagacuacggucucccaaugaugacaucucuggauacaaggaaaacuacacaagguaacugaguucgaauccugcagccuggcuccaaagagaaccuuucaaggcaugaaauuacuauucacuucugcucugcucagugacuccauucacucagacagcaugccuaugcaguuuaguuucaaguucuaguuuuaauuaauuaauuaauuaauuaauaauguauuuauauuuauuugucucucugcccugccauguauguggggguuguagaaacaggcuuguagggaucggcucucucuaccaugugauacagagaaauguuacccaguccucagguuugguggcaagaaccauuauccacugagccaucuuacuagcccugaugauauuuuagauaaauuaaauuaaauaggguuaauuuaacuucuaguuuuuauuucuucaauguggcuacuaugugauuuacaacaucuacaggagccaagacacaugccuuuaaauccaacauuugagaggcagaagcaagcagaucucugaaaagaccagcuuagucuacuuuagugaguuccauauuauaugcucaaccaaugcuauauaauaagacacugucacaaagaaaaaaauguuagaacauggcuuauauuuuuucauuuaacuuuuugguuuuaauuuuaaugauuacaauaucauauaguauauugacaugaaggauaaauuagaaaacaauucugcauguucauuuuccaaaauauaaaggcuuacauucaucuucaguuaaguagcugugggaagaaauuuuaucucuuuccaugauauucauaccauguauggacuuguuugagagagggugcauguagcccggguauccuugaacucacuauauagcccaggugaauucugagauuacagguguguaccaccaauccugugcuuguagcucuuacuggagaaaauuauuguuucaucaagaaaaaaagggacaaaagagaaagaaagaaagaaagaaagaaagaaaggaaggaaggaaggaaggaaggaaggaagaaagaaggaaagaaggaaagaaggaaagaaggaaagaaggaaagaaggaaagaaggaaagaaggaaagaaggaaagaaggaaagaaaggaaggugaauaauuaaaaaaagaggugugugcauaccugugcucugaagaugcuaaaaguggaggcaggaugauugugaguuucaggccacagucuuuaagaggggguuuggagguuugagguagaauggaaggagaagaaagagaauuaaauguuaaagaaacacgagcgauauugccaaauuuuagaaaacaaagugaagcuggguguggugguguaugccuuuaaucaaagcacuugagaggcagaucucugaguuggggggcagccugaaugaguuuccggacagccagaacuauacagagaaacacugucugcaaaaaaaaaaccaaaaaccaaaaaacaaaaaacaaaaaacaaaaaacaaacaaacaaacaaaaaacccaacccaaaccaaccaaccaaccaaaccaaaccaaacccaaauaauuaguagagggaggcacuucggaacuaucaagaaaugguuggcacauaauagauacuuagagaguggcaaaaccagaaauugggcucucagugggcucagggcuugucucuggucccaccuuccucuaucugugugagcuguagagcagccuucucuuuccuuacucucagcuucuugcucuguggaguuguauccucugagaaguuugcacugcugucuggcauaaaccaguuacagggaagauuuuggguuuuguuuucaccugccucccccaccagugcuaucuagaacacagucugccaauguaggguugucaagacuaauggacaguugaacgagaguguugguauuugagugagacuuuugaagcugucauaguauaugauagaaacaggagaagaguccuuuggugcucagcuuccccccuggaccaaaaagguggagcuaaccaugagaagagaaaccugcccagagacaguggauaugucccuguauguccugggaccuguucauuucuagaccaagagacucuguuuauaauaggagggaaugaagguagaugcauucaccucagcguccuccaucaugcccuuugaugaaaggaaacagggagaagaacccagcaaaguugaggacaauuggggaaaaaaaaauaaaacaacaaacagaccauacuuacagaacacuauuaacguaaaaaugaggcaagugggauucucuguggugaauaaaggucugaagcuuuauuuauugaaaaaaguaaaaagcaaccugagauggcacaugucuauaaucuuagucccagggaugugaucccaggagggucaggacugcaaggccagacagcuacaggagaccccaccucaaaauacaaaauaaaugaaacggauuuaacagaauugcuuggcacucuuaugaguaaaagaaaagguguuuuaaguuuuacauuauuguuuagucaguugugguaguucauggaucuugguguuugaggcuagccugcucuacacagcuaguuccaggccagccagggcuacgaaaagagacccuaucucaaaaccaaccaaccaaccagccaaccaaccagauaauuaaaucuuuuauuaugauauucauaaaccauaauuuuuauagcagaaaugccaguuucuugauugucagauaccuauaaugcauuuuagacacaagcuagcacugcuuagauacagaugugaagcccagauaggggccacaugugcaaaauaguaccuacacuguaugaauauguauauauguauguauauauccauauaugucugucugucugucugucugucugucugucugucugucugucuaucuaucuaucuaucuaucuaucuaccuaccuaccuaccuaccuaccuaccuaccuaccuaccuaucuaucuaucuaucuaucuaucuaucuaucuaucuaucauccaucuauagagaggagugagcugagagaggaaaacagaaguaguguaguguuuuaagacuaugaaucugggaagauugcucagugauuuacugcacacacugcucuugcaggggacugguguuugguucccagcacucauauuagguggcucauaaccaccugug

SEQ ID NO: 8663 - RNA, 14550 nt, Mus musculus
cuaugucucaaaagaggucauuaagucugguuuauuuauaucauauuauacaaccacagaaauaacuauaucuaucaaccagggaagucucaaacucuuaagucaauuauaaacauaaauaauacaauacauauuuuauaaaaauacauguuucauaaaaauguugacacaaaccccuuaauagcccaugaguaaacacuacagcaagaauaaagaaagaugaagaagacuaaaggccuaauaccagcuuuaagauaagugacuggcauggagugagugagcgucaccaugacacuagacaugcugaccuacgaaguagccauuuaaaugucuauagcaggaaguggauuuuuguuuguuugguuuuugagauccguaguaccugacucagccucuauauugcugaaauuacauguaugcaacauaucagccuuuggaaagcuuuuuugacaaaaggggagaaaauaaauaucugagguucugcaagccaaguagcaaaauuuaauccaaauauuuucuacuuuauguuaacuacagaaaaaguaaauuuagcuuguccaaaacagauagggccuuucucuauguaggcuguacuaugguaaucaccgcuacaugcagcuaacugggcugaaacuagacuuuuaacugcauuuauauuuagcuaaaauggauacuuucaagauaccaugacauuagaaaaugauaaauggaguggcugaggauugcugugacuacuccuaccacacacagaguuguggguccaauccucagagcuguaaacaguggcuaaaaauguaaggcugugaugggcgagaggggugcacgugagugacagagccacacuuucaguuugaugguaaauguaggaagccaugcaguuguggguaaaaucugagaugaccaccagaaggcccuucugauagcuuaaaaucuccuguuugagugguauuuaucuaucccugggccuugcccauaggagacaaacguucuuccgauuuaaugaaaauugaaaugccuugauguuggcccuggaggcuucaguugggaaaacuugacaggacaaaucuaaugggaagaaaaggggaaccagggaagacagaagagguuccagcuaaguugggagugguaaaggccagaaaggaagauaaucaagaguaacugaccauuaagagcaaaaggaaaacacaaugcggucaccauaggcuucaccuuuaacaauggaccaguuacaacgauuuaaguuugaagacauacauacacacauaaagauucaauguucugaacuggauacuuuuauuuuguucacauaucaaagccagaagccccuuuauucacaccuuuauuuacacuguagacugaccacacaaagggcuagccugagguccacgacagugcuauuauucugcugagcaauagcauaguacucacaguucacaacaguuaccuuguuccagaacccaauucauuaauucucuuaaucaccauucgauacacaguuuacagaaagaaucaaugacagaagggauccucacccacuuaugucuuacugugaugguaaggauuuaugaaagaucuacauccuauguaaguuuucuacgaugcaaguuuuguacucugcaauucuccugcuuaaggaaaaaauaaggaugcuggagaaguuuuagauguugguaauauaauaguccauacaaaguauauguccaagagacccuccugaucagagccugguagagguucugcccauugugcacugucuaauaauauuuuauuagguaaaaaagaaggaucaccuuaaacaguagcuaaucaaaugaguuacuguguuugcuugguucuucuuuuaggacaucucauaccccuuuucugcuugaaaauaggagaauucaagaaacacaaguccgugaaaggguccccucuucuuagcuuucuguaaguaaagagagagaaaagagagugagggagggagggagacauugagauuacaugacuacaaauauacgaguuugaagucagcacaggauuaugcuaacauuaugccagucuuaggcucaaguaugauacacucaugucuucaguucucccgcgagagucaucacagcugaguccacacaacaauacucacgaagcgaguguuggcucuuuauagcuuuugauggugcuacaccugcguuuagucagagccacugcugggcugucuucacgccgcuuuggaggcagagaaggcuuccugaucuucacucuaggacacugcaggauauuggugacauccuuuaggcuacaacgaggugacucuugagucucaggugggauaccuaugauacaguauuuauugaauauggaccaguggauaaaaaccacagaaauaaaacugugcuaaguuaccuauuguaaacacaaaacauaucuggcacuucauaaucagugauuaaaaaucuuuuuauugccuuuucuuccuuucaauccagauaauguagaaacuaugacaggcaaaaagaagugcuagcuacaacagaauguuuuacuaaaacucagcauucuuccccaaaagcuuaaaugcuaugaguugguuuaaggcgggacacugcauuuuagucacuuuaauacuuagaaucauuaaggcaccagucucauucaacaccaaaguuuguaacacuguugaaggcgcacugaccacaaagguccuucaauucauuccauuaaacacacaagaacucucaaucaguccgugaagaccaggauaaaauguguuccuauuggugcuaguuaacaagauucagaugucucucccaccauaaacaucaaguuccuuccaucucugagaucuagguagcucucccacaauaaccauccagccagguuccucuaucccugauaaccuugauaaacuaaauuauaacugugagaugacuugaagcuacgcagccacagucuacagaauaucuagguuucagucuguccucuuaaccccaucaauauauucaauuccaauauuaauugcauagagcaccuccaaacaucaggauuagaccagcugcuguauucuagaauaaagcuucacaaauuuaaguauuuauaaccacaggcaaaguucuaacaaauucuaauucaagagauaggauagaaccagaugguuguuuucuggucaugcuagaagucuggggucaaacuacuccaguguuuauuuuguucuuuucaaaacuucuuauuuucaaaagaacacaaaaaaauaacaguaauucacugaaagccuguguuacucaacgucaauaguuaucaaguuugccgauuugguucaacucuaucaucagacuaucuuuaccuaagguagagcaaacagauuuauuaaggaaaagagaaacagcuacggaaaguggaaagaauacucaugauauauuguuuaaaaacggaaucuugcaagcuucacugcucagcuguuccgcuaggaaaguuucacuguucaaguuuuaauaucuggguuaaacaaacugagcaggcugacugagcuguuucaaugggacaacauuuuggagaugauaggaccugauagcacggggcuauugccacaggaaucccaacucccagagucuuugugaguaggugcgggcugaugacuaacacugauccacuuugauaauagaaaaggaagaguuucucagccaaaguuuucagcacagaugagacaagaacucuuugcucucauaagcucaccaacaacuagaaaaacaaguuaugcuuccuauuaaauuaaauauaugucuauuaaaaugagguuuuuuuuaaaaauuuuuucaugaguguaaagguuuuuuuuaauucaaaccaaccacagcaaccuugucacacuacucagaagucuccuuaguugauaagaauccaguuugugggaaguaauacuccuguaagauucauguuuguuugaacuacuucaacaacacagccgcauuuccauuuuccgccuccuacuauuuaaucaggcuguaacuuccccuacagagagacagaugggaagucucuaaccuccuccagaguaacagaugguagguacaguaucuaagauuacauccgcaucagggcaaccauuuagcagaaacauuggaaacacaggcaaaaaagcacacugcuuaccaguaggagcuguagauggcagcaccuccuuccucucuuucccaucuggguacugaaguccucuuuuagaccgaggccugguaacugcucucucugacucucuguagucucgcaagcgcuuggagggaggcagguagaggucaucagacucauccucagagguacugcauucgaggucacucacuucugaguugcugcuauccguuucuuuguugcagccauuguucauuuuuugucggaaaggggugggguggaccgucccuuuuagauuaaaaucguaagcaucacaggaaccaauaccuccauccaguguaguaggggguaaacccugcuuaucuuuguuuuuguuccccuuacuccucaaugaggauuuugauuugcaucucugcuugguucuucuuugcucugcucuucuuuuucgugcacguuuaugcuugcuuucuauuuguucagguuuagaugauaaaaugacuucuguuucaguaaucuuugcuggguuaaucagucuagaacauaagcuaauuuggucuuuguuccacagacaaacauuuucaagucugugcaggguuacgguuacuucucuacaucuacuuccuuuaacuuccagagacugugccacucuuggacuggcuuuacaauccuccaaagucguggaguggcuuauauuacuaaaaucuuuccuuaaauggcgacggauagauauaguucuggguaagacuucaucaguagacucaacuuuaccugaaucaaaaucgcaacccugugucucuggaguaacagcaggacuugguucugaccauuuaaaaaacaaaugagaaaaacaguguuaugcuucagaaaucugcauuccaagaauauuagaauucaaaguugcagcaguuauucaauaguuucucuguacuuccuauacacaaauaaagaccuggacagcucaacaccuauuuacuccucauugaacaacagacagcuuacaucagcacuuaaaaauacuguuggaaugaaaagcccagauguguguagcucauacuuggaagacagaugcagcucaagugagguccagcuugugcuacacagcucuaggacugccugggccacagaaugagacacugugucaaaauaaaacaagaauuuaagucuggugccagccuuuaauaccaacauuuagaaggccgaggaucacuuuugaguucauugucagauguacauagugagacccugucucaaaagaacaaaacaauacccccaacauaagcaaauauauacucauuaaguauacauuuuaagagggguuuuuaugugcuucuuguuccaagguuuaaagaaaaagccuuucuguuuaaucugugaacacagaggaaaacuucaaaagucugaaguaggaaaauauacagaagcuaaauuaguuuuucaaagugacuaagauuugaauaauugcuaauuaggccuuucagauaaauauaaucuguauuuauaggaacagcaggguuuucaucugacuuagcuuauucaaauuucauccaugcuguguaccacuuaguacaaagugguauccucuccauuccuucuggucagaugucuuauuuucccugaggcuacagaaaguagauuauauuucuagacuacaacaggguuaacuaagucaauuuauguaaaaugcuucagcaggaagcaguugguuacagcuacagauacaaccacaauuucuucuuguagacuggguacaaucaaucgaugugcugguguuguuuguuuuucacgacagggucucaacuguguacucagaaggccuagaacucuuaagccuacuguugcccugugcuagcuagcuuuaugucaguuugacacaagcuucugagaggaggaagcuacaacuaaaaaaacgccuccguaagauccagggaaggugagagugugggguguuuucuuaauuagugauugauguggaaggacccaguccauugugaguggugucaugcuggggcuggugguccuggguucuuuaagaaagcaggcugagcaagcuaugaggagcaagcuaguaagcaucauuccuccaguaucucugaccucuagguuccugccauguuugaguuccugaauuuaugaacuauauggaacuacgagugggacacaacaacaaaaccuuuacuggauugcuuuuggucauggcauuucaucauggggacaguaacuaagacacucacccuccugagugcugcgauugccggugaccuaugccuuauaucagucuacguaagauaaaguuacuuugaacagaauaacagacaaauagacuuaaaagauaaaaagaagcugggugugguggcgcacaccuuuuaucccagcacucugggaggcagagacagguggauuucugaguucaaggccagccuggucuacaaagugagccagagcuauacagaggaacccugucucgaaaaacaaaacaaaaaaugauaaaaagauagaaaaugaaaugaaauuagguugcuuguccacaaugaucaauauuuuuagauuuucuaccugacguaccugugguuugguaaggacaaucaguuucuucaacagcaauuugccuuaaagaauaacaaugaaaaacaaaaauaucagcaauuaugucaaaagaaauuugaaauuuucccaggcuauaaguuugcuacuguaucauuucaaaauucuaguccaaauccccacacacugauguugcuuacaugaggccugauauacuuuuucuuucucaacuaguauuaacucucacugaaagaaacaaaucaagguagauaguuuguucugaaaacgugacauaauccaaucucccaucacaguaggaacagucacucaguccuucagaacccggcgucccuaguggggcucucaugugguauaugcuuuaauguugucaacuagagcugcuucuccuuuauuuucuucaaaacuuccacucauuuuugcuucaugaaccaaguuuucuuccacuuaaaaccuguaacugauaauuuguaauuuuauucuuuguaaaaaauuuacacuuuauguuauaaaaauuaaaauauagguuugguaauaaaguagaggguacuaauuaucuugaaaucuaauaaaaaucugauuaccuuguuucaucuaacuucauuagucagaucuuaaaaccaacaguuugaaaaggacuaaagcuucauagugaccuguggggcuagaaaugguacuauggcuucuucuguaagaaagagauuuuaacagggcuaacaacaacugucuauggcacucacucuugggacuaucugccaagaucuggaaacacugucuguccuaacagcucaggagggaguggcuccuggcacagugguacaggccaaggggccacacacccugcgacgugcacagcaugugggcaaccccagcuccguggcagcaccaccaaggcugaggucuacgaagaaugaagccauaugcuguagcuuuccaaguuuuuugguuucaagucaagguuuagccauguagcccaggcuaucuuugaauguccuguaucagucucuuaaacacugggauuacaacucaguuugauguucuguauuuuaucuaaaguuuuggaucuauagcuauacuuguuagucaaacucacuaaguggucuaauuaaaggcuggauauuucauacuggcaaagagaaaaauaaguuuucuccaaucaaguuucucuagguauauuaauuaacuacacuccagcgcaggcuccacacccgggagugguggcaagcacagaacagacucagucuauuuuuuauuuuuguuuugguuauuuuuuuuaauuggucuuuugccuguuuguucugauuuucauuuuuguguuucuuguuuucuuuuuuuuucccucucucuugagagaaugaccauaauguugguugggcagagaggaucuaggaguuuggggagggguaaaagaucaaaauacauugcuugaaaaaaaauguuugaucaaaagagauggauauuuucauauacauauaauuaagccuccacaguucaugaaagaacauuaaaaaaaaaaaaaaaaaaguaaaagccgggcagugguggcgcacgccuuuuaucccagcacucaggaggcagaggcagguggauuucugaguucgaugccagccugguuaacaaagugaguuccaggacagccagggcuacacagagaaacccugucucgaaaaaccaaaaaagcaaaaacaaaccaaaagaaagaacauaaaaucuauacaaucaaagagaagagaucagcaugugaaucuggaaaaacagaacuaauuaaugagagguguuuugcuuuauuuucuuccugcuaaauuggacaguguuuagaacuggaaaaauauccuuuuuaauaaugacuccuuccuaaaaugaaaauaugacacacauaaaaacuagacugaaagaaaacaguuaaaagaaaguuucuaacucuuagucauuaaagcaacuaaacaaaagaaaaagacagcucuaauuuucuauauacaauaguauuugaguaucaaauucucuuacuuauacucccaguaggaaaagccucaaacuguggacacaaauaaugucaauuuccuuuaacaaauggaucaguguuauagaaacaauaaugaacuuggcacucacuguaaggacuucccugacaagucccuggucguauugucaaugcuggagaccacgucugagggacguccuuuccaguucuguuaauauauuaaaacaaaaacacaaguauguacugcuaugagguaugcauaugcacucugcauuauuaauguauuguugaaugaacaaauacauuugcugacagucuacagcacugccauguaguuucaggaacuaggauuccaacagcugaaacaccacacacacucugccucuuaaagcuuacauuuuaguguauaaagagaaaauuuaaaaaacgauuuugcaggguaggucacagguaaagucagcugacaugcaagccucgugacgaguuggaucuguggaacccagcguggaaggaaacaacacccagaagugucuucugacguucacaugcacacugaggcacuugugccucuccucccaaugaaaaaaaaagacacgucugaguuuuacacagugaaaagugcuaugaaggcaacacaagaacgaauugagagcaacuaaagucgagcgcucuaugacacagggaugcugaccuaaaguagaagaacuagucagcuguuggacgagcaggaggaagagaaagcagggaaaacagcaaacgcagaaguugugaaucaggacaaguccugauaagaacauaggccaaugugacuaaaacacagaaacugagaacagcgggaggugugcaccuacuagccagcuagcaaaggggccuaauaggaagguuagucuaagugugauggaaacucauuuaaauacuaaguaaggcaguaaaaugaucagcuuugaaaagaucacucuggcccauaugaagcaugacucaaaagggacccugaguggaaaggguuaagagaucaucguagcaaaugaagauaggagacuggguaggucuggagcugggguucuagugguaaagccugugggauggcuccacuaauaaaacauguagaacccgaggggucuguggcuuauucauaguuaagcgagcugccaaggaguuucugccaaggguuccaucauucucaacauugaguagacgagaauacuaggaaaagaggaguccaaccacgugcaaggauugaauguggauggggugaugguuagagugagcaggcuacuucacugagauguguagcaguuauggaggaagaacugggcacagcuuaaucuuagcacucugcugcugaggcaggaagaaaaucaguguaaggcuagcugggcuucagaccgaguucugggcuugcccaggcgacaaagagagaccaugcuucaauaacagccaaccaaacagggagaaaggccgaagugcacagcauaaaaaagcugacaacacagaagaccuguuagucuucuaacagcaggaauguagaaagagaaugcagggcacaucugguggcaagaaaauuaauggaucaauacuuuuaagaagagagacugaauaucucuacaagguuaagaaacaagggcaagccaaauggcagcacacaaguuuuggugaucuugacacagcaacagagcacaugguuuaaaugagauaggguuuuacuauacagaccuggccagccuaaaauuaaacucccuauguagaccaggcuggggugggcccuuacagagaucugaaugccuguuucuccagcgcagguauuaaagcuaugaacaccaugcuugguccccuuuuuuuaauuuccccauuuuucuuuuugaaguucuguugugagggagaaacaaagaaaaaaaaaaaaaaaccaaacagaugaaaaccugaccaagagugguuucaccuugaaggccagaguuucuacagacacuacaccucuuaacuauaauauaaauauaucacauauaaaauauaaagauuuacuauaaaacauaggaacuacuagaaaaugguaguacaaaagaaacaugcuuuuaaaacuucucuucuuuguguauacauuuuuaaaacauuauuuacuuauuuggggggaggcacgaggaagcaugcauagagaucagaggacagcuucuuuugguggggggagagggucaguucucuuuccagcacggcgagucccaaugacuggacucagcucaucaggauuguaucaaccggcggcaaacccaaugaugucuuuggcuccaaaucuucacuuuucuuccacaauuacuuuugcagugcugaggacgaaugaacucaggaccuuguacauucuaaacaaguauuccacuucugagcuacagacucagcccaagaaaaccuuacacuaaaauaucucaaccugcgcauggcagcacuuagauggcugaggcaggaagacuuuggggccagucuggucuacacagugagcuugagaccagccuggucgacauauugagaucuugucagaaacaaacaaagaaacaacgcuaagcucucuacuacugaaaaaccaaccuugcgcacugaaguacagguacaggauggcucacaagugaucacaugcaugugugacagagaaacaagcaaagcaccugauauuaaaugcuaaguacauaucagcaacuaacuaguaacaauacacuuaacggaaagucaucaauagauggcaucgaaggcgcgagaauaauagaauuuuucccccuacuguuuugaggcuuaugucauuaaguagucacugaacacugguucuucuaauuucagcaaaaacucugcgaaguaggggcuggagguauguauggcucagcaguuaagagugugaacagcucuuugggagaacccaagucugguuuccagcaccuauuucaaguggcucaaaaugccuguaacuccacuccgaugaggauccaaugucucuggcuuccaugugcacacacacucacauacauauacuugcacauacucacauacauauauucacaccacucacacacacacacacacacacacacacacacacacacacacacaauuaaaaaggaauuguuuaaaaacuggaaaaccaugggggagauucagaaaccauuagguuuacacuguacuaacugaaaaaggaggaaaaaagauuaaguguugaaggaaaacaaucuuuaaaaaguaauugaaaucuuagagaaaagucaugaaaucauauguaggcuucaaaaaucucuucuagagaugaggucucauugugcaguucagguugacccauaacuugggucuuucugaguuagcauauugaguucuggcaucacaaaaucgcagguauacaugacacucaggaagaaauagcaccuucuagaaagacaacugucuucgauaacgucaauauacacauuauaugugagggcacauauauguauguuacuuauuucuauauaacaccuaauguuauccucugaacuacacacagacacacacacagaguaaauggauauaaugaaguauuuuuuuaaaaagugacucuccgaagaauacuuaagaauauuuuccauaucuaaaucuauauaaagcugaacugcauauggcaaaacuacacagaaaaguuuuguacugaauauaccugaguaguuucuucacuuugucgggaaguuagcuucucuuucaaugcauacagcugacaaguaagguaguagcauucuuuucucaguugcaggaugacauccugugcuucucucacuuuggauuucucauuuuccaaagccaagacuaacaaccuguuguuaucuugguaauaucucaguaguguagcaguguuagcuauaagauaaaauuuucaguuaguaagccucaaccuagaaggugaagcagaggcuagagauaucucucaauggcuaggagugcuugcuaagaaaccaaugaggcccacaggucaaauccccuaaagagccaggugugguccugcacacuggugacucuaucugcuguggcaggacggagggaagguaagguguuaaagguguguggagacaggaggaucucuggggcuugacuggcugccacaauaguuccuuguucagugagagacccuuugcaggggaacagggcagagauuaauagcaggacuccagaacuucuacuacagcaacaccccacugugcuccacacacaaagaaacacacacaacacacacaaaugccacacuuucaaaguaagaaugcuggaagaagacaacacaaaauucucuuacuggguacuuggcccggugcaacaauaaaggacuugcguuucccaauccccgccaaauuuuuauuccuuuuuucuuucauucgauucuuaaugucuucaaggguaucuugaaaggaccuuuucugacaccuuuccuuagccaucuuugucuuugaauuaaaaacaaaacaaaaaaaaaaaaaaccaaugaacacuucucagauauuuuuuaaacauaaaauuuaagaaacauaggcuguucaucaagaagggauuacaaaagacuaaauuguaaacuuacuucaaaaaaagcaauauuuugauuuucugcuuagaaauauuaagucagguguuguagaauaauccaagcuacuaaaaaggcuaaggcaggugggucauagauuuaugcuugggcuacauagugaaauucaucuaaaacaaaacaagaagaaaaaagauguuagaaucaagccaucauaagaaaaaaaaucccauaaaaugucauucaugcuuuugcuauaaccuuaucuucuacuauuucauaggaaaguauuaaauaacuccagaaaguaucaauuauucaucuuauaguaaauauucauuggaggcguacaacauucuaggcucuaugggaacuuauuauuuugggacaggauauugcuguuacccagucugguuuugaacuuaagagcucucauguccuuccuaccucagccuccugaguagcugggaccacaaauguaugagccauaagcagacuuacuuuucuuacaauguuuauagccaaccuuuaguguuuaggauuacaguauuaguucagaagcaauuuauauguauaucuggguuucuguuuggcagcuuuucucuaguaauuuuggggcugagaaaacauguauucauguuaauaacaguagcgugcuucaagcaaaauaaacuuccuggucucaaaauuguaaacuguugccaaccacaaugugugcauauaauugucaccacaagaacuaucuugauucaucuccuuuuaguuaaguguuuucuugaaucucuucuugaguauucucaccaggacguauuuuccuccacgcauaaugaagccuuaaauugguacuguauaucuuaucuaacccuuuauuuuuaccaauguguauauacgauagauuggagaggggaguucaacagaauaaaugcaacgacuucuuauaagaaugggugggucaccaucaaguuuuaaaaguuugcaccggagacaucugagugacacacagaaugaauaacugauagaguuaaaguuaauuacaguuuguucgcgugcgcgagcacagugggauggaaaucgggccuugugcgugcuagacagugcaagucggcgagaacaccccuuccuccggccccuaucuaaaaaguuuuugcuacuuugauugagcaaaagcccugucgauuucggggugcucgcuuucgcgagcggaacgcgucguccggucggagagauaccuccagucccgccgcccguaccgcuccguaccucggccacucagguccggacgagcagaugcaaccucccgcuccgccgcgcuccgcagcuaccgccgccacauucgaaauucugcguuacgcguauccauuggcuggccggacaccaucacgug

SEQ ID NO: 8664 - RNA, 890 nt, Mus musculus
uggcuugugaauagcagguaaaucuaucuaagcaccuuucuccuucuauuguauaccuugagacauuucacccuccuacacauaaauuagauauagaagauugguauuguuaguuaucuuuaaaguggacaacuugccauuaacuaugaaauuugaagacuccgauacauaauccucaaaccagucuucuaccugaugugauugcaaauauuucgucuugucauauuccugacucuccuuacucuuuuuuuuuuuuuuaagauacuaugugcuuuuaauagcucaucgcugggaacauuucauaaucaagagcaaguuaauaggcuagcauuuaaaaauguagacuuuaauaaguguacagggcagcuuguggggcagcugaccgagauacacaguguaggagauacaagugaccaccuggaguuucuguacuucauucugcucacagaauauuuauuaagguuguuuaauauaugacuuuucauuugacauuguggaaguccuuuauuguaaagcuaacccuucugucuggugacaagcagcagccacgacggucacucuggacccccacgcuggauaaauuccauuuccucuugagacauagguuuccuucuguauuucugagguaaugauuuuauaauuucugcagugucugguggccccuggugcaucaguaaaucgggggacguacuuccuuuagaaugcugugaaauugcagaggagugggaggggagcacugcagaccccaaagcuucugaggcacugaguuuagguuugucucuucugugagggaacuuuauuaauggagcguguggcuucacuaccugcacgacccugguggcggaagccaucuugcugcccaucgugacccccgagcaggggccucuccu

SEQ ID NO: 8665 - RNA, 813 nt, Mus musculus
gaugggagacaagccaauuugggagcagacuggauccagcuuuauucagcauuacuaccaguuauuugauaacgacagaacccaacuaggcgcaauuuauauugaugcaucauugccuuacaugggaaggacagcaguuccaggggaaagcugccauuguggagaagccuuccguucgagaaaauucagcauagcaucacggcgcaggaccaccagccuacaccagauagcuauaucaccagcaugguugugggcgagcucuaggcugaggaagaucccaucauggguuuccaccagauguuucuauuaaagaacaucaacgaugcuuggguuugcaccaaugacauguucaggcuugcccugcacaacuucggcugaccuccuccuggccagauagucacgcuguuucccccucccucuccccaguccuagcucacuccuccagaugcuccaaauaucauacacaaaggagcagggccgaggcaggagcgggugcagggcgcuucugucaccacgguguugugcaugauguuuggaugcuagacuagucgcaccugacaagaaguuuguguuguaccagagcaugccuuguaaagacuuaaguaaugcaaacaauugucggguuuucuuuuuguuuuauuuuguuuuguuuuuuaaucuacugacaaguugcucuaguaacccaaagaagugaaggagaaagcagcuaccucaccaaccgcccagauauugauuuguucagauguuucaaugccucaugauacaauaaaaccacaaaauuguucuuaacaguuuaaaaaaaaagaaaaagaa

SEQ ID NO: 8666 - RNA, 1020 nt, Mus musculus
aaugguuucaagacaaccagaagugcuugcucuugcucccagugggccucuaggcaagaugucccugcccaucgggaugugccaccgggcauuuagcuaugaugaugaugcccuagaggacccugcacccaugacuccuccuccaucagacauuugcagcauccccuggaagccaguaauuacagaaugcaaguaucaacaucuugacaagacagaggaaggaacagccagugucucuuuccuugcugugacuccaucaccagcuacugacaguucagacaaagcccuucuggugaaggcuaaagcuacccaugucaucaaugaauucccugauggaaaaacagacccaagagagcauguaguguuuugaacaacaggcaggacugagaguugcuagcuacacaccccauaagggccuuaccacagaggagaccaaguaccuuugaguggcagaagcacuccguaaacuaaagcugcagaguggagagacagcaaaagaagagaagcgcccugcaucagcccaguccaccccgagcagcaucccucacucguccccuaagcagaaguccaggggcugguucccaucuggcuccuccacagccuuaccugaucugaauaucauagaucuugggaguggaaaugauaggaauucagcagacaaauggagcaucuuuagaccaugaccccugcagaaaucugauucugguuuugcuauucagguuuacaaaggugcccccaaacccucuccuauggaggugaugcauacccaggccacacgaguaggugaagauccagcaaccuuuaagccgccaaagauggaugucccaaugguagaaggaaagaaacaaccacuucgaacccauaaucucaaaccccgugaccugaaugugcucacacccacuggcuucuagaaugcucuguccagggucugcaacuucccugggcucugacauaggagugaugugacuaacugaggccugagugagugugcagauuguccuuuggugagugagaaaaaac

SEQ ID NO: 8667 - RNA, 4425 nt, Mus musculus
cagccggaaggaaagcugcucagugacuucucccuuuuggggcccuccuucuaccucaaggccuuuccccacacauacacacagcagcuggugacagaaucaggguucccgucaccaucaucaucuccugccccauacacuggacaacugagccacacugggcagguccuucccuggggccagguucccugugugaguccccuguccuucacccucucucugaugggucacuaacucggauccaaggaacagagccacagagcauguccaagcugcucuuccugucacuugcccucugggccagccgcuccccugguuacacugaaacagguaggugaccacagggggacuggggcaccugggcggagggaacuaguccuucccuuucaguuuaaggucauaucuaccaucagcugggaacucacaccuauacccguuggaccuguucuccuucuacuacagggauggggaaacugaggcaugaagccucaaaaccucauuuauccaggcagaggcacccuugaacuuagacauuuguggagcuagacaguugacucucagaaacccgaaaccugaagccucaccuuugugacucagcagcuguaaaagaaaagaaaacgaaaaagaaauguagacaauacuggguauaguggggcacaccugccaugaagcucucaggaguucagggucauccacagucacauaggaggaagccaaguaucaagagauuccaauguccugauccacucaggguaggaggcagccuaggccccuugggaaccugcuucuaaagcaacagaacaagugugggguguggguagucuagggaguucuucagaauccacaguucaaggccagccuaggcuaugugagacccuccagaaggaggaagaggaggaggaagaaggaagaggagggagauggaggagaaggagaaaggagagaagggaaauuagaaaaaaagaagaaaaaaaaaaaaaaaccucaggccaggcagugguggcacacgccuuuaaucccagcacuuaggaggcagaggcagguggauuucugaguuccaggccagccuggucuacagagugaauuccaggacagucagggcuacacagagaaacccugucucgaaaaaccaaaaaaaaaaaaaaacaaaaaaacaaaaaaaccucaguuuucucaucuagaaauugagcuaagaaccuugggguuuguaguaaguauaggagcucaugcuuccaugcauaacagguccuacauggccuacggaagcuccuguuccuuugucuccuccagcucucguggcucuaagccagcccagagugcaaugccaugcuucucgguaucccguggccguggacugcuccuggacuccucuccaggcucccaacuccaccagauccacguccuucauugccacuuacaggucagaaaauggaaaggguuuaggaggaagccaaguaucaagagauuccaauguccugauccacucaggguaggaggcagccuaggccccuugggaaccugcuucuaaagcaacagaacaagugugggguguggguauucuagggaguucuucagaauccacaguccccaagucccccugagcauaucacccccugagcgugacccacagucagcugugggugagcuggggccucacgggcacccagguuccuuucgagauucaccauggugcuucccaugcaggcucgguguggccacccagcagcagagccagcccugccuacaacggagcccccaggccucccgaugcaccauccccgacgugcaccuguucuccacggugcccuacaugcuaaaugucacugcagugcacccaggcggcgccagcagcagccuccuagccuuuguggcugagcgaaucagugagugucuguccucccugccccucuccaccugcuccaucccguggcuccucccugccgccgccccccuacccccacccaccucuugcuuugucccugcagcuuccauccuuuggcucugcucccgccucacaggcuuccugucgaugccccggggccuuugcauugcuuccuuccuuggcuuuccugggucucugcuccaauguuggcuccucagugaggccuccccaaaaguauaucauuaaacauaagcaauagucacaguuaagagaggaugaaagccaaaggugguguacaagucuuuaaucccagagguaggcagaucucugagaauucaaggccagccugaucuacagaucauguucaaugcaagccagggucacuccugagcaccugucucagaaaagaaagccaagaacaaaagcugaugcaggucggugaaaggcuacacagcucucgaggguuuaaaccugaagucucgacaugaucgcccaacuccaauccuaaggaucugcucaacagcaauaaagcuguuccucccuaccaauccuuggcaacaucauugcuggcauccagaaggccagugccccgugcguucccauggagcgaugggcacccagugcuuaucuagcguuacucagcccuaacaaagagagaguggggcucuggcaccaacagcuguggcgggaccuugaggacacuacgcucagugagcaacccagacucaacccacccagugugggcugcaguacagaggagucuagagacaggaagccugagugcugaggacagagaaggguaggaagauggcuuguguugucaugaaggaguguuccauaaguagguggaguaaugaaaacgcucucugcagaugcacgggaugucuucuagcagagacuugugcucucagaauuguaucucagaaaagcccuucagccuacuggagacuugcacuuuucuuugccugugcaacccuugugacuucuaucagcagugaugagagcgguccagcaaaugguuuuuccuugagcagauagacgaaugaaggaauaaaugaaugccugcaugacagauaucaaguggaugagugaaugauuuaguaaugaaugaaugcauaaugagugaaugaaggcagaaaugacaugagugcaugcacacgaaugacuuaaugaaugaacgaaugaaugcaugaaugacuuagugaaugagugaauaaaugcacaacugacauaaugaaugcauaaugaauacaugaaggccaugaguaaaugaaugaaugacaugagugagugcaugaacgaaugaaugacucaauuagggagugaaugaaugaauucacaaaggauacagugaaugaccuaaugacugggaaauggaucccugaacgaaugaguguauaaacgauaagcgcaaaugaaugaguuaaugaauccagaaacaaaucugcacuugaaucaaccaauaaauaaaugugugagugagauggugaguaacugaguagaggaaugaauuagugaagaauuuagugaauacgugaacgaaugaagugugaguaugaaugaacggcaggacggagcaaauccaugaauagcugucugagggcgaaagcgaacaugugaaugaaugagagucacaaacgaagacuuagugugugagggaugaaccggcagagcggacgcugaccccgguccugcucccaccagucaagccggacccuccggaaggcgugcgccugcgcacagcgggacagcgccugcaggugcucuggcaucccccugcuuccuggcccuucccggacaucuucucucucaaguaccgacuccgcuaccggcgccgaggagccucucacuuccgccaggugagcugcgcgcgcaggggggcguggucuggaagaaggaggagcacagagguggaugcugagugagacugggucccacuggguaaucuccugucuccgccuaucgccucuguuggagcguagagauuguuggugugauucagcaauagacuuuaccugcuugcugggaauucgaacucacugcaagcucuuuacccaccaagccagcuccccagcuccccaaugcauugugguccuucccaccuccuccuuccaauggccugacaccccuucuccccacaggugggacccauugaagccacgacuuucacccucaggaacucgaaaccccaugccaaguauugcauccaggugucagcucaggaccucacagauuaugggaaaccaagugacuggagccucccugggcaaguagaaagugcaccccauaagcccugaagagggacuggauccuugauaucagacccugaugucgucuacuugaggguggcaggguggccuguccugagucugaauacugacuuuccauguacugggcugcuccgaagcacuggauaauucacuugacuucuucagaccucaauuuccaacccugugggaugaucuuucuucuucugccggugcggggcuuugugaacuuugugauuuaauuagaaagacggauuaaauaagaaucaucaucau

SEQ ID NO: 8668 - RNA, 4633 nt, Mus musculus
ugguguacaagucuuuaaucccagagguaggcagaucucugagaauucaaggccagccugaucuacagaucauguucaaugcaagccagggucacuccugagcaccugucucagaaaagaaagccaagaacaaaagcugaugcaggucggugaaaggcuacacagcucucgaggguuuaaaccugaagucucgacaugaucgcccaacuccaauccuaaggaucugcucaacagcaauaaagcuguuccucccuaccaauccuuggcaacaucauugcuggcauccagaaggccagugccccgugcguucccauggagcgaugggcacccagugcuuaucuagcguuacucagcccuaacaaagagagaguggggcucuggcaccaacagcuguggcgggaccuugaggacacuacgcucagugagcaacccagacucaacccacccagugugggcugcaguacagaggagucuagagacaggaagccugagugcugaggacagagaaggguaggaagauggcuuguguugucaugaaggaguguuccauaaguagguggaguaaugaaaacgcucucugcagaugcacgggaugucuucuagcagagacuugugcucucagaauuguaucucagaaaagcccuucagccuacuggagacuugcacuuuucuuugccugugcaacccuugugacuucuaucagcagugaugagagcgguccagcaaaugguuuuuccuugagcagauagacgaaugaaggaauaaaugaaugccugcaugacagauaucaaguggaugagugaaugauuuaguaaugaaugaaugcauaaugagugaaugaaggcagaaaugacaugagugcaugcacacgaaugacuuaaugaaugaacgaaugaaugcaugaaugacuuagugaaugagugaauaaaugcacaacugacauaaugaaugcauaaugaauacaugaaggccaugaguaaaugaaugaaugacaugagugagugcaugaacgaaugaaugacucaauuagggagugaaugaaugaauucacaaaggauacagugaaugaccuaaugacugggaaauggaucccugaacgaaugaguguauaaacgauaagcgcaaaugaaugaguuaaugaauccagaaacaaaucugcacuugaaucaaccaauaaauaaaugugugagugagauggugaguaacugaguagaggaaugaauuagugaagaauuuagugaauacgugaacgaaugaagugugaguaugaaugaacggcaggacggagcaaauccaugaauagcugucugagggcgaaagcgaacaugugaaugaaugagagucacaaacgaagacuuagugugugagggaugaaccggcagagcggacgcugaccccgguccugcucccaccagucaagccggacccuccggaaggcgugcgccugcgcacagcgggacagcgccugcaggugcucuggcaucccccugcuuccuggcccuucccggacaucuucucucucaaguaccgacuccgcuaccggcgccgaggagccucucacuuccgccaggugagcugcgcgcgcaggggggcguggucuggaagaaggaggagcacagagguggaugcugagugagacugggucccacuggguaaucuccugucuccgccuaucgccucuguuggagcguagagauuguuggugugauucagcaauagacuuuaccugcuugcugggaauucgaacucacugcaagcucuuuacccaccaagccagcuccccagcuccccaaugcauugugguccuucccaccuccuccuuccaauggccugacaccccuucuccccacaggugggacccauugaagccacgacuuucacccucaggaacucgaaaccccaugccaaguauugcauccaggugucagcucaggaccucacagauuaugggaaaccaagugacuggagccucccugggcaaguagaaagugcaccccauaagcccugaagagggacuggauccuugauaucagacccugaugucgucuacuugaggguggcaggguggccuguccugagucugaauacugacuuuccauguacugggcugcuccgaagcacuggauaauucacuugacuucuucagaccucaauuuccaacccugugggaugaucuuucuucuucugccggugcggggcuuugugaacuuugugauuuaauuagaaagacggauuaaauaagaaucaucaucaucgugguguuuuguuuuguuucuuuguuucuuuguuuugagaccggguuucucuguguagcccuggcugaccuagaacugacucuguagaccaaucuaucuucaaacucaccgagaucgcuugccucugccuccuaagugcuaggauuaaagacgugcaccaccacccaauaggaauuacuauuaaaauuaagaauuccucuuugcccauuuuaaauuuuuaaauauuuuauuuucaaauauaaguaaaggguuaugugcagugcccacugaggccagacgagggcgccagagcccgugaagcaggaguaccgguccacagggugacugcugggucuucagcuagaacagccugugcuccagcacaggagcgccucuuuaucccugucuguccaucauguccauggagugagugacguuggggcuugucuguguuugugugcacacagcacaccucaaggccucauaccuccaaggcuucaccgacugagucaucuccacgggcccccaaacaaggccuucaugacaaaaagaaguuaauguggcucgagggucaggagccuggggggacacagaauggugcuagcuucaaaaaggaauuccacaugguacagugcaugaaggggggcaugaaagugggagaaagggagaggauggagcaaggugcaaggcccugcaaaaggacauggcacaggagcuaccuguaggagaauguuggagacacaccccuagcaccuguuuccucagcuaagaggaaaauaggacaaagcccagccuuguugaaaugaggauaucgaggguggggguagggauggaggaugguggcaagcuaaagaccagccuagaaauccuguuucaaaaagaccaaaagaauaggaggaggaggagcaaugggggcugggcucaaugcuggggcuugucauauuuuguaggcacaaauaauaaauaaacaaauguaaaaaacgaauacuaagccuggcagugguggugcaugucuuuaauccccaacacuagaggcagccacaggcgcaucuuuguugaguuugaggccaaccuggucuacagacugaguuccaggacagccagcacuacacagagaaacccugucucaaaaacaaaaacaaaacaacagcaaagauacuauuuuuuaaagaaaaaaguaaaaagaguugggcacagugucucuuauuuguaaacccagcacuugggagucagagggaggggaggacuacugaguuuucaaggucagccuggauuacguggugaguuccucucucauaaaagaagaaacgcaccggguggugguggcacaggccuuuaaucccagcacuugggaggcagaggcaggcagguuucugaguucgagaccagccuggucuauaaagugaguuccagaacagccaggaccacacagagaaacccugucucgaaaaaaaaaaaaaaaaaaaaggagaagaaagaagaaacgcacgcgcgcacgcacacaccaccaccaccaccaacaaaacacaaugaaaaccaggcaggucacugauuccaggcuugcaguaagauuguuucaaauuuaaggccaagcuggacugcagagucugcuccaggccagccugggcaucuuagugagaggcuaccucccagcauuagagcgcugggugguguuuucugugguagagugccugccuggcauaugcaaagacccuggauuccauccccagcagcagaaauaaagaaacuuaagaagaaggaacaccagaacgggacaugguggccuuuaauuauuuggucccagaacucacaagcaggaggaucuccuuuaguuugugaccacccugagcuacauagugaguuacaggacagccagggacacacagugagacucugacucaaaaaaacaaacagcauuguugaucagaguuaggagagaaaauguuauuaucccaggcagcuuucuccauccuuucagugugcuagauaagcgcacacaggauccacaugucccggaaccuuuauuucggguuucaacuaccggcacccggaagggaacggaagcgcacucccgacucggaucgacaaagauugcagccaaugagaacgaugaagcggguaggcaccaaccagugagccggcuuaggaaguggcgacacugaggcgcugaaucggagaaacuccccguagacugaggaccgcuucuucgcuuguucgcuggacaggaagcgaaaaugucggaacggaaaguuuuaaacguaagugcucagagucuaaauguuccuacagagggugaagugugcgagggcuccgggcgaggcgugcuuccuuccggucauuuccuuuugcaagccccucucgcgcacacgcacgcacacgcacgcgcgucuuccagucgg

SEQ ID NO: 8669 - RNA, 6161 nt, Mus musculus
caaggguuuaagauuaauuuuuauuacauuuauuuauuaauuuauggugugugacuuguuuguaaaucagagaacgacuugcagcucucggcugccaccguguggauucccaggguugagcccagcaggccuggcggcagccgccuuucuucaccugucaagcaugcccgcaggccaugaucuggagcaccccacuagagggcauuaaaggaagucugugcgucauggguccccuuguccccucucuggcuuagcagccaaugugcaggguccuugagagcucuggcugcuggugacaggauagagcagggccaggugcucugccccuugcacgggcagugggcgggcacuguaaugcaggaccagcucagguaugcuggggaagggcccacugugcugucccaguaccaccugguucucccggguccuugcgaauuucaggugcauggaacccugguugcuucugugggacaaggcagaacauugguccccagacccaccaaacucuccaucucuccacagcugccuuccuauaggugcagguaggcaggcuugaugacuucaguccgauuccccaggaccaacauaguggaaggcaagaacugaaccccaaaagugaccuccugacuucuacacccacaugcacacaaaacuaacauaaaauaaacaucucggcaugugaaagguagaggcaggcagauugcuauggacucaggacuagccuggucuacauagugaguuccaggccaggcuggggucugcaguaacacuccuucccuucaugcccugccuggcccugauggcucucagcucagucuggaugucacuucuguaaagaaugcaucccucacagccucucaucuuccacaauccuaguuaggaacucaaucaagaucaguugugccaggguccaggcucaaugaggagacacuggaaugcaacagauacucaacugauguugagucagugaaaagccugcuucuacugcuacgcccccuuuaaaaaauuuuuaaaaguuauguacguauuuauguauguguguguguauguauguguauguguauuuauguauguguguguguguguguauguguguucgugcacguaucaggaguacauacguggaggucagaggauaccuugagaacucgugccagucuauucucuccuuucaccaggcagauccucugauugaacucaaauucuuuaggcuuggcggcaagcaccuuuacccacugagccaucgcaucagcccagauuuauuuacuuauuauuuuauuuacuuauuuaauuuuuguuuuguuuuguuuuuagagacagggcuucucuguguaucccugguuguccuggaacucacucuguagaccagacuggccuugaacucagagagauccaccugccucugccucccugguggugggauuaaaggcaugggccaccacugccuugaaguuuuaguguguguguguuugcaguacugauagugagauagugaucagaaaagaaaaggugucauauuuccuggggcuggaauuacuggcaguugugagccucaugaugugggucugaacccaggucccccugaaaaacagcaaguacccugacacugaguuaccucuccagccagcccuguuuccaguuuuuuuuuuuuuaaagauuuuauuuauuuuaugugaguauacugucacugucuucagacacaccagaagagugcauuagaucucauuacagaugguuaugagccacuaugugguugcugggaauugaacucaggaccucuagaaaugcaauaaccacugagccaucucuccaacaucccccuucucugcuuuuauugggacagucucauguagcccagaaaauccuccugccugccccaauccccggggggugacaggccaugugaugcugcacuuuagguuacacuuucaggcauuuuuaggaaauagagccugaaacucaagugcuuucuaaacauuuugagaaucugucuucaaacagacagcguuucaagguuuggacaaggccauucaaaagaacuauaagaaccuugggcauugguucccagcacaaccagagcuuuggaucgguucggcuuccaagcucauuccccguuggacccaccugccuggaaagcccgcccaccuuccaaaagccccauccacuggcccaggaaccacacccacuaccccuggagcuucacacacucucccagagcuccgcucacuggacugggaggaucaccccagugugucccuaaggcugggucucaccugagagacagaaugcaguccugagcccuggucucgcugagccgaacgagguagcugccuuccuugcagagggacagaagguucucggccucugcucggcucagggggccgugaaaccaccugggcaggguggagauagacaccucaagaagaggcacagacuucaaacagcugaggggaguaaaagggcaggaccccagggcaaagcgagacacuuccauuggacguguaacgugggggccagucugggcuacaugagaccaaagaaauggaugaaugaaugaaugaaugaggccccagcuccccuacagauguaagaguccuaggggccaccccuccuccagggacugcacucacggcugcuucuccagggcaagggcuguauccacacgcuccgcaggcuguggucuccagggcuccuugguggagcauggaguccguucccagucaggaccaucaaauugcacuggaagaggagaaagagagguuaagucucauucacucagggggcagagcaaaagcucuccaaagggauuucagugguggaaauggggccuaagauaggacaggacugacucaggggcugagauuggucuguggaagugaaauggcaaggccacccagaaaucagguaggggaugggggggggggugcuuugacugacaaaucagaguacaggggguguggccaacagggauaaguguaaucagggguucccuucagcguaaagguaaagauguguguggggaaccugggcuacuacuggagcuugauccccaggacccacaugguggaaggcuagcuuugguucaagucauggccccauuucuucccgaccuggguuauuugauauucuauagguugauccuauugccccuuuacuugauugagcaaggaauugucugacccaaguccaucacuggacagcuccuaaaacccccacucugccuuucacuagcucccacaaaaccuagcgcauucuagugcuuagucuacaaucacccuguuggguuggcccuguaaugaccgcagguucccaagaccucagagaacaaggcgauucccuucuacucuagaagcccuuucugcaaagggauuuucucuggggaagaauuggcagaugucagccguucacacacguuagugagaacugaggcacuggagggaggaggccuuggaggggcucggccuugagcauaccugcgaaagcccuggagaugugauccuucuuccacucccaaggcuggucguauucaucugcuggccucucauccuccaggggccuccggcucuggcccgaagacccuccaucuucugguuucguagccugcuccucauauggaguaucguaaagcuggacagcucugcuuggcuguucuggggugggguguggggggacacuggucacccuccccucacaacagcacauuccccacacccccccagccaugugugcucaccacuggagacgcuccgggcaucauagggcuccauguacccacuguugggggcugguggcugaggcugggcaucaaaagggucugaguacucaguuucugcuuccggcugcugggaaaggcuggggcuagcucuggaugacccugcugugggguacuguacuuucugacugcccuugcugggccguuucacacuucucagggcuaggcuggucagggagucucacguguaucauccuguccccgccucaccaauggccgcugggguuucaagaccaugucacuacacucagcucuuuaaguagguucugggaguuugagcccaggccucucgcugauauuguuuuaauaccagcccuuaagcccuuaguaaggauaucggccuacuuuacaggugaagagacagaagcacagagagagucacacagggucacacaugaguacgaggcaggccuugaucccagugugucuugucucucuguguuccuuacuucucuuaugccuuccagagauuugugggguaagaggacuacaaguuuuagagcagcuuggacugcacagggagaaccuguccccaaaccaaaccaaaccaaaccaaaccaaaccaaaccaauccaaaccaaaccaaaccaaaccaaacgaaaccaacagagcagugguucuggacuuuccuaacaccgcaacacccaaccauaaaauaauuuuguugcuauuucauaacuguaacuuuaaaaaaugaauuaugauuuuuaaaauuuauuaucuguguuuucugaugguuuuaggcaaccccugugaaagggucauucgaccuuaaaggggucucagccuucgguaaaaccaagcagggcaugcaccagguccagcuuccaucaggcacagcauaaacagugacugugacacaugccugucauccugugacacacacuucagaaguacaggcagcaggaggaucaggaguucaaacucauuguagcuaguuuuaggucagccugggcaauguuggaccaggucucacacaaaccaaaaacaacaccuacccucugucucccugaagggagaaugggccgagggggauaauggcuagcccagaagaucuuggacuccccagggggcgggggaugagguggggaacccagggugauagggacagaacacccguccagguccuccacgcaccucuucccccgggcuccccagcagagccuuggcucuggccaugucugcagccuccaccuugaucagccggugccuaggagaguuguacuuggggucaccggacccggugaccucuggcucagcgcggccauuggaauccucauagggguccucgaaguccagguccuucuguucgcgguaggcccgcaggaugucgcucucgguguagucgggggugggcggcugcggaggcggccuccggcugcccaaguucagauagucucggagccacuuggccauuggugcccccaaaauaugcuggugucaaacaaggaccuucaugccuagcucugcagcucguccuggggcuggggggaggaaggaggggagagaagaggagggggagacaaaaggggggaggaagaagggagaagagagaagaggaagaggacaggaagauuggaggucagaaguccuuggcugggcucagagcagagggggcagcagguggcgacccuggugcugcaggccaagggucugcgggaacugcgaacuuuaggguccguguugcaggugugaugucaacagggcuguuucacauuaccccuucagcuccaugcauaaaguugucagaggcugagccacuccagagggucguacucccuguggggcugcuguccgaucccgcgagccccaccaguccgaauuacccagauuucuugaccccugauccuucacaccccgcccccgucacaccuccaauccuuuaucuccaucccuuaaucucugaauccuuuaauuccaucuccaguauuccuuaaucuccagaccccuccauuuccuuuaaccucccgguccccuaacuccugcuccacaccgcccccucaaucccuuaaccuccccuaucccuuaaccgccugcagccgccgccacugcacaacaaaagggacuuaaaccacugaguccaggcccggguucucagggccaccggaggggcgagaacacccgcgucccauugggucccgccuugcggacagaccugcagaccucagaccuucuguggcuccgggguggagacagcaggacucggacccuggaggaucccggaggacgagaccaccggcguggggaccgaguugcccuugggaccagggccgggcagggauugggcgagaggcccgagcaucgcgcagggucgcggcuggagguggcgcagggcgggaggcgucguccgucaccgcugcguccguccgucgcuuugugccgggcgagg

SEQ ID NO: 8670 - RNA, 2573 nt, Mus musculus
ugagcgcgcccccuagggccaucccaggcccugccgugccgccuccgcugccaccgaggcugccgcugcgcccuccgcuacccgucccgcgcucgggguccucggccuccgcgucguccucauccuccuccggcgccuccucggccguggccccgggagacagagacucgggagcugcagcgaaauagcaacuggcugcagaggucgcgucccgcugccccguccccgccugcgcggaccauccuaccugccauggacgcugugucccggcacagccuccuccgagugaacgggcuccuccccgcgcggggacacagcagucuauugguuacugaaaauggguggggagguuuggcccgccgggggcggaggggauacggagcgguuggguugugcuugcacuggaguuggagcgauccggugcaauuuggcgaaacuaaagcuggagguugggggagaccuggagaaggaaacaggcccaggaccuucucauucagggacuagagauaccauacucgaggccaccagcuacuagguugcaacuuugaucccugagcaggaguggcucagcuuucaggaaagagauggaaaccuuaggucuugggccugcccacgcgcaguuaaagaaaugagggaagaccuugggacacaagggaaacugaagcagauggugaacuagagggaaaaacagacucaggacgccgccccccauccccugcucucagggggacuauacucccuuaguggggcugcauccuggagcucaugauucccucagccuacagcagcgaugaaggaagcugcuagugaggcuagugcgcuagcuaaaggcagagcccuugaugguugggagcagggaagaaacagguuuguaagaaauguagagccgcuuuaggaaagcagcugcgcguuauagcuggaucgaaaggucugagccuggccagcuuuagccuuucuaggguuaacucagcccaauggcaguucucaucagccaaucaccaggugccuccagcauccaaucagcgacaagggaugguucccacucagccaaucggcguucacguguaaucagcgagcgggaaggggcgguguuacuaggcgcccaaggcccugggccuuuguucucauccugauuuguccuucaucacagauuaccccaacccagggaggucugaaaauccggguggccucaaacuggggaaagaggcaggaugcucuggaaaggucugaguaaugagaaucauucuuuuuuuuuuuuaagauuuguuuauuuauuuauuauauguaaguacacuguagcuguccucagacacuccagaagagggagucagaucucguuauggaugguugugagccaccaugugguugcugggauuugaacuccugaccuucggaagaacagucgggugcucuuacccacugagccaucucaccaguccgagaaccacucuucccuuagcccaggccaccagacuuugggcuccauaguuuaccgcuuccaagucccggcacaauaugcaggucuaaccaucuuguaaacaggcaaagccuugagagaggcuccaaguucugcucacuggacguuuucauccuguuuaucuuccaccucgauccaaaagggacuuuucuaugauguaacuacugccacauccuauccuugcgcuacaacaguccuuggcucccggcuaauuuuucuuuuccuuccuuccacuugcagugauccuccugcucagcccccuccugcuuacgucauaggcuugcauccccacaccuagcuccccuguggccuuugacacuuugaagcaacuacuguggcuugacaauguacagaaaccuaaagauaacauugguugaagauaaaggaagguugugccacucacagccacuaucuggguccccaucuccacccuuuuaccuguguaaaguccaggugcccuagcugggaacugaagaaaaugaguucacaaucuguucugccuuugccuuuugaaaauagcaucucgcagggcagugguggccugugauccuagcacuugggaggcagaagccgguggauuucuaaauucaacgccagccuggucuacagagugaguuccaggacagccagggcaauucagagaaauccugucuugaaccuccgccaccccccacccccccauccccaaaauagcaucucaggcagaccgcacuagacucaaguuacuauguaacuacggcugcuccggucucuuccucccaaguucugggaaaacccaaauguacuaccacgccuggccaaauuuacaauuacacacugaucaauuguacuggaauugaccuuagagccuuguccuagccaggagccagguacacuaccaccacaagccaggcgcccaggcccucucaagaccguucuuaguggggggccugggggcguggucagggcagaaccucagcgcagaaucacacugggaagggcuguguguaaccgauagagcacuuacucagguugugcaaagggcuugaguugcuucuacagcgacaaggggaaaaaaaaaaaaaaaguagaaagcuaaagaaauaaacugacuugg

SEQ ID NO: 8671 - RNA, 8045 nt, Mus musculus
gugguggcacacaccuuuaaucccagcacuugggaggcagaggcaggcagacuucugaguuccaggacagccaggacuaugccagagaaacccugucuugaaaaaauaaacaaacaaaaaaagaaagacagaccaagaaagugcauguucaguugguuaucugaaucuaaaguccagaagccauucagguugcugugggguacugccgcuggcaauuuugagauuggaacauagcucaucuuagcacuggguuugcagcaauaggucccaguguagacaguuucaccaggaauuacuguccaguacaguauguuggggguggugguacauggucaacaugcugacaggcuguauuuugcacagguugggucuggggacauggauggcuuccaggcagacacagaagaggaugaagaggaugacacagacuguaugaucauagaugugccagauguugggagugacgugucagaagcucccauaccugcucccacacuuugcaagugacaggugucaaguugaaagaccugggggaaauugaccuaggugacagggaguaguggaguguaggcaccugaagugcaagguugguaguaggcauguucugggcaguggaggcugugcuuccccucagccuuguagagcugcugagggagaugggaauggagaccagcaacagccugcucccugcagcaucugacuagcaaccaccagagugagccuccugcugacucucaugauaaagagcacuuuguccuacauuccuaggucuggagucugggggaggccuggacagcuacuuccaaauuguaaagacucuggguccgugugcuaaucugcccuucuuaauugacagaugccugcuugggccuuaaucacagcacuugcugugggcaaacaucugcuaugaauugugcuagggaugauguggcugcugugcaggcccugggcaaauguggacauguauaaacauacucuacuugagcccucugucuucugucucaacuaucauauuacacuggugcauguccuuccacuuguccugggcacaguccaagccugcuagggugcugguagaaaagaaacacccagggaccucagaaugauacuaaagcuacaguugguugguugacuuauaggacagauucauacugccagcccuucaacggccauggugcuauggcucugaugaaacacugggaggcugaguuuaaauagccuguuuauuugggguuuauaacuuaggaauuacagcuccaugcugccagcugucuccauccacagccugugugcauuccaccugugcugcacuccaagauggcaccagagggcuaaggcuccacacaccgcaagccaggacaagccugucccuugcagcccacagaggagguaggaccuugucuccaacucuacugcuacuacuguccuuccuauugcuggggacucagggaaaggaauggguuugggaacagcaugagacuggagccacagugggccaagccugcauuuauucaggagaguugcucgauggcugcaagcagcucaggccucaagacagauuuugcuggcucagcuccugcugcccuuauaucuuccaacacugaagcaucccaggagaaggucaacagggcagaggguaccugcaaggcagauagaaugucaccuaggaugcaauaccccuaugaugacccugucuccaugccaccuucaccaccauacagaucccuucaguuggcuuuuuaaagguaccuuccccaucuaacagaaugaaaacaaaggcacuaagacaauguaauaaacccaccaaaggugacagcaccuccacacacacccuggcagugggaauuugguccaaaaugcuggacccucccauucagugccaagggcaugaucucaugagcacagccccagcucaccagcccacacucauucaaggccagggccucguucuccuccagcuucuguccaccggaggcccucagcucaaagggcagccagucguucuguagcgccucgcgcacaaaucggaagagcgcggauagcuucucccgggcauagaaggucccugcaggguacagagcaugagcuagagguggugcaguaugauuaccacccacccugggcugggguggucacacaccuugcaguagacagccaucuggcaggcgcacgcgcacaagggcauagguauacuugcgaagcucccgcugcuccucuuucucccgcauggcuuugguccugagugagcucagucgcuccaccgccucuguccuguguggcaaagaguauuuauuggucaggccucccaagcuaaugccccaugaacugcccucuccucauaagggcguaccugagccuuugcucccgcuucaccuccucagcuguaaggcugaagaaaucugaggggaguucaaaaugugaggccagagccgaggggcggaagacucggagcugccgauccagaguggcccgcacaggcucggcauccaacagcugcugcuugugccgcgccagguucugcggcugcgcccgugcauccucacccagaacguagaacuccuccuggcccucuguagaggcaucacagcugucuucgugucccaugugccaccgcugcccccucccaccugccuggccgcccucucacccugauccggcacagguagggugaccuucuugaagccaauggcuucaaagaacucguggcuucccucgagacaguugaugcgcuccugaggaugaggcacacacaggucacccagguugcagggccaggacccagcacugcugagauugaagccaagcagcucccacuggcccaacagcugaugagugguucuuggaaugacgucccccauaauggcuuugugguuagagaggcuacaccaagcaagccucaugucugcauuuguaggauaaauuuggagggugucuucccaaaaguauucaaauuaaagagaggccucucgagggagccaggucuccaacccugaguuucagucguagacccaacauuacugcgaucuugaaagucaagacccuauacucaaaaaauccaaagaacagagcuggugaaauggcuagguaaguuuaggugugacaccaaggacaccaagugugacggcuguguucccggacccaugugguggaaggagaacuacuacuccacagguuuccuuuccuccacacaugaagcggcucaugcaccuaccuguaaauuaaaugcaugaacgaaaagaaagaugagugaggagcuccaugccuguauccuagcacuuuggaagcuggucaguacucagcugaccccccaguacugggucagauuggacuauacagugagaccuggucucaacaacaacgaaaguaagacagacaaaaauccaggcaagccgggcgugguggcucacgccuuuaaucccagcacucaggaggcagaggcaggcggauuuccgagauccgagaccagccuggucuacagaguuccaggacagccagagcuacacagagaaacccugucuugaaaaaacaaaacaaacaaaaaaauccaggcaacacagcaugacacccacccccaugcccagugacccaaggacagccauagcagcuaccuggaacaccuuguucugcaguuugauuuucugguauuuuucuuccucuggguguaaauggauguuguccagguaucuggggaggggggaaaagggagagccacccaggggacuaucugacuucacuguucuuacacucagguccucacacagccagggugagccuggugcccaaagcacagggugucuauaacagccccagaugcucagaucccuuggguaaacagcucacucacuuggcgauaguauccacacccagcuucacucggucccggucucuauugaauguauguaucuucaugauggaggcagccacggggucuguggaaaagugcugggggagaggagggcaugcugaggacccuagaagacugcuggggaaugggaagagggacugcaacugcagccaucagcucucaggccaagccagccauaaauguuugauagaggacaaagcaugcacgucuucaguagaggccacuccugccucuuccaggaugagguaaaggccaaacaagaagaggagacaagcacaucucuuugggauuuccagggcccuuguggcccuauagcugugccuuaugugcuagcuuuaaaaccacagcaccugggcugaggucccuauggccaucagucauacaacucccaugguaaccacagugggugucagguagcacaaaaggacacaagccuagcaucaacaaaucagaauggcugguaugaugcuggaacccaggaagaugucauggugggucugggauaaggcagcauuggggcugcuagucauaggcuauugucagaagauccacaauuggggaaagccagacaguucccaagaggaugaaaccacaagccaaaggaugugaggccucuagcagcugaggaagacaaaucuggaggcuccauuagggacuacccuucuaaccugaauuuagaucagcaagucucguguugaacuccuuacaucagagcucaagauaggaacgugcacaccugaagccaccaagcacugucgaagcugggcacagguguguacauguccucauacucccaguuuuucuuuuguguagcaauacgcuugcccaagguucauaauccuccugccucagcaggaaaacaggaauguaccaauaugacucauuuucugagucuccuauacccuaugccucgugaggaugggguagaaaccuugcuagguaucgugaucugaauaagauggcucugacaggcucaucuacugggauauuuagucauugaagaguggcacuauuuaaaagaauuagaaguccgggcggugguggcgcacgccuuuaaucccagcacuugggaggcagaggcaggcagauuucugaguuugaggccagccuggucuacagagugaguuccaggacggccaggacuacacagagaaacccugucucgaaaaaccaaaggaggaaaaaaaaaauagaauuagaaggauuagguguggcuuugcuggaaguuugucacuggggggugggugucugucacaucaggauauguggcauuuagcuacuccaguugagcaccauaccugccugccugcugccaagcucucugccauaacaaacuaaaccucugaaacuaagcuauccccaauuaaauacuuucuuuuguaagaacugccuugaccauggugucucuucacuguaauagaauaguagaauagugacuaagacacuaggguugaugggcauguguccaguagcuggaacacgggucacucaccgacaggauggccugcuugaugugggcaucccgcuggucccuccucagggugacaccugugagcggacagaugaagaacacaccaggcacugccaaauggggagagauuuccuccuugggcucagguaccugaagacagaagacaggaggcucuuauagcuggacauauaggcccacgcugucacuccuccuuuccaagggucugucuccuccccacugccacagguacugcucauaugcaugaagcucucccuccccaggcuucagcugccuccauacugcccgagaacacugggcaguccccagcagauaaccuuaccgaguuggucccaggagcuccuggauuguugcuggagguggcuucggccugaaguuccuuccucacugagaguaggaaggggugauauggacagaguaaggacccauccugaacccagaggcugagccucugggugcaaaggugggaguugggggguggggagggggcuggucugagagcuagcaacucucccucccaauguccaggagguagaaucuagucccugcuucuccaagucuccauccaagcaagaacuaauggugucucugccacaugggacucagagcuacccucuggggacccuuucccauuggauucagucugccccagaugccaccuagagcagaacucacccugguuccggauggaguccugagauguagggccccgggcucggggcuguuucuguuccagccgggccagggcagcagcggcagccaucugugccucaucaguggggcccugacggggcugccggagggccagcuguggugacuuuccuuugguggucuucucccugaacagacauagggacccaauuuugcaaaacgguguauagaggaauuuuaaucaagcaacaugugggaggaaugcagacaugcaacaaaucuuuaaucucucuugcuggaaugcagacagguccauaguauguaucuuuaaucccuaacaauguagguaagguuaguuuguagaaggaagaagucauguuugaaaguggcaucuaauugaguggcagacagugacgaaucagaaaaauuugacagaaugagucagggauagauuacacccaacucugagaacagucaggaaagagaggacucaaaaggcagcacagagagagagaguugaaagcaguucagccugccagugcaguucagaggcagguugcagcgagagaaugagaaggaaccagaagauuagaagagacugccagacuuaguuugaguccaagcagagcacuucagugagaaauugagagaagccaaauugaauuagucagcuugguuaauuagauuguacagaugcuagaagcuuccugggauaguuguuagaacauggauaaugcucugagcucagcccaagcaguguguuguguucacagagcaugguugcagcucucaucacuucaucugaggaaauaaaagugacauuuacuuuuauagaucacacacagaucacggacacuggaccauccccuccaacuucuggccugaggauccuuugaaccuccauguuccucucaucauugaaacugccccacuauuuguagcuguacccugguguguuuaccucccuucuagcccuggcuugcaggccccuccuucuccucacauucagccccagucgcugguugucauuuuccuccacauauacuuccugcagacuacucccugguagccuguagcugucuccaaucucuacuucaccccuucugagcagcuccaacaugccuuaccucccucuccagaacacaaaguucuccggaaagaacuccaggaaaguacuccuggaagacccggaguugccaaggcccccacagagaucccaucuucaccugucaccccaaccacucaacaacauucugggucugggccucucugguuuccacacuccuccaagauccuucuauaauccucucucacuccccaaccccucccagauuaccacacaaccuacaaagaagucuuaacaucucucacagaccuucuucccacaccuucucuuagguccuuccuacccacauuucgccaaggccacaccuuuaggcggcucuucucuuagcuaaauucugggcauugccccgucccuucucaccacccagaaccaagagucucuaagcagugaccaacgcgcccuggccacgaccgcccacgccuacccuuagcgccccgcccacccgugcuacaccacacaacugcccucccuucugccccgcccaccacugcuacaacgccccgcccucauuguaggcuccgccccugccuuacaaucuuccacaccccacccaccaaucuacuccugcuaagcauagccuagaaagacccugacacccaaccgccggcccuuuuugcccccuggcccucgcccucuccgucgcccaaccagcgucacauacccugcggaauccguaagcuucuggccgggccccgcgcucuugaacuugaugucagccuugauuuccuggaagaacuucuucauggcggcagcggcccggcggcuugggccgcagggcggagggcgcagggcccggguggaugaggagcaggcggccaaccaccggaaagaaaauaucgcggcgacggaagucccgccugguucacgugacaaucgccuugcagcaccucgcgcgggcggggcgccaucuuccu

SEQ ID NO: 8672 - RNA, 1042 nt, Mus musculus
ggaggcgacgggagcaggaggaagagcuccggagacuucgagaacaggagagggaggagaaggagcggcgcaaggagcgggcagagcgugggggcagcaguggagaggagcuggaggacgaggagccugugaagaagcguagccgaaaggcucgaggccgaggcacaccauccuccucugacucagaaccugagggggagcuugggaaagagguguguggugccccccucuucaccugagucacaagacacugacccugggcaccacucuuuugagcaccuacuggguacugggccucauccuggguguuggugauacaauggaaacacaggaccccaggccuagaaaauagggauagccagucgaggguccuuccagcauauauauggcuugucucucacauggagaucuggacuucaaagauccuccuaaaggccaggggagccauugcccagauaugcuggguggggggcgggggcagagcccacagcucuguagacuaaaugaggggaauaggggacaaauuuuaucugaggcagcaaccuguccuuuggcugcucccuguaggggaagaaguuggccaagaagucccaacugccaggcucagagucugcaaggaagccugggcaaaaggagaagagagggcggccagaugagaagccacgagccaggucagcaucuguccugagcccuggaucuaugaguuuagccucagagcuacaccuauccaaggguuccuccgacccuugagccugcagccgcaggacuugcccugccccugccuuacuaugggagucccuccugggccacauguggcugucagacuaggagcugcuggcuuauagugaguggguagaggccaacagcaauguccagaauaccaaaaagcaauccagccgguauccacagcacccagaaacuuuaacucagcugcagguggugcaguacagcuccuguuuguucccuaaguauauucccagcuagugcuaauuagagcugcccguggugggugucagcagugugucauggucgccacacagca

SEQ ID NO: 8673 - RNA, 1042 nt, Mus musculus
ugcuguguggcgaccaugacacacugcugacacccaccacgggcagcucuaauuagcacuagcugggaauauacuuagggaacaaacaggagcuguacugcaccaccugcagcugaguuaaaguuucugggugcuguggauaccggcuggauugcuuuuugguauucuggacauugcuguuggccucuacccacucacuauaagccagcagcuccuagucugacagccacauguggcccaggagggacucccauaguaaggcaggggcagggcaaguccugcggcugcaggcucaagggucggaggaacccuuggauagguguagcucugaggcuaaacucauagauccagggcucaggacagaugcugaccuggcucguggcuucucaucuggccgcccucucuucuccuuuugcccaggcuuccuugcagacucugagccuggcaguugggacuucuuggccaacuucuuccccuacagggagcagccaaaggacagguugcugccucagauaaaauuuguccccuauuccccucauuuagucuacagagcugugggcucugcccccgccccccacccagcauaucugggcaauggcuccccuggccuuuaggaggaucuuugaaguccagaucuccaugugagagacaagccauauauaugcuggaaggacccucgacuggcuaucccuauuuucuaggccugggguccuguguuuccauuguaucaccaacacccaggaugaggcccaguacccaguaggugcucaaaagaguggugcccagggucagugucuugugacucaggugaagaggggggcaccacacaccucuuucccaagcucccccucagguucugagucagaggaggauggugugccucggccucgagccuuucggcuacgcuucuucacaggcuccucguccuccagcuccucuccacugcugcccccacgcucugcccgcuccuugcgccgcuccuucuccucccucuccuguucucgaagucuccggagcucuuccuccugcucccgucgccucc

SEQ ID NO: 8674 - RNA, 10295 nt, Mus musculus
gcuagaaauggggugcuggaaguguucuuugggccauagcaccuauaugcacuuaaacugcuuguaaguuugaccccagcugagugaggaggguucuuuuuuuuuuuaaaagauuuauuuauuuauuauauguaaaguacacuguagcuaucuucagacacuccagaagagggugucagaucucguuacagaugguugugagccaccaugugguugcugggauuugaacucuggaccuucggaagagcagucggguacucuuaccaacugagccaucucaccagccccggugaggaggguucuaaugaaaggcaagcuguguguucauaaugacccucugucucccuagaucggucagcaccugugaauggugaggccacaucccagaagggggagaacauggaagacagagcacaggaagacgggcaggacucugaagauggccccagggguggcuccucagaagagcugcaugagugagucccugggacaucaggugcauucccugcacgauggagcccucacccugccccuaccacaugcuggggccaaccaacacucugaucuuggcccacauuaggccaccccaggcuuccagcuacugguacucugggaaagaacucccugcugacugucuaggucuagcccuccaguaaccaccaugagcacugaccaccagacugagcuacaguuggacuggggagggucaggaaggccauacaaggcacaggugccuuugacaggagugucacccuuccuuggcugcccaccgacccauuagcuccauggugacaccaggcaaccgcaugcuuaccaaccuucuuuaugcccccagcagcccacgcgacaacucggacccagccaagccuggaaaugagcgucaggaccaugagaggacacggcuggccucugagucugccaaugaugacaaugaggacagcugagcuccagccacuguggccauggugccauguccauccccagccucccagggaagugcugcgcuguuuguauuuguggucugggcuuuucugccuaguucugugauuucaauugacaugaaauggcuauaaagaauuuuguaaugaaaaagaaacagcuuuuauuggcuuaggugcuggcuaccaugagcaguauagggagccagaccugauucagggcaggucucauacccacaggcuggcagaacucuuagugcagcgaguagccuguucuaccagcuugagugaagcagacacuaaggacaacccaacagaaauccaucacuagcugugcagggacccccaggugggaccagcaaagugccucuggggcagcucggccucugggcuggaguguugcaguccacaccaccccaacccccucucacuguagcuuucagcaggggcuuccccacucuucuguguucccagugggcucacgaguuggguacaugccuccugguuguauccaccugccucaauagccaccaauaacuuggcaugauguaaugaggcucaugccaucuguuggaaagcuuagcugcaggcucugagcccaguguuugccaguggcugggucuagugucacccugaugcugacauggcagaaggucagggaaaggcuccuugccgucucuaucauggcauuccuuggccacagcuggcccaggccuaaagcuuguggacauuguuauuuuccaagagauaaaggggcuggaagauuggggucacuaguacugcugggguucagggagggcugggcuguggccuuggccugguggugagucagugccuugugccccagcaucuuguuugcuucuaucuugggugcguagggcaagggagaggagccaucaacugcccauauccccauucaguacagucuucaacccuaggcugcaggccauguuccuguacaggccacagcuacucagcagugcugggccugucagaucaacccuguuuccaugcagugauauauauaugacucucguuuucucagcagagcaggccugagucaggccuauagcagccuggaauguaauugugugguuuugugcagcauuucucccuaguaaguagcagaagcggcuguaggagccuacaucagcauggcugugcauucuagucccagggaacaaggacauagucauuagcuaagaucugugguugugcugcccagaguagggccuggguuggagugacaccacucguagagaagagcuaugggcccuggaaagacugucagagccccaaggauagaaagcuggccaguggggacgcgugaugcuucuuuacucugugugggggucuguguggccuguaucugaacagacuugguggcuaguuuggagggaagggaucauugguucuuagaaauagcaggagcuguggcugguuucaaauucacuuuccgaggaucuucugcuccuguucaauccagagcuuuggggaaguacagccagcuguggucacagcauggucccugggaccccacccacccagcccucaggugccuacagcuggccacaaggcaucgaggugaaggguccaaccagccagcugaguggaggguucugcugcagcuucucaagcagcaccuccaggcccugccaggccucaacaacaccagcacugcucugggccagcugcucugucugcagcucacuaccugccuccgaagacacaaggccauacagcuugcagaggcugugccgugccugcccugccugcugcugcaccucuggcaggcccugcaggcugguuacuaggcugcuguaagcugcauggagcugaugggcgagggugcacagccuguccugagccacggaagcccgcaucugcagagguggagaaagguaaggagggacagagcuuugacuaggggcagugggaaggaaggcccaugccacacccaccucauggcuaccaacagccuccaccaugguguucaagcucuggucacugcacagcuucccacaugcagccuccauggucaugucugucuggaaaaagaaccacaggacagguagugggcccagaaggggugggaacacucaguccuguacuuggaucuugaguccauauguggugcagccaaaacacaaaguccccaugagggcaucuggaaggccagguggugguuccucuguccacucaucucccacccuacuacucuucucugcauguccacacagauuccuuucuguccccugaccacucuuaccaugcucuuuccccaggaaucucaccuugcaucacaccauaccucugucuuuuccauagucccuggguaucuguuuaggguacaggggggcuuuguggccagggaggagguggacagaugucagagacucagaauauuaggcuucuguguccaugauacccagcauaacucuggagguggguggaauauuggggaaagaaucccugcuagagcggggucacccacacuacccuuucccuuagguucacagauugcagccccacacucagcucccuagaugucgccgguacauccaugcaucagcucccucugcaugcagguggcuuagcccacugggcacuuggcuagugaccaguuggaggaauccagaguggggaugagagauguucuuaccaucuggaaggccuccuggagcugggcuagugcagcccuggcuuggaacugguugugcuguauguggcucagggcauguucgaaggcccgcuggcggaagcuaggggccaggucacccagacggauguaguagcuuccccggucagcagagaguacucggggcccugacucugagacugccagcugagcuggaggaaggcaaugagacucagucugaaaggugccuugagacacccagaauggguauagggucucaccaaagcccaggcucuagggacccgugauagggaagggcagaggcacucaccuuguuccucaguugucaugggcugaaagauaucacccagcccuuucaacucaucaggaagugcagcaaagccuguggcagccagcugaccacacuccuccacugaccugguagcugcgcaggcagaugaagccauaccagacacaaggguuuuggugucagcucugggcucugugacaugccccaagccauauuugucugagaagcugcuugucucacagcacagggacucuguagaagucaggauggcuuguccuaccccaugguuaguggcucuguaaaugcuaggcucaugacagaugauggaaugagagccagagagugaacucggaacugugugaacaccuguguggauggcauugguggcuacauuaccugaaugagccagcacagaagacugggugucucugguggugucuguguucuuaugaauaccuuuagccauguucauggcacugguaaccccagcacagacaguguccuucaugccuauaagcauaugcuugcugguguccaggcuuguuugcacuguuccuuuggccguguccauugugccugugagugcugcguucgaaguauccaggccuccuugagcagccccuuugaccacaguaauggcuccuguggccccagcacauauagaguccuuuguguccaucaggauguucuugcugguauccagacccauuugcacuguuucuuuggccacauuugcugccccugugagccccguggucacgguguccuugguaccuaagagcacagacuuggugguauccaggccuccuugggcagccccuuuggcaacauuaauggcaccugugaguccuguggucaccguguccuuuguacccaugagcacagacuuggugguguccaggccuccuuggguagccccuuuagcuacauuaauggcuccugugagcccagcacauacaguguccuuugugccagucagcacagucuugcuggugucuauacccaucugugcugugccuuuagccacauucauggccccugugaguccugugguuacuguguccuuggugcccaugaccacagauuugguaguguccaggccacccuggacagcaccuuuagccacguucacagccccugugaguccuguggucaccguguccuuagugcccaugaccacagacuuggugguguccaagccgcccuggaugguaccuuuggccacauuuacugcaccagugaccccagcauauacauuguccuuugugccugucagcacucucuggcuaguauccagaccugucuguacuguuccuuuggccacauucaaggcuccugugagcccuguggucaccguguccuucguaccaaugagcacagacuuggugguguccaggccuccuugggcagacccuuuagccacguuaauggccccugugaguccuguggucaccguguccuuuguacccaugagcacggacuugguaguguccaggccuccuugggcagccccuuuagccauguuaauggcuccuguggccccagcacauacaguguccuuugugccaaucagcacagucuugcuggugucuauacccaucugugcugugccuuuagccacauucaaggccccugugaguccugugguuacuguguccuuggugcccaugaccacagacuugguaguguccaggccacccuggacagcaccuuuagccacguucacagccccugugaguccuguggucaccguguccuuagugcccaugaccacagacuuggugguguccaggccacccuggaugguaccuuuagccacguucacagccccugugagcccuguggucacuguguccuuuguacccaugagcacagacuuggugguguccaggccuccuugggcagccccuuuagccacauuaauggcuccugugagcccagcacauacaguguccuuugugccagucagcacagucuugcuggugccaagacccaucugugcugugccuuuagccacauucauggccccugugaguccugugguuacuguguccuuggugcccaugaccacagacuugguaguguccaggccucccugggcagcaccuuuagccacguucacagccccugugaguccuguggucaccguguccuuagugcccaugaccacagacuuggugguguccaagccgcccuggaugguaccuuuggccacauuuacugcaccagugaccccagcauauacauuguccuuugugccugucagcacucucuggcuaguauccagaccugucuguacuguuccuuuggccacauucaaggcuccugugagcccuguggacaccguguccuucguaccaaugagcacagacuuggugguguccaggccuccuugggcagacccuuuagccacguuaauggccccugugaguccuguggucaccguguccuuuguacccaugagcacggacuugguaguguccaggccuucuugggcagccccuuuagccauguuaauggcuccuguggccccagcacauacaguguccuuugugccagucagcacagucuugcuggugucuauacccaucugugcugugccuuuagccacauucaaggccccugugaguccugugguuacuguguccuuggugcccaugaccacagauuugguaguguccaggccacccuggacagcaccuuuagccacguucacagccccugugaguccuguggucaccguguccuuagugcccaugaccacagacuuggugguguccaggccacccuggaugguaccuuuagccacguucacagccccugugagcccuguggucaccguguccuuagugcccaugaccacagacuuggugguguccaggccacccuggaugguaccuuuagccacguucacagccccugugagcccuguggucacuguguccuuuguacccaugagcacagacuuggugguguccaggccuccuugggcagccccuuuagccacauuaauggcuccugugagcccagcacauacaguguccuuugugccagucagcacagucuugcuggugccaagacccaucugugcugugccuuuagccacauucauggccccagugaguccugugguuaccguguccuuggugcccaugaccacagacuugguaguguccaggccucccuggacagcaccuuuagccacguucacagccccugugagcccuguggucaccguauccuuggugccuaugagcacagacuuggugguguccaggccuccuugggcagccccuuuagcuacauuaauggcuccuguggccccagcacauacaguguccuuugugccagucagcacagucuugcuggugucuauacccaucugcgcugugccuuuagccacauucauggccccugugaguccugugguuacuguguccuuggugcccaugaccacagacuugguaguguccaggccacccuggacaacaccuuuagccacguucacagccccugugaguccuguggucaccguguccuuagugcccaugaccacagacuuggugguguccaggccacccuggauggugccuuuagccacauucacagccccugcaaguccuguggccacuguguccuuagugcccaugaccacagacuuggugguguccaggccugucuguacugucccuuuggccauguuugcagcucccaugacuccugugguaacuguguccuucguauuggugaggacauucuuugaagugucaagaccucccuugacaagaccuuuggccacgcccacugcucccaucacaccuccagauacugccuccuuaguuccgacaagggccgacuggguagcacccaguccacccuggaccauuccuuuugcagcauccaugaugccaaacaccccagagaaggcaucuucacugcuggucacacugaaacuucccauguccuugucuccagcugucuaaugaggaaaggcagaggucaacacccacaaaagucccucuaugcuguccauaucuucuaugcacccaguccucugagucccugagaucuuucucugcaccuacccugaccaaacacccuagccucauccagcuguaggguaaugucugggaacccaggacagagcauacaaucucacuaaaaugauucccuucuagcuggacaugugaucagcccagcacuuaggaagcugaggcaggauuguugcaugucugccugggcuauauaguuaguaugagaccccaucagugacugcugggcuuugacagcucaaacuauugccaagggaccacagggucagaggcugcucucuguugucacuuggcugcuugauacagggucucauguagccaagaaggacuugcuggggugacacagauguguugccacugagcagcucucccuagaugcuacuuccccaggggacuuugaacagaccugcagacucuaaaguugucccaacagaggaacugugggcacugagucgguggaagcugggccagcauugcaucccacagugccugagugcucacugugcuuucuacauuggcugugcuugaguccccagcucuucccuaccuuugagugauguaaggugucaccccucccccaaagccugccuagaaaauauacccacgccugcuggggcugguacuguagugcagaggcaugcacacaccugucaauccagcauuugggagguugaggcagaaggaucagaugcucaaggucagccucagcuauauaaugaaguacaggccaaccugggcacaugagacucuaucagauacaagcaaaccccauuuccuucaaggucaggagggaaaaugaaagggauucaauggaugcuuaauuguagccaaaauaggugauccuggcugccaagguugugauuugauuugagucuacaggguguggucacaccauugcuggcccucugagaacuuugauuugugugguguuuuggggcacagucucugugucccaggggcaggggaaagcaagugcugagcacagagcccauaggauugcugaaagguugugcccauuucccagaugugaaaacugaggcccaagguagagaauguacugguaacccuaccucgugaaaggaaguagaaccucccagagaagcccagguuuccuguccaaggucuuccaaaccagcucaccuguucagaagguuggagcagcccugcugcauccccugccaucugugaguugguggacacugcagagacagagacagacagggaaugagggacaggccucuggcuagagccuguugcuguugugcaauuaccaagccugucccuaaaggauaggaaugucccagcugcuggcaagggacagcaggagccaggcccagccucccuucccgcucacugccaaggguggcccuugcccaugugacgcaggccccugcagcugcgagaggacauucugugcuggacucugggugcuggacacccacccugcacacuuggugcccacagagcuugcagugggcgagugguaccacccugccuuggcagcccugccauggucaccagcugcccguuacacauauguggccuucaaggaaauagccugcugcaggcaccccaguugaaccucagaaugcuguguuaccccagggcagcugcuggcccucuccgaguacccuugacaagcucagacaagaacaacguccagccuaguauccagugcaaacagcagaggggccuuggcaggguuuaaacgccccguuccccuggcuauaucgccuaguaucuccaccucaguuuccuuaucuaaggagauuacauagauacaaggucaccagaguugcugaagcuccuucccaggcaguugcucugccaggccacucaguccccacuucucuugugccacucaccuuuagaugagggggcaggaguccccgaggggucuguugcuguuuguaaguccuuuguggagguggagcugugagugugggacaccagguuccgggcagagcugaagccaggcagggacccaaagaaacugcucaaggucuguguggggugaguaggggugagguaaguggacacugggguugccuucccagggucccuggcagaguagcccucuguucucuuaccuugccuuuggauuugggggggacccuggucccaucuccugaagcugacaugauggcagccuguggggcuagaaaggagaaaaaagugcuaagugcuggagaggcccuucuguuucauccccacccugacucccaccaacacccccuucacccaccuggagguggcagucucugggugacacagcagcucgagucaccuggaccagucaggguaaagggucccucagagcaggaccgcugcuggcagcgucugggcgcccaaucccc

SEQ ID NO: 8675 - RNA, 8460 nt, Mus musculus
cugucaacccccauguuguccugaagugaguccgggagcccauuuaagugagauauaaaaauauccgggggggaggcaaaaguuaccugcaaacuccaacccaaacaagcgccaagacgaagucgcccuccaggcauccgcgagcgucaaucagaggcgcuguagugcaucacgugccaagucgagucccgccccaccauggcagccaaaucgggcggggcgacguugucaccguucggcgcugacgugucccgcgcgugucacuccacguucgcgagcgccugcgcauugccccggaagcaagauggcagcccccagcggaggcuucuggacugcggugguccuggcggccgcagcgcugaaauuggccgccgcuguguccgagcccaccaccgugccauuugacgugaggcccggaggggucgugcauucguucucccaggacguaggacccgggguacgugcuaagccuccugcccgggaaucgaugccuauggacuuccgaucaggugguccuggagaccggguggaguggcagaggcaggguuaccugaagaagggaccuggcugccucgucugucuucugucagucacucccuaccugcaaggcgacuuccccuugcccaucucauuguagaaaagggaauacugguugauaagagcagcggaucuaggggacuggcuauacaggucgcacguggguuacucacugaacccggacuagagcgggagcaccccccaagccuuacacgaguccaucaccucuccuuucagcgagccagcagucagccuagccucugcccgccccagcuuggcuucugggacagcggugucccuagugaccauuucuugagaccauuacuauaguccugugcuuucuggcagguuuguguugugggcaggaagcaguacaagcuuguaucuaacaggagccccgaguacugaccucauaggugauguucuagggaugauugcugaaggccauuugaccuuccuaggaaaucacagugauuugagcaaaguucugagcuccugagaggagagagaucugguggccucuggaggguguacugagggauggaaccuagagucucacaucggcagagccaggguucugccccgcccuaggcaggggcuccaccccugagccacaucccuagcuccucauuaggggauucuaggugggacuccaccccugagucacccucccaaccccucacugcuggauucuggacaggcucaacccuugaccuucugggcaggggcugauguauaucucaguccuuuuugaucuguuuuacaucgggacagcaccuugcuaagucacccaggcuagcuuaugucccaguucccaguucugcgucagccuccuggauaccagagaugaugugcauacaggaccaugcccaguaugcuagggucuugguucugaguauugagaucuuugcucuucagccuccuuuuauuucuccuucuacagaacaaguuuacauguacauucaccuacgcuucccaaggagggaccaacgagguaaguuccucagggugucacacgacuggugucaagggaaaguggccagacucccgaggcucuaaagucccagucccuugagccugaaggacuucuaguugccuuggcuuccgccuaauggaaucagcagcccacagugcugaucccugacucuuagucuauguguaaucagugagccaccagagccugggacaguccucagggcagcccguaagcuggcaagagggccgauaccucagcagcacccagggcaucgaggugaacuguuaugagguuagcugccugucccacacacaaguuaguucauucaguggaaauacugguguauccagaaccuuggacaugcauguucugagcagagcuuuccauaggagcaaugaguggaagugucuuaguguccacggaugggcagggguacacagcaccucaacaguuggaauaucacacacccgugaacaagagcguugcguauggcauggagaggguuaacagcccugcucguggcaucgaaugaaugaguuuauuauguacauagcaaguaaggaaaagaaauggagaggcuacagacagcaaaaccaucuucaguuaaguacucaaugagcagaaaccagcaugcagugaccacagaggcccaaagugggcaucggaucuccuggaacuggaguuacaguugugagccaccaugugguugcugggaaucaaagucagguccucugcaagagcagccagugcuauaaccaccgagccaucucugccgauccuugguuagugaauaagaagaaaccaucugaggaagcaagauggcagucagcuggagagcccaugggcaagccccuaggaccuagcucccagccuauccucuccccucuaggcaggguuuuuaagcacguguauguaguuggauguguggguguaugcgcguguguuuggcucucugauguuagaggagcuuggguuauugagugguugugagcuguccugugggugcuggggacugagccuggguauucuacuuagacucaguacugcugugaugagucaccauaaccgaagcaggcuggguggaggguguggauucaggcugcaccuccauaucacuggcaucauagaaggaacucaagcagggcaggaaccuggaggcaggagcugaugcagaggcccaugagggugcugcuuacuggcuuacuccucauggcuugcuuaggcugcucucuuagagaacccagagccaccagcucagagagggcuccaccaacagugggcuaggcugaucacuaauuaagaaaauguccuggaggcugguggaaagucugauuuuauggagguguuuucucaacuaaggacuccuccucuccugugacucuagcuugagaugaaacuguccaggacgagcagcaccuguuccccgaaccucucuccagcagucuguaguuagcuccuggaguggcuuaugccugcaguugucguugcugcccauuaccaggcugggccaucccucccuccaagaccauggagagagugccuugagaucccacuuccagaaccaguuucccagugagcucaaggagagugugacagugacgauuucuauuacaaggagagcggcacugacaccacccaagucuagagggaccucaaggaugcuacucagugagagacagagacacaagucacgcugugggauuccauuacaugaaguauccaggacaggagcccugagauagaaaguggaugcgcugggccagagagaggcuugagggaaggcucagcauggggcugccuuuuggacugauggaauguucuagaugcaagguagucauggcugcacuguggacuucacacggugugugcuuuaaugggaaugauccaggggauggacauuuucuacuuuauucugugagagguuuuaggguuuggcugugccagagauuaaauggcuauaagagggcccaguagcaaguaggauggauggcagcucucuuguggcugaggcaggaggaucuggaguucaaggucauucuccacuuuacagagagaucaaggacacaagacugucgcuaaagaaaaagcaagguguggacccccuugagcagcguuucucagaugggcuauuuucagacugcagaggcucugggaacagcagagccaggaauuagcaggucuguggcgucggcaggaaccacucagagcuggccccuggccuuggcaugagugcaguuaggucucagggcuucaccuuggggagaauacacacagcuugcugcaggguccccuuguaauugacacagguagguccuggccaugagagccccccuugggaagccaggaagggcagugaugggcgcgucucugggugagggcuggcagcgagggccgcaaauacucugugagaacuggcuaguuguuuuguggauuuuguucuuguuuuugauuuuuauguuuuaauuuuauguguaugguuuuuacuugcauuaauuaucugcaccagcugcauaccuggugccuguggagaccgaaaaaggacuucagguuuucuguaacuaguuacagauggcugggagccacugugugggugcagguaacagaacucugguccucugaaagagcagccugugcucuuagguacagggcugucucuccagcccuggcugguuuuuggcuuugguuuugguugauuguguuggauuguuggcuuuugauagcccaggcuggaucccuacacuuuauguagcugagacuaaauccuggguguccugagugcuaggugcuagggugacagucauuccccauugcccaugugcaaacuacagacauucucuacugugcaugcgcacaccacggauccaugcaggacaauuggaaacaggcuggguggugguccugcgacccugaggaagcugucagugaguguguuggcaccaaggcacuggacggaggagggaagggaggaggagauggcagauagcaagcagggccuggggaaucuagaguggagcuagagccccgugcuguagcugauccacaguucccaacugaauuuagacagggucuuaacuguugccacuuguucucaagaugucuuacagguaaaaaagugacuggauagugcccuccaccagcagggcagugucuguggcucuaguguaggauacagagccuaggagggaccauguguagccggccuuuugaagaccugcuaacaccuguccuugcucaccaagccuguccuuucuccccagcaauggcagaugagccuggggacaagugaagacagccagcacuuuaccuguaccaucuggaggugagcugcugugcacaugcugggcuagaggcucguucucucucucccucucucucucccucucucucucccucucccucucccucucccucucucucuuucuccagcuacuuugcaugcacacaccacaguccaugcaggacaaguaggcugggcagugguccugcgaccccaaggaagcuccaguaugugugcuggcaccacagcacugggcagaggagggaagagagaggaagaugucagagaguaggcagggggcuggggaaucuggucacacaacaggaagucaccaaaacacugcugauucuauuguucgguucuggggaaacagaagccaggauaccaggagcucaaggccaguccuggccacagaguuagcugggggccauucugagcuuccucagauccugucucaaaaaccagucuugaaacaaaaaaagaaaguauacagcaggcaauagcccugaccccagagcugucauccgucccuuccccacucccugaccucagagcugucaccccuaccuuccccacucccugaccccagagcugucacccgucccuuucccacucccugaccccagagcugucacccgucccuuccccacucccugaccccagagcugucauccgucccuuccccacucccugaccccagagcugucauccgucccuuccccacucccugaccccagagcugucauccgucccuuccccacucccugaccccagagcugucauccgucccuuccccacucccugaccccagagcugucaccccucccuuccccacucccugaccccagagcugucauccgucccuuucccacucccugaccccagagcugucauccgucccuuccccaaucccuggcgcccacagaacuacuucuuaccucuggcuuuggcauccuggagauuuaccacuauggagucccacaucaccaggcucuuuccggggccucaguuggguccucucccccucccccauuccugugcuaacucugucuuuccacaggccccaggggaaauccuaccucuacuucacacaguucaaggcugaguugcgaggugcugagaucgaguaugccauggccuacgugagugucagucacggggacccgaggacaaagggaccugcaaggccccagauaccauucacugcaggggacagggccccgugucacucagccacccuguugaccccuagggcucccacccaaguugaggggaucagcgggaggcccacuaugugggugguuccugcagaguggcuggaggagccaggguggccucggucagcuccugucccucaggcagucaaugauaggcucuuccucacaguaccagugcccucagcagccucaccaaguguguuucugggaaccaaggugacagacugaggcuguccaucaccugugaucugacccacugcuugggcucugcugggacuacucccugggaauaccacacccgcccuagcaagcaugccugacuuuaggccacagugcccaggagacaaaacugaggggacccgaggggacuucucucuccaugacgugugucugcucaaguguucuguuuuauuuuaguccaaagccgcauuugagagagagagugaugucccccugaaaagugaggaguuugaagugaccaagacagcagguaggugaaggugggucccagcagugggggguacgccauuacccagcaagagccauuuggagagaucucuguggaggaggguccucgugccugugcacugcagaucagaaacugucucgagaaagggcugcaggcuaaauucaagcugcuugugggauggacucuguguugagguuguuccagccaguuugguucacagcauccuagucaccaguacugguccacuuucuguugcugugacaacacaccugaggcaagcugcugcauaaaacauaaaggaccauucagugcccaagucuagagguucaagugcaccagagcaccucugcuagacucugugaggaccuggugagggagacacuggcagagccagggaagacaguccacauccccccaugaacuuacucaaggcuucacuggggaauucuaggcagacgcuccaugccugcaacgcccccagcucccucacagggggcuggggggagggggauccucaacaaggacuccacccucaccaugcccacuagcccucuuuguaauuucccagucuccuuuguaguuccccaugcagggcaggaucuccuugugucacacugcccggcucugcaguuuucuauuuucauccaccucgcgcccugucagaccuggccucugucggaccucugucaggguuuaauugugcuugugucuugcagugucucacaggccuggggccuucaaagcugagcucuccaagcuggugaucguagccaaggcggcacgcucggagcugugacccucgccugucaagggccuucauguccacguuccucaggcacacugaccgggacuacuugucuagggcacugguucccauaggagcugcccugcccugcacaggucacacugugucacuccgcagaacucucugagcccggucaccuguuuugccagggaagaugcagggcaugugcgggggugggauggaaggacuuccuggcuuuccugaagucaagauguggugugguuuccccucugagccacagaugaguguccccaucccaggaccacuuucuaaccccauccagggcagcuccacucagaaggaugggaaaggauagaaaaaauaaauaaauaaguagccaccuuagugguggcucuguggggucaggacucagagauggauucucaucguuuucuacaauagcagcaggugcaggcacauagccucuccuaauagugacugucacauaggugccagcacagugggucacaacgcaaccaaugacuuugcacccacaaugacuagucacucucucucuugagacacaaugaugccuugaauccacacuguguucucuaguacuaggaccacagggcaaggccacuguccccacagauuuuggauucaggauuuugaagucaaaugaaagcaacauguuuuuagauuuaucuuaugcucucucugugugugugugugagagagagagagugagagagugcugugaaucucugcuguuugugagagagugagacucuguguguguguguguguguguguguguguguguguguguguguguguguguguguguguguguguguaagagagagagcugugaaucucuacuguuugugugccaguggaaacaagagggcauugcauuccugacacuggaguuacaggugguugugaaccucugcaagagcgaccaauucucuuaacugcugagccaccauuacagccuuaguaagaaaucuuaaaauaaguaaauaaguaaauaaaacaaaggguuagagagauggcucagugguuaagagcacugauugcucuuccagagguccugaguucaauucccagcaaccacaugguggcucacaaccaucuguaauggcauccaauguccuuuucuggugugucugaagauagugacaguguacucauauaaaugaaauuuuaaaauuaaaaaaaaaucaaacaaac

SEQ ID NO: 8676 - RNA, 1092 nt, Mus musculus
cacaucaccaacgugggauuuauuguuccaggcacgaggagcacacacuugucaccccagcacgcagggaguagaggcaggaggaugagaacuucaagaucaucuuuggcuacacaaggaguucaaagcuuggucuacaguguuuuaaaauaauaauaauuauauauauaauugagagaaaaacucuuuuuaaaaauaaaaagaacuugagauuuaaaguuggauugaggcuggcuuuccccucaccacuucacuuuggaaauuaguacacccagaggcacucauaacaucucguugaccaaaugcuucgccuguacucugugaguuugaagccagccuagucuacauagugaguuucagaacagcuagagguacacacaaaaaaacccuguuucaaaaaagaaaaaaaaaaucccuccguaaaggacaaaugccaagaaccauuaagagguuccuucccuguacacucuccgccagaacagaccccaaggcgaucccugaagcuggguguugagagcuuggcacugccaggggccgggugcugaagccuagucucuucgugacccgcugggagcuguccgaaauccuggugcugaagccgaacucugcuccgagucccucagccggauggcgcuguccgcgucuccagugcugaaacauaauuaguuauugggggaggggguggucagugcggcucgaggacacucucccagcuucugccuucugccaaaaugccccgcuccuuguuucuguucuucguccuagggacccaucuucuguuuuaaucucuucccauggacccgggguguucuaggcggggacgaaggcgcaaggcucucaccugcucccacaucucagggagacagcccuggguucucugcccuuccuaaacaguccaguuggccuucuggaagaugugccaacuugcauuguacccagaguccccgcuucccucccucagcgcaccuuuuccuccuuccuucgugccuuaccuucuccugcucaccagcagcugcaggugucucgguggcuguccaguuuccgacguuucaccuuuaugcgcuuaaggggaaggcggagcgcuggaaaccc

SEQ ID NO: 8677 - RNA, 1974 nt, Mus musculus
gccuuuaaauuuuuuauuuauuuaauuuuauuuuaugugcauuaguguaagaucccuugaacuggaauuacagaccaguugggagcuaccaugugggugcugggaauugaaccagaguccuuuggauaaguagucagugcucuugaccacugagccaucucucuagccccgcauguggcuccuuaaaaaaagaagaaagaaagaaaaagaaaagcuaacgugaaaaucgagacugccuaacauuucugcaaauagcuaaaggcgaguuggggugcgcugccagcucaagaucuuacacucggcgcgcgcccccugcuggucagcaagccuuucguagaagcccuucgccuuccaccucgcuccggauuggcugggaguugccuuuguugcccgcugggaaauguaguccgcaaaggaggcggaggcccauucauuuccugccugcgcgaccucgaaaaccggaaguacagcaccacgcuacccugggucguccgcaagggccgccgagccuugcccgauacgaagggaggcuuuuuauuuacauuucgucucgcgggugccccacggcgcugugggaagcgaauuccuuuuucccccacuucauguuuuccuguggauucugacaugaaugacagaaugcacauuaucaccuggccaagcugcucagagccccucaaaacaugguguauuuccaugaugggaacuguagucuuucaaugguaccucgcccaguauucuucgagcuaaagcucggacuucuugcccugucuagagucugugucagugacaguaaccggaaguaugucaucaaauacucagggucacauacaacuuuauagacuugcaugguaggaauugaaaacugagacccuuuugagagacguccuuuugggaacugagugagaacaugcugccggcaaucuccgccuuagagucaauaccaggaaguaugucaccacauuucccaaggaucgcacuaaccauuggccuugcuuggcggaaauugccguccugucaccgguuccccccuaucccuuucgggaaauguaguuuuuucgcuuuucugauuccaguaucauucggcgggcgaucgcucauaggacuccauuucccagcaugccugugcacacucuguccucgccccuucgcggcggccauuuuauuccucccggagacccgcuaagaugacagcccgggagaaggugaagguugucucuggcgaccggcggcccggcuagauccagcagcgaggcuuccagcauggaucugcacacagcgguguacaaugcggcgcacgacggcaagcugccgcugcugcagaagcugcuggccggccgugggcgugaggagcuggaggagcugcugggugagguggccggcgguggcacgccacugcuaaucgcagcgcgccguggacaccuagacgugguggaguaucugguggaccacugcggcgccagcguggaggcgagcggcuccgugcacuucgauggcgagaccaucgagggcgcgccgccgcucugggcagcgucggccgcgggucaccuggccguggugcguagccuucugcgccgaggcgccucggucaaccgcaccacgcgcaccaacuccacgccgcugcgcgccgccugcuucgacggccaccuggacgugguacgcuaccuggugggcgagcacaaggcggaccuggagguggccaaucgccacggccacacgugccuuaugaucuccugcuacaagggccaccgcgagaucgcgcgcuaccugcuggagcgcggcgcacaggugaaccggcgcagcgccaagggcaacaccgcccugcacgacugugcagaaucuggcagccuggagauccuacagcugcugcugggcugccacgcgcgcauggagcgcgacggcuauggcaugaccccgcugcuggccgccagcgucaccgggcacaccaacaucguggaguaccucauccaggaacag

SEQ ID NO: 8678 - RNA, 7470 nt, Mus musculus
cggaaccgaacgcucccuccucccuucucucuccuccuccuccagcagccaccagggaccgggagaucuaccagcucaagaccccuacagccagguaggaugaaggcagagggaacaggacggcgggccggcgggcauagggucgggaauagaugcugggccggccaccugcaggcugccagguuccucaaguucuuucccauggauacucagauccgcaauccaacuccuaacucccaaaccagcccugugacccugggugcucgcucaguuccuaguuacccccccccccccccaaccuccauggcuagaucuucuaagucccaggucuucuccagccccaacagcgaauccucaacccucuccacccucaaucccucccguugucgcuauuuccugaucagaucugcuuucucuaccucaauguucccugucaaaauuccugccccagacuaacacagacaccaucuacuacuaccuguggggacuggcuugcugcaccuucuacagucaacuauuuccggccccuggauacaugcaaggucacccuggcaguacaaagucccugaguuccagagcugacagucagcagagccuggaggagggccccccugugccagagacuaaguucugccagggagagaaggccagggaagaaagaaagaggccuauuuaccccauccacucaccauccacccauccugguuucugcuguucuggggauaucacacagucucuuaggcaugcuggaugcuuuuuuuuuuuuuuuuuuuuuugagacaggguuucucuguguagcccuggcuguccuggaacucacucuguagaccaggcuggccuugaacucgaaauccaccugccucugccucccaagugcuaggauuaaaggccugagccaccauugccagacuggcaugcuggaugagugcuuuacccacugagcacaucuccucccucuuccuaacucuccccucccccuccccuucuccuucccuccuucuuucucucucucuccuuacucuccccuuuccucuucccucucucuuaaaaauaacuaccuuuauuuuugugucauuuguguuauuuguaucuuuuuuuuuuuuuuuuuuuuuuuuugguuuuugaggcaggguuucucuguguagcccuggcuguccuggaacucacuuuguagaccaggcuagccuugaacucagaaaucuaccugccucugccuccugaguacugggauuaaaggcgugcgccaccacgcccagcuguguuauuuguaucuuaagacaggguguaucacuaugcugaccaggcugaccuggaacuuaccuaaguggacccugaucucuuggguucaagaauccuccuguuguugggcagugguuguacauaccuuugaucccagcacucaggaggcagaagaggguggaucucugaguuuguuuuuuuuaaagauuuauuuauuauauauaaguacacuauagcugucuucagacauuccagaaaagggagucaaaucuuguuacagaugguugugagucaccauaugguugcugggauuugaacucacgaccuucggaagagcaguuggugcucuuauccgcugagccaucucaccagccuggaguuugaggccagccuggucuacagagcgaggugcaggacagccugggcuacacagagaaacccugucuugaaaaaccaacccccccccaaaaaaaaaaacccaaaaacaaaacaagaaagaagaaagagggcuggugagauggcucaguggguaagagcaccugacugcucuuccaaagguccggaguucaaaucccagcaaccacaugguggcucacaaccauccguaacgagaucugacucccucuucuggaguaucugaagauagcuacaguguacuuacauauaauaaauaaauaaaucuuuaaaaaaaaaaaaaaaagaaagaagaaagaaagaaauccucugucucagcuuuucagauauagcuuggacaagaggaagcugcugcccauacaugguggaggcaggaggaucagaaguguaagguuaugcugggcuacauagugcaaggcccaauccugucuuagcgacaaaaaaagcaaauaaaacacaaguacuguguguccugcucuguuuugucuauucacugcucagugugucaauaaacauuucucucuccugucugcucucuuucucuccucucucugcugcuauccucuuuccuggcugggagcugaaugcagggccucauguaugacagacaagcgcucugucaagucaacugcagcuccacaccucagugugcacuuauuaggcacuggcuguguaccaggcacuguccuguuccuauuguucucacuauguagcccugggaacucacucuguagaccagggaggccucaacucugagauccuccugccuccuccacugcuaagugcugggauuaauggcgugcacuaccaggcccaucgguuuauuuuuauuucauuuuguucuuccaccacaugggucucaggaacugaacucagaucuucagacguggaagccucucaagcacccuuauccacccagccaucuugucgacccucguggagcaguuauugugcaccuacugugugucaggcacucuagauacaggaacuauagacaguuguaucagagcccugccccuguggaguccccagauuggucagguaggaggacauuaguuagugugagguugugaagaguugagagaugacuccagcagguguguugagagaguugcccacuggggaggccagugggcuacugcacugagguuuuguucccaaaugguugcuauugcugucugagggacagccgugcaaagguccugagguaggacagugcauuucagucacagcgcaguaaggucagagagaagagagggacaaacgaugcuguauccucugacuggugcccccucaccccacaguccauccucuccacagcacacaaaggguucccaugagcauagaugaaaguuuccucccugugaccugcccacagcuuuccugggcucccaccucccugcagcccaccaggcccuggccgcccuggccauuccugcccugccucccucugcuccggccuccucacuacugcagcuugccaggauccucuugcuguacauggggcugagcccugugucccagggccuuugcacugagugcucuccggaagaacucaccuucaggggcgaucaacucuguggugcccucccugaggcauccuucaccccggguuccgucucaggcucauuuccuccagggcacuuuuauuucuugaaaugaccuuacacgguuguucucauuuccuguugcucugacagaggucagcagcaucuccugccgaaguggccagacacaguaggugugggagaacuggucagccuaugaggggacugcacaagugcggggugagaaggcuggacgugagaauggaaguagaguguccuagaaauggguagaguuuuggugugguggggaagucaggacugggacuugguugcuagggcuguguguguccucugcuccagggccuuuauaugagcugcacccuucacucaggcuucuccauuuuugugucccugggaucuauaaacacaagccuuaguccuuggaguucuugacccuuuccggcuuaguucugcagcacugacccgcugcaaacauuacccauuuuucucuggcccaggguuauauuuuucuguuucuuuugucuccacuaucacugccucugccugcauagccacaccugauugcccccauuucccagcagccacagagaagguggucacccucucucucagcucucucucucauuccuggucugccaucagcuguuaccacucccaccugugacuguugcucugccaacgguuguaaggcccuucccucugccuaccuggcucucaugaauuuggcacugagcccggccccaccucugcugcucaaaaucaggucuuugaaggcuuuaggucaucugugugcaaagucuguggguuagcugacugaccuguccacuucugguuuagcccaggguccucugccuugggcauuuucucuggggcauuguaggcugcuagaugcuucccuggccuucacgcacucuaugccagggcucucuggucauagcagccacaucugucccugccugagcggagcaggcagugaccccccauuccagccugccuauggaggcaggagaggugucagggucccgaggauuggcagaugcucugcggucuucucagcugugaacagggagcugggaauaagugacuguccaccugaggguaugccaguuuaugccacauccacucacccacucauuaagagcagucacucaucaccacaccuuguagaugcagcgcugggcauggaacuuggugcuccaugagugcucagccaacagcacucuaccccauggacucagcccucuuccugauuugacaggcccgggacccuugccucugccucccaggguugggguugaaugggugcagcaucuugucuggaaagucaugaugaacuccuacuccugcaggucugugcugccgcccuccagcaucuuugcagcaggggacgaggcugugugggaggcugucgguucggaacaugucuccacccaccccacccucuguggcuccaggcuucauucucccccauccauggauaacccagggccuucgcuccguggugccuuuggcauucuaggugccuuggaaagggacaggcugacccaccugaaacacaagcuggggagucuguguucaggcagccaggagucaaagcuucuccaugccaugguacuccuggcucugggccaggacacggaggccagggucucucuggaguccuugaagaugaacacaguagcccagcugguagcccaccagugggcagacauggagaccacagagggcccugaggagccuccagacuuguccuggacgguggcucgccuguaccaccugcuggcugaggagaaccuguguccggccuccacaagggacauggcuuaccagguggcccuucgugacuuugccucccagggugaccaccagcugggccaacuccagaaugaggccugggaucggugcaguucagauaucaagggggaccccagugguuuccagccacuccauucucaucaggguucccugcagccaccuucagcauccccugcagugaccagaagccagccucgucccauugacacaccagacuggaguuggggacauacguuacacuccaccaacagcacugccucacuggccagccaccuagagaucagccagucacccacucuugccuuucucucuucacaccauggaacccaugggcccagcaagcuauguaacacaccgcuggacacucaggagccucagcuugucccugaaggcugccaagaaccugaggagauaagcuggccuccaucaguggagaccagugucuccuuaggguuaccacacgaaauuagcguuccagaggugucuccagaggaggcuucgcccauccucccugacgcccuggcugcuccagacacaaguguccacugucccauugaaugcacagaguugucuacaaacuccaggucuccccugacguccaccacagaaaguguuggaaagcaguggccuauuacaagucagaggucaccucagguuccuguaggagaugauucucugcagaacaccacgucauccagcccuccugcccagccaccaucccuccaagccuccccuaagcugccuccuuccccucuguccucugcuuccuccccgagcagcuacccugcuccuccaaccuccacauccccuguuuuggaccacucagaaacaucugaucagaaauucuauaacuuugugguuauccaugccagggcugaugaacagguggcccuacguauucgggagaagcuggagacccucgggguaccugacggggccaccuucugugaggaauuucaggugcccgggcguggugagcugcacugucuccaagaugccaucgaucacucgggguucacgauccugcuccugacugcuagcuuugauugcagccugagccugcaucaaaucaaccaugcucucaugaacagccuuacacagucugggaggcaggacugugugaucccccuccucccacuugaguguucucaggcccagcucagcccagauacaaccagacugcuccacagcauuguguggcuggaugaacacuccccaaucuucgccagaaagguggcaaacaccuucaagacacagaagcuccaggcacagcggguacgcuggaagaaagcgcaggaggccagaacccucaaggagcagagcauacagcuggaggcagagcggcaaaacguggcagccauaucugcugccuacacagccuauguccauagcuauagggccuggcaagcagagaugaacaaacuugggguggcuuuugggaagaacuugucacuggggacuccaacacccagcuggcccggauguccacagccaauaccuucucauccucagggugguacuccaguuuuccccuauuccccacagccuccauccuucccucagccuccaugcuucccucagccuccauccuucccucagccuccauccuucccacugccuccagucucuuccccacagucccaauccuuuccaucagccuccuccccagccccacagacuccaggaccucagccucucauuauucaccaugcccagaugguucagcugggugucaacaaucacauguggggccacacaggggcccagucaucugaugacaagacugaguguucggagaaccccuguaugggcccucugacugaucagggcgaaccccuucuugagacuccagagugaccagguuggaccccaccuagauggcuagagugacaagauuggacuucaccuggguccuuaaaaugauaguggaggaagggaaccucgccuggguccccagaguagccagaggacuuagcuugggcucccacaguggcuauuaguuggacccagcuugagaccccagaggcagggaagaccacaccuauaaaucaggccugggaaacaugcagaaaccccauuugaacagacugugggacuccaaucugaauccucuauguggacagaggaugauggggccagaggcaccucugaggugcccucagcgcagccucguaaacuucauucacugugacacaugcuguucauagggucucucuggggaggaugcggucccggggcacauagggaggguccuguuuuuauaauaaaguuauugacaacugagucauaagccagcgucaccacacucuaucgucuucagggaacaagcaggauacgacaacucugccaugacuggaauagaaaaggaggucggcugacccaguccuugagaggcaggaaacggaaauuauguaaauauacucaucccauuggu

SEQ ID NO: 8679 - RNA, 15400 nt, Mus musculus
aggagccaccaggcagcaugcaggguugaccccagagcccagagaagcaagggaccaaggagaccugcugcaugccucucacaggaccuggaguggccaggaaaugguggucagaaugugguggccagagaaaggaacgcagguaacucaagggccugggagaagccaugccaaccugguggaccaugggucucagagccguguucuucccccaagcuuaccaccgccacuucacaggguacagcagcagcuggcugccacaaggcucaggaggguggggacagacagagccagguucugcauguuaaaugacccccagcuuccuguggugaggggcaggacacccccccccccguccacgguccacgugagaaggagacauggguagcagcuggccaucaggucacugaguuacagcaagggcuuguggcuguuaauuauccuucaaagaguaaggacacagaccgagagcuccuguuucaucuagcaucuuccauuguuuuuccugcuccaaucucauggaacucaggccggccucaaacucacuggguaacacuugaacugauuccccauggucccccugccucagcucuggcugcuggagugacaggcaugugccacaccugguggaugugggguggggggugggggcagaacccaaguuuuguguauacugauugagcacugugcacuagccucuaauuucuccucucauuccaucacugggagacugaagccggggagggggggggggauauggccucagucagugagacaaaguaaaagucccuuagaggccagugaaauggaucagugagaaagggagggaguggcugccaacucugcagaucugagcuuaguccccaggcucaacaacgguggugcagagaaaugacgucccacgugcucuuuccugaccuacacacacacuagugguagagugccccccuaaauaaauagguguaauauacauuuuaaauuuuccuucgacuccccucccaauauuguuuuguuuuuuaagacagucacuguguagcucuggugguccacccaguaucccucuaaagucuuaaugcuauucugcuggcgugacuucccacuggucucugaaugcuaccaagcugagaggguacagacuauguuccuggggcugcccuacaugaccuuuguguacagcaugugccuaauaauuguugaaugccuguauacacagcuaaugagccaugggccaggcccaagguuaauaggacaugcuuucuacggcaccgaugggccuagacacgucaggggcacagagagggagaggcgccauuguggaaagagaggagaggggagccgucgggagggggucacagagagaaggucgcuguaggggacacagaguggaggggcucuguaagggaaggaacgcagaggcgcuagaggcacagagggaaguggcaccguugggggacauggcggggaggggcgcagucgcgagcagggcgccaccugguggcaacaugccccaucccgccacugccccugugaaggcggcauuguucacuggaagcaggaagauaaagaacucagccugagucaaggcagcucagaaaaaaaaaggaggggccgggcggaagucuggaaagaucugagguaacucaguaaggguggguccucuccaggccuggcucacauccgugcaugcgcaguugcaaaugcccgugcacauuuucacaacugcacacguagucacacccucaacaaaaauacauucccuucuuucuuagcuccugcagccgucugagguuaacacuuggcuuacaggccaaggggagaaagaagauuuagggaugagaaaaaaaaaaaaguccaggaggugucugucuucaggaaaggauugauccagggguccaggagcagaaagcuggauacugcgcauggcuggccauaucagggccucagugcccucguccagaggacuugggacaacaagaaccucaaucuggaugacagcaacuuuuccuuuaggacccaaucagggcugagguucaggguguguaaccuccuggcauugauuucccuggguccgaugggcuucuaaaaaugucacucaaucaguccuuggaucuggaagccucucuaaggucucuggaaacaugggaggauucaaggaccccagaauggcacuccccucuccccuccaucuaggaucaggacuccaagucuuucugggacucaacuaaugcaagcaaccugggcugggucgccuuagaagggugggcggaacuacgccauagggaccucugauuggcccucuguccugucacuccaaggccccucccuccacgggggaugcacaaggccgccccgccccacccgguagauccaagcuggacuugguaggggagguuuccucgcuuggacgaccugaggacuuuggugagagcuggggggcaaggggcaggaucgaucuugaggcgcccuuagagaggagggagaaacgaggcuuccugggaggacuccgguaucccaaaaaucccugcacgcuaggaaacccuacuucuagagacuaacuuuuacccaaggacccaacuucugcagcgcuuccaacucuuggccuggccacccuaggaccuuagcguccucgucagugacggagucccugagcguccaaaaagguggauuccacuguccuggguccccagaauuagaguuguguucaaaugcgagucccguguguccugggcugcggcuccucccucuuccccgugauucugagucuccuguccccaagaacaaacaaccccgcaggcacagucacaaauagcuucaccugccgugcacuaacuagccccaggcccuggauccuacauaaagccaggccuguuccacaggaagcugugacccccagccgagcauggugccucccucuguuggaaucucucaaauuuaauguuuuguuucugucuuguuaauuguuuuuggaaauggcccuacgcuaaacuuagggugccuuggaauuugccuccaccaaaaaugcugggaugacagcauugucaccaaaccaggccgaaagacucccuuaaccacuucuaagccuuggcuacaugcugguuuuuugacccugggggcuuuucuggcuuucuuugcagagaaaguaaucuggugggcggagugugugggggagggucaguuucaggcagcuggagccggguguagagagauuagcugccacaagugcucaaaaagagcaaaaagcccuuguuuuucuccagcggccaccauugcuuaggaaggggagcuccaggggugucugacuccucaggcuuugccacccaccuuaccgaugacaggaaggcaugaccagcaucaccugacucccguguugggaaaucuuuaucgcaaaccuaacugcugcgguuugccagacuaguuuauugagcacccacugugguuuagcugccgauuugagcauucugcagacaacgccaagcaaucucauaaagcccaggcuggccuagaauucacacacuggguaguggaagauggcuuugauuucuaaccuuccucaagugcuggggugacaggcaugugccaucacacuugguguuuguuguucuggggcaucuggaaggcccagccccaguuuuuaacugguuuuuaaacaaaugauaucaccuaccuguccuaaaauucagacgccaggcuucuaccucugucugaacucuguccuuaguccauuaagcuuccugaucuucuaacauucuauguaaagacaagcagacuccggcugcaagugaugauucaguaguuaagagcacuuccuguucccucaaaggaccgaggcucaguucuuagcaccagcuucaggcuccuuauguaaccuaacuccagcugcaggggucugacucuccugaacucuguggccacugcaugcacauaagcaaaacuaaaauguagaucuuuauaagauguauuauauuuguuuauuuuugcuuuauguuuuguuguaacugggucucacucuguagaccagguuggccugggacucacagagacccuccugcuccaacucccaagugcugggauuaaaggcgcacaccuggcuuaucuuauuuugaguuguguguaugcccguguggauguggugccuguagagaucacguguccuugaccuugaguuacagguaguugugaaucccgugcuaugggugcugggaaucaaacucagauccucugagagagcaauacuugcuuuguaccuccuaacucccaacauacucuuuaaggagagagaaagagaaucuuggauguuucagacauuugccucugaacuucuuggcuugcaagaggucucugucuugaacacacaggggcauuuguuagacuugaacacacagggacauuuguuaguuuguuuuuguuucuaaguccccuucugcugggacuauugucauguugagacccacaaaugggcacagcugugggaacagugucaacugucuggucacauggaagaagacugugaggaaacaguacccuugagagagguauaggaccugaccuuaaugaauggcagaagugagcuuuaaagggacaugucugccggauggauguggccuaggacccugucacaaccacccagaguuagggguucuaaaggcauaauuaggaauggagccccugccuagaauccccccuaccccauuaggggcugagggguguggcuagggguggauuccuaccuagaaccccccaguaagggggcugggguguggccagaagugcagcuuuguugagugugccugaggaacuggguuggcacuucuccagcaccacagggucagucagcaguuggggcggagcuagggugagcuaggccccaccuuggaccuugcugacggggcccugagagggcugaagguucacagaucaacugugcugcuuccuguguuccuggcuuucccuggagagagggguagggcugguugucacuugacugucuucugcccacagcaacugcugcugagaccaugucuagcaaugguacagaugcgccugccgaagcucaagcugcuauggaggaaccuguugugcaggugaggggccugagcuucagggagcccugggcuccugaguucuguggcagccugcuggggucuggaaggggcuagcuaggaggggaguuagggggucucccucccuccuuucuucuuuccucucucuuuucuuuucuuuuuuuuuuuauuuuuuuauuuuuuuuuuuuugguuuuucgagacaggguuucucuguauagcccuggcuguccuggagcucauuuuguagaccaggcuggccucaaacucagaaauccgccugcaucugccucccgagugcugggguuaaaggcaugugccaccacgcccggccuuuuuuuuaaauuuugagacaaagucuugguauguagucuaggcuaguauggaacucacagagauccccuaugucugucgucugaaugcuggagauuaaacucuuagauccagcccuucauuuuuucuuugcuuucaauacagggucucauguagcccaggcuagccucagacccacuagguggcugaggauggcuuuaaaccccugauccuccagccuauaccuccugagugcuggaaugagugcucacgugcacuuucucuaucauucuuuuucucucccccucagcucucugucucucucucucucucucuccccccugucucucugagacagugucauuuagcucaggcugaauuccaauucauuguguagcccaggacaucaaagucauccuagaacccuugagggucacagccugugcuggaugacgucaugcgccauuuuccucgguuucuaggguugggaauggaaccaagggccuguuaugugguuggcuagugcuuuaacaaaaaugcaguucuucagacaagcaugauguagcugcagagguaggcaaaucucugugaguuccaggccagcauggucuacacagugagacccauucucaaaaauacaagaggaaaccaaaaaaaugggauuucucagucacugcacuuccugacaccucacuggguggucaaccccgugcuggaaccuucagcuuccugcuuugugcaauuguuggucccaggagugguguagcccagcugaucuauccccccccacacacacaaaaaugagagcauaccgguaggcacccugagcuucucaccugguccccugcccuucacagcccagcgugguggaucguguugccggccugccucuuaucaguuccacguaugggauggugagcgccgccuacaccuccaccaaggagaacuacccccacgucaggacugugugcgauguggcugagaaaggcgucaagacccucaccacggccgcugucagcacagcacagcccauccuguccaagcuggagccccagagugaguugaggaccccaagguguggagggagaaugccucucauuuggaaggaaucacccccacuucugaucuccaauuccccgaaaccaguccugggcgucucugcccaccauugagggcauuuaccgugaauguguguuuucuccccacaguugcgacggccagugaguaugcacaccgagggcuggacagacugcaggaaagccugcccauccuccagcagccgacugagaaggucagugcuaagucaguugauuccaucuugaggccgugucuggaccugccaaguccugcugcgugcacagcacagggcacaugugacaguucucaccguccucaccucuacugggcaagaaggucuuuaagguuggccacauucagucaagaaugcccucuggaucccaccgaacccagagcaaaaggcacacuggggcugucaucugggucuggccccucgacuacuaagcagaguuuagauugugguccacacccuuagacacggccuuuggaagggaaccuaaacccaagaagacggauugcagagacaacagaugcauacgugagaucugccccaugacuuuuacaugcgcuguuccagaaacucagcucuccgaucuguagaaccuccauccaccaaacccaguguauaacuggacagccaguaggguauuuucuugacagggucuuacugaaauagcccagguggcuugaaugcugaccacgccccagccucucauuuggggggcuccaccccugaucacacccccagcuccugacugaggaauucuaggcagaauuccaauucuggucauaccuagucccucacuggggacucugugcaggagcuccaccccugaccaagcccccagccucucucugagggauucuaggcaggggcuccaccuagacuccauccuaucuggucucugaaucaaaggcuggguggcuacuuugcuaugggagcacacuuucuuuucauguucuugugggcuaggccccuauccuauacuucuguauaccaugcccaggaacaguuucaaugccuggacaagaggacauucuggguuugauggcaucuggaugaccugaggccugaggcaacuggaggccucccagcagcucuuucccucuccuagcacagaccugcuuuaaagugucuucacagugguacucacauuauagaaguucagggucagguucucuagacucgugagguagcgccuauacagaggcucugggccugggaguugggaaggucucuuuacccaagccacaugggaccagggugugaccacccuggcauuugaaccugggcuauuacauagacugcagcuacauagugaguuuagguuuggagcuagccugggauacauaagccccuauguccagaauaacuggggccaagauagcucagugaguacaggcgacugcagccaagccugaggaccagagcucaauccccaggacccacaaagcaggagaaaaucgacucccacaaguuguccucugagcuucacacaugugcuguggcacauaagaaguuuaaauuauuuacuuaacuaucuaauuaaucaauuagaggcuggcgaaaugguucaguggucaaggcuguuugcucuucuuccauaggaccugaguucuguucccaucacccucuuuagguagcucacugccuguaacuccagcuggccucugagggcaccugcgcacacaacauacaccuauauaguuguauaaacuuaaacaaaaugucuuuuuaaaauuuuuuagcuaacuggguaggacacagacuuauccaggaacaccuuuaaaauaaauaccaaaaacacagacagguugagugauggcuguccuggaacuugcuauguaguccaggcugcuaugcagugcugggguuaaaggcaccauaauccuagcuaugaagucuucuuacccacacaaggcuagggugacccccauggucugucugaguuggguauccugguguggaaggaugccgauuuguccccuccugcagguuuuggcggauacuaaggaacuggugucaucuacagugucuggggcucaagaaaugguaucuagcucagugucuagugcgaaggaaacaguggccacccgggucacaggagcgguggaugugacccucggggcugugcagaacagcguggacaagaccaagucagcaaugaccagcgguguccaaucagucaugggcucacgugugggacagauggugauuagcggaguggacagagugcuugugaaaucagaggccugggcagacaaucgccugccccugacagaggcggagcuaggugaguauccuuacccugggcccucuggccuccagccuggcucaccuccugccucagugcguaugcuugguauuccccacagcugucccugagagggcucccuccucugcccacagccuuccaaguccuuugguggaaucuuuccauccaccucauagguccuagagaucaaacucagucaggcuuugcaaugaguaccuuuaaccgccuagccaccucucaagugguaugccaacuucuuuuuuuuuuuuuuuaaagauuuauuuauuuauuauauguaaguacacuguagcuguccucagauacuccagaagaggacaucagauuucguuacagaugguugugagccaccaugugguugcugggauuugaacucaggaccuucggaagagcagucggugcucuuaaccacugagccaucucaccagcccgguaugccaacuucuauagaggucucgauuccucaugguuggccgugagcaugcagcgcuacagcuucaguguggcaaaacacccacuccugcagugacucucugcagggacagagcuggcugcugcaccucugcagcucccccacagauggcaggagacgcuaccagccugggagagggugggguguacagugagaaagugggaaggugcuccaaaagcggggcgggggacaugcauaaagaggaaccaaggcucuguggggguggcucucaucugagcagccuugguuuuaaccacugcccuccuagaggcaucccuggcuguccuauaggacccagguggcuucucgauagagaauagcagagccaugugggaccuagcuuugaaacccaagcaagguggccugugccuaucaucccaggaaggaaggggcgaggcgagaagaugagaaguucuaggccaaccuaggcuacauaggaagaccuugucucacaacacaaucaagcuucaggcuggggcuaugguucaguggauaaaguggucacuuagcacacaccagguccuggguucugucccuagcacagcagccaugugugguguguaccagucaccuggcacucaggagguggaugcagggggagcggaaguuggaggcuagcccccccuccuucccauuucaguucaggccaauugagcugccugccuguuccucucgguguccugccaacucucuguccauggauugcugucuuugcuuuggcuuggagcacaaagccccuuucacuuucccagaugcggucccagcuuccaggagaacggccacacaccagcuggcccaaaaauguaccauagagaagugagaaggggauggauuuuuuucuuuuccuucaaaauacagaauuuuaccaggcaugauggcacacaccuuuaaucccaguaucaggagacagaggcaggcggaugucuaugaguuugaauccaaccuguguuacauagugagacccugucucaaaaaccaaaccaaacaaaaaguccuaggauuugauuuuuuuuuuuuugucucugaacgucucagcggccucucaacugaugguggugcagaggccacagcuccacagcuguguuucugugucccagccagucugaccccugcuuuuuuuuuuuguuuuuuugguuuuucaagacaggguuucucuguauaucccuggcugugaccuggaacucacucuguagaccaggcuggccucgaacucagaaauuugccugccucugagaccccugcuuuuugaaacagcacaucagugacuuaggaggacucugauguggcuaggcuaucugguggcucuaggaguuuauccuccagucuccaccaccugcuuuucaauauauauacauacauauauauguguguguguguguguguguguguguguauaaagaccaaauauauauacauauauguauauauauguguguguguguguguguguguaugugugugugcauauauauauauauauauauagucuuuuucaagaccggguuucucuguagcccuggcugaccuggaacucacuuuguagcccaggcuggccucaaacucagaaauccaccugccucugccucccaagugcugggguuaaaggcgugagccaccacugcccagcugcuuuucaauauuuuaaaaucuauuucauuuuaaugauaugagguauguaugcuugugcuagguacacacagagcagccagaacacaacuuuugguaguugguucucuccuaccaugggauccacggguugaacuugggucaugaagcuuggcagcaaguaccuuggucugcucagccauuuugcgggcccaucuuuguuuucuaguucuguagacccgagaaugaaccagcuuccagauagccgcucuacuacugagccauaccaucagcccucuuuuuugcauuuuuuuccgugacagggucuccaguagcuuagguugccagagacuugcaauccuccugccuugccucaacuuccuaacugccuggcgcguggcguuguguggcguggguaaugugagcaaucucucccucugucccugcagcucugauugccacacccccggaggacucggacauggccucacugcagcagcagcgacaggagcagaacuacuuuguccgguugggcucucucucugagaggcugcgcaaucacgccuaugaacacucccucggcaagcugcagaaugccaggcagaaggcacaggagacgcugcagcagcuaacaagugugcucggccuggugagccuccccguguggguguggccguggcuggggccuccuucuugcagcucagcucuuaagugagcugagaucucacccaguggcaggugggcugggcugguuccccugggcuggcuuccucuacaccuuaguguaucagucagcucaggcuguguaacaaaguuccugaguauguaaggccuuuuucucuacccggcuggauaggggugcuggucgcugcugggucacuaggccagugagagcagcuaagacacaugcauaguauuccaccuuauucaugugaagucgauguggugggcaguggagcagggucuaaccucagcacugcccaaggagaaaaauaaaagugugugucuccuugguguaugccucucauucaggcagagaccagccuggucuacauagugaauuccaggcuagccagaaaagaaaaaacaaugaaaaugaagagccccccaucccugcauugucccggcuggaacccagugucugggauauguucucccucuaauagggccccuuucucugugcuguagauggaauccgugaaacaggguguggaccagaggcugggggaggggcaggagaagcugcaccagauguggcucagcuggaaccagaagaccccacaggaugcugaaaaggacccagcuaagccagagguaccugcuggggcccccgggauccccauaugaguguccaugcccuguucagcauaacucaugcuuccuguccccagggcaaccacagaaaccaugacagaauucuauuuuguuuuggcuuugguuuuuaauuuuugcauuuuuauuaguauuacugggguaagguggugguuuuggcuuggcuuuuuuuuuuuuuuuuuuuuuuugguuuuucgagacaggguuucucuguauaucccuggcuguccuagaacucacuuuguagaccaggcuggccucgaacucagaaauccgccugccucugccucgcgaguuggcuuggcuuuaagauaacagcugugagcccgguaccauaucuggccucauagugcccauauugugguuugauuugggguuuauaauuuuuugauuuuggugggggguuuguuuuuaacuuuugcuguuuggcuuuugauuucccugcccagccccaguggcuuucaucucugauaagucuagauuccaggcaucuuccagugucucucuguaaaccuuaacuauucugaaaagguuaugggagucugucuucuaguuucaaacucagggagccaaauuccuguccuccaagcagggcucugcacccuacuggcccucaauacccugaccccaccccaaucucccccuuccagcagguggaggcccgggcacucagcauguucagggacaucacccagcagcugcagagcauguguguggcccugggggccagcauccagggcuugcccagccacgucagggagcaggcacagcaggcccgcagccaggugaacgaccuucaggccaccuucuccggcauucacuccuuccaggaccucucagccggcguucuugcccaaacucgggagcgcauagccagagcccgggaggcccuagacaacacuguggaguacguggcccagaacacuccagccauguggcuggugggccccuucgcuccuggaaucacagagaaaaccccugaagggaaguagggagaagguucagggccaacaucuaucuggcuugacugcuuuucccaacaguccaauugcacaacagguccuccccuacugagucugaaugagacauguguuuaaccuauucccaucagucuuuuaaagcaauuuuuuuucuagaauguuccagggguaaaaagauccagaacauucuagaaaaaaaaaauguuuuuuuccuaaaaaaaaaaaaaaaaaaaaaaugaggaaugaggguaaugaauagugauagcacuagucugucauccugugucagcacugugguauagaggcaagagggucacagguucaaagcccggcugccacaucacaaauucagugauagucuaagcuacauuagaccuugucuugaaguaaaaaaaggcauaaugauuuuucacuccggguuucuuuucuacaucauggcccacaauagcaagagcuuuucuuguuuguuuuuuuuuuuuuuuuccugagacaggguuucucuguauagccccuggcuguccuggaacucacuuuguagaccaggcuggccuugaacucagaaauccaccugccucugccuccugagugcugggauuaaaggccggcuagcaagagcuuuucuaacagacccugauaccuggcccaagaacccagcaacugugacaggauagacagcugggauguugcaauuguuucagaugagaaagugagggccgaguacacuguuccucaaauccuggggcucaguauugccuuaauaaauuuuauaugcaucagaggccaaguggaugguguauauguguguugccuuccuaggagcugagcugcccugacaucccuagagaccuucuuccuucugucucuacucuaugcacagugcgagucuucccacuuugaauguuggacgugaucacuugugacccuguggggacagcaggaagggccugcugccuauuuucccuccgucucugugauguauggagaagggucagugugacaagcugagccugccaaauaugcccacagucuguuccccuugaucucagggaagguggggacaagaagaucuggaguucagggucauccuugacuaccuaguaaguuugaaacuaaccugggcuacuuugagacuauguuucaaaacagcaaaacucggggcaggagagcugccugcugugguaaagugcuuggaguuguuugguuugcgguagaaacugagaaaacuuacuucagagacagaagcuuaaaaaauaaaagcuuuauuuucugcacuggcagggagguggccaguuggggaucugaacccugaugagagacugcacgacgcuuuuuauaggaugggaacacaaagcgaaggggaccuggguacugaccaaucauaucuugacacaaaggguuaaacaaggacuuaacacuggugacuaggucuuaucugggucaccugguuucaggguccuugagucagcuuuuacagccuaguccccuccuggacucugaccuggaaucuaguguggugaaggaccaaaggagugggugagccgcaguagucaguuaaaucaaggcagggacacacuaacgacuugugugcuuuaguuuggauaacuggagaacagcaucuuccuuccuuacagccuucacuggcuaacagacaaacaugaaagaucuaagaagcaggauaggaguuguauucuggggccugggaacaugaacucagucuugacccugccagcaagauagaacuuguuucugagauggcuggacucaggaaacugucuccuaaagaugugaccaagagcaaacacuugaugucaaccuccaacuuacacaaauacgugugcauauguaagcaugaaaauguggagaaguccgucugcuaccugcuuuggggagaugaguguccagagucugggagagauugaguucaguggcaugaggcagauacuccugccuagacuccccagcaagaggguggggugguucuccuuugugcaccucaucuuccagucauaguccucugggaacugcugcuuuucuguuuucacaauuuaguuuuaucaguuuuaaaacaugccauagggcuggagagauggcucaguggcuaagagcacuggcuacucuuccagagguccccgaguucaaccccuagcaaccacauccaucagauguggcucacaaccgacuguaaugagaucugaugcccucuucugguguaucugaagagagccagaguguacucauacguaaaauaaauaaauaaagcuuuaaagua

SEQ ID NO: 8680 - RNA, 20178 nt, Mus musculus
aagagcccuccccacccaauugggguggaagucucccgcagcagccugugcacacuaauaaaaacgcccugaguuuucgcgggaaaaaaaguccuagcagcuggaaggaacccgcgcucuagugcucacuugggucuucagccacucacgcggcucccuucugggucacccagccgcagagcccuagccuagaaccaggcguuccaagggagaggagagugcggaucgccgccgugagagaggugaguggaagagcgcguucuaugcacacaguggcacgcggggcaccacgcaaaacugaaaggaacccuucucacacaaggcugcgggggcuugcuucaggggauccgaugggugucuucuacgcuuagcccucuuacuggucaggcgcacuacguugacggcccgggucgugggggggagcuuugcaaaacuuucccgcgcguggggugagaucugcagagggccauugcccacgcguggguuccacaccucuuguaagaggaauccgaguuguguccuccacgcugagccucccucuccggcccugugcacacgguuagacccgaaaacuuggcauaaguuucccgcgcguggcucggggcauugcacagccacugcgcaugcgugcuucugcauccguugaggggcaacuugagaggaauccuccacgcugcaccugguuuuucacucuccugggugccgcuaaaguucgcgggaaacgcgugggguccggcggggaagugcacgcggcuccacgccuaagagcggacacuccccgagauucaauugucgcgcccgagucggguuucgcgcgcccaggcgucuccgaggucaucuaggccaaucgcaugcgaggagggcggggcacguagcccgggaggagccaaucagcagcgagcucuccgggaagggcggaacuuaaacggcggggcuccaggggucuggccugggcggcggcggcggaugugggcgugggcucugugccucccgggucuuuaaagcgccuuuccgggaggccagggucugugucccgaggggaaguuagggcagccagcugugggugggguucaggugaguuuguggccacaagcgcgcgcuaacggguggcccggcccggacugccgguugccauggccacggcgggggggugucuugcucuaaguacgcgcgcgggaggcacgggucuggaacuuugggggaguccugaguggugugugugugugugugugugugugugcgugcgcgggggccccugccuucugugaccgaguucucccuccugggacuugagagguuccaguccgcuucggaguuggcgaguuccaguuacugggacuuaagacuacguggaaugaaugaaugaaugaaugaaugaaugaaugaaugaguagcugcuggcacuuuucagcccgaccagggucuuuaucccgccauggacauuuuuucccucuucccucauuggaagcgugguggauggauguucuuggaucacccagaguguuuuggcaauucacauucaaguguccccacucgccgguuauuaaaacuuuuaagugccuaauuuaugccaccugguccucccaggguggggucuugcccuauguaggaggccaggacuacaggagauugaucgugggaguugcuuccuuugcucaauccgauguaacggggcgaggguacucuacuuccccuccuccuuccuggcaggccccacugacuggaggggggggucucccucugucucccucucucucucucuccaguacaucggcaucauguggauccagguucgaacuauggaugggaaggagacccacaccgugaacucucuguccagguugaccaaggugcaggagcugaggaaaaagauugaggaaguguuucacguggaaccccaacuacagagacucuuuuauaggggcaaacagguaagggggccacuggcgccuuuccauucauccacccucugagcuuuguuccaagcacccugcuucucaaagccaccaagcaauaggcccgcgcccccccucaagucgccagucaguucccgccccccuccuggaaggagaugccucagcugcuggggaggaggagggggcgaacaaaggcaggccuccucagcagcuggccagcuggccucgugcuuugaagccugguacucuuuauuaucuuuuaaacucucuccuaaacguuaucuuucuugagauaguuugaaguggccauagagggccccaagguaguuucugcuuggaauguguuuaacagucuucacgugucggcaguaagaggggaccagguuuuacuuuugagauccacccugauugccugcagcuuguuuccauaagacagcaacacacacaccccucccccgaggauccauuugauuagucuaggcuuguggggaaaauggggccaguggcccuucuuggugccuaaacccguguuacaccucuccagucaucuuugcagcccaguugcccgcacuuggggcaucuuauccuuguccucuagcugggcuaucuuuuauuggugucuagagguacugagaguugccugugcuagcauuggggucucggguggggcaagcgccugugaggcccauuuggcgcugagugcacugcugccagcagagaaggggccaaagucgauuugccagguuuuuguggccuguacucaccuuuaugguugggcagggcacugcugcccucugguguccagguccaaggguuugguuuuggacccccucccuggccccaggaggggcuggcugugacugcccgcucuccuggaugggaguggggguauuguuuagcugggugguguguugacgccguguucaauugcccgcuguggagacucauuuccuuucauacccaguguguuuccugggaacuguguguagugggucaaguucacagaacauggaagagguauaagugaccauacccacugcagagacucagucuuuaacuccugguuuuuaacuggcugccuaugucuucuaucaggucacuggacucacuuucuucugggaccaucaaaggugggaaugcuuguccagguucucccuaaacaguggugguguuuuauugagagacaggguuucagguagccuaggcuggccuugaacuuagaucugccugccucucugccuaaaggaaugagcagugugcccagccucacuguuaacaguuuaaccuguagcaaaccugcagcacauguuacuaccuggucccuuucccuaccucucuccauacuguagcacuguuggcuuugucaaggguuggggccuggcuucuggucucuuccccagcugcuggggcuacuaggacacagcaggucggucauggggagggagcaaggggcuggaagguaggggacaagcagagagcuaggggaagccugcuucuguggugguugauaggaacagaaacccaugcaaguaguccauucuucagaaaguuuuagaugguucaugacucguuggcuuucuccuuugcucuuguggcccagaugccuccauccacugagaacugaaaggagcuagcuggugucuggauuugaugugcuggccccuccuugccugugagcagggugucgggugugugggagggggcucugagcagcaucccugcuagggcagaugugagaugugucugguagacccauguuaucuugagacugccugugaaaagagcuguagucuugagugugcucaguauguucaggcuuuaauguuguuaaguuccuugccucccuggucaugggcagcuuaaccuuucgugucccaaaugacaagcauggcugacugguggcugcugcacauggugauguguuaugaguugagcaggaccuggcuugauggcgucaccagauuaucaacccaggguccccccagggagauguacacucaggguguucuguuucuaugucaggauuccccguuguuaagacagucucuagaaaucacccaggagccccuuggaauacuucccuuucaacuuuuccuuagcuggucucauugaugauugcaugagccaugcugacaguguugguuaaaugcuugaguacccuggaaauacccuggaaaaaccauaccuuuaguuccagcacugggucugucuccucuaccuguagaguucaggguuagcugggcuacagguaacuugguugcucuccucccucccuaccccaaugugucaggaacaaagugguuggaccaaggccugccuaucaggcuguucuggaggcugagacuggguuucagguucaaggccagucuugucugaaaauguuaguuguugauuuuuuuuuuuuuuuaaacuuccuuguuacugugugugcgugcaccuccguguguaugggggucagaggacaguguugaaaguuggugcuuccuuccacuguggacucacagggcaagagcucuuaccggcugagccaucucaccagcuuuuacuuaucuagauaaaggucccguguagcccaaguuguagucauucucuguguagccaaggauaacccugagcuuguuucuccuugagauggaaugacagguuuguguagugcuggggauggagcccagggucuucugcacauuagugugugcacagccccugcccugggguuuuuagucucagucuuagaaguuagccaggaguugagacugaguccuggauuuaccuguugcuggacucaguuauuguugaggucauugagugggaguugagcauuuaggcucuuagacugucuguccucuugugauagauggucccaggggugaccagagccugggcucacaugguuuccugaauuuccuaaccagccauuugguaagugggauguaggugggggguacuacacccaccccuaguccuagucacaugccauugcaggcuuccaccugccuucccgggggcccuuccggggguaguuccagaagcagcagccagaagccguccaaccggccuugugaguuaggagcucuaguuagaacugcuggcugagucugcccagagccuguuccagccacauccugcucugcguguugagugggggcugcccuuagcaucccaggccguggccaugguugggacagcuuggugggcuccuuggggacagggaggcuuuugugguuugauugccuacccuucuggcccuaccuccuaguggugccagcacugaccaccaguccuugggcucaguaacuaccacaauuugcuuuguauuugagaacuuugggcauaugugugugucugucauaugcauaggcauuguauguuuauggcugucagauguccuuuguugcuuucuuagcugugcuccuguuuaugacugagugauguuucacuguguggauggcacacaacaguguuuguucaucugcagaaagacuugguuuuacuguggucacugccucauguuguuuucucucugcccccuuccaucuugggauccccaagucuggccuauggugcagagucucuguguugggugacagauguuguggaguguuguggguccugaccuccaauguaagcgugcaucagagcugucacggacugcugacaucuuugucucccaagcuguucccacaugcagaguuccugaagaaagacccagucucauuccugaagagucuuguucccuuagacggguugccauuccccccuucccccaguccuauuuccaccccaggacucuucuuccugaagucccagucucccacauugguccucaggcuuggucaggucuguucuugguuaccauagguuauaugggccugcaagccuuucuuucauaugcccucccaauuaguuuccaggggugggggcaucauucacuguaacccuaaaaccucuguggguacugauagugcucgacgcauggcuucucaagagcagcugugagugcccaggccuggaacagagcuuugucuggccucuguauucccaucuaccccuuccccaugcuaggccuuugaggaagacggucuguuauggauuuucccacagauggaggauggccacacacucuucgauuaugaugugcgccucaaugacacaauccagcugcucgugcgccagagucuggcacugccucucaguacaaaagaacgggacucggagcucucagacucugacucuggcuauggugugggucacagugaaucagacaagucguccacgcauggugaaggggcagcugaagcggaugacaagacugugugggaggacacggaccuggggcuguacaaggugagggucccuguggcugugugcaggugugacgguggcauucuggguuugcucccaacccagauuuauccuuugccagccuuggcagugccugcccaucucuguacugacaacugcacagggucucuugggacugacuccuuggugacggcacuaccugcagguguucccucuacaguugaaacuucuguauuuuugucaaacuggagguugagccucccugagaauccuagcagaugugguugaagcugaagagugagugccccaugagagagagccaugucugcccucugugaccacaucacuuauuuuuuuuuaaagauuuauuuauuguuauacauaaguacacuguagcugucuucaaacacuccagaagagggcgucagaucccauuauaguugguugugagccaccaugugguugggaauugaacucaggaccucuggaagagcagccaguguucuuaaccuccaagccaucucucuagccccccuuuuuuguuuuuuguuuauuuuuuugagacaggguuucucuguguaguccuggcuacucuggaacucacucuguagaccaggcuggccucgaacucggaaaucugccugccucugccucugugccagcacugcucagcugaccacaucacucuugaucugugcccugcaucugcuuuguggcaguauagauucucacccaaggaucuaggguuacgugggagguuccacucuggaguguauggaggccugggauguggcucagcaacuggaccuagugucacauguggucacuacuuauuugcugucaguaaaccucuauggagauagucacagccaucagagcagaggucucuugcagaugguguuuguugagcuguuuguacagaauaguccagucucauccaguguccauagugcugagcuuugcugccagguaggacaugguggcucacaccuaacauccccuuaccucuggaggcugaggcagcaugcuugaguguguaaggccaaccugggcuacagaguaaaacuuggaggcauagcugggcacaggcccugggucugcucugcugcugggucuccugagccgccucuucccguaggucaaugaguauguggacgugcgugacaauaucuucggugcaugguuugaggcccaggugguccagguacagaagagagcccuaucugaggacgagcccuguagcuccagugccguuaagaccucggaggaugacaucauguaccaugucaaguaugaugagugagugccaucaguccugcccuguccuccccaagugacugcugcuggggauaugggaggcugcccuugucccauccucauugcccuguuuagacaaagggcccuuccuucuucccugggcuuccuagugcuaggagcccagccaugugcugcccugccuugaucugauccuguucagucugugugugugaagcucgcucucucucucucucucucucucucucucucuuuuuuuuuuuuuuuugguuuuuuucgagacaggguuucucugucuagcccuggcuggccucgaacucagaaauccgccugccucugccucccaagugcugggauuaaaggugugcgccaccaccgcccggcuaugugugugaagcucucuugaguguccucggucccaaccuucacagaguucccauaggugcagaaggccccugcccuuauggcuuugcuggacucugcuucccucuucuggucauaugcugggguuuuggccucagcucuuuacuguccauggccuagauggccuggauggcucaccugccugccuaugaugguucccuccauauaguaggugguacagaucccaguagcauaaauugacaucuaguuagagauuuccauguuccagcucugggaucacauguggcccccugcuuauuguugucaauaaagcuuuauauagagucauuuuguguggaagugcuuggcagagggugcuugcugagcagaguucugugauggaccugaagugagugaguacucuggaguagucaacucugcucucugccuccacacauggauguggagaaacaguucacuuugaacaauuuccuaaagucugguuccccaggccaacuguucuaggcugcccugacuuuguguuugugggcauauggccaccucaccauaguguuugcuauugucugugcuacuuugucacuucucucaugugaaaaaaaaaaaaaaaagcuuuccuuacucccauugggugcacugagcugccaaagccuuccuuucaaguugcugucucccuugugcugggauggggagagggucacuuugggaagcuacauuugucuacguuccacauaccuggaccaugagcauagacacuguggucccccagaacauggcuccccaugcuaucacauuucugucccuaugaagggacugcauguguuagccugguaggucugagguuggaccuuugcuugcagcuauccagagcauggaguggacauugucaaagccaagaauguccgugcucgugcucgcacugugauaccaugggagaaccuggaggugggucagguggucauggccaacuauaacguggacuaccccaggaaacgcggcuucugguaugauguugagaucuguaggaagcgccaaaccaggacggcacgugagcuauacggcaacaucaggcucuugugagugaccugcuuggacaggaacccugauagccucucucauccucccacugagcccucuuuggccuagucucgcuucaaggccuccagauuuggcuuucuggaugcuucuguuuguucauguuguccccaugcugugggaaggugugggcuugagugguucuggaggccugccagccuacacuuagcagcaggccaagggcaauugccuccuuuggaggguaccauuccuugcugucuuacccagggugucuucaaacaccugccucagugggugguaaggguacuugcugugcaaauacuaggaccagaguucaaauccccaauacccacauaaaagccacuugcagaagcuugcacugcuagggacaugggaggcaggggcagaauuccuggauguccaggggcagcuagcuugccagauguaggcagaaauugaggcuagacagcugaagggugcccuaaccugucuguagcacaggccugcccagaugauuuaauccacacauguagaaaccaaaggggagaaucaaccugggugaagaagcccaggcucagccccauagugugcuaagguuuugggauguucuguaggaaugacucucagcucaacaacugucggaucauguuuguggaugaagucuugaugauugagcucccuaaagagaggaggccuuugaucgcuagccccucgcaacgugagucuuggucgggcccugagugugccuggguggggguggcaaucccagguggcaugguggccuguugcagccccuccugcccuccggaacacagggaagagcggcccauccugccgguucugcaaggaugaugaaaacaaaccaugucgaaagugugccugccauguguguggugggcgcgaggcuccugagaaacagcuguugugugaugagugugacauggccuuccaccuguacugccugaagccaccgcucaccucuguccccccugagccggaguggugaguggcauaccucugggguuaccuagcaggucuagaagggaauggaagacaggcugggagguagcucagccuugaugcacaauucugcuguccugaguucaaaucccagagcugggcuguuaacaugccccugugagcccagugcugggggagcaaugauaggaguuuggcuaggaccuucugacugccagcuuggcuguaggcucagugagaggaagcuguaucagaguuaagggaguuuggcucgugucccucaggucugccacugugugccccacuccacugugcagcugugcacuuggggagcuuugugguucccuucugcacaagggggcugcuuuugagcugucugacccuaugcagacgggaaaccugagacucugccagagaaggaaggguauugucacaugacgcaugcucuuucuuucccuuacagaacauugggauuugcucuuuuuuuuuuuuugagacaggguuugucuguccuggaacucacuuuguagaccaggcuggccucgaacucagaaauccaccugccucugccucccgagugcugggauuaaaggugugcgccaccacgcccggcucggauuugcucucuuuuuuaaagacaggauuucucuguguagccccggcuguccuggaacucacuggccuugaacucacgagaccugucagccuccccagugcugagacuaaaggcguaugccaccacugcccaaccuuuuuaguuugacuuuuaaaauuuuuguuuaauuuuuauuucacgugcauugguauuuugccuguacgagggggucagauccucuggaacuuuugagcugccauaugggugcugggaauugagucccaguccucuggaauaacagccagugcucuuaacugcuaagccaucucuccagccuuaaaauuuguuuuuauuuuuaaauuauacuuaacaugugugcaagcgaaguagcaggguacucacggaggucagagaugucacaucaccuggagcuagaguaacaggugacugugaugccaaugaugcaugugcugggaccgaaccccaggccucugcagaagcagcugauguuggcgagcacugcuccagcucuguucuugucuuuguguggggguuucuuuuugggacagggucugauuuuauauuccaggacuucugagcuggaacaccucuaccucugacuugcuggaaauagaggcaugagcgacucuacuuggcuuugaaguuuuuauuucuuaugaaguaaagggagguguaggagguggggcuuuagcuccuuccaucccacucaggacaggguuucucuacguagcccuugcuguccuggaacucacucuguagaccaggcugaccuugaauuuagagaucuaccugccucugccagcugagugcuggcauaaaagacauacaccaccaugggucucugggguucuuaaaaaaccuuuuuuuuuuguuuuugguuuuuuuguuuaucuuuguuuuguuuuguguuuggguguguggacagcuuugauaguuacuucuguaccauguagguccuggggauugaacuccaauccucaagcuugguggcaaccugcugagcccucucacuacuagccuacuagccuucugcagacagggcuuuuaguggaaagcuaagaaaacucauguccuauagacauucuauaacgguagggacaguccagguuggaguuuaaccaugugccucugagugcacguggcugcacauggcuagagcacaucauagcugcgcaggaacccacacuugggauuggacuaaguaagcucucgugaccuugguucugaacggccgugugggcuguguggcuucucucuuuggccuguguguagugucugcgggaaggacauuauccaccuugcacuuugggcuccaggccacaugcaguugacauucuugucuuccuagguacugccccagcugccgcacugacucaagugaggugguacaagcaggggagaagcugaaggagagcaagaagaaggcaaagauggcaucagccacuuccuccucccggcgggacuggggcaaggugagacacacaucccuucuugucccugucccuguuccuguuccccacuucccauuucucacauagcccuuuccacauggcagggcauggcaugugugggccgcaccacagaguguaccauugugcccgccaaccacuucgggcccaucccuggugucccugugggcaccauguggcgcuucagaguccagguaugcugauccucagggcuccagacauuucucuauugagugugugucuuagguguggcuggggcaggaaacgauugcugagugggguucagggaguucagguggguaccugcuuaggugcaugacccuagacccuugucacagcuagcuccuuuaugguggcuauacucagccauugugccagugugcucuuguuagggacucauccuggggugugucgaggguuacaguccccaggaaauggaguggguaucuuguugauguucacaggucagugaguccggugugcaucggccucauguggcaggcauccauggccggagcaacgacggugccuacucauugguccuggcugguggcuaugaggaugauguggugagcacugcgccucucauguuacccaccaugacugauggauggaucaggaguccaggcuggcuuuggguagccugucaggauucuuuucuguaucauucuacccagucuccacacugguacccacccucagcgcuggccagaggugcaaggucacucucucaaucuguuucagucacucuugucagaucuaauaguguccccagacaacaagaacagagacacuugugguucauuucugccagagaaagagaugccacgagguauaaccuaaagcacaaaaauaagucuugauuuuauaaggaaaauugcucugaggaugccacagcuaaguaugguagggugggauggcaggagcuggccuggcgucauggucagggccgccgugugggggugugauggcugcuuaauuagaagggaagaugggaagucacaggguggagcaggcauucugcgcccaugguuggggugguucaacccucccugcucagcaaaggaggcaucccaaguucaguagcaagacaugucaggugccacugucucuacauccaccucuagaaccucguguuuucccuaugcugaggcucugucucaucaggcacuccugacacacacuguccucgcucuuugugggucugacaacugggaacuccagggcauggggccccgugcuguguuucugagucuggcucaugucacugagcauaugccuuccaguccccuccaaguuagaacaguacucugccuuuucgaagaguggcacuuguuaaggggacacaggguagcugcauggcuccucugggcguccauauuccacugcucccucagucucacugccuccuuagggcucacacucucuuuuuuuguuuuguuuuuuuuuuuuuuguuuuuuuguuuuucgagacaggguuucucuguguagcccuggcuguccuggaacucacucuguagaccaggcuggccucgaacucagaaauccgccuaccucugcuucccgagugcugggauuaaaggcgugcaccaccacgcccggcgggguucacacucuuguccucaccuaaugugucaaggcuuacucacccuuaugcugcgagcucauacagccauucuucuccauugcaggacaauggcaauuacuucacauacacagggagugguggccgagaccucucuggcaacaagcguacagcaggccaguccucugaccagaagcucacuaauaacaauaggucuguggaaagcauggucccugugccaugggugugacugcucuuguguggcagagggugaggggacauagguuccuauuaacucuugcccagagaucuaaguuugaguuuugagacagucucacugugccuaucaggcuggcuuggacuucagagauccuguauggguguuuugucaagaugucugaauaccacuugugucuaguaucaggccccaagagggcaucaggucccguagagcuguaguuacagauaguugugaguucccauguuggugcuggaaauagaaccuggguccucugcaaggacagcuggugcucuaacugcugagccaucuguccagccccaggaauuuucuccaaauccuauuuccauagacaguggugucuaacacugggaagaggcuacccugccuagccuugugccugcucucucccuggggagggcauugccaggaaaucccuuccugguuggauaccauuuuuauaucucuuuuucccucauggguaacacuuccauuccgccugggggagagguucuggacaggguucccuguguucuggucugcagcagccagggugcagcucuacacgugguuauuguaacgcaucuucuaggguagguccaaagaggccagacaguugugagcuaccauguagguccugggaauugaacuggguccuuugagagcgaccagugcucuaaccacugagcaaccccuucagccccuuugggaggcauuuaaaucagacaguagccucuggcaggcccuggccuaugcuagggaucuuguuuugguguccaguugauaucuccaugaaucuaugugccuuucuuguggaggcauguaacuucucaugcguguccugucuccccaaagggcucuggcacucaauugccacuccccaaucaaugagaaaggugcggaggcugaagacuggcgccaagggaagccagugcgugugguccggaacaugaagggcgggaaacacagcaaguacgcuccugcagagggcaaccgcuaugauggcaucuacaaggugagcgcacugagcaccugcccuugucucauguccuccugccggugcccugagaccccacaccacacugcaccagccacacuguccuuuccacagguggugaaguacuggccagagagagggaaaucuggcuuccucguguggcguuaucuccuucgacgagaugacacagagccugagcccuggacccgggagggcaaggaccgcacucgacagcuggggcucacuaugcaggugugugucuuugaaggccaugagucaagggauuuccaaccaccuccucuuuggagcuugcuguccaucauggugggagcugggauugaaggugcuugcucugcuuccaggucccaggcucuccaagguuucuguugccuccagaaggcugaggcagaaggguugugaguucaaggccagccugggcuacguagcaagacccucucggcaaaaacgaaacugggcuuaguuaggccuguggcuuugagcagagauuuccccuucuugaaacccauguuuucucugcagcacccccuaugucaggcagggucagggguucaaggccagccuccacagugaaguuagaggccagacuagacuauacaagaucccaucuuaaagaaacugauuauguauggagagagugauggcuuaguaguuaagagcauuggcugcuccuacagaggaccuuaguuugauucccagcacccccauggacccacguggcagcucacaaugucaugagaccugacagccuuuucaggcacugcacacacauaguguagcauguaguuaacacaccaauacaccgaaaauauaaauccaaaaauguugaggucacaggugaaucuggauauugagguaauauaucugaucagccaccccuguggccaguguugcuucugcuccucugaccucugacuuuuuuuuuuuuugagaccggguuucucgguauagcccuggcuguccuggaacucacuuuguagaccaugcuggccucgaacucagaaauccaccugccucugcuucccaagugcuggcguuaaaggcgugcaccaccacgcccggccugaccucugacucuugaugaaagcuaaugaaagcaucagcagguagaagcuaccagaacugauagaacacagguggugugugggcagcuaaggguagcaaguccccaagaccagagccaccucaccucucugcugccagaacauuagucacacuuucaucuuguuggggacauuuaagggcaugcuggcauggccucagaguuuguggucugcacugaauguauagcgggauguacagaaacgugugggugcacacaugugugcgaggaggcaggguugggggcuaggagagggucagugguaagacugcugagacuagccgggcgugguggcgcacgcccuuaaucccagcacucgggaggcagaggcaggcggauuucugaguucgaggccagccuggucuauagagugaguuccaggacagccgggcuacacagagaaucccugucucaaaaacaaaaacaaaaacaaaaacaaaccaaaagaaaacaacaaagacugcugagacuagguuuucuuuuugugguucuuaaaggucucauucugucacucgggcuguaucucauauagguccucuugcuacagucucccaggucacagguggggcaucuggcuucguggaccggcagcuagccuugagguugcuauguagcucaggaugaccuuugaacuccuaacccucucuuuaccucuagugaacggugacaggaaugugcugcuaguucuggcuuuacuuaguuuuggguaagacucuucccacauaguucaggcuggccuuaagggacuucugacccucaggugcuaggguaggaccucuuugcugccacacuuggccuccaugcuugggcaguaaauccccucaggugcccaagagcuuguugggugauggcacugugacuucaggaugggccgagucuugauucugccucccacuccuccccguucaguacccugaaggcuacuuggaggccuuggcuaacaaggagaagagcaggaagcgcccggccaaggccuuggagcagggacccucaucuuccaagacaggcaaaagcaagcagaaguccacagguaggugcccccauugggacuugcuacugcccuguacauccccaugucugacgugcuccccagcacugcuguacuccucacugccuuguucuaccuccuccugacuccccacagggccaacccucuccagcccccgugccucuaagaagagcaagcuggagccguacacacucucagagcagcaggcuaaccucaucaaagaggacaagggcaacgccaagcugugggaugaugugcuaacuucacuucaggaugggccggugagccacuggggucccauugcucccaugggcaagcugggucaggucgcagucugucugucuguccuacugcagcacuccaaugucucuguacaugacccaacaccaaagcuguugguuuuuaacaugaacuaacuucugucacccaccauuccucuuccucaguggcucugacuccaaggaccccuugggagugggacccuguagcuuuguauuucugugcuggcucacagcgccgaggcucaccuaugcuggagcggauaugagaauaccccccuuuuuuguugguuuuugucuuuauguauguauguauguauguauguauguauguauguauguauuuauuuacuuauuuauuuaauguaaguacacuguagcuguccucagauacuccagaagagggcaucagauuucuuuacagauaguugugagccaccaugugguugcugggauuugaacuccggaccuucagaagagcagucggcacucuuaaccacugagccauuucgucaucuccuggguguuuuuuuuuuuuuuuuuuuuccaagacaggguuucucuguauagcccuggcuguccuggaacucacuuuguagaccaggcuggccucgaacucagaaauccgccugccucugccuccugagcacugggauuaaaggcgugcgccaccaugcccuuccagaauaucccuuuucaugcuugaggaauauuccucuauacacugccuucuccaguggugguccauccauccauugggcucauauggugucuuagaguuuuacugcugugaacagagaauucuacaucuucagaaggcagcuaggagaguguuuggcuucuaggcagcuaggaugagggucuucaagcccaugccuacacacugacacaccuacuccaaaaaggcuauacuuccuaauagugccacucccagggccaagcauauucaaaccaccacccaagggcugcugcaccuauuucccgcugugccuuuguggcucuggaagugucccuuugcccuugcugugcuugacuuaaaguuugugugcuugacuuaguguguccccagagugagaguccuguaucuuguaacugcuauguauguguguuaaugaagaccuguaccugccuuuagcgaggcugugacaugagacccugccaugacggcugcuguccuggggaugccaguuucuggggcucauucagggucaaacugaauaaagccucuacuuguuacagacugagucuggaugaucaguucagacucuguaugugucucagugcugaaaucagaggucuggacuuagagggacuugaagaggcucagccccuuccugccauuuucagugucugaagccuugucucugugucuuacacugcaguguccucagucuuugcugagggucagaugggugugggagacccuugucuuguggcuggggcgagagugauggaagugggcccucucacuugccuugcaguaccagaucuuccugagcaaggugaaagaggcuuuccagugcaucugcugccaggagcugguguuccggccagucaccaccgugugucagcacaacgucuguaaggugaggaggcagggguuacugcgaugggagcauggcuuggaaccacccucugcacuuucgggguuucuugacaauugccucagcugugucuuuuauagagaucccagaccccaacagccuuugggauguugccaggagcuaccaagagggagcucuguguguacgugagaggacggaguccuguggggcuacuuugagcuguccccucacccugccuauuucucacgcaggacugucuggacagguccuuccgggcccagguguucagcugcccagccugucgcuuugagcuggaccacagcuccccaacccgggugaaccagcccuugcagaccauucucaaccagcucuucccuggcuauggcagcggccggugaugcugagacccaggcagagggcucaugguuccaacuucauaguguguuuagcuugaagguguuguccuucacgucugccuguggcaacucuucugaucuggucaccaguuaaccaggcaucuauaggaaucccauguucuggcuaccaguuggacuucuguuuuucaucccuccacccccuuucuauaacaaagccugcgauuuauuguccaagagaaggaaaaaaauguuuuuguuuuuguuuuuuuuuuuuugagauggguuuagaaaccguugaguuucauaccaggccucaugucaugcugguaggaguucuccccacaccagcugccuagaaaccaucugcacccaucuuugaaaagcccagacaugucuuccuggcagcuaucugugugcuucauuccagggguggccccugcagcugccccucagaccuucauagaugcccuggcccgcgccauucacugacaugauugcagaggggaguuggcuguggccucaggccaggggaccagcugggcugaagcugcaugugccuugggcuggccacuucuucacuccccucaccacugagcauuggaugucuaccuugaaagccugguuuucagagagugcacugacugggugucauggaaggcagagauguguuaucaguuccaucucauuuuuaacucagcaacagaauucugaggguuucuguauuauggguuuuuuuauuuuuauuuuuuaaagcgagauaaauggguuuccucgaugaauuucuuuuguaguuacagccuguacugaggaagauguuuuccuugguagguuuuguuucuuuuguaacuuuaccaaagugugcaggugugucucauggaaacuaaaccauuuacuacaggcagacuggacagcacaguucuaaggguuguguuuuguuuugugugggguauuuuuuccuuguuagauuguuaacauauugcaauaaaauaaaauucuggccgggcagugguggcgca

SEQ ID NO: 8681 - RNA, 76826 nt, Mus musculus
ccgggcucuugcugagggcucggccgcgagcgagcgaaccaucgaaggagcaaagagaccgggcgaagcucggagcccaguggccggggcgagcgagugagggccggcgggggcgacgcgagacggccgggcacgcgccgcucagccugcugucugcggcccgggccgcgcguugcgccaggugagugagugugcgauccguggcggcgcucagcagcuuccaggccccuuuggggggccgcgcggccgccaugccugcccccacgccgcaccuugggccgccgcgcgcacuccaggccgaggcuuuggcugcggccuacucggcuccucagggcggcggaguacgccgcgcuuuuguccguucgggcgaagcugcuguuuguugaucgacaaaacgauugugugccugggaaaggaggguguguuuuuuugggggugggugggggggguugacgauggggccggacaaaggcggggcgggggcggggcgccgcguccccuuuccagggcacaaaagaugacagcguggguggcccgguccagccaucccuucaacaaccccaaauccuuaaaaauaaaaaacccacuccaagucccugcuccccgccgcuugcauuuugguucccuuugguuuggagcuguccccuccaaacacucacccaucauggccuugcaaacuugacccccgcauguccagaaucuguaaaucaccauauaaucugcauuuuaaaaaugaaaauaaauaguacacguaucugcuauugcaauggcagccuuuccaccucgcuucuguacccuggucucuuugcuuuccagcucccuucuuucuguaagccaugaaaugugcaguuuuccgcgugcacacuaguccagggcaucccggcagacagggaagcuuggcaaagcuggggacagcuggggguggcuuuccuacugccauauccugggggguuuuggggguucuguuagggguuucggucagccagcugagaguauaagggauuccagguuugcagauuugaugcuguaacuggugcgguuuggccauuacgguucgggcaucgcgguuccuugucccaucugucugaaaggggggggggcggggcggaggauggcaucgcuuuaauaauuaacaccuggggaagugucuugccggaguaguugcuaguuuuuuucaacuauggagaggauggauccgguauguuucaaaaagcaaaaagaaagaguguaucuuucccuguaaccaagugggauuugcucagccugcagccuggugccagcaccuucauaggcgcugaggaucuugguugcagaagguugggggguccgggaugucucugugucccauuaguuguguaucugacaguccccaggcuggagacugcacuguuccccaaacagcuccugccucaaaauggguucauuacgugggucuucaggggcuccuaccacuaccaggaaagggcuaaucacucucuuuaauucuccaguaauugcugccuucagagucaccaaaagggcgugucuccagacugggccaaccuuuucuucccacccugcucuagcuguagucagcuuucuucuucccuuccuuuuuuccccaagccuuguggguguucuguaucuaaacuuguagggucccuaugcaagacuccagucaaacuuuucauccucucccuaggagggcaggaagccugacugucaugggguguuuugauguuugggguggaaauguccuugugccaggugcuccauguaccugugcauauccaggcgcaccugugaauguguguguucuaagcugggauuguauaggucugauugacaaaugauuuucuaauccuuuccucccggggagagggcugcugaggagauaucauaguacacuuuguaucuggagacucaguuacagucuuguagauauuugucuguagccuguagccugucuccuucccugccccaggggccccucuguuuucccugccugcccagcccuuacuuagacuuucuguucuugcuucccaccucugcugggccccuucucacauuguccugggagccccagcacuagguagccaucugucccugugcuaccugacaccuguggggagucaacaagcugucagaucacucaggggccuggggcuccuugggagugcugggaagaggcugaucuggcuagcccaguauccauaagacagugaggugcuuggguauucgagugcaugcgugugugcucacgcuugugguguagaggugugggcugugauguacuuccugaugguugucucuggaacuggaggugggguggaggguucagggccugguggccuugggcuugucacuugcuccagaagcaagauuuagagccaccagucugccaaagccuccugggaacaggggacagggaguagacuauagcagauggccugccucuggagagaccugucacugcagggcccauggggggcagggacugggcucugcucaccauacuuggaguucaggcuaugguggaaucccagaggucuggauugacaucccucccucagcaggugccuuuccugcucugugcagcauccugacucccucuuuaucuauagcguuggccucagguggccuugaggaucaagagcuaggggccaggaguuuggaugcuuucugcucugcacuaguguucccacuggcucaguucacugugacuuggucaccccuggggugggcguucguuguacuagaugugcagcuggcccuuacccacaccuugcugguaccucacuuucagcccuguagcuccaucugccuaugucccagcuaccgcuucucacugcucccuucacucugccuucagugaccagugguucuguuugcucuugcaccccacuauuucccccuauuucuuuuuuuuuuuuuuuaauuuuuuuuuuuuuaagauucauuuauuauauauaaguacacuguagcugucuucagacacuccagaagagggcgucagaucguguuacagaugguugugagccaccaugugguugcugggauuugaacucuggaccuucggaagaacagucgggugcucuuacccacugagccaucucaccagcccuuucccccuauuucuagucuaggccugugcuuguacagacaggaucugccuacgaccauccuuggcaccccacacccacccugugaagguccuaccauggcugucuuggcucuguggaggcagcacugacaccccuccccauugcuguaucccauccuguuaguuugaugaacuugccucuuaucuacuucaguugacucauuucuuuaaucuuggcuuucuccuccacaauaaugucccaaaagucaugggguguucuugugcuggcagguucagagagagugacaaggacucagugacuagcuaagccuuacauuaguauccagucaggcaggucaugauagugaggcaagaggccuuggcucuaucccaacacugcaaaaacaguuucaaacauaugaauugaucuuuuucccuuuucuccuccccuucccccaugaauugauuuuuaaaaaagaagucucagaggguugaguuucugcucagucccacuggguguggucuguucuaggacccuccuguuggcuggauaagguguuuggggcucugucauuuuccugucugcuauucccuuuacaguggggauaagaaagcaugagacaucucuacccaaaaccauuccagaaaaguaaagucuacuagaaaacgaagcucagggcuggggcugaguggauagaguguaugucucagcccuggguuucuucuccuguguaaacuguguggaucccagcacugugucaggagguggaggaugacaaguucuaggcuagugucuguguauccagggauacauagacuuugucuugaaucugcaacagaaccauggcugggaaaaggacucaguagauaggagcugcugcugcgcaagcacagacucaagugcagaugucuucacugacauaagagcugguccuagucaggugugcuugcagccccagcacagggacgugaagacaggaggaucucggggcugucaguccaaguauggagagcuccugucauuagagaccagauaaauaagauaaaggugauggaggacaccuguguugaccuacccuccaacacauacuagaaaugcagccauaaagaaauacaaccagccuggguggagauuugcaucccagcaccagauggaugccugcaaggacagagcuuccuagcuaggggugggcugucccuccucacaauggguagcaauuccugaagaguugugagccucucaggagcccuguacauaccuagcuuccagccuuauggguuccccucugccuugggugacacaucauaagcacccagccucuuuucugagcuagauccaguaacugggaagaacaucggcaccccuagaggcugcuuuugcugcaccuaaccuagcaagagagguggcuucccccacaggcccuagugaagaccuggucauagguaggcagccaccgggagcaggggcucaugucuaccacauccugucucguucauuuccccagacuuaccagguguucagugcucaccucuccuuugcugggucugucugccccuuuucuuucucuccuuccuuccccuccccacccacucaccuuugggaauaaguuccugucaagccaucugugccuugugaggggcccuguggucuuuugucuuuuuuggagacgagaggccaacuuuccgugugagcccuugcuucuauggcuaaggguggagcugucaucuugagugcacacaccagggcagccggcccuccagcucuugcaucugccucccaggucacaugcuccugcacuggacuuuuuggguucuggggauuugagcucagcucuacacacuuguaaaguaaaugcuguacccacugagaucuguaucuccccagcccugagagauccucuugucuccccugccacaguacugggauugcagccuugcccaauuaugccuggcuuuaugauuuugggggauuugaacucaugcuuguacaacaagcacuugucaugggcaucuuaguucaggcuguuccucuuacugauacuggagugcuaggcugguuguccuugaguagcagacaaagaauaaguuuguaagccaggcugugguugcugcccuacugacucucagauacagaagggaguauugcaaacuagggcuuuuacuugugggcccaucugaguggcagcugugucugugugugcugcagguggaauuucagggcagacuccagccucagugucuuuccagaguugcuccaggcacuggggcccucugcugccuauccuggcccagucccagggcaugggguguagagccagaugauuccuugcaagaggagaagccauggaacaaugggucccugggguugcuucugaccacagagcuggcagaagccuuucuggguguggaauguaucagggagcccuaggcaugguaggauagaagaggcagcugagacuggagagcccaguggaucucagcagcuccccucaacuccuguguccucuccaugagguuucuauauacuuucuucaauuagagagggucagccauaagggguccucaagugcuaccuucucagggaggguggggcagagagacauacauggagcagaaccccaggcauuuagauaccccucuuagaggucacuaguaccuucaggggccuuccagguuguagcggggagccacagcaucuuggucccucucugcuugacgucccaggcuagagacaccagcggccucgcucagugcgagaacccuucuggugcucugcuucuguccuuguggcucccuaugggaugauugucugcagcuggcuggcaccaucaccuggagaggaggaggcagcugggguggcugcuguucugacucccucuguagucaagcugagugugccuggggcagguguggcagcagccagugaccagagccugaugugcacagguuguccuggcacugugggcaaccagacaaggggcagcugagucgggguggggggcaucacuggggcuacaccuguccugggugaugauagacauaggaaggaggaagagaugcugggucauggccugggagacccuuggaggcaggcaggguggagguggggcgcuaggcuauggugaugucucagggucucucugggacucccuagcaccagggccccaggggggugggcaguggguuucucucaggagcccuaugucauaguacagaaagaucugucaggugcaugaaagugacccucuuguggccauauuucugggucacuuuccacuaacaugggucauguuuguggacccugcaaacucugaccccugucacaugcaggaccuggccaucagaguuacaggcccugccuguguagcuuugggaaaugauuaguuuggauuuuaaauguuuuuuauaacguucauuguagaguguggagcaugugccacaguugcacauguggaacucuggggaucagguuuggcagcaagugccuuuaccugccagguccucucgcagaacccauauuucugagccacaguagaagguggaggcagagccgguaagcuggccucagcgcuagccguccucaguuacugcaucacuugcugcaggugauuaguccauacuggccuuugcuuuugauuuaauuauuauugcugcugguagugauuuauuauuauuuuguuuuuuucaagucaggcuuucucugugcagcccugguuguccaguagcucacuuuguaaaccaagcuggucauaaacucauaaagauccucuugcuucugccuccugagugcugggguuaaauguauacaccaccagugaagcccagccaggacuuuacuuuuuuaaaaaaaaguuacauacuuacuucauggguauuuugccuguguaugugugcaaugccuguugaugccagaagagggugucagaucgauccccugaagcugggugugcuuaggagugcuggcgauugaggcuggguccuuugcaagggcggccagugcucuaacagcugagccauuugucucacuguugagcuuacuuaaggagcacagggagaggagcagucucuguuguacagaugagggaggcaucacagagcccgggaagcugggcucucugucgccaucugcugcacuuacggccugagcagggccgcaaucaccuagcuuaaaacagcuuccuagagggcauggauaggggcgagugagugccugcccaguacaccagaccucagaacuguuaccucaaaccccaaaaagcaugguaugaaaaccaacugcacggcugaugacaugcucagccaauaacggggcuugcugugaagccugaccacugguucaguucccaggacucacagggaagaacaagagaaccaguccugccgguugucuucaugcuuccacaugcaugacuucuccaaacaauaaauaauaaaaauaaauuguagcuggccgugguggcgcacgccuuuaaucccagcaucugggaggcagaggcaggcggauuucugaguuagaggccagccuggucuacagagugaguuccaggacagccagggcuacacagagaaacccugucucaaaaaaaaaaaaaaaaguaaaaauuuguaauauauuaauuaacaaacaaacaaacaaaacgagcugcagaguuguguccgaagcuguguccucaugugucagggcaggugcugggauguuaagcauggggguggggguggggaaaagagguacuagaaagugcugaaggguccuccagggcacugccccugccacuacauccagaagaugaugugggcagagguaguaaggagcagggacuccaaagacagacagaccacacauguaaaaacccugggguggugcucccagagugaaagaacuggugugcucaugguucacaggcuggcagugucagccuugggcuauaucuuacggacaggggagccugaaacuuaucuauugccacuguugcuguggcagccuuugcaucaugucccgugcugccucaggacagagcucuggaggggaggggagggagagaaggagaagcuuugucccuaggccaggccaccacaccucucugcgccucagcagccuggcucugaucauaugagcagggggagacagguauugggagcaagaggugcacugguucugcaguugcgugcaucccuuaguacucuccucauaaucuauguggaggucaacgggcaacuuguaggagucagccagccuuuuccuucaccaggcuuggcaacaagcuccuuuucccuaauuuaucuugcccccccccucagguuacaugugugcagguacacguggaagcuacagaacaacccuagcagugucccucacuuguucuccacuuugucuugggaggcaaggucucacugaggcuggacuugcugccaugauugcuggccagagagagcuccacagaugcuccuggcuucacuggcuucaccucccgagugcugccaucauaggccacaccuucuuccagcuuucucucugggagcuggggguggaguccaguccuuaggcucugaggcaggcacuggcucaugugugcacacgugcgcaugcaggcauacaccaacaggcauacaugcaaugcaugcacacucgucucuaagcacgacaggcuugcucucucacagcuccugucccuguccuucuggaacacucucaguguucuacagaagcccauuucuguuaucccuuucugucugccccuuccucccagccccugcuagacacagaccacagcuuucguguuuggaguacagucuugcuguuguggugggccauggcugugaagggcuucgaguuggugaugaagaugaagauccuauggcuccaugucuucacaaggcccuucuucauguguguagaugugugacagugcccauguuuugugcuauggcaggcugcaggauugaagcugaggugcguggagccagugacagcuuucauaaagcauaucccuguugucauguucugugacuggggaugagaucacauggcaggucucucccacuggccugauauuaucaagguuuggucacugugggucagagccuuguuccuguuuauggcugaguaauauucuguggaaugcauggaccauuauacaucuguguguccuugauagacaucuuaguuuugggguuucuaucuguugugaacaugugugaguuuaugcagauauguguguuuguguuaauuuuuuuuuauuuuaugugcauugguaugagggugucagaucccuuggaacuggaguuacagacaguuguaagcuggcauguaggaugcuaggaauuaaacccggguccuuuagaagagcagauagugcucuuaaccacuaagccauugcuccagccucuuuuguguucauuuuugccaugcucaauauguguuccagaguggcugcuucauuguccaugccuggcaguguagaauacuuccaguuuuggcagggucccgcaauggcuaagccucgagaucccaacccuccugccuugcucaguguccugcaccgugaacccuauugucuuuuuugagucucaguccuggcccuucucuccuguugaguuggguacuguguuguguccugagccccccccccacacacacacacauacacaggguguguccugggcugggggaccucuggaaugggaaucccugggccaucaaucuuuccuggcccaagucauuacagucagugaugucucugauagcacaggcaucccugggcagcaucguaugguggccucugcugugacacuucaugaaguccaugcuucaccagcucugagacccgucuagggaguugacagugccaguggccuccucccuucccaguguucccacccauauuacugcugucuccaugccccucacaccuccacugcaagguggccuugggcauucuguauccugauuugugucucuuucaccaucugggauaguguagugauggugccugacugcuucagauggcugugguguggcagcacaugagcacauguguguguguacaugcauguguacgucuguccccacacguguguguuaaugcaugcccguguguuguaggaauauguguauguguccaugccuguguggaccaggcgucccugacugaucuugauaggugccuugccccagaagucccucagccauaccauaaugaugaugaugaugaugaggaggaggcggugcaaguuaagagacccgcccuaggccacugggcucagugaagcccugggauggcaggggcauccagcuccauuuuugguccuccaggcacugguuaugguguuugaugcaaggcuagagcaugggucaauaaacagaugccgucugggccuggcgcuuaguagccaagaaugcacauaagguucaggagccuauaucucuuugggaggugucuuucacuagugacacugggugcugggguucuggcuguggcuucuuuccaggggagagacaaguggcucuccccagucugcuuuccuccucugaucuaaugaugcuagcagguccugaccucugacaggcugugguuccagaacccagggcugggcagccaugccacagguaaaccugguuuccugccccuaccccagcacuggcuuacuuguuuuuuugcuuuauucuuuauuuuauuuauuuauuuauuuauuuauuuauuuuuacauuugguaugcuuauuuuguguguauacacaugcaugugugggcuuugugucacauacugugccuguggagggagucacuuuucuccuuccaccacagggggccuggaggcaugggguuuggggcaggugccagccauucuuuuuuuuuuuuuuuuuuuuuugagacaggguuucucuguaaagcucuggcuguccuggaacucacuuuguagaccaggcuggccucgaacucaaaauccaccugccucugccucccgagugcugggauuaaaggugugcgccaccaugcccggccuagugccagccauucuuauguuugucccuggcaagucacccuggccugauugguguuauuuaaugacacugauuauuugccugagugugugugcaaccgugcauguucgggcuccaucauucguguuuguggucaggucaguucucugccuuaacucucaugauaaggcccaugaaccggaagcucacaugccagucugaauugcuugccagcagggucacacugggccaacaguugcaagggaagggguucuggaaagacuccaaggugccuuuccugaggcccccacaugggggcacucugaggauggcuaagaucuccuuucucugcccuuugccugaaccaucucaggcaacugugggcugaguccucugugucacuaauacuugagugcaugcucucuccaggcuggaccaaauugucaugugugucacccccagcacugacaggcuccaucuugacucugugggagccuguuaguacaaagagaaucuagguucgaguuguccacuuccuguuauuccuuucacugggaauagccccuugaaucugugaagguuugaugaggugaggcuacagguggggaagagaaaugucacuguguccuuuuaguguuggugcagagggucugguguggauccauucuguuuggugacaugaacuccgauuagagguucuacucuguucuugagggagauguuugaguugugagagcucacuacuggucccccgcugggaaagcuguagagagagaagggcaucucauggcauugcucuguaccuaucguuaucugccuucuauucugagacacagcaguuucuccucccuggguuguuggugacuuccccuucucugcugacaucgugguguucauggcucuugagccacaauguucucagcacauccucaucugccacccugugguggauuccugaugauucuucugccucaggacuguaguugauucuagacccucaucagcgaugcaaggccacugugcacacugcaagagcacgcaugugacagugucuaguuucaaacugaagaccaugucuguguguauagcuaaucuagauggacaucuuaucuaucuacuuaucuuuucuuccaucuaucuuuuuguuugcccacucacccacccauccaucuacccauuuauucaccccuccauccauuuauccauccauccauccauccauccauccauccauccauccacccacccauccauccaucuacccacccacccauccacacauccacccauccauccacccacccaucuacuuacccauccauccauccacccacccacucacccauccauuuguccaccuacuugcucauaccaccucccacccucuucccagcaucaguacugugaguucacaccaaggucugcaguuccuaugcagugucccuuggaccucucagcuccugugacaaacuucugcugacaguaagauccacucucugcacugagagcccccagaggagcagcguccuccauguuugucuuaggugcacgguucaggcuguuguacaaguucugugguccugucccuugccauggcuaugcugcuuucacuugaaauaaagucuuuucuuuuuuccuucuccugccugagcagggcccuacugguuucaguuucugaugccuuuggaacauggaaggugaacaaggcucaguguugggucugcugggaaggugcauugugugaaugucacugcccugccugcugccccugugccucacagucucggucagaggcauggagcccacaggccagccccuugugccucugugcagccaguguccucugcucagccugugacccagugucugcagagccaccuugcagcacagcuguuacaguuccccacauguuagaaggagacccuuccaccuugucagcugcuucaaaggccucucuuggccucugaggcccuagguccacaugccauuccccaccucgccagcagggugugauacucuuggucacagugucugcacccugggcugcagggaccucggcugguuucaacuuccuaagcagaguaaggcccucuuucuguacuuccuaaagaaguugguuuuuagcuggguggugguggcucacgccuuuaaucccugcacucaggaggcagaggcaggcggauuucugaguucaaggccagccuggucuacagagugaguuccaggacagccagggcuauacagagaaacccugucuggaaaagcaaaaaacaaaaaaaacaaaacaaaacaacagaaaaaguugcguuugguuauuucuuuacuuguguguguguaugaggguggucuuccucaguaugugugggagcucagagagcagguuucagcccucagucucccuuccaccacgcaggaccccaaggcaccuuuaccuguugaacugucucagcucccaacuuuuauugauuuuauuuuauagcuuuuaaauguuagcauuuaauuaaauuauauguguaugaguacagugccugaggaggccagagaggacgucaggucccuggagcuggagccaucugacauggugcuggggacggagggugccacagaggagcagcuggugugcuuagcccuccaacuuguaaacuuguauuuaauucaguuuccuuccuuccuuccuuccuuccuuccuuccuuccuuccuuccuuccuuccuuccuggguuuucagacagggucucacuguguagccccgcccuguccuguucuuggccuacgcugggcuuaaacuggcagaauucugucugccugcuccucagugcugggauuaaggaugugcgccaacaugccggacaguuuuaaauuuugauuuuuucuguuuuucgagacagagucuggcuuuguagucccagauagccuuaaacuccuaaguccccugcuuucgcccacgagaacaaggaugacaggcaugugccaucuuuagcuaugucucgguccucuuauauuccacugucuauuucugugacaaaguccugggggacuaguacgauugacuuccaagaggaaaagugguucuaggcugguaagagggcuuaguggguaaggagcuugcggccaugccaggccacauggugacacguuguccucugacugccacacccgggucauggcaugugcacucacauacaagaugaacaaaugaaaauguaaucaaaguaauugaaaauguccuccucacagcagcuggccacuaagauguuuguccaugguaugcuggucaccuguccccucaggccuauggaccacucuucuguggcugugcagaucccauuguucccagguggcaggggauuauuagagguuagacuacaauaguaacagcagaguugaagggguagggcuguggacagguuguuccucuggaaagugguggguguaccgguggggcauuccugagcuccccuagggauuguagagaggcuccugggcaucccccugugccagggccuugcuuguggcagaaggcaguggucuggcuguuucugccaucugcagcuacccuguugucacaaacuuugaccucacauccauccuccuucgacuucaagcagggaacuugggacucuggauguccucacugucuguugucacacccugggucuuuaggcauaucugaaguccaucuccagagaugacugguuguagugguauguccacagguccugcugccagccuugccuugcuccucugcuugacaacauucccaucaugccagcuucugugucuccuugccauacccccuccuggguuggguuuccugucacaacacacuggaggauauuggcaagccuguguggccugucccuggucaucucugucuugauccaucuggauagaguugguguugggaaagcugaagauuucccccuugagccacuuuccugauaccugugugaucaugucagccaaggcucaguugagagccccaagacuguggccugacccuaaugacaccccagagaugcuggggagagacauaucugcugggagcucacugugggaacagagccuggcuuccuguuccugcaccuaucuagggccaagagggaucuguagcaacacagggaaccccuuuuuguagcagcuguguccugcuuggguuucuauuuuggggacuugggcuggggagaaguggggacuucuuaucgugugaaguguggacucuuguccagacaggcaguuaccugcugaggcaguggcuuucuguggccccuuggucuccuugguggccggccugggacacccugguggauggaguccuucaugcugugguagaguugcugcugcagaucugcugggauuuugcuuggagaacagggcuauacaagagcccugugauguucaagagcugugaugcugcaguggcugucugcucaagcuugucagcuguucucuacagcucucagaaccaugauagagucuaugcccagugcaggucaagagcaugcuccuccaucuccagugugauuguuccacugcucuaugcuagcagcugcuucuguuggccccagaugucucugaggcagugucugcucagacccuugccugacuuuucauggcuugucuuuguuugagugucaagggcucuauguucugaaugcuggucccuuuucuugugguugugugguaucuuagggguucaauacugugaugaaauaccaagaccaaagcaaauuggggaggaaaggguuuuuugaguuuauacuuucauauuguagucuauuacugaaggaacucgaauagggcaggaaccuggaggcagagcugcuguagagaccauggagggugcuguuuacuggcuugcucccccuggcuuguucagccugcuucugauagaacccaagacugccagcccagggacggcccuacccacagugggcuggacacuccuccaucaaccacuaauuaagaaaaugucuuacaggcuuaaaaaucuacaguuagauuuuauggaggcauuuucucaguugaggcucccuccucucugaugacucuggcuugugucaaguggacaugaaacuagccaggacaaacggugagcucguuguguauucaggauacuggucucuugucuuuuuuuuuuuuuaauauuuauuuauuauauguaaguacacuguagcugucuuaaggcacuccagacgagggcauccaaucucauuacagaugguugugagccaucaugugguugcugggauuugaacucaggaccuucggaagagcaguuagugcucuuaaccgcugagccaucucuccagcccccggucucuugucuucuugugguugaguggugaagacuuuuuucugaacucuggucuucuuggacuuguggcuuucagguauuuccugagagccaugauaaagagagaggcagccuuugaguucagaggccagugcauguuaccucuuaccccuugucugaaaacuacaaauauucaaggccacaaauacucuuaggguuugauguuugauuuuaaaauuuguucuggacugguuuagaauuguuuuuguguguggucugagggucuaaauucauucauccauccauguauauugcaggaacuuuucuugaacaaaacccacucuccccauuaaugggucuagccuuagcacagaucuuuagugugggucuauucagaaaucucaacucuaguagcuuuugcaugguagcucuugcuaccagugucugucugucugucugucugucucucucucucucucuuuuguguguguguguuuuuguuuuuuguuuuuuguuuuuuguuuucgagacaggguuucuauguaguccuggcuguccuggaacucacucuguagaccaggcuggccucaaacucagaaauccgccugccucugccucccaggugcuaggauuaaaggugugcaccaccacaccuggcaggacuaggucuuuuauugcuggagguguuggggcuggaacccauggcugccccagcuaccucccacccauucuuguucaguucuuggaaguuuccuauccugagcuguuugauaucauuuuuuugcuggacugguggucugcaagcuccuaucucuauaaacaccuuuaccucuacuccccguacucacacucccuuaccccugcuggcagcucagugcugcccuuuagcugggugcugggauuuggacucaaguccugugcagcaagcacucucacccacugagccaucucuccagcuccucuguugaauucucuguucuuucagagagaagguugugacuuggugcugggccugccuagaagcagagugggggacagcagggacaaggucaagagccccagggacggggcaguuuccagacagcagaggaggagggagagagaaugggguucuugcuggugcugggccugggaagacuagcccaggggauccugaaggcauggugacaguugggguguggugugguaggaucuugggugaugggaggguuguuagccugucacuauuuaggaaguguauaggggaagagcuuuccucaggcacgggccaaguugggcaaggcugagcaucugagcagugacaaaggaagcuagagcccaggacaguugggacaaaaggcauaggugggggccauaaagguugcagauugguaaccucagccacaggcuccagucacaagguccuagugccacaguggcacgucuugucaccaagcccugagcauuugagucccugugcacuaaaugguggcucacugguggggacuacacugaccuaacucuaaaggucagggacuuugaaaggagccaggcacuuugugcucuuugaggccagguguagcccaggcugaccccagacuugguguguagcugagacuugcagugugucauauguagcacagguaugccucagacuugguguguagcugacgcuggccucaaguuccugcccuccuucuucaccucccgagugcuggggugacaggcaugugccauuacacuuggcuaaacuugaaaaucaguagcugucugcggcuucucuauuguuacuugacugcucccagcucucacuaugcuagcucacaguggggcagcagagagcuggggacagccugcuugaacaauggcagggcaaggacugugccugguuggacaggcaggggcugcagccauguagcuuagucacaagcucucaucugcacuuuguaggcaggacacugcuacugcuggaggugccugacaggaagcaaccugccugcuuccuugagccugggucaucuggccacuucagccccuugggaucuucuggaacccucagguaaguggccaggcccaaggagacagguuggcuggccugagugcuggagagaugguuuggugcuuaagagcagucgcugcucuucuagaggaccagcacccuugucaggggcucacaaucaaaacuccuggcaucugcagagcccuguauucacaagcacacauagcuuucaucugcacuuugcagggugcugcugcuucucacauguacacacacagacaugugcacacacaagcacauacauaacuuaaaaauccuuuaaaagcaggaucuauagaaagagagccuguuuguggggugguguuuccaagggugaacccagggcuuuguguaugcugauccaugcuuagcaccaagccacaccccagccucucugugaagugugaaucguguuaaugcacuguccagugcucaccaugugucugugguggccaucagaguccccgcccagugugagauguuguguccacccgugcccuucuuagcuccccuugaaaggcaccagucacccucucacauagcagguuccucugcccucaggaaaccagguguguucguuugugucuggggcuagagacacaguccugggccuugugugugaauuugggcaugaccacuacaccgcucugcagcuuggauagggcuaauuuagcaggggcaucuguaguggcuugggguuccccaggaaggugcagggcugagaaaggcccagaugggguuaucaaguuguagauaaauuuuugggguuucaaguugggcuucauguuaccucugagccaugaagacagaugccacugccaaguggguucauugccgccucccugguucagggaugauucccagcaaggugauuuugcaaggccauugagcugaccaggccauugcagauuggagcugggggaggccuuuccgcuugcuguggacagggaagccacggcucaaaaggcuugaccugcagggccuggcucagcaucuuaggugggacucccugucugcauugggcuuuauuaacucaagcuggcacaauagagucuugaaccagagauuacugccucuugggcucaaaacaaccagagccacuguccuugcaggcaguguggaucacugguggcugagagacaguggacagguggcucuggcuuggaagucauugugucuuaaccuccuaaaacaacuguuuuuguccuucaagcuuagugccccagacagccuuugcccucaaacaagguuucugagccaggaugagccugaagggaguggaagaguucuuuuuuuuuuuuuuuccucgagacagguuuucucuguauagcucuggcuguccuggaacucacucuguagaccaguagaccaggcuggccuugaacucagagauccgccugccuuugccucccaagugcucccaaggcaugugccaccacuucccggcuaccggaaugccacggaagaguucuuuccccagcucccagaaggaaacuagggaauucacagugugcagggaggguccucuggacacacagggcucgcucccucagcagguccugcaggcuucucugucuggagcauccacucagccuacaagcaagaguagacagcucagugguuugcaguauauucacagaguagugccacugccuaguuccagagcuguccauuaucccaggagcaguuaguuagcucucuccccugccucuagcacccauuuaugggguggccuguuuuggacauuuccuguuauggaucccacauugagugauguuuuauuagagcuucuauugcuaugaugagacaucaugaccaaaagcaaccuggggaggaaaggcugccucugacucccaagggcugggauuaaugugcaugucgcccaaccuccaagcaagaggcaauuucuccccuccccuccccuccccuccccuccccuccccuccccuccccuccccucuuuuuuuuuauuggauauuuuuuuuauuuacauuucaaauguuuucccccuuccagguuuccccuuuggaaacccccucucccauccccccuccuccugccucuaugagggugcuuccccacucacccauucccauccuccugcccuggcauuccccuacacuggggcauuaaacgcacucaggcucaagggcugcuccucccacugauguccaaaaaaggccauucucugucacauguguggccagcgccaugggucacuccauguguacucuuugguugugguccagucccugggagcuccaggcgggggugucuggccuguugacaaauguugcucccuccaugggacuacaaacccccucaacuccuucagucccuucuccaacuccuccagagguauuuucuuaauugaggcucucucagaugacccuagcuugugucaacuugacauuaaauuagccagcacaaguaguuuuuuuccugggucucucacuuaagcugaucaucagaucaucaggucccuccacacuguggguaucugagucucacgcucguucagggcugccugguaauccagugugugguugggucauacuuauccauuaucuaccuuguuucugguuuggcuacugugugcaacaugaaaucaugccauggacuugcauuggacuuucugguuuaugguggcaguggcuuugguauuugaguaagauuggcccucauagguucauauauuugcauaggugggauuaggagggauggacuugcugaagguaugcuacuggggugggcuuagagguuucuaaagccuauauuaaucucagucucucuaccugcagucuguggaucaguauguaaagcucucagcuacugccucagugccacucugcucccaccaugauaguaaugcacaagucucugaaacuguaagcaagcccccaaucgaaugcuuuucuuuaucagaguugcuguggccauggggcuccuuacagcgaaaaaagagcggccaugcuaggccuuuggagcucagaagcuccaggagcagaguguucaaggaguugcuucuuguagucucagaggcuucgaucugugcugugacaguugguagcagcucuguccugcccugcaccacaguuuauucagaacacacgucagacuuccacuugaauccauccugucucucgcuccacagccuugagugccuuucaccucagccucccaagugccuuccagacacccacucugugccugcacaaagauggaugcagcugagcugucucugaggagugguccugugugaugucacaggucauggcccuuguuccuguguuggugugacuuaagauggcaucuuuuaguucucccuuaaacauauaggauggggguggggggcuagagagauggcucagggguuaagaacacugauugcucuuccagagguugugaguucagcucccagcaacuacauggugguuuacaaccaucaguuauagggucugaugcuuucaucuguuucagugacagcaugcucauauacauaaauaaaucuagaaaaagagaaaaaaagcacacacaaaacuagauggaugucccauguaccuucuguaagcauggcagguccuugcaguuccccgacagccggcuccugggagcacugacagccaacuccugggaacacuuggucuggcuggccuuucuacuccuggugcugugccaagcccacugcccacuugcccccgugacccugccaucucccgaguuaaauaacaaaguuccaaacuuaccagccguagccccaggcucauagccggccuuggccucuguuccagcccaccuuccugcaguccagcugaccacacaaggcccucagagcuuauucuuucuaccagcccuucuugcuccaucccaccccugcuguucacccagauaaagaaaaagagggcagggcugccaggaaggcugcaugcagaggacugggaggugcuucugucacagcaugcaggcuucuugugcucagggaucaugcucaacuugcacacagcuaggagaguaagaggaguggggcagucagcauucuaggggcaaauugugcaggcaagaccuguccaggaaccccaacaugggcccagccacaccccggaaccggcacagggagauguagcuaccuccaugcuggagacugagcuugagucauggggucucucaagaugguagcccaagcccaugguuagcugggagucaccaggaaguuugagguaucagaccuccagggggagggaccuucaggagcaggggagguugggaagacacccugggacaccagcaggacugacaccuguagugucacuacugaggggccugucaggcuccuguucuguuuccugaggguacugccuaggguguggcaccugugcuguccuggccucauggugccugauugcuucugugugucaaagggcucagcccaaaugcuaucccccugccuucucaggcccuuggagcccagccuaugugccccuagucuucccucugggaggcuuuguccuagggcuugugugugugugggacaaguguguguaggcaaugggguacaggugacaugacauagccuggccacacagugucccacugaagaagcagccauugcagaggcucuuugugugcagacccugugcuauagccuagggcaggccaccagccacucagccuggccugaaagcucuggucuugacacauguuucugaacaguaggagcaggguuggguaggucuuauuggacaccuuacucucagucccuguuuuaacaggcaggaggagggcagggcacuuucccugugggcaauaaggaguuguugccacuaaguggagacagugaguuuccuguuugcuggcuagcaggugguggcuggcuguccucuucccccagugcccagcacauacaaucugaggcuggguaggaggcuacuagcccugccuagcccagggccucaaggugaguggcaccuagaauccauugugcugggcccauagcagauaaugggcacgccuguguccugcgggcuuuuguguaccccaugucaguggcagcuguaacucguugcuauagauagauggagauucucagauggugcccaaguucauggugcaucugugguggaaagcaccuggccugccuggcucuccuggggaccugggccacugcaccugccagccuguccagcuucucuuaggacuugagccuuaucucccugcaucucuugugaugcaugccccagagagcucuggcugaucccuucuccuaucccaaggguccuuuucuucuggagggagugauauuugucucuacuaguccugguccacaccucugcuaugccucucaggauagccagaggggucagugugggccucauucucugcugauaaucugcagcugggaccuucaggaucccaaguccucgucagguaaagucaccugcugccaagcaugacaacuccgagguuuaacccugggucacacuuguggaaggagagagcugacaacugcagguugccuuccgaccucugcauguuugggcagugcugccugcuauguccuagcccucuuucuggugagccuucauguggccagcaggagguuagcugcauuuuguguaccaguguggugcucugucugugccccacuaucacuagcacccagugugggggcugaaguggccccuugaugggacacagcucucaggucucaucccccgucacaggugcccacacagcacccugguggcagccugggccuuuuccccgaccauauuggacuugaguaagagacaggcaggcaggugggagaccaaagucaucaugaaggagagaaccugugugaaagggaaauggugggugcaggcacccuuaucccacgagguagagagacaggccauugguucccagugguccggcucuggaacagcucuguggcacaggacucagcucauagaagaaacucugcuccaccauuucguguggccugugaggcagcggaggagggccauggucagggcugagaggaguuagugguccugggcccuuccaugugccucccaccugcccauucuaacacugaggcugcuggggccccugaggaggugcugugccuucuacaucauccuucccuagcucucacccucuacaucuaggagguggcaggugagcucagcaauuaguguggggcugcuggggagcaguggcaguccugagaccugcugguggggucaguugucuagcaggauagcuucuaguuaugugguuagggccuuccccuuguguacuggaggacaaugucuggcagucccccucuguaaacccugugcuccugugagcucugagggcuaugucuaguagacccucaggacacccaggugaugcacgcagccuuauuccucuccagagcccugaaggacuguggccuuugggugcucagacaccaacugguggccuagcucacggcuguaaucaagcccucuacuccauuuaugggcaugugcugccacuugguggacacuuugggaaaugcauaggagcuauucucuacucccacuuuggggccuguguguaugugugugugugugugggggggcaguucucuaggaggaugggacuccacaacccuuucuggacccugggcugcaggccauaugauugcccagugaggagaaggcaccuggcugagaagaucccuuuacaaggggcagguaggaggccagcacagguaaguugauguuagcuguggcuugggcuggcucagacagguuggauuugcccuccugauccagggcucuaagaauagcugauggaguccagguuucaaacaguuggcuccugugcacaaguggagcccucugaacaagcccagugugcucucacaugugcacagggcuccugggugacguggugaccuaaggcuacaaggucugcaugggaaggucccugcugagaacagugcugggcuccagggggccucugauuggaaaauacacagcuucugggaccccgucagcuuuagaaggaggguuccuauguguuuacucaaccggugucaccuuggcuuuugacuggugggaguauggggcuuugugguuugcuggccuggcacggcugccugcuguugcccucaggagcuguggguauuucguugccuccaagggaggcuuggagguggugauggcagggcuaugcugacugcucuuaucuccucacagguguagcuccacuuugcugcaaccaugggguccgaggaccacagcgcccagaaccccagcuguaagaucaugacuuuccgccccaccauggaugaauucagggacuucaacagauauguggcguacauugagucgcagggugcccaccgugcuggccuggccaaggugcgucaugccacucccaagcuccuuugugcccagacacuguggcacugccuccccgaccuucuuaaacauggaggcagacacugguuuuguggcuguggcuugggcuggcucagacagguuggauuugcccuccugauccagggcucuaagaauagcugauggaguccagguuucaaacaguuggcuccugugcacaaguggagcccucugaacaagcccaggguuccuagaccaaaucagggcacauguuguguuccugacucuagggaguggccuagcuugggugggacacagaaccugcugcuaugagggacaaagcuuuuggagggcuaggguuggaaggggaccugaugccuaggggugguggugccaggagacacuuuuaauuauugauggaguggcagagguuaaguaccuuguucuuggggcccugcgacucugccuaaacuuugcauucuacuguuuugccugccugucugaauggagcugucauacuaaguuguggcucagguucccuguaaccuuguggaccuauguuaauccaugggagagaaugcuggggaggcugacuucaucugagcccuaggcacacacagcacagcaugagcacacaccucuuccuaccuucugagggcagauggacagacaccacaagcaucuguggcccgugcucugccguaugagccgagccguguaugagccaagggcauaggcucaucagccuugacugguguguguacguacgugcgugcgugcgugcgugcguguguguauguguguucgcgcuaugguguauuuguguguguguaugcgugcaugucuauaagaaugugaauguguggguggcuaucuguguaagaauguguauauguauguguauggugugucuguguaagaauaugugugugaguauaagaaucugagucuguguguuuauguguggguaucuguaagaaugugagcauguauguguguguguaugugugagugugagugugugugugugugugugccugcugcagugggacccaacugccccuuguuugucacagcugucuugucaugguuguguggugccuguacugcagcacuagccuggagcacuuaaauaauuggggaccugggauccccuacccuugggagcucuaucaccuacaccguucuuggccccgcagaucauuccacccaaggaguggaagccacggcagacguaugaugacaucgacgauguggucaucccagcgccuauucagcagguggugacgggccagucggggcuuuucacacaguacaacauccagaagaaggccaugacugugggggaguaccgccgccuagccaauagugaaaaguaugugggugagagcagucucucugcugcucaggcuucucacuuuccagaggcccagcuugacccuuaccuugucccugucucugucccuagggggcuucccucaucccaguauguggccugaagguggcccuucaggggagguccccccaugcuuccuggaaaccucuuccugcuuccgugcaucuuguggcuuacagucacagcaugcacagacacaugguccccaugcucucagcuccagcugccccugguuuccaaagcucuaugccccuccuuguacaucuagccuuguuucuggaguuggguucugaggcuccuagaggguauuauacugcccagaaccuaacccgaaccacugcacuguuuacagguacuguaccccacgccaucaggacuucgaugacuuggagcgcaaguacuggaagaaccugaccuuugucucacccaucuauggagcugacaucaguggcucccuguacgacgauguaagugcccaaaagugccugcuauaccuggccaccauguggacucauggggaugggaggaaaguggcuauaccuuucuucucagggccaccccaacuccgguggcucccacuucuguguucccuauucacuacuuggcagggcugugcugucuucuggcccaggguggcaugcugcauaggaggccacagccugaaccaucucuguggugguggugcccgcugagguguggagcugggagcccacggcugggagcuguaacagagcugagucugcucuggcacuucacuguaugcuguugcaagguucucuuggucgacugugugugugugugugugugugugugugugugugugugugugugcaugcacacacacaugugcacauaggagaccagcagauaaucucaucuguguuucucagauccaagcccugucuacuuuggguuucuugcaguggggacagggucucauuguguaggcaagcuugccucaaccucaagaaggucugccuaccuccaggcucuacccugaguacuuggguuacuuggccuacugucauuuuauuguuggguuuuuaaaauguauuaacuugcuuuuuuuguuuuguuuuuguuuuuguuuuucgagacaugguuucucuguauagcccuggcuguccuggaacucacucuguagacuaggcuggccucaaacucagaaauucaccugccucugccucccaaaugcugggauuaaaggcuugugccaccacgcccagcugcuuuuuuuauucuguguguaagaguguuuugccuguaugcauguauguugaguuccccggagcuggaguacuucugguaugagccuccauguggguucuaggaacuaaacuucugggagagcagccagacucuuaagucucuuaaguguugagcugucuccccagucauuugaccuaccuuguuggcugggagcaucucacugaaccuagacaucacucauuaggcuagacuagcuggccagcaagcugagaggccuuccccuguuugcccagggcugggauuauggguguguaacgucacagccacuuucugcauggguacuggggccucccacugagcccugucccuggugguuuuuguguuuuuauaaguuguguguggugugaguguuccuggcucuuuuuguguguaggcacaugugucuggccucucugugucucugaacuggggucaccaggcuggugucagggaccuucauggugaguccucucaguagcugugauuguuucuaugggcagcuuggccauauacggaugacaagccacauggcacagcaguuagacacauaggguucaguggacucuacuguacucacagagcugcucagccaugccuaucacaccagaaaacagaccuagcuccacaaacaguuacaguggagggaccacacagcaugaccccaucugucaggcaauagaugugugggcugaggccugcuugggcuccugugggccuugucuagguccauguggaugaggguuguguuucucugaggucugcaucaaagguggaccugcuggucuggucugcuuuccagcugcuggccaguacauaaugaccuguugcuaucacacuguuguaaccucaguagccucuguccuccuuauggaacugggcaucaccaggaucacccugcugagaccccagcauguacucugguggcucucuuaggggcagucuuaggugcaggcaccugaggcucccacugugccuuagcuccagcucgcagcacuugacaggagcuuagggcaaggugggggcuccauccguauuugccugcauccaucugaagcuguccaggcuugucugaugcaagguucuggaagggcugucauuugagcuuggguucacaugcuugugaagggauuacuccacauggagacuguccuucaguguuacuuagagguauggacgucacugccaaguuguaguugucccuugacaugugcuggcuuguggacaguuauguguaaccgcuguuccaagaagggugggguggcgaagaguguggagccuaagcagcccuaaugugaccuuaggccccuugaccugucugaagggcccgugaugcugacauaccccagucauccuuuuguaccuugggugacuaugcagccaggguacaggcagguacacauguccuggaaggacucugaugacugcacacucauuguccauaggacguggcgcaguggaacaucggcaaucugaggaccauccuagacaugguggagcgcgaaugcgggaccaucauugagggcgugaauacacccuacuuguacuuuggcauguggaagaccacguuugccuggcacacagaggacauggaccucuacagcaucaacuaccugcacuucggcgagccuaaguccuggugagugccaggaugugagccaugggaagaccugaugguugcugaggggccacuggggaauuuccaguucccucuuugacuuggggagguacacugacccaggacugauguucacaggauguaccccugucauccugggcaguggaugggggcucuggucuugccugagccucagccaggccaauggaugugugucaccugccagccacaguacagggacugguuucugugagaccuggaggcugagugaggugccagcagaaucguucccuucaagugcuuugugucuggggcccuuguguggcucuuggucucccuggagcacaaggugacagcucaggucuucuuucaaacauuggaaacuagggagaucugcugccccuuaguuguacccuguaaucacacagugugguccuucugcccccauuguccagcaccuccuugaggcuccaggugugacagggccaccugcugggaguucuuguuguacaguggaguccaugcucagcccuaggcagcucuccuucccuggaagacacagcucuguugauaugaaugccuuugauggccuagcuggaugggaaaauguacccccaaacccguuucccuuuuugacauucucaugucuugucggucccagaacuguuuccuugcaguuacagaggugagaaauuccguuaguguugugucugcuuucugguucccagagccguagggagcuaugcacugcgcugucccagggucagagguccugcauuccuuggcccugggcacccuuucuccuccuucaguccuggccacgagucgucucccaggcugccucugacuguguugccucugucugaggguuuuguggugacgcuggucauccaggacagcccccauacgcucaguucccugugcauggggaggugaacucuguugguucugggaggucagggaugugugggcagcacucugucggcccuggcucuuagcugcuuuuccuguuguaacaaaauccugacaagaggagaaaggguuugccugacucuacugucauaaaggggaggagcugaaucggucacaugacaggaaggggauucgauggaugcuguugcagcucccucuccucauuugugguccaggaucccaacccaagggauggugcagucuucuguccucagguagcacagucgagauaagcucacaggugauccugcaggccugucuccugugcuucucuucuuucucuucuacaguuaacccugcuuggaccaugcucauugugggccccucuggggugguugagcuacacacuuacaccgaauucuaacucccaauaucccugucuguguccucaacccccaguguggcccccuagccucuggugacaucguccucuguguagaccuguccagccaugugacuccucccauggugcucugcucccaccucuguggagggcagcuaugguagcugacacuuggggcucagggaucccaugagaagugauguggcaguggcaaggaccuguuccucgugauuuacgcagggccagugacacccacagaucuaaaccaaaucaauggcuacuccugcugcaagucacuauaugugugcagcuguugccugccuaagcaggugugguugaguguauuugugugugagaauauaagcaggaugucccacuccuggugaccacuagauggcacucccaccuuucugagugaggcaacuguucccacuggcuuccuggcugcaguuagcaggcuccuugacugugccuuucuccagguaggaagccuguuguauuuuauacaaaaaggagagccaggauguguuuuguagagcacaguagaggugggaggggugccucugggcccauacugaaacaucucuucuuucuaaaguaccagccauauagguagagugaggaauagggguuauuuagggcauaggaagggaauuugagaagggaguagagucagagaaagacagagaagagagaggggaggaaggaagggagggagaaagagagagagaagaagaggaggaagaagaagaagaggaagaggaggaagaggagaaagaagaagaagaggagaaagaagaagaggagaaagaagaagaagaggaggaagaggagaaagaggagagagaggagagggagagaagaagagaagagguuggccaggaacacggggagagagaaagaaaggggucagggagaaaagauagucagagagaucaagaagagaccacacaaccccuuuuauaggaagccaggcuacuuggcuguugccaggugacuguugggcaaagccuagaaggaaugcuaacagagccuaugacaguuccuaguaugggcaccaccaaaguccagcguggugccaugaguuuuauuggggucacugacaggcauaugcaugaggggucaccuacuggagcagaaaugacucacagacagcugcaucaccaaggccugagugacagcucagaaagcugagaaccugaugcucaccgcacagccugcagggaggaugucaggaugcagacuguccuuuccagugccucaguuggucugagcaucuuccaggcagacugguuuccugagcucagcuuuauuagugcucacucugacagggaggggccaagugaagcugguugguuucagggacuuccugaagcuguuuuuaguugcuuaccuuccuguuuaaaaugcaucucugcaaaauggaaugcuuuacucucagagggaacuguugcaaccccuccuccaucagauccucuaguccagucuauguuuuguguucugguucagcaccauacuggguuuuggauacaugaggauaucugcagguugcaguauuuucugaagguucucugcaucuguugcagcuuugacuggugugauuugagggucaaggaaucugaaggugggggugugugcugcccugggcagguucugucuagucuuccagaagcugccccugcagguggcacuugaaggagcggugggcucucaugcucucuauagaaagcuguucuugcacuggggucucuggaggagugggcacacuguacagcuguuauaaggcuuccaaggacagugccuuguaugggaaaugaggaggccuguauuugaaggucucccagucgugcuucccccuccacccuguguaaucugcuaugaccacuaugguuagucagacccuuuagccuagccuagggaagguagccuacaucaauugcccucuaagaccccaaaggacggcuggaucugcuggagagcugcccuggcuuggaucucuaucagcugguauggcacuggcuucugagugccuugcagcccccauacugagggagcaaagaugguucuugugcccuacccuaacucucugcaccugugagggugguuccuuccaguugucagcugagcugccagaucccucugaugaugaagccagcaggaggcagcgcagcuuggagugguugucucuuaucuggcucacauugcuggucccucccuuguccugccucuacugugugguagacaccugggagguggaugcuuuccaugugccaaguauucccugcagugcuuuggaaaggcagaugccccacaaugucugaguugaacugaugugugcaagucugugagcugcugcugucccugcucugaccugaagccagugacugugauggucucuugguguggggacaucaccacugggggggugggaguggggaugggggacuucuucauggucccugcacugccacucuguccucucuagagcaccuggccauggugcuuguccucaguuguccuugggguuuaugagauugcagagcucucuauagaaggaaccuccuccaagggugacauuugucccagguagcugcccugugcuguagagccuaacaacaggcucuguggcuguguugcuaaugcaccaaguauggcuguggcaggaucuuucucuacccaguccacaucucaaugauggccuuggccucugucccaaggaugcaaucacuccauguccccugaccuauguugucuccgacauugcaagcaugugaagucaguccacaggcuacuguguguucccucccucaggacuagaagccaggagaccccaaauguaaggugauugagagccagccaggggcauucuccagcuggacucaaagcucuguccuguggggcuuggcucuccagccaucgcaaccacuugguccagacacacagaagcuagcaagggacaauuguguuauuccuggcccaguaccccuugcugccuugucauugggcccuuggccucacucuggccacagcugcucugucacccuaaugccaugguucuggccuuccgcuuguugagacugcuguacaucucagccaccacugcagccagauaaguaacugaggcuugugacgugccugagcuugaacuggggcauugggccccuggcaugcaagaugagcccugugucauuagccaccacgaugcucugaugaugacgggcaauuucagggaaucuggugcacacggcagggugcagcucugagucacagccugugcccauuagcucgaugagccguccugcuuuguccuuuccacaaccaggccugccgaagacuuggcuguggcaggcccugccucgcagcuguguucccaggaucugagggucagagcagccagcacaccauuugcauguuggggcucauacagggucccacuugacucuccccugccuuucugucuucacuuaaagaguuugcuucugggcugcagagcucuguaagcaaugcugagcaggaagccuucuguauucuuugccugaaucagggcuguuagccugcagcaguuugugaggagccccuccccaccccacagacuuggggaauuggagcugaguugggcucuugagccaaacggugagcuggggugguggcccguagcucuuucucuuugguuuuuauauggccuacuuuuuuugguuggggauuccucucccuuccaccacccuuuuccucccccucucugucuccuuucuucucuccuuucuuccucucuccucugucuuccucucccugcccccuccccucccuuuuugucuuccucuuccucucucugucuacuucuuuuacuuucugucuucuuccuccucuuuguccucuuccuccuugucucuguccucuuccucccucuuccuguuccucccucuuuuaccugauagugcagguggaucugucuauggugagccagcacugcagcuuucccaggaguggaccaugcgcuaugcagaguuuucagugucuuacacaguccuccuagcuccucugggcagccuguuaucugacuucccacuuuccuucuugcucgcuggccuuggugauguggaguauagugucuguggucccuccaucacagacuggccaugcuaaugcugaccuugacuguguggcucaggucgucuccuggguauucucucccagcagggcauucuuuaaugucugccacacuguacuuugaggugaaauaaacucuaaaauuaaauguuuuaauucucagagaagucaagagaggaagaagcaggguggcccugugcuaggccgacaguuggacccaacacugucucuuuuucagggugccugguuccuuuccuucuuccuggagaggaaucacagauggagcgugggcucugugguaucugugugccuggggcucuguggcucagaaguggaguguaugaacccuuugggcucucuaggcagccuacaguagccccuugccuucaggcugugugggaacacccuugcuuucugcagcccugaccuuggaggggccaucuccugaugaggccagacucaccccaaugaguuuuuaauaaugacuuauuuuuauuuuaugugcauugguguuuugccugcauaugugucuguccaaucccuggaacuggagugagcugucauaugggugcugggaauugaaucuagguacuuuggaagauuagccagugcucuuaacuacugggccaucucuuuaucccugagccacugaauucuuugcaggcucccgguaggccauggaacccccucuuucuuacuguggaacgaaggaugggggccuagguguguguucauguguacucuccaugugugcggugaacugcugugcucugcaggagcccuugaagucccauugcccucucugcacacagugcugcuguccuggcuugaggacuugagcuaccccauuugucuuugaacuccauacacuccaugucccugggcugcguggccugggaaaggccauugcugaacuuuguauaaacgguucagucuucucuccaaccauauguaaaagcuugauuggcauacuuccuguugggaauucaccuuugcaggcugucucaggcucagucaccugcuggugacuuuugggauguccacauauaggucacaccucuuucagguggacagaccucagagagaccugggugaccacaggccugcuguccaugcugccuaccaugcaggccacaguguauagcacauagguccuggaagugucuccugucuccacccauauucucuuuguucugagcagccccccuccuuguucucagaggaccugccccuaauucuuuguuuuuaaguuugaacacagugauugggcagaauccugagccuggcuuaggagaccacugacacaggguuacugcaucagacugugaguccaggcugauggcuguguacaggacuccuguugucugggacaugguccaggguauuggaagccucugcauguccacagcuccaaguccaaaauggugccuuuucuguaccccacucauguccaccacuaggcccuuacuagcucugcaccaucaccaggaccugccucucggauucucuccugugaaccuuucccagacuuugggcagugcagaguaggugacauuuaaguuuuggucuuuguccuucacuaaaaauccaugggggugggggugggggugggggugggguggggguggggccccacaccucaucugagcaugcagccucugccucaucugagauuguuggacacaaaugugacagugucuaaccucuucccuggguccccagggagaugugacagucacagauauccauccaccccuccccggcuacccagacacuguucuuccccauaccaccagcuucccugugggugguugguccuccuaucucugaggcucuguguucuccaagcuagcucucuugauccccuguguguuucaauaaaaaugucauuacuagaagccauugacaccgcuggugugugacaccaaauucuaccgcccauugucccagaaaacgauccauuagagauaaagccaguggcucaauagucuccauccugggagcagccucucccauucuggcugcugcuaucuuugcugcaguuuguauugucugucccaccugcacaagcgauaagacgcuaagacgcuaagacguggggauucccuggugggaaugggcagaccucacucagugccagccaggucaggugguuccuuacuggaaaucccuuuuggguuaggcaaacugaagcucuuuuugugggagugaucaaauugggguacauagaagccuggucccucauauggagcugcucacagccccaugugucuuucccaugugugucacauccucuccauugggugggcaguggguguugacagucuguuugccagccugccucugaugccuggguucaagggcaccuucauuuaacaccugucuguccagguuuugcucugaccuguggaaucccuccuuuugagacucagcugcagaggccuccugcuuggucacaccaggaagucaccugcagucccauaugcucucuuuccaaggucucccaggcuguggccagggcugugggagccaccaucacuugcucuuugccagugguaugaccauaggccucaaugagacccugugggagggagugugucuaccauucuugucugcauuccuguugcuggggacacagaacaggugucucuuggaccugacacaguguugguuuccuucugagugccuuacuuuagaucccggguauuucuuguagcccugugcucugagucccuucugcuguugggagucuccaugugcugggacuuggcucaggucugcaaggugcuggcuaccuuucagccuguucccuccgguuguugacuauuccuugagcauuccugacuuguuccugcuguauuucauuggcuagugucucuaguguggagcuagcuagagaaggugucugugaaggccacuuacucugcucuggaucaccucuucaguguugcccuuuacuacuguagggacacuuggggacaguggcuuuccuguccugguuggccgcagacuuuaugugcagugcuuugcugucugguuuucuuucuuucuucuucuucuuuuuuguuuuguuuuuguuuuuuugagacaggguuucucuguguagcccuugcuguccuggaacucacucuguagaccaggcuggccucgaacucagaaauccaccugccucugccucccaagugcugggauuaaaggcgugcgccaccaccgcccagacuucuucuucuucuucuuuuuuuccuuuucuauucuucuuuugacauaagaucucccuguguagcucugguaagcucagaacucacgcuguagaccaggcuggcuuugaacucagagaucuaucuaccuaucucugcccccugaauacugggguuauagguguguccaccaaacuugggcuagguguuuuguauagauuucaucugcagcauguuuuugguagcccugguggggggguggggguggucaguuccuuggucuguuuucgcacugugagaggcuggccuguuacuugauaugcuccuguuuucgacaugguuuucugcuugccuuccuuuuucugccacuaagaaaucucugccaaccugaccuucuccccuaagccacggcugugggcuuauggcacugcgucuuuagugggaagggcguggaggacucccaggaaaacagccagggcccauggccuuuugcagagagaggccucucacuguuugagguguucucugcaguggccaaugcacuggccucauccucagagcuaagauguuuaaacagcucuucugagggggguacugugugcaggaaccacaugaggacuugaugugucguccuguggucgucagauacaucuccacugucucagccucugccuccucaugguccaagcagagggccacccuggacuauucccaccagggccugggaagcugcuggcucacggggagcagugagcauccuccaggacuguguggaccuuagcucaggagcugcccuguugguuuuagcccaggggcuuuguaucugaggguagucaugacaaguuggcucuuggggcccaggagagccacugcaguugaaccuacagugacauccuaggcuaugguguguauguguuggguuggggaggcauauguaugcaugucccuacaagggccuucacguggcacuuggccuggccucuguggcagggggagaguguucugcucucuuccuguaugaauuguuuccugccaggcacuguauaggcacuguggaaucaccucccucauccuuaacuguggacaucacacaaggcucccucauugcuuggccucaauguugucauugacuugagcucagcuagaugauggucuccucacugaggacugagcaccaugguccucagcagguccuuggagcuuggggcacagauguggcuaaaggccuggcaaggcaccuugccugugggagccagacagaggccaccaaaguccaaagcuuugggcacaugagggcaguuggguucauggcauggcucacccucaccagcuggcaggcuucugugcuggccugcucccagguccaugugccccuuccugacacaguccugugugagccuguggccccuuccugacacaguccugugugaggcuugcucccccaagccuguauuccccuuccugacauaguccugacacaguccugugugagccugccccucccccccaagccuauggccccuuccugacacaguccugugugaggcuugcucccccaagccuguauuccccuuccugacacaguuguuuaguuuuuaacuggcaaggcuuugcuuauuuauuuucauuguucuugauaauaauucugagccauuagaggggaaaauuauauucagaaacacuguuucuugcuuuauuuguuugaugauuuagagcaauagagagcagcacauacgcuggcuuuuauagucugguaauuauucacauccaucagcccuuccgggggauaaacagaacaccgcagaaauugcacuauuaauagcggccuccucugugggcgggagacaggcaggagggcaggaagagacugguguguccacagagcccuguucaucccauugcaccagggcucagcuggcugucuacccacagggcuggacccaugguacccugaggccuugagauugcccccuuacuugaaaccuguacuguaccaucaaggccucgugcccgugucccucagaugauccugggcugcuuagcaucacucaacacuguagccuggcacagaguucacaccuccuugccucauguugaaguaccuggggucccugugucuccaguuugcuucagaccaacuaccccacauggaccuucuacccuccccacauggcuuggucacuccccagggucagccauguggucuagacuuggugaugugaggcguuaggguccuugcugugguggcugcagacagggaugagucauagcucuugucccuggcacaaauuuguggguucagcuuuggguugggggaggcaggagccauaucagcuauccuuuucuuccuggagaccccagcuacccuagccuuuacuugugcuuguuucgcaaggcuucgugaaccacugacguguagaggagucagggccacauccgcaguaguucaccugaucccucggcauaccucccaggcaggcacagggcugcugucuucccacuagccaaugcagaguuccccauaggcuugucagucagggagaccaaauccauggagcaugcuggagacaggacagggcugccucuucuguagaccuccuggaaguacuuuguggagaacagaugauuuagaacauggaggcaaaugccaggggaucauggggacuuucagaaggaugccguggggucucuagccuguguaucuccuaggaggaguuggcugaaccucagaacccuaggaccuugaguggccugcuuggagaucauauugaaggcuuccuauagcacccaaagggucuuccuggaccugugcauagccuagggcaucccaguguccacacagagccugaccugcuggaaacuucucugccaugccgagucacccaggauggcuugggacacguggacuggaguggcaggauaggcuucucagcuguuaucagagacaauccuagaggagcagggacaaggcacuggguccugcugagcauacggugggaggugugugcguguuuguguacauugguaugggugggagggaggacaugugcaagcagugaccagagcugucacaggagagccgugagcagucugcaacaguggccacugccuaggaccagcgugggugcuguuugggcacagcugccauggcaugggagguugaugcuggagggagguggagggaccugccuucccugaagcucaaagauggagucauagugccggcugguggcuccugauccucuguaguucuguugcacuguuccuaacccagacugccuuuagcaaggcugaauugaugucaguggugcccuagcaucgugcagggcuuugauaaaggccugcgauuuaguucuugugucugacauguggucucugaccuuugcaucuccuaggaggagccgcacaggauccuugaagcucugcucugggagccccauaggauccuugggaagguuggcugugcauuuggcugcagccacccagagcugcccuuccagaugggccuggccacccugcccuggcucaugcagcuuucuccaggcucaguacugggcccuuacccuggcugccucaucugggaaaucaaggugcucacuggccauggcccguggcagggugguacauagguagucucuguggccucauuugguugccgcaaagcacagagguuuccagcccgcuguucccuaccauguguccauaggcuugucucccuagggcuacccuucugcacccauggccagcagccugcaggcugcacuuccugauaaugccaggcauguuccaacauauuaaacuucagcagccaccagauucaauuaaucuuaucuuuacaagucccaauuacaggcacuaauuaaguggaaggcgcuguguccuggggaugccgcauucaucauuguggccagagcugggaauugguuccuuucaggccuugggugucuucccagcagcccccagaggugggggugggggcugcuggccaccaucauagugcucugggcugugaggaacucagcaucccuugcaugagugaugcgagaccauggaaggaagugugaccucaguuuguccagacaugaagaauccggaguaacccuagagcugagggugccagcuuuucuuggauggggucccgagcaccuggaaacuccuuauuguguucucuguagaucugaugacagggugguagcugagucucuuaccaccuuuuuauuucacuugaaaacuccucaguucucagcuguuguauugcggcuguaguaggcguccucugccuuggcuccugcauccucuucuugccucugugcccugcaaggugcugagcuguauacccucaccuuccuucucccccagugugacagcuccacuguucauuguccagugugacucccugccugcuaucuguggguguucacgacacuagccagagguccuuggcucuaaugugccuccucucucauagguacgccauaccaccggagcacggcaagcgccuggagcgccuggccauagguagguaucugagccccugcucagcccaggugggacagggacaaaggugagaugggagguggccugcuaggugaauguugcugugacugucagcugaucacucacuggauguguaugacccccugcacucagcccucuguggucucucccuagagugauggcagagcuuuggaugcugccugucaggaaggaaccaagcagccagagcucaaggugcagagaggucccagcuagaggccccggguggguauagugggcugagugacagcaugcccuagccuggucucugaggucacugcgagugcacucagucugccaucagugaccccuaugcccucagaugagggcacagcaagcucugucagaagcccuggucuccacggccggagccuggcuuuaauaccuguagcccaagcugguagggaguucgccauccuccugccugggucuaggaugucugggugaagagugugugcuaugauaucugccuuucccuuuuucucacugcacucugaugcuugggaugacaccuagggccucaugagugcagggcagcuauccuagccauguugguuuuucuuuugcuagcuuuuaaagacaggguuuagcuacauugaacccuggcuuaucuugaauucacuuuguagccuaagcuagccuugaauuuacaauccuccugccucagccucacaagugcugggaugacagauccaugccaccaugcccagcucagccauuccuuugucaggucuaaguuuguaugugggaaucuagggacacacacauugagagcacugugaguccugacuacuugaaaggucugccuagccucagucauccccagagcagcccugacacaggaagacuaaccuggcuccugcaggacccagcugcaggaaacaucuucauacagcgcccagacauugcccucugcaguguucaccguguggccuugagcaaggccacuaaggcagugcuggccacauaccugcuucccuguuccacugugcccaugcauagccucaguggcugugagcagccuagguggugcccacacagcucagaugcuaaggccacagaugcagcaggguguccugggaguccuucagcccaccaugcagcuuucagcucuccacccccuuuuccuagccuagugccagcaguacaucuccuaggcucucagccuguccuccuccuccugccucugucugaggaggagccgugaggacacugggcagggugaucaagcucaggcucuuuagcuugagaugucugcagagucuuuucugcccuggaagucgccacacacagguccuggggguuagguuguggauaccuuguaggugcccugagugagcugaugucauuuauaaaacacaaaggaaaugcucuucagcugacaccgcagggccugggcaugaccucacaguugcugcccagccucugcugacagugugaugcagcucagugagugaggcucaggcaguucuugcuuuguggccucuggaaacagggaagcugaccucagaaugacgccagcacccuccguccaucccacucgucacaucagcauuccgagggccagcaggggugugcagcagcucagcgggauuucaguucugaaccuccaggcugacugcuucaaacaccugacuucagggugugguggugcaggcguccagacccagcacucaggaggcagaggcagguggaucucuggguuuaagguccuccugguccacauagugaguucuaggcuauccaagaccacauagugagacccugccuccaacaagaacaaucugcccuguccacauagucccgacagcuggguggggagguucccuggaaccagaggaaggaccgagcaguuugcccagggaaggguggggauaagaucgggaggcaggacacagcaggaggcuccauacagcuccccugcggcuccagcuuuggcagccccaagaccuucuuugggcaugcgccacugaugccacccacagcagagcugaguggagcaggcucacagaguucucugcuaacucacagagaacgaauagcugagccauaaaugggcuuauggggagaggcacccgcccgcaggagagcacugaugugggggcgcuaaucacuuuagauuugagccuuuauuagggcccuaaugagagccacuuaagccgugcuuaggagggagacgugcugcuggaagcugcagucauaauuuuaacuaaggcgcuuuuagcaccaaggaaggaaaguugaggacucggccgucauccccucuggugccugcucuuccagcucagccuccugccaacagccagggccucuaaaucccugcucgccaugugcccugugcacaugucugugggugugcauacacucaaacaugugcucuggaagcagagaccuagcagggacauacuagcuuagaagcugggcgagugucugagggauucuggaaggguccuuagacucugaagcuggcucaguucuccuccuguccccugcuuugcccacagcagacuucugugacccucacuguguucucugaguguacacaggacaguguuguguggugagcagucagucuaagaacuaggugcccccugccucacuugcuuccuaugcugcccaucuuggcugcugcagugcugcuuuugagaggguagagcugagcccagccuacccugagccucugaaaggaucaucuguccguagugggaacugcuccucaaggagcacaagggcagaaucuauguggggaucccaggacauggcugauccuugagacggcugucuuguucuaaggcaaacagaacaucugccuggggaggugagggggcccugguaggaacauaggcugcucccuguccugaggucagcuguguccuggggccucauuucuccucuguggacuacuaaggugcugggacccagaggcugcacacagcagcugcagccgucuuguuucuugguaguucucaacuuugcucuuuguaguuucccaugccauucagggaggaguuaaaugcugccagcucaccgaacccauccauaugguccugggaugcugccuccuagaggcugugugcuuaggacaccuuggugacuguccuagugaauaggguggagucugccuaagagcuugcaggagagcugucugcugggcagcugucagucacaggagugacagcugcuccugucucccacacugacacccacucugacacggcuuuccuccaccccaggcuucuucccugggagcucacagggcugugaugccuuccuaaggcacaagaugacacucaucucgcccaucauccugaagaaguacggcauccccuucagccggguauguaccacuagggaugguucugugguggggaccaacuggucuugggacaugaccuuguucuuuugaaggugaaaugggugagggcacagggcaagcguggguuuggcagggucuucacuguccccaaaccacacagagcccuuugcucaaguacagaucccuacugcucaggccacaccugguauuaacugcucagagucaacagaguggcuggccucugggugaagaugucuugcuuagcaguuagugguucagcauuccugagcauggagccugagcucguccugugugcuauuguaaaggcugugacggauaaggucugaggugggagagccagccuguggcaacugcuggggagugggagcggauugacaaguacuuuaaguuugcagacccaggaccuuggguuuuaccaugcccugugggccacauccuagcagggaaugcuagcccaauugggcuugugucugcagaggaguacaauccugggugcucuggggaccaagaagggagaggggccuuaggacaacuguuucugaaaguuucuuugaagagcaauuugucaacccaggagcucguucauagauucagagcccuugcuccgugcucacaucggugucagugaguuagaaauuguuccugacguuucaaucaaggcaccuguguuacccagcuguguucuuccugcggaugcagcccagaggcugcccccggcucuggcucugagaagcacaggucccacugccagauggcagaucaucacuuguggaagugagaagugucugcuuuguaacuggcucauggagaauguuuuccaggcuggugcuucaugcacuaggacccccauggacagagucacugccugguccuuuccuccuagucagugucucaauagugcuguagauugcacauaugguacccagccccaaggcagccggcuugccuccggacucaaagaggcugcugacaugagagccacgcucucuacacuguuguguuggguguucuggcuggccagcccuaaaggcuugugggugaaggcccuugucuggcaucagcugcuuugggauggggcuaaggacaggcaagaaauaagcauguccuccugcaaaugaggcguggaucccucaucagaauuccugucacccuucagaugagcagcugcacacugcacuugugagucuguaaugguauuuacuuuuagaagggaaagcugaucaauagcuggcucguuaauaauuaagaguguguauuucuguaaucugccaucgacuuccucaucugucccucuugaagcgucuccagcuuucucccuggcuggcccuggcccuggccacuguggcucugccgcacagccauccgucaucugacgcuuccuaauuuaucccugggcucuguugacggcagugaggggaaagcagcuacagcggcuuagcagagacuggggcacaguggcugugacaggagcacgguucuuuugccacccugagcaagacuuugucuugucuguuguguggccaugccuacaucaucacugcuggccccaguguguguggugugcugcaccccagaaggccaagugugcuggcuccuggcaugugcugcaccaugaaugcuggguggcauggagaggacagcacugagcugcuaucaccgccacuguccacagagacaguguuaaagcuccaggccuuccuuuccuuugcagugcuaugacugccaggacccggggacacacuugugucacacuucaccacccugcaucccaccagccuucauaagcaacugucacuuggguaggaauuuaaaacauaaugcugcugucacugacuuuccaugauuggugcaauuaauuaugugaaaagaaaaauacuggcacauucuccggggcaugcugugcugcaggccauguugguuuuaguggauuuuugacgaauggcugauguaccccgcacaccuuggcauccauucuuccucuccagugucacuaagagaaauccaaugacaugggccagguggccuguggggaacacacagcccagccacccagaauaagguguugagaggaaggguggagaucauugugacuuagagugcuaagagagagaagacccucucaauaccguuuaugucauagugacucacuaugacaggcacauaggaaugccauccaucuguaaaggcucagaagccuugggccagugaaucuccuaugugcuugagaagccagcaccagagcccauguuuuaagaagccagggugaccagggucacagaaugagccaggcugagggccagggccuccuugggguucuggaaccuuccuccuugguuggugugggccaagcucagaaccacagacacuugucuuuaagccuuccagacuucucaguagacaguaggauccagcagccucggaggacacccuguuccucaugagaucucaguugucauuacagaugggacuccaucccuccccuugggagcaugugucuggagcuguuccagaguguucuuggaggugucagugcuguccccagcacaaagggcugugucuguacuuccucauaugacaguagugucaucagggcaacucugcacaagaggacacugcuugcauguauucuggccuggacucugaggguuggcuuuagcagccaguggcccagggccacacuggguggaugacuguccccuuuagcugggugagauggcauggugcagaguguaggcaugcuuucugcccuguguccucuggugcuuagugcuggaaccaagucuucucauguaguccaggcuagucucaauucaugauucuccugccuuagcuaccaagggcuaacaugacugcuccuccacagcaucuuuggcccaugcuuacuuguuuuuugaagacaggguuucacuguguagaccaaacuagccugaaacuaacucagagaggccuccgagugcugggauuaaagacauguaacagcaugucuagcucuuccuuuuuaaaaaacugcuuauguauuuauaugggugugaguacuacagcaugcaugcugaggucagaggauagcugccagaagucagguauaaguucuguccugggaccuggggauugaacccagguugucaggcuuggcagcaaaugcuuuuaguguugaucagucucaccagcccucacccacauucauuuugaaccuggcaggaucucacaggcuucugagcuacccuguggcccuacuaaacccaccaggucaugaaagggcuucagcugcuaugggcauccuuagguccacauccaucacccgcuuaguucaucacucucuuccauagauuacacaggaagcuggggaguucaugaucacguuccccuaugguuaccaugcgggcuucaaccauggcuuuaacugcgcugaguccacuaacuucgccacacugcgcuggaucgacuauggcaaaguggccacacagguaggugcaacagucaccucagguucaguggauggauggguaggaacagucuugcaccugagugcaccccaccugcuggugguacucaaaaaggugggcauuuggugguucugucuuuaaggagccccaucuuugguuuuucuuuucuuagugaucucagggggggacagucucucccugguagggcugcucaggggagcuggccuuuguuguugagccaaguuauuuacuaguuccauuucaguuuuugagacaucaagcaugaacuugccugauccugccuuggccuuccuaaugaugggcccacaggauggccaugcccaggccugggucaccauuuaccuuuuuauuaguguugcuacuacucauguguauucaugugcaccugugugcacauguaacccacaugucaucuuccuaugugaggcauggucuccugccuauggcuucuggggugccccaucagccucccaucucacuuccauucacgacuagcacacccaccuuuauguggguucagaaggugggaauucagaucguugccugcuuugucuacugggccauuccuggucucccucagccccuugcuucuugcuugcugcccucacucugcugccuggggcaguugucuccuuuugugacuggacaugauacagagccaugaagcucugggcuaacucacuaaggauguaguaugggccuggugauccacuguuguuggggccugucuucagucuaaacgaaacaccaagucuggcaugacgugggaagguggcaugagccaggguugagacccguguccaguuuugauugaguagacaccuugcauggcuagagcugguagggcuggcaccugcaaauugagcugugaaggcagggcuguuucagccgcagccaugacaggaacugcccagacaguaaaagcaauuucagucucagccacauguucacaaacaagcaacauuuguggaucgugguccaugauggcaccauucuccacagucagacagcaaagugucaaauuaggugacaagugguccgaggcaucauagaccagccagugaaagggcagaguggccagcacagcgcucucccaggugugcccaccagccaggggggugcauggccagcugaggguggggccucauggugggaacugggguccaggauugcugcucccuccugguguggacagagaagcugugaggggugccaugccaugcaaggcaagauggggucugagucccggggugagugccugucuuucucuuccccgccagcugcucccacaugguggucacaauuccgcaccauccuccccagccugcaugcauaggcuguguccuuuuuggcuucucuccguuccccugggaccucaccugcccucccaaguccacagcaguaucagggagcugcaagcccuacuccucucugaccagggcagaacaggugguauuuugcauuuuuaauggcugaagagggugcagaggagcccacaguaaaugguaggcacuggaguuccaccugcaugucccuaaggaacagaggagccaccagcauagagucacacagugccaagcuagguccucucugcagccuggcacuccuugagucucccaggaagguacuugcuggcuguggaggugagaacauuagcccuagccagcacugugugcaugcauccccacgccuacaccgccuccuucauaagagaccaggcauccagcugagccagcauaccucuggcccuggcagugggaggcagaacucaaaugcacuggagcuacaggcugaccucugggccaggaaacagcccauacugaagucaccagaaucucuagggaggcaagaugcuauaggguacaggaauuuuucuagauuguucacaugugagcauagacuuugugggaggcucagcucaggggagagaugugguacuggggcaucuaggucaccccagggcacagaccccagaauccucaggucaacugcaguaacucauggacccuuugcagaaggcugucuuaugagccaugucuguuuugaccuuugaccuuggccacuaucuuuuugggacaggugcaguauagucucacagaccuccccaguaaaguaacaugugcuaagggaauauuacacagccauuaaaagaguucucucuugggauuuguucugucuuuacuggcagggagaagugaccgcaguuaaagagcagauuaugggccgugagccucaggucccacuuuugauugggaagggaguguccuuuucuaauuugguuguguagagagauaaggacaccugagaugcucaugcuagcuucucucacccccucuucuggcuuuuccuucugugaucacaguagggcaguugagaguggccuugcucaugugagugucuuguccaugugcagcauccguuguugccaacggucuuguugguucaguuuugagaugagaguuaaggcuaaccaaauggcaggaggaucaggaguucagaaccaucuuugguuacaggcauccuugaguuugagggcagccuggguuaccucaaaacaaaacaaaacaaagccccacagaccugugucgggcuugggccccucaugggcucuucuccucucuugacaacauuuguccuuccagaguuuccugagcugugcguggugcacacauggaaucucagcauccaagaagcuaaggcaggauugcugcaagguuggucacagccuaggcuacagggcaugauccuaucucagaagcaaaagaaucagagaugagaaauccagaaaauucagccacccagcugugucacuuuccaucccacauguauagcaagggccgugaaugagcuuggggcuagcuagggugaacacucucuuaagucucaggcagucaggcauucccacaugauccccguagacaugguucauuccuugcucugugaagucagcacccuccauggaaugguaacucugggcugacagacaggaacagagaggccaagcaacuuugccaaugguacccagcaggugccauguccagcauacccuccagguuccuggccuguucaguagaccuaugugcagauguggugugagcuucugggaaugcaccaggucagcccuuccuucuuaagaguuuuccaggugugauaacaugggcaggcucgaggcacagucugccugccugcccaccagccugcuuuucacaggcuggagcaauucuccacaggucacuaacuagaucaaagggguucucuuagcgagggggcgccuccuguacagcccugccugucacuggcugcugcaucagccuuugcaagucacaggccacacacacagugugggaagcucagcccugguccacacugcagggaagggucucaucacgaccccaccaggcugagcuguggugagaccagggugugauugagagccuggcucuagcugcacguucagcagcuucucuguccccuugccauuucuguggccagaugccagucuucccagaaauacgacacuggaguuggagggaaagucuggagguagccuccucuuugcauaucgucaugcccuugugguagacugguagcagcaggcccucagcacagauuaaugaccagguaagaacuggcagccuuguuuccugcugugggugacaguuaguugcaggcugagaggcauaaggcuggccugaaacugcagucacagggucugaggucgugccaccagcuggucauuugcuccacuggccccugaucuaugcuguggcagggcuguaugcacaugauggcuauugugaaguguguuccuccuccaucccugucucaugacuucugcgcuaugagucccagaaggccagugggagcacagaggguccuguguaaggcugacacagccuucuugugguacagcuggccacuguuagguagagggaagaucuagaaagguagccuagcaugaguuccccagcacaauacauggucuuggcguucucugugggguauccuagccuuguaccccaugucagaagccccaacagcccugguggcaacaguguucuuaaguaucauguaaggucuuugguggaggagguacaugcugauaacccccugcccccugccacugacuccccaguagguuaagugaagaguacaucauggacaccccacauuauguagccugugcauuacaaucuugucccaauuucccuaugaguaaacuggggcuccagggguucccaugguaaggggugcugggaaguugugggcugccccagaaggccaugauggucacacugagguuugcacaaagcagggacugacaggacccagacaaagagcaccgucaggggagaagacagucuagugcugccagcucccugccacucaggacaaguggccucugugccaagaggggugagguggguguugucauggguacagugccacacaaggggcaucaugacaccagagacugcugaggggcacaggccccaccaggcagcacugugagcuggcgccuaaucauccugugcacagucccucuggcucccuaaugaacuggcugccguugcagcgcuggcaaucguagcagaaaugggccaagccgcagcuagaguucugugcuguaacccuuagugggccagagugucucccucaaacagauggcucuucaaaaaugucccuucaaucauugagcuugccuuccucugcuaugggacuggugcacuucugucacccuaacacucaggacgccgagacaggaagauugccccaaguuugaggucagccuuuuuaaaagguauuucugacauggaaagcuaugguagcauugaaaaagggugugcauagccacagccagcugguaugguacugugguuuagcaagguccacuuuuaagaacugacaaaccaggccugagccaggcauccagaggacccacuguggcccagucuucaucaggucagcaggguugaucagcaccccuccugcagccuguagugugccccuacccuggcuccuagaccccaggccuggucacgucuacauagaagggauguggugcagaccuggguguaggggcagucauaucugaauauguccagccaugggugaccauguuggugagcuggggacaauguuguuguccccucuaggacaugcccuacccuuaccaaauucuagccgcuccagcaacaggcuguguuccgcccugguuccuaugccaugacugagaguugucccugccacacuggugagagcaggagagucccugcaguaacaugcuauccgguuuggugguuuuauugagcuguguuuuaaucaucuccucuccagcuauugccucccccagcucacuguuucgcaugagcggguucugguguaaccaagccugucaaaagaacacagccuccaaccagagcucagagcucacagaagauccugggaacccagguggccucacugcugugcacccagccugacucugagugaggcagagggaacagauucaaagugugggagccccagggacagggucgcaauugaggcagaaccuuugugccugacacagcccuaaaggagccaggaagucaagggcuugcaacucucagcagagcuggaauaagcauguaugcacccuacuacaaaugagacaccucccagcagucuucaaucucuagaaaugcaugguauacaggcacagucuguuaauggggaugacccugggcccaggggcauuggggcaagguuuagcuaggcacagagcccugguccagcaccacaagggaaguauggggccuuugucccguguuugccagccacacuccaguguuucaacuucauuagacaagcacuucugugacuuggguagccuugaacgacaugucaccuucgugucucugaggaucucauugaccuggcuaggcuccugauagucagugacguagaaggaucugagauggacaauuggucuccaucaggaucuguguagggaaguggauagugacacagacaggcaggaguaggucacauacuuugaggaguaccaguaccuaggagugagggccacccaaggaagcaggugcugcugucaacacagguggggucucuuacacagaagcacauuaaaggugucugugccaugugcagccacacuaagcucuggaccgccacacagcucgaggagguauucuacauuaccuuaggcugcagagugacuccauggcugcagcaggacgcagagugauggcugcaggaugccaucuguucacaaaguaagacaagguagccuguguagggaggugggcgccauggacucccuaaccucuguaugcagaauugcaagcugguccaggugggcuguccaagcuuggcuccagguugggaagcacguggcagcucauuccucugggccagucugugcuuaaugugcacacugcagauucuaacucuucuuugccugugaguucugcugggcaagaaagaccggacugcuagccaaggggcagcuacaagccccuugggcacuaugcuaggcuacuugaugggccacccuguuggguggucaggagagcagcacagcucugcaugccugugcccacuuucuccuggguaguuacagaggcuucucagaguggagcugagaguaguaggguuggcagcggcagguauagugucacuucuuucuggcuacuuccuggugaugacggagagggacaggaagcagaagugagguucucaggcucuacgggcaaaugucccucucuuucaugacccagcagaggagagcagccuucccugcauucccgacggcacugcuguguccuguguuucagugugaguguggaagccccucccccagaguuggcacgaggcaacaagacaucagcuuuuagaggacuggggaccugcagguggcuuuggggucuugcacgcaggaaguauuccuggccccaucccugcuucccugcucgagaccccagcacacaggaggggugguaauugcaaccuuuguggacaaugccacaccccugugaccucugaccagggccucucgaggcaaucaggcaggcuccugguaaccaaccggggauuugguucugcacugcuaacgccugugccauguuuaagcuggaugcaguucugugcugugcacucucccagcugcagcuguucuguacgccguggauagcaccagcucugccgucacuugcuguguugaucacccuaagacaguggcaaguaggaacacugaugguaacuccagcuagucaugugugacagcugucucagcuuaugcucagccuaggcuauuucuauaagucugugacagacuauagaccaugcuuaagacuccauugcagccucggggaaggagcccgaggggagccuucccuugcauuguccccaagccccauucugaggcagacucagcagguggacauguccaggucaguggcuggggaguauuccuggccuucccagaggugcuugaugguauggaugccuugguaggacugucuuauugucaccuggguguccuauugguaugcuggcauucagggauggugugaaaaggaagcugcugccaggcgugguggugcacaccuuuaaucccagcacuugggaggcagaggcaggcgaauuucugaguucaaggccagccuggucuacagagugaguuccaggacagccagggcuacacagagaaacccugucucaaaaaaccaaaagaaagaaaggaaggaaggaaggaaggaaggaaggaaggaaggaaggaaggaaggaaggaaggaaagaaaagaaagaaagaaagaaagagagagagagagagagaaagaaagaaaaaaagaaagaaagaaagaaagaaagaaagaaagaaagaaaagaaaagaaaagaaaagaaaagaaaagaaaagaaaagaaaagaaaagaaagaaaggaaagaaagcugccgcaggcggaaguuccugugccucagguucuggaagguucucagcaaacugcacugaguaugggcucauggggugcaucugcagucccuaggcugugcuaugcagugccaccauggacuugcaaaugugcugccacccuggcacuugaggucagagcccugggugucaggccauuggaaugcggguacagggugcagagccuuacaggugguugguacagguccucuuggcagccucaguggaagugugaggugucugugccauugcguuguucguccuuugucccaggacacccucaagccuaucugcugaugagcuaagcuagugccaacgacuucggugaguggugccacccgggccccucaaggaccccccuuugcuaucaggcaucuucagagcuuacuaauccccagcggggauaacaccuuuccaucacaggcugggcucacuagaaagggccgugaccaccucagaaucccagguggcaguaggacacccaagugacagcugcccaccaaggagggagucuaaauugcacugaugggugaguccucaagaagcucuguccucaagaaguaaugaagucugaggcagcaccuccucuggaggggcuuggccuuaguggcccgacugcuuuccuucuuuguggcuuagggugugacuucguucuguaaggguagggugauacccagcccugagaaggcuccagcaugcaagggucaagucagauccucugcagagauaaaucuuuaccccuuaggaagagagugacaccacaguggagaacugccugcuaucucaugugcuggugcuacuaagcugcuguagccagcugcagaauccugggcagcugcuugggccucaccuagaagauggaccaagccuucccuguggcugagcugucagaucaccuuaccacccuccuccggaccauguguuagauccaccaggcugcugcucccagacccugcccaaaacauuugcuuuuggccacacacuccccaugucugcagagcucacgugggguauguaaaggccacugucauugcaaggccagccgguacuggcagcucuguccuggccacuggugcuggcuucagcaguguggggcccaugggagcacucaggugcuuuugcuaauuacugacggcaaagucauggcugagccauuuggcacagaucccuuaaucugcaguugaugaggacucagugaggccaggcucaggaacacacaacuugggcaccaucugcggccacugcugacugaucaagucccugcacagacgcuaucuugcacauucccauuaagcaaguugaguuugcuugaaaucgcucacccauaaauacccccucucacucaguuuacuggacccagacagauucccagugccuuccccuccagcaaagaggggugggagcuacaggacauucccucauguaccaggaccagccuugcugaggcuuccucaguagaauggggaagccaggaagggcucaccauacccaccucuguuuucuuccucuccauuaagggcauucuagauggagucauagcugcuguagaaugggagcagugagcucacagugggcuuaggagcguaccacccuaucugcagcaucacagccugcagcccccucaggagaagagacgcaagaguaucucagccaccaugucacucuggcccaacuuguucugugacacaguugucauguugcuugagaggccugugcccuccaggccaggagggagacuggcucaggaguguccaaccuaggugaugaacacuaggcacuggcugcucccuagcuugucuggauuugccagacccaggcuugcaucuucuagguaggcccuuuagauggcagccagacuaccugguccugggugauugauguauaaagaccauguugccuucugggaaugaugccauguccaucuucccucucuucucacugggcaaggcugggcauccacucaucagugggcauucccucugggggucuuugggucuggccuaccuguggugaggccagagaggggccugaacuagcagucucaucucauacugggcuguguccgcagcgugggaggcaggugccuggugugagacucagugccucugcguguuuccacaguguacaugucgaaaggacauggucaagaucuccauggacguguuuguacgcauccugcagcccgaacgcuaugagcaauggaagcaaggccgugaccucacagugcuggaccacacgaggcccacagcccugagcaguccugagcucagcuccuggagugccucgcgcaccuccaucaaggccaagcuccugcgcaggugaguggcugcccccagugcccucccucucccuccacucucuuacuuauuucugcuucuauaacaggaguugucuggucaucccaggcagagccucagacccuuuccccgggcaucugaaugcuugcugcuacuuacuuggugauguaauccugguacccuugcauuucagagagcuggcagguccccugcaagcauucauagggccaagccaauaccagaugcccugcuccuaaggaugaguggaccguacugcccugcuccuuacaguagugugaucgaucacccauagugcccaugucccuaguuagagguggcaguguagguaacagguuuggggaggaaccugacuccauuuucuaagagggagaccuacauggcuaggcucagccccucacuccagguguccauccuacuccuugccuccugcaacuccucaggguuugagauucuaagaggccaaggauagcccucagagcugaacaugagccacagcuaugagacuucauagaacucaggugucagcugggcaugguggcacaugccuuuaaucccagcacucgggaggcagaggcaggcggauuucugaguucgaggccaaccuggucuacaaagugaauuccaggacagccagggcuauacagagaaacccugucucaaaaaaccagaaaaaaaaaaaaaaaaaaaaaaaaagaacucgggugucugccugugaaggaccagggagguccaagaacucugcacccagcaggccaggcuaugaccaccacucagaagccaacaguguugacaaggccuugcauaggaacauaccugcugccuugaccuguagacacugcuguuaggauccugauggcuuugaaauauugcagaaucugugguaucuucuggaaccagcugcagccucagcacacauuggcugugccaggcagccugccaccuuccauuccugacgaguucagggguucuuugucuagcccaggggucggugcuggcugggccuuggcccuggccauaggguccugcucugcaggcaggccaugggcacugucuaggacagucagacuguggucuaaagccuucccuccucaccacguucucuucuacacuguugcauaugcugcagucuuacccacuguuuccugcuuuaugucuucuccuggugagcagucugugguucucgaucauucuucagggucuucauugcucaaguucuaagacaggcaaaggcacuugcaguagugguucugugcagccugguuuugauggcccgagaugugguacaugcccauggguccucaccuggcuucaguaggcaauccucagagcuuccagagagagcaggcacccagcuaaaggcugcagagcgagcuuuuguggccuguggucccgucccaggaucuccucccagggucccccagccagacugccugcuggacucaggggaagaaagauaggcuggcagcuccucaggacgcauggaaagcugcaggacugcggaaggcucaccuugcuagaggcaucgugaugugugccaccuggaacagggccaggguugcuagggucaucaguguggaacuggugacaagcugcuuaguggguaggaguggggcgagagcaccuggagauggcaggaagcaguaaaucacccaauaggagagggucugaagcagacugcagucccaggagcccugccccagcuauggcucacacagaugcaagggcauagagugcucuggcugucugaagagaagcugcuauagaaggguggccaugucugugucuggccucgggaagaggucuuaauguggggguaugaaaggacugggcugggcuuguucuuauaacagcaucagcaaggcuauucuuugauguacaguggcccucccugcucuggaugggugcagcauauucgugugagucccaaguuccuuauuuucugguauggggcacagauggacccuuaagauggcuuuccugugacugugggaaccuggcagacuagcuggcauguucagcuguaaauggugcugugcgcagccccggcugucccagucugcuugugcaagggcugggcaggccccugaugcagccuccagucccagcucauaauagggucaggacagugacugagucaggguuacucaggaaacuguagccaggaggguugguagcagccugugagcguugucuggagcuggagccauugaaagcaaccuuagaccuugggggaacaguuggagguugagccaccaaacuuccugacuugguguauuccagucacccuguugcuggggcugccuaccccaaggcauagacugucccugguuccgaggcccuguguccccagccccuucuuucucuccucugucaauacuucccaccccuccugccuguucugcaguccauccuccugcagccacuguuugugcacaccuucccucucucuucguccucggaaugcuaccugcuugccugcuggucaucuugugaggcucauauauucaccgagggauccugcccuggucggggguguuucagccacagacaugagggagaggagggcaugccauggccagaaccacagaggccaaugccuagggccagauaugcugcaaagcauuccagcucuucugggccacggaggggcugggaugggugagggcuaugggcuggagcugccagggacgcagcugcaggaagucauucucccuuaccaguugaaacagcuuuaggggagguccugccugugcccuuguugcaccugcugagccuaucgccucauucagugaggcuaagcccugcagccuugaguuguauccugugucagggcugguuuguuggugccagggaccauccuugcugccaggaggguggcaccuugcuaugcucaggcugaguucagggcuugagagcccuaugaggaggguauagagagggcacggaagccagaggaaaacccaaaaauuuacauucuagacaaauuagugugaaggagagcagacccuggagaaaggcugaggaggagaggaggcgggagccgaccaggaggccagggccggcguaagugaucucccucgcaucgcccccagcauucugcccauccugugccaccaucaccugcuucaccccagcccagcuccucacccugcccacccuagacugcgucuguuuccucuccugccugaccagugcccuccuccaggucacaccggagacggagccagcccaagaagucaaaaccugaagaguccaggucuccaggggaagccacggcugggguaucuacucuggaugaggccaggggcugcucccgaggagaggccaugccugaggacgaggaggaggaggagcugcuaccuucacagggccaugaggccgaggguguggaaggucggugcuguguacuugcagcaugaaguuugggucccuucgguccugcuccugcuagccacauuacaccgugaggugccuaugcacauggggaccuugagcgcagucuggcaccgugucccagcuuucuugugcugcacaggcaugccucacuccugcugcuagcauccacucaguuguagccuugugcccagguaggguggggccaugaggccuuuggccuuucugcagugugaggcagugguaagaggccacaacaucucagauuugcacuggcugcuagggggaguuacagacaagagaacuguccacagcacaccaugacagagucuuccugcccagaaaagccaaaugauggaaagcaggguggccacgauguaaugugaccagagacagagugacuccuguggcugagggcaaggccacacauguccagagacucagggccuguaagugcuguggauaagccaggccacagggugaaucguggcucccaccagccagucagagccagcuauacagggaguucagacagauaacagccaagaagaaacugauggccacagcuccagggagcuccaaacuggaugcuugaguggggcuggaguguggaggucaggugccugcugacaugcagaaggcccugaggucaucaugguauaaguggauccauaggagcugcaggcaggaaugaugccaauauccacaaacauacagagaagccauaggaaguagguggcauaccgagggucuagccugggcucccucuuuugccucccacacuggcuugugagcuuccuguugccaugugaucaguuaugggaucuugguaccuugaaguauguuuauucccuuggaacuggugucagguaaagcccuuccuccuuccugacuauggugugagggagcaaagugucuccucgacucacccagucugucugcuucucauccugcauccucagaggaucccaugugaccucagaguccuuggcucuauuuauacagucccuucugcugugggaggugacaaggccccaggggcaagacguggcuguuguugggggcccccacugucugcugcugacuuaagauucuccuugaccucgaccuugucagcuuuaaguggaagcaguguccuucccuguagcagguggcauuuuucugaggacauggaugaugguuaguaugucugauguuaucugaggucuccuccucagagagcagaaagagcagucaccaggcaggugguuacuggagcagauggaaauggccagguuccugauguaccccagcagucaaagguguccacaagaaccacaccaggccauugcuacauagcucagcuugccacaugcuuggcccuccauuuucaggggcugcugcccacuucugggauggaggauggaaugccuccacucugaacaggagcuucuuggcuaggguugccagggcauuccaguagacuugggaccaccaaggacggugacagacuggcaggauuggugugccucuuggaaaagaacucaaaugacacucaggauauccccucugaugggugugaggaagcagcuagcaucacuagcuucacagguguauugccaccagagcccugugugucacaggcaccugcugugaccauguguggcaagaucacaaccaucagucaguucugaagauguggcuuaugugugggccuuugggugacaucucccaggcugagggauccaaaggucugcagauugcagcuaacauuuggccagcauauaagauucaggaguggugugucccaaagcugggaggagugccaacugugaagaccagagccacccucagaucaucguaucauuugugcuguugguagcuacucucaagaugucaauucuggggcaugauaugaaccuugagggaccucugugcagagguggggaccccaguguguuaaggcugggaagccuguguguguguguguguggggggggugacagcucauauuucugugcccguguuauaggguggcacagugacaaaagcuucaauccaccccagucuccccaagagauugucucccuaacccacccugucuccgcgucucccaagcacacaggaugcucagucacuugggaaugcaguaagggcugaauuaacuguucccugcgagucugcucuucccaccuucuguguggggagagcuguaccuccaccucuuugccugucaguugagccacauaccuggaggccuggcugccacuugaaggauggaaauagucacaguggcuaugacacaguagggccuccgcugcucugaggccugaggcuuggugugccacagaagggagccagacuuucuagcaggacagaacacuaaggacugaaugguuggucagaaggcaguguccuaggcaccacccuccuaucccacaaccugucuuccugggcagugacaggugaugguuugagacucucccaacagcacagguggaccuugguuccaugauaugccugagcugccagaauggccaucaacagagcugugguuggccaacucagucucagcaacccaggagacagaaguacuugcauccucccaagugugcccaacccuaggaacugggacagagaucauaccuauagauauguggccuaccacaccccuuggccucccguggccugugacccugaaccagucagacugaccaaugcagauauguugggggcaccuggccauaucuccuggccaccccuggaggaccuguccaccagguugucuaccccgacauuccagaggaaccagauugagacucucaguccaccccuggcucccaaggugcagggcugcaguagugcucaugcuccugugcccccgggggucugugcugaggcaguggcuucugcuaagggcuccgucuaucucauggccauacagagccuagagaugccaaggcauccacagcucuuaggucauaggaaaaccaggagagcgcccugggcgucgggaucaggggccgugaagaggcugaguucaccacagucagugcacaacagucggguucucccuugcaccccaggacacauccugcgaggguucauccugguccuuggugaccaaguaacccuggcauagagugagucagggcugagggguacccaccuguuugcacccaugcuccauugcagggugggaagcugagugucuaggguuggaggugccauccuaacauacuggagacagagugcaagcugucaucuggauuagugaguccuuaccuuugaccuacugcugguaccugacuccgguggggaugcuucuccaucagcggccuggcugagcggggcaggugccaaguuccaggccuggauuccgcagcccaggccacgcacagcaggagcgaaucccuggagccuaguguagagggcuagguuccaggucacacagaauuagguggcucucccuaaagagcauguuaggagugaccaaacccuaaucuucugucccugucaccugucccugguuaacgauguacuauacagccaccauggcaccaaaggcaagccccauuugcucucuccuuuaugucaccuggcaggauuguccccaggcccaucugccgcuggaucccuccaggcugugugguguguugucugcagugacagcagaagcauggaguagugugguuauaagaagagcggcuucucucacacgugugcuggcuuggcaggccccuuggcugugggcagcugggugucuucacagccuuccugagagcccagcucccucccacaccuaaguccaaaggcucugggguuuguuugguuugguuuugagcuggcaucaucagcccaggcuagcucuuugcuccucccaccacacucugagugcugggauggccggucuccgcucucugccaggucaggaaucucucaguccagcaguccaguccuccgcacuugcagagguuggacuuguccaagugucuggggacacccaaucgucuccagcacuuccaucugcuuccacuugguucugaauggcucuuucucuccccagaggauggcagaggcaagccucggccuacuaaggccagaaauaagaagaagacucccagcccgucgucacccccguugcugucugccccaccagcccuauuccccaccgaggagguccugaggccaccaccccaacccaagucuccagggccagcuaugggccccauggcugcagagggggguccuccaccaacaccccucaaugucgugccuccuggggcgccaguugaggaagcagaggugcggccacggcccauuaucccaaugcuguacguguugccccgcaccagcagcaccgauggggacagggagcacucugcccacgcacaguuggcacccauggagcuggggccagaagaggaaaaccaggcccaggcuggugacucacaggugggugauuaagggcagcuggguacauugguaguucugccacacacagggcggcaacucugguuguguguguguguguguguguguguauguauguaugcacugugggagacaggagugaauguguguguauguguguugugaggaguagguuugugugcauauauacaauggucaacgugaguaugugagugugugcuguggguaacagaaguguguauauauucauguguguugaguauauuggggggggcagguauguguaugcacugggggacagaagugugugaaugugcaugugcagugggggacaagagugugugcaugugugcgugugugugugugauguggauggcaggaauguguguguguguguguguguguaugugugugauguggauggcaggaguguguguguguguguguguaauguggaugacaggaaugugugugaguguaugcuguggaugacaggagugugugugugugugugugugugugugugugugcguacacucaugguauggggcacaggagugugggguguggugcuguggaugacugugugagugugcaugugcacuggggggcaggugugugugugugagugugccugcgugcugugggggacaggucccaggacucacagaguucuguuucagggaacaaccccuuucucuaagcugaagguggagaucaaaaagagccggcgucaccccuugggucggccacccacucgauccccgcugucuguggucaagcaggaggccucaagugaugaaggugagcauagccccagccaccaugcaacgcucuuuccaguugcauggggcccagaccaaccccuccacaggugccaguguccacccauccagccuuggagucagguccucccuauaccauggcagcuucaucaccaugcucugugaggcucagcacagccuccucuguccccucacaucuguaggcccaacuguccaugucccuaugccuuguaccacccacaguccuugcugccugcggggccuccaccccacccugcuucccauucacacuugccacgacccaacaccucaaaugucauuagaccauugagggcccagauuccagccaggccaggccacuggugccauugauauuuucauccaucugaacagugggcugcaacauucagccugugauaggcagcugaggcgccagagguugugaugugcaggcugugcuuggggcuaugguugugggcagcaguggcaacugcucucauuguugcacaggaccuucuaggcagggcuugcagaacuaggcauccuaagugucuuccccauugcaugguaugacugugggggugcugauagccucaggaagggacuccccaguggguugagccuuggguacagaggucuccggcuggcuaacaaggcagguagggcugcaccugugugcaggucaugguggguuuggcuccuucuaagcuucuggcaggaucuaggagcagucuggcaguccuuccacccaugaccuugccacaggagugacaagaccuggguaacaguugagacccagaccccuagauucuugccuccuggcugggcucuuccaagaaugauuucuggggaguccuggacuggcagaucccccaagcuccaugccccagacccagcaguccuggggucucugggucccuugagauuaugugggacuuucgcaggcugagcaguuuggacagcaggcagggugccccagacuuuaugcaaggaguuccuagggccagaaggucgaaggugaugcgaauggaguagacuccagcaucucccaggggacagcugacaccucccgcucccucuguccuucuguccagcuguggcugcacuggagagucaaccuuuaacagccuaugccuaaggcuccuucauagacaggaggacgugucugagguuagcauguuugaaguguccgggcuuuaggcucagggagacucagggcaggaaaccaguguccccucccugacagaagccaggacuggugcugugaaagugcccaguaggguggcacugcugcaggaccuguccuccagcucaacccccugaucuaucccagaagccuuccuguucucaggagaggaugaugucacugauccugaggccuugagaucgcugcugucccugcaguggaagaacaaggcggccagcuuccaagccgagaggaaguucaaugcggcagccgcccucagugagcccuacugugccaucuguacccucuucuaccccuacagccaggugagcugccucaguggccuccccacauugauggcacccacugucaccugucccacucagccccagugcagccuggccuacuguggcccugcgcugagugcugugacucugcagucaguacagacagagcgggacagugcuguccagccgcccuccaaaaguggccagaggacacggccacugaucccugagaugugcuucacuucaaguggggagaacacagagccgcugccugcuaacuccuacgucggugaggacggcaccaguccacucaucuccugugcccacugcugccugcagguccaugccagugaguguuugacagcugccccugccucagugugaagggcucuagggagagggagaaccuaguguguuuugauguggggggacacuguccaggguucuggccuggauggcuguaccacgcagauauggggaacuacaggugugcagggcuacaugcaguuguuccaggcgacauauuugggcugcucucagugcuccacugucuuccagguugcuaugguguccggccugaguuggccaaagagggcuggacauguucccggugugcggcccacgcuuggacugcgguaacucaccuaugcuggcuggcuccuagagcuugggagguccugggcccguguaccacugguguugaucuuagcugugcaggcugggguuggguggcgcaugguggagguggccgcaccucaccacacugaucugucccucaggaaugcuguuugugcaaccugcgggggggagcgcuacagaggaccacagagcacaggugugugcccuggcugcccuguaaccucaccugccugcugcccuccccacacccauccugacuggccucuugaggacagccugggaccugcacugcuccugugaccuuguccugaccucucagguggauucacgugaucugcgccauugcagucccugagguacgauuccucaaugugauugaacgcaacccaguggacgucagugccaucccugagcagcgauggaaacugguagguccccaggacugcggccgcugaccucagaccuguugcaggguggggagcuaugcauaggacacaguggcagugcuccaggggcagccagcgccccugguccaagugucccaacuccaaggcucugucuagagacugccagggccugucagugccucaguucaguggugcuugcuguccucaugcaagacuugcacccagugagagccagccugcaacucuaaccucagagugguguucccaagcuucauuuucuaguuguguugucugugcaugggugaguguguguguguguguguguguauguguagugugugguguguguagagccagaggacaaccucaagugucaguccucugcauccaucuugcuuaacauagagucuuuccauguguauguccaacuaccuggcuggucagcuuccagggguuccccagcucuggcucccaucaugcuauaacacuggcauuuaaauaaucugcaucuggcuuuauguggguucugaggauucaaauccacauccuuacaguuagaugauaaauguuuucccacugagccaucuuuccagccuccuuccuuuuucaugcacugaguggccagacugcugguucgcuucccucaccuaccugacucugcaucuuggaacacucugcaucuuugacacucguggauauggccaagacagaggcagauacagaaauggaucuggucuuugcacgcaugccauaagcacaguggguugucacuguuaucaaacuccccaaggaaccuuuccuucauccucugucccuuccugcaccaugcagcccuucuccauggugauugcacauagggagggcaccuuuucagaucugccaccuuugagaacuguuguccccaccuuaacuuguuuccauucagaucacacaguugaagucucaguugaauugaaggcacugcauggugcugcauacugaggcucuuaugugagcguggacacacacacacaugcacacacguauucauacaccccucuuuagcagguuaguggaggaggucucaggcuccaguuugcuuguccaggugcugugugccucuagacaggccccuugacuucucugggcuucagcuuucccagcccuucccguguagacugucauggcuuucugcagaggaucuguuccccaggccuagcuugcuacagacacucccaaucacucuccugccccccacccccacccuuucugucagcugaguggugccugagugcggcccaauugcuccgacccugugucccaggcauggggcaaggggcuucuuacaucugggagguggccuagccaggggguggggaauggagauggcucagcucagaccucaggccaggcccugcucagggcacuuagcacacuggcuguggugguguuggaaugcuggaggccaggcccucaguguuggccauggacagugccuugcauugguuuugccugguucauuucuacugcugccaggccacacuggguggagggcugcugcggaguccugugggaccugggcuggcuccuagcacaguggcuccccaggccuaguggguggucucagagaccccuucagaagcagguguuuacugcuggguggucugaugaagccaggguagcucuuagaaagagcaucauggcucaggaggguaguaugcugacagcaaguccugccccucuaugcacauggccucugcaguuguggucccccaguggcucuguacuaggagauguugugacaccauccuguccucugagcugcagggaggguggggacuuggcaucagggagaccugagaagagaugggcuggguucagaugcuaucaagcuccagucguguccuguccaguccugugucguguugcccccccuccccgcccccagaccuguucuggaagguuccucucuggcuuugcugguaaccuuccuugcucuccacccucugcagaaaugcauuuacugccgcaagcguaugaagagagugucgggugccugcauccagugcuccuaugagcacugcuccacauccuuccaugugaccugugcgcaugcugcugguguccucauggaacccgaugacuggcccuaugugguguccaucaccugccucaagcaccgggccagcggagcagggguaagugcaguggccagagcccugcccauaccaccaauagccccgcccacaugacugggcucgguccuugugggcuaguucuucccacaaagcccggacuccauguaccaucgccccacccagggccagcuccugcgcacagugucccugggccagaucgucaucaccaagaaccgcaaugggcucuacuaucgcugccgggucauuggcaccacugcgcagacauucuacgaggucaacuuugacgauggcuccuacagugacaaccuguacccagagagcaucacggugaggggcagggcagcaggggcggcagggucagcaggggcggcagggucagcaggggaaugcugcacagggccucaccauucccucccuguagagcagagacugccuacggcuagggccaccuccugagggcgagcugguggagcuucgguggacagacgguaaucuguacagagccagguuuaucuccauggccaccagccucaucuaccaggugaggagccucacagaggccuucgugugcaugugcgggccccucuggcagacacccagccucuacuagccuacccuaugucauacagacuaaaggaugggcaggccaaggcuggggacaagccacagugggagugcgagguggggugcagccuggggcagaguugcccagccugcacugugacuacaccaccuugucucggcaacaugaagcacagagacaaauaauagggagccaacugcagccuagcugugcucccaccucagcagaugaagaggggaagggacagguccagcccagcuauuccugucccugcagacagugugggcaagcauggugccggcacagccugggaggccagccaggacaugccacccuguagcccaggggauagauacacucauaucacucaggauguuuccagaagccuaugugggcccggauaggguagccuggacugagagccagcaggggauucagacaacuaaggugcuggugucugaguguuaggggcauggauacagaguggccccauggaguaucauagcugaagcagagcugggagauagugggugacuuccagaacuuccuccuggggaaccugacuccauguguauggcacuguugcuggccugacaggcucagacccugcucacauguacuccaguauacccucaaaggcaucaaaaggggccuuggccucuaccccuuuacuucaccuaggcuggcucccaggccauggucauuuacgaucuucacuguuguccccagagaagacagucagguccccaagcacccacgaugucuaccucccagccgagcagccugagccguccuagcgcuggguauccauuauggaacaggaagccuguuuggggugacuucccauagcugacauucugaguuuagggaaacaggucccaggucuggagggcccuggggaagccccuuagccucucguccagggcuucuggcuuuucacccuagaggcugcaggccugcugcccagccucaucuuauucuguauuggccauaugccacacagggccugcuugggaaguaggccagccccagacuugggcagguguccagaggcccugugacccaggaucccauggcaagccccaugcuuagacuccucuaucucaaugcagguagaguuugaggaugggucucagcugacugugaagcguggggacaucuucacacuggaagaggagcugcccaagagggugcguucccggcuggugagugucccuggcaccuccaucugcggcauugaagacacaugucucauagcauguugucccuuccuccuuggccaugagugucacccuggcacuguccacaguugucaagacuccccacucagccaaggaacaggggcagaugggagccacccccugggugugagucaggguauggucccaaggggcuuugccagggagacaaccugaucuaucucugauaucuacagucacugagcacuggcacaccacaggagcccagcuucucuggagacgaugugaaggcugccaagcgcccacggguggccucagugcuggccaccaccacugaggacacagggcguagcccagaauaccuguccuucauggagagccugcugcaggcacagggccggccuggagcacccuucuagauccugcccacuccugucccacuguagguaacugguaacaggaccagcaggauccaacuuggccagacucagggaguggggccagcaccccuggacuacagugacuccauggggccuggccuggcucugcucuucuccuaaaggugcuaaggggcauccuagagccuccugugacagaugcuagccaaggacacuggggcacagccccaaccuguuuucuagauuuguggcuuuaaaaacugacagcaggcacauucuuuuuccucuaaaccaggaugugaggagauaaaaguuucaucuguguuugacaccugcagauguuugucuacugaucaggucgaaaggcacuuuuguaucccuggaagggacagcaguccagugugcagugaccugugugauggccgcuugugauuccucaugcuuccugcucugggaggugggccugcaggaguggccccugccaugcccccaccaugucccugcucugugcagagucugcuucacucugccucugcugccuggggucccaugagccuucacacuuggaccagggccucuguguggcugagggcaggagaaagcaggugacaccuucacuugaagcccuggucaagugacacaggacgcagacuucacaggcccagucugcacuauccgccaccgcccacggguuggcuaugggcucugucucuuuagaagcuauggccacccuagggcaucaggcccaggauagacagcugaucuuaaaugacaaaggacuggacugagggcccugggccuguggaccagcuggaaacuuagggacugggccucugcugagugcccgauggcggccgugcccauguguacuuggaaauucuauuuauauuguaaagagaauaaaaaaggaccuaaccuugggccuggagggagaggccagaccacaggagucucaggcugugccccuugugggcucugcaguggcugcagguggccccacacaugccccacacagagagguccggguuuuugugcaaaagcaaaaccaugcccuccuccucuccccaccccagaugaaggacuucauauuuuugccucauucucuggccuccaguucaguaucaauuaaagcccgugagcugagcgcuuccuauucccaccugguca

SEQ ID NO: 8682 - RNA, 3163 nt, Mus musculus
uggaggagcugcggcgagggcugucccgcuggaagcgcuaccacaucaagguacaccuagccgacgaggcauugcuacugccacugaccgugcggccccgagacacacugagugaccugcgcgcacagcuagugggccaggguguaagcucuuggcgcagaaccuucuacuacaacucuaggccucugccugaccaucagacaguucgcgaagcucgccugcaggacggcucaguauuacuucugcucagcgacaccaggugaccagggaucuaggcugggacuugggcuagaaccugguaggaucuugagcucuggcuuauggagguuggcccagugggauggugauggcuuggggacauggugagaaagaccucugugaccgugccugcuuccucucggcuccauuagcuaugucgauauguggugugagcuccagcgguggcucugaggacucccugcccucauuucuguguaucuggcucuggcucagcacgucucucuguaucuguguccuggucucugucucucucugcacaccgccccuaucuguuucuucaugucuccgagugucuccaucucucucucaguuucuguccacucaucuaagaggucggugggaugagcagcccugggccacuacugcacuccccaucccaagcccgucacaccuugugucuacacuggccucagugucucuaguggggcccggcuguauagugcaucaccaccaguaugaagacacuucagagcgauccuggacuagcuggaaagacuuuagucgucaccgcuugucuuuauguucacccccucagguaggaaauggaggagauggagcgaugauuuuagggacacaagaugcuggcugaaggagcaaacuggcccaggcaccacaucucucucuuccugggaguccagucguacuucagguaagccauucaugggaggccugagagaugguggggaaacugagggccucaugaggugggcacauuagccuuauccuuccaucuccucuguuggcucagcacugguguccccaucugugugacuuugagaaguucucuacucuccucuggacucuuuacuuugaugcagacauaaacugacugugcuuugugggcuuggguccacaagagcucugccugcaauuccuguaacagacaccaggacaaacggagcagcuuugccugcaauuccugugguguccaccagggggauccuagcacugugccugcuacagaagggccucaggauugugggcaaccacugcacucccuuccaagcccagauccaggcuauuuggagaagggaaaaagggccauuagcuuggaaacugcugguugacaucccugggcccacaugucccuugcugauccaggugcugggcuuccagagagaugccaacuccccagcccugcugaugcccacugccucugguguuccugauggugacuucugacauugucguccagcccuccauccccccaaccccggcaaggaaccuucugguugcucuguggccuuaggacccucccuugggagccucugcugccuggaucgaccucuguccauccccagagcacagccuccucggggaagcucaacaggcacacuuccuucuuuggaggacccacggggcuccagcuacgaacagaacaggaggacacucugauccaggggggucuuggugagcccauaggugugcaaaguggucugaguauuucagcacgugcugugggggcucuacuccacagcuccaguguugggugcuaugugacccugccccccauugucccuguuuccccccaccccuucaugugcugggggacuacacugugagcccagaaggaaauaauguuuuaauuaagaguuguacaggcugcaggaggcagagcagggcagcugggaacugaaccauggucuuuggaaucaggguugcuagacauucgcaacuaugcaggccuugggggugugggucccucucugccuccccagucuccuucuagauccaccaggcuguuguucagcugugggggaagcugcuggcccucugggagagcugcuggggaguggaggggaggcugguauugaggggcgagagaaagcauuuugacauuuaacaaaccuuaugcaaauugcaugcaaauuacaugcaaaucacuauucauuucuucaggcggacagccuuagcguguucagaaauaauaauguagggccuguuccuuggucccaguccuggcggucuucccucccugcccuccucccucucucccucccucccucccucucucuuucccuccuacccuucccaucuuugauccaaggccgccuagcccugaaguggauguaaacagcccaauuggcugccuucauucuguuuucuagaucagagaaccaaggccugaggucccaaagccacaauguggagagcaugugaccucucuccaacagucaucagaagccaacaugaacagaaccugugacccacaaagaaaaggugacaugaggaggcuccaggccugugauagcuugcaacagcacaggggaauuguggugcugaaggccaggcugcugagugugagccccccacaagcucacccuguuccuuauguccugagaucucccugaauuccugccacaggaccaucaguuuuuuuuuuuucccacuccaccuucuuuuuguuuuuuauagacuccuauuuauucuaccuucagugccccauuuauacacagccauuccugauacuccagugauagccuccaguguccuccgggucccugcuaugccagcacuaugcuccuguccuaggccugagucaugagcccagguuagguaggaggcucauuccaucucugugaacucacuucaggagacccaaggucauguuccuacuccgggcucuaggugcagaggugccauuuugaauguguuaucaaauaaagacugacaacaaagcaggauccugcugugaccuggcuuccuucucuguacuguccucccccacgguccccacuccggggaaccagccagcugcccauucucccuccagggccuggcagguuucaggccccacccagccagcaaguuucaggugagacuuggcagcuucuccagucucacugaggccuauggcauccagggaggggcccgcccacgcugg

SEQ ID NO: 8683 - RNA, 864 nt, Mus musculus
cauauaucccaggauucugcgcggugccguucuuccugucccggccgccaucggagagcaucagguaagugggccucgucggggcucaucugcccccaucgggcaucccggccccauggggagucccugcgggccggcaugcgggcgggcgcgggccgagguaccgugucucagccgcugucuuguccccgcugcccacagccauggcucugcgcuaccccauggccgugggccucaacaagggccacaaggugacgaaaaacgucaguaagccgagacacagccggcgacgcggggugagugcuggggacgcgaccgccucgucagagauggggacgggggugaagaagugaauaucgacaccugcguagauucugugucguuggaaugggaaggucugagugguucgugggcccggucguugauugggcgucugagacugggagucggucggugggcuguugcguucggcccccuguaaggcccauuuugggguucgugaccucggggcugugcucgcagcgccucaccaaacacaccaaguucgugcgggacaugauccgggaggugugcggcuucgcacccuacgagcggcgagccauggaguugcucaaaguguccaaggacaagcgcgcacucaaguucaucaagaagaggguaggcagcgugcugcaccgagcacggguggggguguggcuggcugcaguggcccugggugacaugcgacuacuccucgcaggugggcacgcacauccgcgccaagagaaagcgggaggagcugagcaacgugcuggcagccaugaggaaggcggcggccaagaaggauugaugaacccucccccaauaaaagaugguuccuacagu

SEQ ID NO: 8684 - RNA, 4095 nt, Mus musculus
ggcgccccagggaccuccgcgcgcccucugaccuuugcuuccagaccuccgcccuccgcccgcccaccggcccgcgcucaccgcaaaugccgccuaaggccguggugauguaggucuugcgaugacacugggugccgucggggaccucaugguaagauucaaagaaccgcuucaccaucgccauaccuagcugggcuugcucggccgacccuaaagcgucugggcgaacucaaggguagccggcuaggucaacucucgcgagguuuccagcgcgcaacuuuauugaacgccuuggacgcagacaaggcgugcgcgcaugcgcgcagugcagguuuguaccgaggucuuauuaaucccguagcaagaucugugucgugcucgguccacaagugaaucuggacagagacgcccgugacgucaggaaagguaaacugaggccaugaagaaaaacgccuccagcccuagcgaagacgagguuucuaguacggagaauguugauagugcauccaaggaugggauugacaggucgcaggacagccauuacacugucaggcaggucagcgaucgaaacuaacagaagguaggacaaucgcagggcagauauuacagcgcgaggcuagugauacccuaguuagccggagcugcacggacgcggcgggacacagcgcaaaagcgguuggcucgucagggauccggacuguguaggggugugguuucaugcccaucucaaucaggaccgcguguaacuauuugggggcguggccaggcugggggcaaggggaccaaucgugaggauuuagcgugaggauuauaauugacggagaccaggcccacucugcuuugguuuuaaguccucgcugcacucgcaggcacagccacacucaggagcugguccugaaagggacgugaacauuggcuacggggcguggccgcacuuaguccugccccugguagaaacguggccaauagugagagcccaagaggaagcacacgccuuccuccggggggcgugucuuucuugacgucacuucgaaguugggcggggccucuugagaagguuuaaauuaaugcagcggcagccuggcagcugcaugugagggaggggguggggggugggggucgggcucaggggcggggcuucuugcguugugggcgugacccgacagggcgggguggggccugcacggcagccgggggccaugucugcgccgccaccucugcagauccgggaggcgaacgcgcaccuggccgccgugcaccgacgcgcagcggagcuggagaggcggcugcuggcggcugagcgcacgauuggugcgcaggccgagcgccuggccugccacgaccagcaccugcgcgccgcccuggaugagcugggucgcgccaaggaccggugaggcccuggaggaggcccggcggacaucccaaaggaggcggguggaaagggcugggaaccgagagcaaaaauuuccggagcacuaaaugcccggcaucacagcacuaggagggcugagacuggaggaucaggaguucgggccauccucgacuacauggggacuuuagaguauagccuggguuacuugagagcauuucaaacuguuaaaaugaagccagcugucccacccacaaggccgagucugccgguaggugcaagaguauugugucugaugaucgaaggaagcugcuggguaggggcccacaucgguagacaaaggcacagaacaccccuauauagaauagucagaucugugacaaccauuugugaccaugcggaaguccuaccgaaggacacacaaaacuggcacuguuuuguuuuuugagagaaggcuggccuuaaaggcacuauguagcuuucaaccccugauccuucugccuccaucucucgagugcugggaugacagagcgccaggccugcuguggggcugagggugcuuuaccaaugacaucaauggcucuguguauaaagacacucgccacuaagaaugacaaagaauuugaucccauggggcaggaggagcgaaccaacucuugaaaauuguaccuugacuuccacauguuugcugucacaugugugcgccuaugcacauaaacaagcacacaaagaaguagugcaggaggagacauagggagucucagaggauucuggagcagguagaugcccccacccccacccccuguagguaacuaccuuauuugguccucuuaccagggagauaucugcccuccaagagcagcugcugagcucugaggccacaguucgcagccugcaggccgcaguggaccagagggaccagaugauccagcagcuacagccucgggcugaccugcugcaggacaucacucgccaccgaccaccccuggccgcacuguuggccacccuggaggaggcagaggaacugggccccuugccggccagccacagccauagggcccagcuacuuccugaugggccuggcccaccccugggcaacaacaugggaaaggaggagggccaggacgaccaggacgaccagcagccugcuguguuugggaccacggugugagcuguccugacagaucucagaaucuguggucacggccccauggggauuccacucuuagaguccuggacaucaccuagaggggucuugagacauuacccggaucccaucuaaacaucacaacaagugaaaacucaagaucucauuuaaaccccccccccccccccagugcuggaguaucugcuacauuccacugguuuuaaauaguuucaaaaacaaaugaagguaagggugguaacucugggaggagcauucuccaccaggcauacacaaagcccaagccagacaggcaccccagcaucagugagaugguggggacugacccugaaaccucgguguuuccuguuugggacagggucccagguagccaggcuugcugucucaggaguguggcauggaucccugcuaggcugacaggcucccacuacaggcccugccuguggggaguuugucuuuuugcuugagauggggucucucucuauaacccaggcuucccuugaauccuccuuccaaguacuuggaaucuagaugugagccaccgugcccugcugaugggagcacucccuaccuuucuuucuacucacucuugugccuccugaaccauccuuaaugccaagacaaaucauuaaucuuggaucucucucccauagcucuacccuucuaggaagaacaaguggguugagacaccacaacccagagugccucaaugucuuucccugauuccacacucaguuccuugacacucaggucucucucaaaugcccccuucuggaggggccuuccaaccagcaucucugaagucauuccugccagcuggucacugcccuguacugugauuguuuggucuaguuuuucugaagcuuagucuuauguagcucaggcuggccucuaaaauuuuuauguagcucaagcuggauuuaaacuuuugauccuccugcuucagcaucuccagugcuaguaugacaggcuuugugcaaacacccacagccccauccugggaccaccuuuucagugggaaggcaguggcuaugaagcagggaauuuugucuucugucuccaucagugccuagcacagcccgggaggcccugccuuagccaggagccuucuggauaccugauaagcccuuuccugguuuccagggacaaugauguuuuuguagcaagacgccuuuuugauacccuaagagaaucuauuuuuuaaauccugguuucugugcugccuagagccuaugauggugagggugcauugcccuuguuagagcagugagaggaaggggccccacaagcccuugcacccagagguggugucuguugaauuccaugaccugugcgcucagggaaauuguccuugagcagccaccaagauagaagguaggggguguucgaaacagaagggccuccagccauccagucuacccagagucugacauggacccucagugugggagacagaggcccauuuuuucuuggggauggaggaaagaagggagcuaucuguauagaaggcagacuagggccugucugcaccagaauaaauuggcuauuucucaaccuggac

SEQ ID NO: 8685 - RNA, 6756 nt, Mus musculus
ucaaaacaggguuccuguagcccaggguagccugaaacuaugugacaaaugauucuccugauuccaccugcacuacugggauggcacugugucccacucuuaccccccugugacucaggcgugcaugcucugugagucugccugaauggcucccaccccaacuugccuuguccugugggaaauauaccuuagcuuaggcuugacccaagauagcuggcuguccuggcugggccgcucuuccauaggagccagacucccacagugcauuuaaaaucacauuuauuuguguacuuugugccacagucagagaacaacccaggggagccuguucuguuucugcuguguagauuucagagauugaaccuggguugcuaguucaggccuugguggccagcagcuaacuagaggccucacucagacaauaauuccaugugcugggaugggacgagggguauaacagccaaaaccuagccuaguuccacauagggacacacaggacgagaugacacgugacaacauggugcagccgcuggagcagagaggacuugagccuuggcccugagguagauggaggcaagagguggggcuccuguugauaccugugcucaccagcagaggcccgugcgccaccuguggccaggccaggguucuggaagccuuguguguagggguggacuucaggagaggggauguucaguauccccagaucugcgaucaaccgaggacauucugucucugcugauggcccuccuucuuagggucucuucuaggccuucaggggacaagacuggaccuguguugucaugaugguccuacugcuccauacagaaggcugcugggacauuccagaugggggccucuguguggaggugacgucagcccuucucuggcuaguaaauguuuauagccaauguagccuggguuuggggcucccucgagucuggugagcagucaccccauccugccccuuucuggaggucuggaugccggcagggggcuggggggugggggugggcuggcaggccacucuagcccuggcagcuggcccagaaagggcugggugggcuaugugcagagccagcagcacccugaaaggcagggggcagggagcagaauggugucagcuuugaaugcuccuugucagacccauggaagacaaagccauggugaccagugggcaaggcagcaccaugccagguccugguggagcgccucugucccucaggguggauggaugggaaagaagauggaggcgugacgugaaguuacaggacugcacucccaagaagauacuccaguccauucaaaccuuuauggggacacagucagauccagguacacagggcccaacugggagggaccugucgugaugaccagagggaagucguucuucccauuucuggggcagagcugaggcuuggugcuuguguugagggacacagccaggagcccaggauucaaaguuggaacacaucugagcuacagcacucuggggccugggcuccugugccuucugugccucuugggguuucccauuccuuucuuggggagccccaaguccagcucaaacagcccucaugguaacccugagcuggcacgugaggcuacaaaggaugggauucagggaggcaggggaugcauaccaccaggcuggcccucauuucaggucuaggcuuccaggagggcagacgauguggcccucucccagcaagugucuggguccagcaggggccucaggagcuaggcuucucaggcaggacccagaccuugauuuauggccccagaggcugcuggagcccacugcuuccuccacaguugccaggaagcucggccagugcugggcugggcgucgcuagcauuccagggccaccuaaaucaaaggcugucagcugcugggcaaggauccuacaaggcagggacugggcccugugucaccuggccaggcugaaagacuccaucccuggccuugggcuugcggaggccugcaggacaggacagcccauacagggcucucugcuccauugcccagaaauuuggagcaacugguauguggggcccaggcauguuuuccagaagcuguuggcuuugggaauaggcccaggaggggaagcccacaacccgagcguggggguggccagguugcuacucacugguggcugaccauggggcucugagcuguaucugcagagccaggucaguggccucugggcagcccacagcaggcuggcgggcaggcgcaugugggcuuccgggccugccugugaacccugugugccaagugcaggcccaggccucugucaucuuaucugccuucugcuauacccccucccaauuggccaucucaugcagcaagccugccuuuaagacauugcacacaggaacauacagcguuuauuugucacagggguuuggcucacaccuuggggguagggaacaacucccagccuuccagcuugccgaucuugaacagggcggccgcagugcccauguagacacagcccauggcugcugucccauagcugugagcuguggagaaggacagcaucagguauggggugcuccaggugugauccaagagccucccaggaagauggggucugauagagcgaggcuuccucaggggccucucuaauagcccagcaacagaguuaaggggauggagaaacugaggccaaaggcugcccugcaucaaucccuuuaacucaagagacaucguguggggaggguggauguggucagcccugacuccuggcaguggggauacuccccugcuaaagccuuuucccacagcugaacuguggcuggcauggcuuuccuguccccagaccccuaggaauacaaagagggagagaggcaguuuggggcuaagucuguccgaguuagagucaggcugugggucacaccccaauagugaagagaugggcagggaugcccacugcagggcacagucuccccuaucacggagcugccugcuguugagaaggcagcgacugccguaggcaggggacagagugggaggggcuggagugaucagugguuacauacuguccccagggaauggccacucacugcgagcucccaaugucaggccucccgcgcagccaccaaugaaguaguucagggggucaucuggcuucucucggaccugggcacugacacaggugguaaggccaaacaucgcuccaauagcagcuguaaggggcaauggggguuggagguggggaaacugaggcagugacuguccugugcagauaaugcugggugccacccucugcccuucugagcccccuagccagucuuguagucaguguccuaggaccccacucagugguuccagucgccucugaauggccugugucacugugagcaggacacuagcucaccugcagugaauguguaccggccgacucuggccacugcuuccaggguggaaucugcgggguugagugagacgcuguaagcggagccgauuaugccugugggagggagggagagaggguugagguuguugggaugccuuuccaggauacagcagaacucaaauccagggccacggcugcuaggccagagcccaauaccuaaggcagagcccugccccaguggguugaugcugguccacgaccccugacccagaccuccagccaucaauaugcagcugccacagugccuccuccaggcucaucaaaggccauaguuuccaagggucugggaccucggccuaauccaguuuggcagcaaugggucucaggaugccaauccuuccacgugccggcagcucggcccagacgugucccuacaucuggcuggcuccauuccucccacgccaaccccacugccacaccagucagcuuuuccaucuccuccacccccugccucuccagaguuuacaccauaguuuacauagcaagcuggggccaaggugggugcuaagucaggagcccaggccuuggugggcugcagagcaagcaucacaaucaggccagaccaggcauaagcagccccacaccacuccauugugcaaagcucucuggggaagcugacacaggauccuugcuacaggggcgacaagacccacuacugccccucacccuccaggcuggaugaauucuguuguuauuccuuccaucggaguugaaguggcccagaaaaguagcccaagguggcccagcauagcuggucauggggcagugggucuggccccucaacucuucuccagccucuggggaugucacacacacccuuccuggugagcucuggagcucugauuugagcaccgagcacuuacagaucuugaguuucaguaucaacacagacugaagacccuagcagggccucaaagaugaggcugggcacugggcuggaggccuugaagacauuguagcuccccagcccagccaucccuuugccucagcaucacuguggcuucuguguacacgcacagggugcgagaaagcucacacgggaacccaaccucacuguuggagguugcugaaaugucuuucccagaugcagcaggacuugaacccaggggcacugggauucuugauggggacuggugaggccacagggacccugggugacuuuggugaccacaccuaacaagccagaugucaugggacccagagugacugcccuucaccaucuaacugcucccuuguggugauucucccauggcccagccaaaccacagccaagccucagcaccaccuguaacaugggacccuccaggaguaccaccugcagcaugggacccuccaggaguaccaccugcagcaugggacccuccaggagcaccaccugcagcaugggacccuccaggagcaccuccugcaacaugggacccuccaagagcaccaccuacagcauggagcgccuccaggagcaccagcugcagcacgggacccuccaggagcaccagcugcagcauggaaccuccaggugcagcugcgcccaggagcuauccauuccuaacugcugugccggcagggcaggaauucauucauucauucauucauucacucacuguguugcacaagccacguucauuuauucauccauccuuccacugaggccccaaagaccucccucauucaauugugaguuccaccacgccuccaaguugcuagauccugcugggaaggcagggucacugccuuucugcaauaucccccuuaggggagccaagcagggagcuugggaacaaaggaguuaggacacagggaagaauuuucaaagcugacauaauuguccacuuccucccucaguagcucugacauggcaccucuggcaagggccugccuacucuccacaucuacccaagacagacuccagccagacaccaagagugcacacaguccuccucuggaucaacacccauguucucuccauggccucccucacagagaucugccugccuugccccccaaguucugggcucaaaggcaugcaccaccacgacuaggcuuguucugucuguuuuaaaaucccccaaucaccugacccuacaacaccugcuuugugggagcaaagccuuggguaaacucaugaaugugaggccuguggacacaccagaaauauaugacugaaugaggccuugagggauagcauaagugagugaaugaacuaggcaugagggggcaccuuaagagucucaaaugccaaagguaaccccaugacagccuuaaaaggacaucugaccuuccaaacaagugugcccuauuuggaaucuuccagaaucagguccucaugaugaugcauacuuuuaaucugggaauucaggaggcagaggcgggacacuuucuuugaaucccaagccagccuggguuacauagggagaucauguccaaaauaauaguaaaucaugcuggagagauggcucucucucaguccuggagaaauagaacagcccuuccacauuaccuggguucaacucucaggccccacacgggcaccucacaacugucugcagcuccaauuccagagaaucggacacacaagacauacagguaacacaccaaugagcguaagacaaaacuaaaucacuuuaaaucauuuaaaaauaagagcaaauuaauagguuccgugguggcggaaaauagaaacaaaacaaaacaaaacaaaaauaacaaaaacaucuuccagaggcuagauugggguguagcccugucaucccagcacucgggcagcugaggcaggaggaucaugcaggccagacuggagacaggagaaucaagaccucaaggccauccuccgcuacacagaggguuugcagucuugccaaggcaacccuagaacuugucuucaaaaacuccgaugacccgaucaccccuuaacccuaaaaacuccugacgacgcugaaaugaccuucacauuuucuccagcuuuugcucccugauauugaccuacgaccucugaagccccuaggcacugacgagucuacgccccucaaaagucucaaccucuuccgccuuuacagccauugcgccccggcgccccagggaccuccgcgcgcccucugaccuuugcuuccagaccuccgcccuccgcccgcccaccggcccgcgcucaccgcaaaugccgccuaaggccguggugauguaggucuugcgaugacacugggugccgucggggaccucaugguaagauucaaagaaccgcuucaccaucgccauaccuagcugggcuugcucggccgacccuaaagcgucugggcgaacucaaggguagccggcuaggucaacucucgcgagguuucca

SEQ ID NO: 8686 - RNA, 1861 nt, Mus musculus
cugagagaucaaauggcuuuaauuggggauggcucccggguccagccuggguccugcagcagcggcggcggcagcugugucagcugggccuguggucugccugugucugcugccuggcuucccuuucuuggugggcaugcuggguuuuuuccccaguugaugggaccgcaggccuggggccacugugucaguggcagggaccccgagaugcggcacuggugguucaucauccagggccuugaagcugaaaaaguaguccacauuggccaccgcaucuaggaucucggggacacuguagucaaaggacagcaggucaucuggcaggugcagggagcgaaugucgguugggaagucauccccaccgccaccacugucccgcaguccagggccaggaccccugugcaaggccaccucaggcucagugccaccagggagacaaucaaaaaguuucauggcaucuucgagaaggaccuuguccgguaggaagaacgcacgugccgccucggcaggcauggucuccccugagcccacuggggugacguccuccaccuuggccaccuugggcucuacaggcccgggugggaaucgcagaccuggccuggccacaccacugcucugcagcucccuggaagccucaaugggccucauggucaccugggguccugggaacuggcuggcuuggccaccgagauggccauagggcccggguggcagcgugugugccguggggacugugauaagcaagggagauggcguagucucuuuggggguuggcggaggugccaggcggucucugagcaucuccaugaaguugagaggcccuccgucccgcaugaagcccagagccucaggcacaggcuccuccgcuggaagguaaugugugagguacuguggcccgcugggggccggcugguaguggggguacaguagaggugguggccccggggccuugagguaggauggggccuccagcaaguaaccaccagacaaggcaggacccccagccacugccacuuuguacagggaugacuggccaaagucggagguggcccacucgaugcgguagauucgggggucgaagaagcagccgcagggagccaucuggaagccuguggguggcagacaccugaguggagcuccauggggcaaccaggccuuggggagggggggcgggaugcccaaagccgaggcacauaggacacagcccugaccucagaggggccuugugaccuggcccugacuaccagucaucugacacagagaaacuguugggguuuucuccucugaugccucucagaggaacagcgaccugaguuugggugcccaggccucucagaaagccuugccuaguagcagcugccaucaccaaaacaggcuucggcuuggucuccagugucacuugaaaugugacacaugaguuuagcuauagggaaaucugucuggaguacagaggggacccagggucauuuuagggucucaucucgggagaguauggagccugcucauagcagggcucaggggugcuggcugauaccugcuggaggggcuggaagcacauccugguccgagccgggggucugauagugcagguuagcauuggcuguggacaaaggugcccgguggguggggcaggagcccaggccccauggccaucacacaccccugcccaccaccaccaucguaccuacggugggaagggguucugggccaccuggcaccucagggcccuccaggcucugcaggcugaagccuuccugggauauggcugggggauacaggguuuugggaugcugcaugggugagacaagccaccccggggggaccuggguggcagcagaggcaccuuggggauagagucccu

SEQ ID NO: 8687 - RNA, 1731 nt, Mus musculus
ggacuuagaccaggaaucgccaggggauuuauugaacaauguaguuuagggcauugugaacacugagauaggagaggaggccuggaucuugccacaaguucuggacguucgcuacaccuguauucguuuucagagggcguccagcuuucuagaagcguuccuuuuuuguccaaguaaaacuggaggguagguagacagugccuacuguccaugugcaugguccuauaccuugagaaauacugugcccgccaucucgaucugucgccguaagaccaagauucugggagcuccccccaccgccauaccugccucgucugugccuacguugcagcuggaggcucuuggaagaggugaaacugagccauugaaccugcgacagucaggcaaucaccucugcauucaucuucuuugucuucccugcaacucuuuuaaaaaaauaauauagauauagauauuuagauauagauuuauuuauuauuauucauaaguacacuguagcugucuucagaugcaccagaagagggcgucagaucucauuaagggugguuguaagccaccaugugguugcugggauuugaacuuaggaccuugggaagagcagucagugcaacucuuuuuagcagccacacuuuuucccacgugucacuccccucugcccugugcuaggcuccuuuacaauacaucuguaucgggcugagacaucaugcucugcuaccaccucaggcacauucuggaacuuucuuaauugucgccugauguaagcauuacuuaaagcgguugccauguucccugaggaagauacacuugcguaacuggagacuuguaccuuuaaauugcauaaaagccagacaugaccaucaaaagccagagauguuuuucccuagagcucuccaaacgacacaggcucuugucauuacucuggguugcucaccauaauuagaugacaagacucaguugcugaagacaccagucacuuuggugucuucaugggucaugcagaaaccaaacuggaauugaccuggagauuuccucccagcugauucaauuucauaguaccagaagguaacauuuggucuggauaagaccacuuaugacaaaagucauaaguggucuuauccagggguggaccucgagugcugcaacuccaucugguggcaagauguggcugcuggugcacugguggcaugagagcuauggugaacucaaggcugcucugcaggaggggaccacgcucagugcuauaaccugacuagagcccacacuccaagguuacacaacaaggagagaaacuugccuuccguugcucugccaaaugguugugcugugaaacugccuucugaauauuuguccccauagauugccgcucugggcccucgucagagaugcuucacuuugcagcaggaagcgggaaauucagaggcucucaaguccgaaugcagaggaagaacuggcuacgagugcuugcucuaagaggggcaagagcugugaaagguugucuaauggaugucugguggccaucauccuugugaccucacagcagcuggacaagaucaacccagcuagaucagccagugucccagcaggcagcaguuccuggacuccauguguuacagaaaagggacaugaaggugggaggaggcugugccaggaguguugggaggaagagcaauaauucugaguaaacacuugguauaaaugugugaaauuguuaaagaauaaaagauaaaaaua

SEQ ID NO: 8688 - RNA, 6375 nt, Mus musculus
caauugguuacaggccagcacguggaccugauugcugcgggacgaugguggugggcuggugcguccccuaagccucuucucacccuuuggugagcaccuccgugagcuucuucccgcgugggcaccgggaacagcgcaaccucguccgagaacuuccaugggacuaauacgcggguuuuucuuauuuauucgaacgccuaccucuaacgaggaccccacccacagacuuauccccgccuucuucaguuccgcuuauucuguucucggaaguggaugagccagugacucccgcaaagcacgccggguguuguaguuccggaagccaagccggagugcgcgucgucauguggcccagagugcugcugggggaggcccggguggcuguggacggaugucgcgcucuguugucucgccuugccgugcauuucuccccgccauggacugcugugagcugcucaccccugcggaggagccugcauggaacugcgacgcgagcuuucccgcucauccccauagugguggagcagacgguacggugaccugauggggacauggcgcggaggcuuguagucggucggcgugcaagggaggaugaccuuucacaucuucuuuucccacgaagggucgaggcgagcgcgcuuaugacauauacucgaggcuguugcgggaacgcaucgugugcgucaugggcccggugagcgaccccgguccuucccgggcacaccuuguugucucaccaacauuuauccuuugucaagcucugugucauauaacccccucuucccccucauccuuggugaccuccuagacccuaggcccuagacccugaccuuaaacauucuuuaaaaaaaaaaaaaaaaaacuugagcaaaauuuuugcuuuguaguacaggcuagccccuaccuuuccaucguccugccauagcuucccaaacguuggaauguaaaaugugcauucuuaccauagucugcuguugucagccauucuuuguuucaguuuauccuuuggucuucugagucagggucccaggcuggccuugaacuccccauguagcugacaggacauuugagggagggaugagguuccuaaaccagaccagguguaggcagugcuuaaacccagggccuuuugccugcuaggagagcacuccgucccagucuuguccccagcuuagggucuuccacuaucuggggcuuccccagccaucucuuccugugcuggaaauuccugguucccagggccucaacuccuuaagccucuauccaucccaccuucaaccugaggauaccucugcucuccccaccugcagauugacgacaguguggccagucuggucauugcccagcuguuguucuuacagucugaaagcaacaagaagcccauucauauguauaucaacagcccagguaagccaggacagccugguuguggggucagagauagccccuuuggggaagacaugcagccuugugccuccuacagaaucuaaaauuuaaaaucgcucaaagcaggguaugguagugcacacauuuaauuccugcacuugggaggcagaggcaggcugauuucugaauucgagaccagccuggucuacagagugaguuccaggauagccagagcuacacagagaagaacucuuaucucgaaaaacaaacaaacaaaaaaaaguaagaaagaaagaaagaaacccuuucucgaaaaaaaacaaaaaaaaacaaaaagagagagagagaaaaaaaucacucuaagacggucucucacuggccuggaacuuuccaaauaugcuaguauaccgggucaaugagccugaggguccuucugccuccaccucccuagugcuagaauuacaagugugugcugccaugccuacuuuguggggacuggggaucugaacuugaguccacauacauuuuagcaacugagcagucucccuugcuucgagaguagcugaauuaaaacaaacaaacaaagccuguuuugagacagagauagcccagauccucugcaguccucucaccuuagggauuuaguuuagcugaaccaccaaacucugaagaaauaguucauuuuuaagaaaaauauuaagccaggcggugguggcacacgccuuuaaucccagcacuugggaggcugaggcaggcagauuucuggguucgaggacagccuggucuacagagugaguucuaggacagucaggcuacacagagaaacccugucuuggaaaaaagaaaaaagaaaagaaaagaaaagaaaaagaaaagacugguuaaaaaaaagaaaaauauuaaguuacauuuauuucuguguauauggaugggugaguacauuccacugugugugugcguguagauuagaggacaaccuguggguuuucccugauauguauggguccaugugaugugggcuccugccuguccuguggguccugggaauugaguucaguuuguuagguuugguggagagcaccgucaccagauaauacuucucagcugcucaaggcugggcgguuucaaugacuggacacugggcgggcugucaguuaggcacgcaucugucuucucauccagcuccacguggacaguaagaaagcucgcgucugccuugugcugggcccgugggccuggacgagcaggaaguagccagcuuuacuauguugaugcacagcugagagguggcuaacagcccuuugguuccuuuuacuuaauucuguguguguugucacguguacgugucugaucaugucccccaccccaccccucaaacaacauuugcccuuguggcuugcuggaaggguacugggguaggaucccccugggcccuuacuugcuccacugccuacagguggugugguaacugcgggccuggccaucuacgacacaaugcaguacauccugaaccccaucugcacgugguguguuggacaggcugccagcaugggcucccugcuccucgcugcuggcagcccgggcaugcgccauucacugcccaauuccagaaucaugauccaccagcccucuggaggagccagggugaguacgcuuucugcagggacgucuagugggaacuagaacgggagugccgcuccuucuuguuuguugguuggagacgggucucaucuuuuagccucagcugugcuguaguucacucuguagaucaggcuggccucuagccuacugagauccugcuaccacugcuuugagauaaguauuuucauggcuggggagguacuucaggaguaagaacgacugcaaggcccuggguuccauuuccagcgccagaaagaauaaaaacaaaaauagaauccagguguggugguacaugccuuuaaucccaauacucaggcagcagaggcagagacaggcugaucucugucaguuucaaggcagccuggacuagaucaguggcucccucacuagugccccaugagaaguuucaucuucuuccucuacuuacugcuccucagggccaagccacagacaucgccauccaggcagaggaaaucaugaagcugaaaaagcagcuauacaacaucuacgccaaacacaccaagcagagccuacaggugaucgguaagcacccagccucccacagcacacacuggagcauuggccucccacagcacacacuggagcaucggccucccacagcacacacuggagcaucagccucccacagcacacacuggagcaucagcagccucccacaggacacacuggagcauuggccucccacagcacacacuggagcaucagcuucucacagcacacacuggagcaucagcaucggccuccuacagcacacacuggagcaucagccucccacagcacacacuggagcaucagcaucaaccucucacaguacacacuggagcaucagcauuguccuaaagcagggcacccccaccugacagucagaaccagauuacuauaauauggucacucugggccguggaugauggucaguagaaucccugacccaccaaugcucugugcuuggggcucuguggcuauggcauagcuccugccuagaaugagcccuuucccagugagggguuggggucgugucaggggugugccuuaaggauacuuuuuucacccuucuuuaucuauuuucuuacgugugugggugcuaggaaucaugucuggguccucugccaaaacaaguccucuuaaccacugagucaacucuccagccccagggauacauuccuggcccgacauagguucuauguccccagagucacaaaacaaaaguuccuagcauguuagacagaauucccuucaguuacaaucuccaguucugagcccuuuagaugagcuuugcaagcuggguguguugguaccuaccugccaucccagcucuggcagguagagguagagaaucaugaguugucgacugggcuagagaaugacagacgcgggcucagcgggccugugcuauagaggugguuuugauggggagaagguagcaagggucacuucccuggagcccuucuuucauuuaugugaguccacugucacuguccucagacacaccagaagagggcaucagaucucauuacacauaguugugagccaccaugugguugcuaggaauugaacucaggaccucuggaagagcaagcugccagugcucuuaaacucugagccaucucugcagcccgacauuucuuuaugguuuuucgagacaggguuucucuguauagcccuggcuguccuggagcucacuuucuagacuaggcuggccucgaacucagaaauccgccugccucugccucccgagugcugggauuaaaggugugcgucacccccacccccacccccacccccggcuccaacauuucauuuuuaaaauaguugauuugggaagcaugugccugccauagugauguguggaagucagaggacaguuuguaaacaucgguucucuguugacaccuuguaaggaguggugauugaacuugaggucauuagacuugguggcaaaccccucuucccaccaagccaucuuacugucccacgugccauucuucgguauaucuuguugcuggucacauauguucagucuaagauccaccaccuagcacugcguggcauuuuccuaguugcaucuuacuguugugugaaugccaugacauguggaguucaggggacaguguucaagaggcgauucucuccuaccauguaguuccugggaccugauguauuacaguagucgguaaaaauugaauuggugugguguaagcacugcagaccucucaucccggcacuuggccagcacagaugggggaaucaggaguugaaggucgucccuucgaggcuagcccgggcugcaugugauccugucuggaaaaaaaaaaaaaagcaaaaacaaaacccuguuuuuuacuacggaggagauugaaucacagagagguuccccagccccaugggaaagauugucagaguaaguguaucuuaugaaacuugggagcuggaagaaaacaucaugggcuggaagcuaaaaugcuaggagugucuaaucucaguccuggaagcaggaaggccaggaauagccagggccuggaaggugacauuuuuguguugcuaucaauuccugaugcuaauggcuucuacaccuuugguuuccuggaauugcuggugcuccuagguaugaagccugggcucuuaggaaaguguucagccaacagagcuccuccuuuuuuucuuugaagacauuaucuuaguuuguagcccuuuuacuuuugccucucuucauaagagcauagaucccaugguagggggucccucacaacuccauaaaucaucucacgacugguaagggcuucaaccuaggaauuuggggaaaaacagcccaggccucuacuccuacccacauauacugcuuucccuagagucagcaauggagagggaccgcuacaugagccccauggaggcccaagaguuuggcaucuuggacaaggucuugguccacccaccucaggacggggaggaugagccagaacugguacagaaggagacugccacagcgccgacggauccuccugccccgacaagcaccuaaggaguggagaccagacugaaacuuccucugcugggcccaagaacaaccccuagaggagauguggauugagguugcccucagagcagggcagacugccugagacacugugauuuaaauuaaaucuuuguagucuuugucccaugucugaagcaccuuccauuacuucuccaagacagcaggccuccuucaccuugacaaaccacuucaguaagcaaacccuggcucuccuggaacuaaaccaaucuagccucagacucagguacccaccugccucaccuccugagugcuaggauuaaagguguacaccacca

SEQ ID NO: 8689 - RNA, 2054 nt, Mus musculus
cagccugcuguggucaaucccugaagauggcgggcagcaggaggcuagcgaugcgguugcuuucugggugcgccugggugcgcggcucagacucugccgugcugggccgccugcgugaugaggccguggugcauccaggcuuccugagccaggaggaggaggacacgcuaacacgcgaacuggagccccagcugcggcgccggcgcuacgaguacgaccacugggacgcggugagugggcggagcggcgagcuaaggggacgcccacugggacauagugagggggcgggguccucggagggguagagugaagagcuaggcuugcuuggccagguuggggacaguguguuuugggcaguccccgauguagguucgggugggaccaaguuucucuggugugggacauggcgggugcugggcaauucgaugagugacaguuggucaggaggucuugugggaauggggcugaucuugaugccagagcugaguccaggggaaggccugcugcugcgggcuuguggaugguacuuagagcaggggaagggaccagagccggagaaggugaacuggcaacguugagcucagagcagcgcaguauuacagugggggcaaaucacugcugggcuuuacuaagaacaggggcuguaguguggggcugggccuggaaucagaagggaggguuuuggugggcaccaaggaaugcguagugaggacaaagaugucacuucagacaugaaguucuggaacacuucaggggcauuggugacaagauuagaaauaaaaagcagacuugggagagggagugccagcaguugggaguuucacuagggacuugagugggaucaaauagagacaggagaccgagauacugaauauuaggguggccagcaccagggaccacugggaaacgaaacgugaagaccagaugcgugguugaaaccucacugauaaugagcuaaaguuggaaagacugccugcccuguacugcaccccucgguaccucauuuuccuguccugggaguucccaguuaugacuugagcucucuauucaggccauccauggcuucagggagacagagaaauccugcuggucugaugcaagccaggucauccugcagcggguucgggcggcugcauuugguccugaccagagccugcuauccccaguacauguguuggaccuggaaccucggggcuacaucaagccucauguugacagugucaaggugggcagaaggcauuccaucagaacuccuagcuagguugucgguggacaggggggcagaacuaagccugacaccccaauauacacagcauacauaccccuuuuccaguucuguggaucuaccauugcuggccuuucccuguugucuccaaguguuaugaagcuggugcauacacaggaaccugagcaguggcuggaacuguugcuggagccagggucucucuauaucuuaagguacgacguaacccaaaguccucaggugaggccgaggguuucuaacagucaccaccaccacucagaaaaaguauagaaaugcugaagggacagucuucccuccauccacccacucagcuucucucuucuugcagggguucagcccgauaugacuucucccaugagauccuuagagaugaagaaucauuuuuuggggagcaccggguuccccggggccgacgcaucucagugauuugccgcucccucccugaggggauggggccaggaaggccagaagagccaccuccagccugcugaccucccacauauccuccauauuugugaauaaaguagggaaaaugcugucaugggaucuucaaaugaccgucugccagggcuggggcucuuaagagacgaucagggucucaggauucacauagcaugguggcugccagggugcaccugaucacacacacucuuaaggccacgagaauaucauuuauugcauccacugcugauuaaaaaaaaaaaaaaacuaacaagcaagcaaagaaagaaacaaaaaacccugguccuuucccuucuuaucuuuaccuaugcaaauuucuaguaauguc

SEQ ID NO: 8690 - RNA, 10476 nt, Mus musculus
ggagguuuuugauaccauuuauuugugaaguuaaaaacgagcgauaaaaaguaaaaacugccauacaauuuuuuuguuuuguucucauuuuuuucucaguuuaucucaucuucaacagaugacaacguaccaggccaguccugggguugggguggguauaaggaggagccagggaagagcgggggcagggagaaagagagacagagagagaugggcagggcaggaggggccugugaaacccacaccugguccaaggaauguuccaacucuaacuaaaaaaaaaaaaaaaaaagaaaaagaaaaaagaaaaagaaaaaaaaaagaaaaaaagagauagcaauagugacuguuucuuuccuuuuaaaaaguuuauuaaaaacaagaauagggccccagacaguagggagauagugaaccgcuucccucagagggugggcucggaggcuggggaauagagauuuauauauuucuauacauauaucauuuuauagguuuuguucugcucuuugugauuuaauuuuuaaacuuuuuuggggggcggggcagagguuaaauucuugcuauuuucuaaggcuggcucaacaugaaggaucccaauuuuggaaaggaaaaagaugagacacacagagugagagagggagcgccucggcaugaaggggauccccagccccuaggcagccgcugcucucucgccaaaccaaucaaauauagaaaccaauaaaagaagcccccaaauggaacaaaaauggagaaaaaaaaauauuuucacagaugaaguucauauccauuugcuucauuugccugcagagagggagagacaggaauggucauggcaggagggcggccuggcuacaggaggcuacaacuccaggcagugggccaagaggccgggcccaagcccccacaggcuaagcagggggccgugacugucugucuuggggacuccacuggccagacugcuccuugguggaggagaagcaggaggaagaggaagaggaggagaagucugcagcagaagccagagguguggaagagggcacacaggggagaaguugccaggggggagggggacagaggagggaggcggcagcucggcgucacaacauucagaucaugguguccccacaacaccccugugagguagguuggaagguggcaacgaucgucaugcccacuucacagacaagaccgggacacagaggcaagcacacaagagauggccuugccaggcagggagggcccaguccccucagugggcuccccuucaucccagcagagccagggccgccugcaacacacaguuacuuggacaugaaaaaagaauaaaaaaagaacaaaacccaaaauagugaugcugagaagggggaaaaaaauagacauuuucuucccaaguggccagauuuugagcgagcagguucagcaaccgguguggcacccagcacaguccccacauccugcccccacccgggacaccccagcaguucagaguuccaccuuugcggccggugcccccagcacccgacaacgucgcacgacaguggcuacuggaggagccucuuccguaagccucugcacccaucgagcgcuucccagcggcggggcugcgaggcucugggagacucuggccacgagcccgaggcuggcaucaagggcacaccccgcaggggaaaggguuuccggcgcuacccacuaaggcaggauggacgguggccggggguuggaaggagaaaggaggaggaggaggguggcaguucccacuugccugcugcugucccugcugggugggagguggcugugggccaccagggccuggggucuguccguaguaagcagccugcugucuguaauacucagcccaggcagcacuguaaucaggcugggagccagggggugcuccaggacccccaccaguggccacuugugcugugggcacagagaggaucaugaguggcuggcagaagaaccuaccccugacccagcagccccaccccgucccuacccagcagcuuaccuugcuucuuguaguacuccucccaggccuugguguaguccugcugugggggugccccaggcugcuggggcugcuggccugaggaacaggguagggugucaggguaguuggacccuaugcagaaaaccccacugcuucccagcacugaacuuaccaauuuuuuuguaauacucuucccaagccuugguguagucugauuggccaguggguggaggcuggggggguucccccugugcagguggggcugcaggggcuggggcagggccuggcacaggaccuggggguugcugguaguagugagaguaguaggcagcccaggcagcauuaggaucuguagccgcugcagcagcuuugucuacaggaagagauguugguugaggaagggcacaguaguuggccuggugucccccccacccccaaauuuccuaugugguacugacacuuacuugggucgugaggggcagguggcugccacuggggguagguauugccccagcccugaggcggguacuggugaggagggggaccaccagcacugcagggaaggagagaaguggccaugagaacugguucaagggugugaaaaccaaaguccuuaccaauaccugaaagcuggggcugacauaaaaccaagaccaaggucuaaggcaggagagucucauggcaccugucacacugggcugcacacagcccaguuagaaagggccugucccucuuuuuccaggccccacaacacuaaacauaacccaggagccaaggaguacucacugugggggugccccuggaggccccugguugaaggguccaggguugaaaggccccauggguccagcagggccuggucccccagggccugguccaacugggcagaggggacccugagggaaaaagugacagcugcagugagcaauccaaggagacaggguaccuucaccagcacccaugaacguaccucuaucuucuccucaaugagcugcuuugcauggucaaucugcuggggcgauccccggaucacaaacaacuugaaauugggguccccauuggguggcagcugccgagauauuuccacaaaggcgccugucugcugguuaauggccuucacauucuccccgccuguuggaccacgaugagugaagggcuggcaaguucagagccaggcagaaaaagggcagagcauuggggacucaccucggccaaugaccagcccacacuuauggguaggaauggagaaagucaucuccccuccaggagggccccaguugccuuggccucggccccggccccugcccccagggggcaugccaggggccccuggaggacccgggggcccacuccgaagacucuggaggaggucauugaugauccgggcugcguguucacaccgaucuggaggccccaugaugugagcaaucuucucagggccggucccaucaucugaauccacaccaagaaacagauauuacucaaagcaaacccagugcccucagagaucaguuccucgaauuugcugacuccaugugaacaagcaggaagcuuguccauacucagcguaacagcuugaacauucucccaccuuccaaguccauagaacuaacuaagcaaucuuagagaaacuaauuccagaaaagcaacugaaaaaaacuggguaccaaaccucugcaggcacugagggccugcaagagcuggggggcagcaccaaugccuaaaccaagguggcgcccaccccucaccuugcuugaacuggaugcgcacaccggcaucauucuggaucuucuugaucaucucuccacuccggccaaugacuacaccaacugaaugccuggguacaggcaccuaggagaacgggaggcauaguuacguggcgugccccuaguucugcccugcucccaguugcccaccuccccgaagcgcuugcacucacaucaaugccuccaccaacucgagauccguauucauugcgguccccaaagccaccuuggucacguucucgcaggauguccaucaccaucucacaggcuugcuguaaacauaccauacugaguagugggaucaggcaaguaugcugccacuguaccuaucuccugguaccugugagggucucccacauccccagagagcugcaaaaugccuuacagagcuuuucacccugggcaagaggcugaagggcuuagagggaggcuacugcuggcaauagccaggcaagauuggacagaaaagccuuccagaguccaugcuuucugggagcucaccuguacuuuguauggguccccgauaauccgcaguggcuuguccacauuuguguucugggagccauccugaauuaaaaucaucuucaccccagcccgcuccugcaauguaagugccugucagaggcagucuugaggaugcuggagaauguggggacaagugcuuuguuuggucuguugccaacacacaccugcagcugcuugauggucucuccaccuuuaccaaugaccaggccagccuugccagcagggaucaugaucuccugcacugugccauucugacccccauuggcguugucgugaaacuguccuggggggccaccacggccccgagacacgaugucauccagcaucaucuuugccuuucuggaaagauaagguagcacucagcauguacaucuggagcacagcagcucagcugagcuaucgggugugugcaaaggaccugggcuguucaagauugagaggugggugucaaauuguccacaaagaucuagggagaagucuugugggaaggacacacauaggugucacuaacuccuguaggaaacuaggaaacccagcuggggacuuacuggacagacucaggugcuccagucagagacacgcugcgcucagggaggccaccacuaucuguggagaagaagaggggcucaguacaaagagggcugcuacagcaggaacaggaaacuuccagaacagccugcagcccucuucuacaaaucauuucaccccugccacaacaugcuaggaagacugcuucucuaaaaucuagugggggaagacagaacuugggagggagacaagcagagcaccacaccccuucucgcacguagaggccaaagcaagaggacugauagugaagaaaggggagacuccagaaaucagcucaggauuacuuuuuuuuuugguuuuguuuuguuucccgagacaggguuucucuguauugcccuggcugucuuggaacucacuuuguagacaaggcuggccucgaacucagaaaucugccugccucugccucccaagugcugggauuaaaggcgugcgccaccacugcccgacucaggauuacucuuaacagcacccaggagccuggcucaaaucuaaagggacccccauguacaccucccacaggagcagaccaagcagccggaaagccugccauucugcuuccugcagcacugagaggugacaccauagagccugccaccuggaaaaguggugccuucgcgcccaugcccacauuccucuagaccaucccaaaugcaaagaggaaaaacaagggcagggacauggcucagggagcagaggugcucaucaccaaaccugauaaccuaaguucaguaucuggauuccgugacagggggagagcuaaccucugaccuccacgugugugccaugauaagugcucaccccacacauuacaaaaauacagaaguauuuccacuguggccucuguauuuaugcaggagauauccacacaacagagccagcuuugcccuggggucccaggcaacuuuacagauggagggucauaccuggugagaucugaacuuugcagccugaguccugcuggauuuuguuuaucugcucaccaccucugccaauaacugagcagaaagaaaaaaaaggugaaggcugaauaagggcacccagaccaaggcuccccaccaguagucccuuggagacccccuuggccagaggcucuuaggcccccacccucaucaaggggacccacacucacucaagcccaccaugccauccggaacccuauacucuucugucauugagguccugugggaagagacacuuaacaucagccuccagcuagagaagagaccacacagcuuuccuggaaauaaaagcccgguagcccuuugaagcuucaggguuuuugcugcacacccugcuacuacaucaagaacaauggcuucagggccagagucuagaaguggcccauggcaaucccauuuccuuagguaagaacacuugaauuugguuuuggagacgaacuccauauagcucaggauggcuuuugaauuccugaucccccugccuuaaccucccacgugguugccugguuuuuuguuuguucugaggcaggauauuugggagggaauccagggugagugcucuauugaccgaguuacagcuuccucaccuuguauacaauuucauaccacacuaacaguccacauaucauuaaaaagggggcuugucacauaguucaccucauucuccaguuaguaucuauuguauuucaugaaacuacaaacucauucaaagaaaaccaguagccuaucucaacaaccuagucauauucaccccaggccaucugaggcagccagacaacagcauccucuacagguucuaaucacccugggaacaucugacuacucagccagugauaaaccacguuguuacaguauccacaauccacacacacccccaaacacacauggacacaagugcacccuuucccccgcccaccagcaucccugguuccgcuuaccuggggggaggauggaugggucccaguugagaaccaaucgcugggaaaagaaauccaaagcagagacuagcuuagcaucuaucugggcuccccaaccccaacccaugaugccccguuugcacacacccaguggacuuacagucucccugggaagccaguuucuugcugucuggcuggucuguggaugagagagucugucagaugugacaccacccacccgcaccgccucaaccccaaagcuggugcagcauguucuaggcauagucaccauuaccacaugacagccgaaauggaggguuagaaggugcuggcccagaaaggggcaacaugcccaagucauucaccaccucagagugacaaagcucacuuuuucuuucuuuuuuuugagacaggguuucucuguguaggccaggcuggccuugaacucagaaaucugacugccucagccuccuaagugcugggauuaaaggcguguaccaccaccacccagcugacaaaguucacacauaaacauuauuaacaucacaggguccucuuccagauuagagucaggaaaccaauguccugcuuaacagcuaccuugugcccuguguuggucucuaacagggaaggaacagucuugagagccuaccacccucccugucacaaucgaccugcccuucucucaucucagcuucugauacuuuuuuucuuuuuucuuuucuuucuuucuuucuuucuuucuuucuuucuuucuuucuuucuuucuuucuuucuuucuuucugguuuuccguuuucuucuuuuuugggggggggggguuucgagacaggguuucucuguguagcccuggcuguccuggaacucacuuuguagaccaggcuggccucgaacucagaaaucagccugccucugccucccaagugcugggauuaaaggcgugugccaccaccacccggcucuuucugguuuuccgagacaggguuucucuguagaacccugccugucuuggaacucagaaaucugccugccuuugccucccaagugcugggauuaaaggugugcaccaccucugccuggugcuagcuaucugauacuuaaggguggcagaugggacaaaaagcugggcuggcuccccugucuugaagucccacugggacaaaaugcuacucuuagccccaggccucccucucaggugagagccagcugcuguuacugccgccgccgccgccgccaccagcaguuaccuccaucuuccagcugucucuuuuggcccccaaagccaaaaucaggaguguuguuauucacggugguagcagcaucaccuccgauuuuggcugcaaucuagggugagguagaaauauagaugaguuaccaucccaagcaacucucaaguuuaucuccagcuuuggccuggaguggcucucccugauuuugaggagugugggcacagacauagacacucuagaagcuuuuaugaaugucucccaaguuuucuaagaacuauaggcucccuguccccauuacagucaggaucugugaccacaagugcaaaaggaacagcagccaaggaagacagggauuccuggaccacccccacaaguggccuggacagcaaacaggauuucaauguggucccuacaaccuuccugucuuuuacccuggacaucuuuacaaaaucauccugagaaaucucagccaaguuucuaccuucaaggcaccugacaucccaguaugaccaaaacaaaagccccuuuggggcacacacugaguuucaaguacacagagaacauauauacaucaccccuaagucaucaaacacacuccaaauccugaacucaggaucuggccuaugcuauuauaaaaaacaaaaaaaaaaauugugcuuacccuugacagggagugucaucucaacugacagcacuuacccacgggaagcugccucguaagacaauuugggggaugaccagaaaaaaggcacgcuaaagcccaucccaccucggaggaaggcagaggugauaaugaagagggcaguaacucaauggguccucccaccuagggaggagccaguccuuaggccggaggccuugggacaaccccaggauagcagcaucugugguaagccuggccuguccaacucucagaauguacccgagugggguugugagcaaggcugagccaggucacaccagcacauaacacucuuaaaugcggucaucaaaacaaggcauguucccaaagacagacaauacuuuugaauucaaacaguaaaaagcaggaucccguguccaccuuccccaccucaucccaaagcccaggcucucuaacaaagggucgguccucucuucaucagaaagaacucucccaaccccuuaccaaaucccuuccuagggaagguacagaaaugggccaggggaccuguuuugacuugaaaauaggaguaaugguguguaaagcaagauccucuaaaagggaguugaauuucugggcgggugcaaaugugugcuaagaugggucccccccacuuucuaaguauacggccaagcucagucccugugcaaaccuaggacuccgucuugggaacuaauauauucugaacccucaggucucugaauagcggucuccuaccauccugcgaugcaacuuuacaaacccugagaagcccuuggggacccuaagacuccaaggguucaaagaggggucucacagcaucucugaccccauccuucaugaacucaggaauugcucuuacagaucugccucaguuucuagaaccccauggguccuaagggggugccuaagugaaaacccaggagugauucuuggggacauccucauaacauucaagcucaggccuuuggaaaacuaggagaccucuccaaaucacaaacagucuuggacuuuagagugguccucagaaugcaaacccuauaucuugaauggaaauaacgggugcaagcucgggggguggcucuuggggacacugucccagacugcaaccuuuauggguccuagaggaauccucuaguacacccaggaaaaaaaucgugggaacuccaaagcugcaacccuccuaauagagaagaccuggugcaaguacaggggugggucucagggaccccaaaggcugcaagcccugguacccaagagaaaccguccagugcaaagucuaguuuucggagauccccccuucaacgcacccuuaacuacacgcacgcagagggucacccucacaccgugacggccccagacuccccgccccgagcccgccgcccacgugacccucccgcgaccccgcgcgcgccgcugcccccucccccgcgcgcgcgcacgcgcccucgcggcccccucaccuggcgggcccgcugcacggcgucggcgaaggcguccuugcggaucccagggccgccgccaccgggaggcugugaggggcccccggacgcgccuccuccacccgggccgccgccgccagggccuccgccgccccggucucccgcgcccggcgggcccggcggagggccuccucccgcacccgcggcucccccuccgccgccagcgggaggcggcgggccgggcgggggaccuccgguguuguaguccgacauggcgcggcggggacgggcuuggugcggaggcuucaagcugaggaggcggaggcggcggcggcucaacgcgggaacaaggccucgcuccacacggccgcggagcacgaugggaagccagcggcug

SEQ ID NO: 8691 - RNA, 10476 nt, Mus musculus
cagccgcuggcuucccaucgugcuccgcggccguguggagcgaggccuuguucccgcguugagccgccgccgccuccgccuccucagcuugaagccuccgcaccaagcccguccccgccgcgccaugucggacuacaacaccggaggucccccgcccggcccgccgccucccgcuggcggcggagggggagccgcgggugcgggaggaggcccuccgccgggcccgccgggcgcgggagaccggggcggcggaggcccuggcggcggcggcccggguggaggaggcgcguccgggggccccucacagccucccgguggcggcggcccugggauccgcaaggacgccuucgccgacgccgugcagcgggcccgccaggugagggggccgcgagggcgcgugcgcgcgcgcgggggagggggcagcggcgcgcgcggggucgcgggagggucacgugggcggcgggcucggggcggggagucuggggccgucacggugugagggugacccucugcgugcguguaguuaagggugcguugaaggggggaucuccgaaaacuagacuuugcacuggacgguuucucuuggguaccagggcuugcagccuuuggggucccugagacccaccccuguacuugcaccaggucuucucuauuaggaggguugcagcuuuggaguucccacgauuuuuuuccuggguguacuagaggauuccucuaggacccauaaagguugcagucugggacaguguccccaagagccaccccccgagcuugcacccguuauuuccauucaagauauaggguuugcauucugaggaccacucuaaaguccaagacuguuugugauuuggagaggucuccuaguuuuccaaaggccugagcuugaauguuaugaggauguccccaagaaucacuccuggguuuucacuuaggcacccccuuaggacccaugggguucuagaaacugaggcagaucuguaagagcaauuccugaguucaugaaggauggggucagagaugcugugagaccccucuuugaacccuuggagucuuaggguccccaagggcuucucaggguuuguaaaguugcaucgcaggaugguaggagaccgcuauucagagaccugaggguucagaauauauuaguucccaagacggaguccuagguuugcacagggacugagcuuggccguauacuuagaaagugggggggacccaucuuagcacacauuugcacccgcccagaaauucaacucccuuuuagaggaucuugcuuuacacaccauuacuccuauuuucaagucaaaacagguccccuggcccauuucuguaccuucccuaggaagggauuugguaagggguugggagaguucuuucugaugaagagaggaccgacccuuuguuagagagccugggcuuugggaugagguggggaagguggacacgggauccugcuuuuuacuguuugaauucaaaaguauugucugucuuugggaacaugccuuguuuugaugaccgcauuuaagaguguuaugugcuggugugaccuggcucagccuugcucacaaccccacucggguacauucugagaguuggacaggccaggcuuaccacagaugcugcuauccugggguugucccaaggccuccggccuaaggacuggcuccucccuaggugggaggacccauugaguuacugcccucuucauuaucaccucugccuuccuccgaggugggaugggcuuuagcgugccuuuuuucuggucaucccccaaauugucuuacgaggcagcuucccguggguaagugcugucaguugagaugacacucccugucaaggguaagcacaauuuuuuuuuuuguuuuuuauaauagcauaggccagauccugaguucaggauuuggaguguguuugaugacuuaggggugauguauauauguucucuguguacuugaaacucagugugugccccaaaggggcuuuuguuuuggucauacugggaugucaggugccuugaagguagaaacuuggcugagauuucucaggaugauuuuguaaagauguccaggguaaaagacaggaagguuguagggaccacauugaaauccuguuugcuguccaggccacuugugggggugguccaggaaucccugucuuccuuggcugcuguuccuuuugcacuuguggucacagauccugacuguaauggggacagggagccuauaguucuuagaaaacuugggagacauucauaaaagcuucuagagugucuaugucugugcccacacuccucaaaaucagggagagccacuccaggccaaagcuggagauaaacuugagaguugcuugggaugguaacucaucuauauuucuaccucacccuagauugcagccaaaaucggaggugaugcugcuaccaccgugaauaacaacacuccugauuuuggcuuugggggccaaaagagacagcuggaagauggagguaacugcugguggcggcggcggcggcggcaguaacagcagcuggcucucaccugagagggaggccuggggcuaagaguagcauuuugucccagugggacuucaagacaggggagccagcccagcuuuuugucccaucugccacccuuaaguaucagauagcuagcaccaggcagagguggugcacaccuuuaaucccagcacuugggaggcaaaggcaggcagauuucugaguuccaagacaggcaggguucuacagagaaacccugucucggaaaaccagaaagagccggguggugguggcacacgccuuuaaucccagcacuugggaggcagaggcaggcugauuucugaguucgaggccagccuggucuacaaagugaguuccaggacagccagggcuacacagagaaacccugucucgaaaccccccccccccaaaaaagaagaaaacggaaaaccagaaagaaagaaagaaagaaagaaagaaagaaagaaagaaagaaagaaagaaagaaagaaagaaaagaaaaaagaaaaaaaguaucagaagcugagaugagagaagggcaggucgauugugacagggagggugguaggcucucaagacuguuccuucccuguuagagaccaacacagggcacaagguagcuguuaagcaggacauugguuuccugacucuaaucuggaagaggacccugugauguuaauaauguuuaugugugaacuuugucagcugggugguggugguacacgccuuuaaucccagcacuuaggaggcugaggcagucagauuucugaguucaaggccagccuggccuacacagagaaacccugucucaaaaaaaagaaagaaaaagugagcuuugucacucugagguggugaaugacuugggcauguugccccuuucugggccagcaccuucuaacccuccauuucggcugucaugugguaauggugacuaugccuagaacaugcugcaccagcuuugggguugaggcggugcggguggguggugucacaucugacagacucucucauccacagaccagccagacagcaagaaacuggcuucccagggagacuguaaguccacugggugugugcaaacggggcaucauggguugggguuggggagcccagauagaugcuaagcuagucucugcuuuggauuucuuuucccagcgauugguucucaacugggacccauccauccuccccccagguaagcggaaccagggaugcuggugggcgggggaaagggugcacuuguguccauguguguuuggggguguguguggauuguggauacuguaacaacgugguuuaucacuggcugaguagucagauguucccagggugauuagaaccuguagaggaugcuguugucuggcugccucagauggccuggggugaauaugacuagguuguugagauaggcuacugguuuucuuugaaugaguuuguaguuucaugaaauacaauagauacuaacuggagaaugaggugaacuaugugacaagcccccuuuuuaaugauauguggacuguuagugugguaugaaauuguauacaaggugaggaagcuguaacucggucaauagagcacucacccuggauucccucccaaauauccugccucagaacaaacaaaaaaccaggcaaccacgugggagguuaaggcagggggaucaggaauucaaaagccauccugagcuauauggaguucgucuccaaaaccaaauucaaguguucuuaccuaaggaaaugggauugccaugggccacuucuagacucuggcccugaagccauuguucuugauguaguagcagggugugcagcaaaaacccugaagcuucaaagggcuaccgggcuuuuauuuccaggaaagcuguguggucucuucucuagcuggaggcugauguuaagugucucuucccacaggaccucaaugacagaagaguauaggguuccggauggcauggugggcuugagugaguguggguccccuugaugagggugggggccuaagagccucuggccaagggggucuccaagggacuacugguggggagccuuggucugggugcccuuauucagccuucaccuuuuuuuucuuucugcucaguuauuggcagagguggugagcagauaaacaaaauccagcaggacucaggcugcaaaguucagaucucaccagguaugacccuccaucuguaaaguugccugggaccccagggcaaagcuggcucuguuguguggauaucuccugcauaaauacagaggccacaguggaaauacuucuguauuuuuguaauguguggggugagcacuuaucauggcacacacguggaggucagagguuagcucucccccugucacggaauccagauacugaacuuagguuaucagguuuggugaugagcaccucugcucccugagccaugucccugcccuuguuuuuccucuuugcauuugggauggucuagaggaaugugggcaugggcgcgaaggcaccacuuuuccagguggcaggcucuauggugucaccucucagugcugcaggaagcagaauggcaggcuuuccggcugcuuggucugcuccugugggagguguacaugggggucccuuuagauuugagccaggcuccugggugcuguuaagaguaauccugagucgggcagugguggcgcacgccuuuaaucccagcacuugggaggcagaggcaggcagauuucugaguucgaggccagccuugucuacaaagugaguuccaagacagccagggcaauacagagaaacccugucucgggaaacaaaacaaaaccaaaaaaaaaaguaauccugagcugauuucuggagucuccccuuucuucacuaucaguccucuugcuuuggccucuacgugcgagaagggguguggugcucugcuugucucccucccaaguucugucuucccccacuagauuuuagagaagcagucuuccuagcauguuguggcaggggugaaaugauuuguagaagagggcugcaggcuguucuggaaguuuccuguuccugcuguagcagcccucuuuguacugagccccucuucuucuccacagauagugguggccucccugagcgcagcgugucucugacuggagcaccugagucuguccaguaaguccccagcuggguuuccuaguuuccuacaggaguuagugacaccuauguguguccuucccacaagacuucucccuagaucuuuguggacaauuugacacccaccucucaaucuugaacagcccagguccuuugcacacacccgauagcucagcugagcugcugugcuccagauguacaugcugagugcuaccuuaucuuuccagaaaggcaaagaugaugcuggaugacaucgugucucggggccgugguggccccccaggacaguuucacgacaacgccaaugggggucagaauggcacagugcaggagaucaugaucccugcuggcaaggcuggccuggucauugguaaagguggagagaccaucaagcagcugcagguguguguuggcaacagaccaaacaaagcacuuguccccacauucuccagcauccucaagacugccucugacaggcacuuacauugcaggagcgggcuggggugaagaugauuuuaauucaggauggcucccagaacacaaauguggacaagccacugcggauuaucggggacccauacaaaguacaggugagcucccagaaagcauggacucuggaaggcuuuucuguccaaucuugccuggcuauugccagcaguagccucccucuaagcccuucagccucuugcccagggugaaaagcucuguaaggcauuuugcagcucucuggggaugugggagacccucacagguaccaggagauagguacaguggcagcauacuugccugaucccacuacucaguaugguauguuuacagcaagccugugagauggugauggacauccugcgagaacgugaccaagguggcuuuggggaccgcaaugaauacggaucucgaguugguggaggcauugaugugagugcaagcgcuucggggaggugggcaacugggagcagggcagaacuaggggcacgccacguaacuaugccucccguucuccuaggugccuguacccaggcauucaguugguguagucauuggccggaguggagagaugaucaagaagauccagaaugaugccggugugcgcauccaguucaagcaaggugaggggugggcgccaccuugguuuaggcauuggugcugccccccagcucuugcaggcccucagugccugcagagguuugguacccaguuuuuuucaguugcuuuucuggaauuaguuucucuaagauugcuuaguuaguucuauggacuuggaaggugggagaauguucaagcuguuacgcugaguauggacaagcuuccugcuuguucacauggagucagcaaauucgaggaacugaucucugagggcacuggguuugcuuugaguaauaucuguuucuugguguggauucagaugaugggaccggcccugagaagauugcucacaucauggggccuccagaucggugugaacacgcagcccggaucaucaaugaccuccuccagagucuucggagugggcccccggguccuccaggggccccuggcaugcccccugggggcaggggccggggccgaggccaaggcaacuggggcccuccuggaggggagaugacuuucuccauuccuacccauaagugugggcuggucauuggccgaggugaguccccaaugcucugcccuuuuucugccuggcucugaacuugccagcccuucacucaucgugguccaacaggcggggagaaugugaaggccauuaaccagcagacaggcgccuuuguggaaauaucucggcagcugccacccaauggggaccccaauuucaaguuguuugugauccggggaucgccccagcagauugaccaugcaaagcagcucauugaggagaagauagagguacguucaugggugcuggugaagguacccugucuccuuggauugcucacugcagcugucacuuuuucccucaggguccccucugcccaguuggaccaggcccugggggaccaggcccugcuggacccauggggccuuucaacccuggacccuucaaccaggggccuccaggggcacccccacagugaguacuccuuggcuccuggguuauguuuaguguuguggggccuggaaaaagagggacaggcccuuucuaacugggcugugugcagcccagugugacaggugccaugagacucuccugccuuagaccuuggucuugguuuuaugucagccccagcuuucagguauugguaaggacuuugguuuucacacccuugaaccaguucucauggccacuucucuccuucccugcagugcugguggucccccuccucaccaguacccgccucagggcuggggcaauaccuacccccaguggcagccaccugccccucacgacccaaguaagugucaguaccacauaggaaauuugggggugggggggacaccaggccaacuacugugcccuuccucaaccaacaucucuuccuguagacaaagcugcugcagcggcuacagauccuaaugcugccugggcugccuacuacucucacuacuaccagcaacccccagguccugugccaggcccugccccagccccugcagccccaccugcacagggggaacccccccagccuccacccacuggccaaucagacuacaccaaggcuugggaagaguauuacaaaaaaauugguaaguucagugcugggaagcagugggguuuucugcauaggguccaacuacccugacacccuacccuguuccucaggccagcagccccagcagccuggggcacccccacagcaggacuacaccaaggccugggaggaguacuacaagaagcaagguaagcugcuggguagggacgggguggggcugcugggucagggguagguucuucugccagccacucaugauccucucugugcccacagcacaaguggccacugguggggguccuggagcacccccuggcucccagccugauuacagugcugccugggcugaguauuacagacagcaggcugcuuacuacggacagaccccaggcccugguggcccacagccaccucccacccagcagggacagcagcaggcaagugggaacugccacccuccuccuccuccuuucuccuuccaacccccggccaccguccauccugccuuaguggguagcgccggaaacccuuuccccugcggggugugcccuugaugccagccucgggcucguggccagagucucccagagccucgcagccccgccgcugggaagcgcucgaugggugcagaggcuuacggaagaggcuccuccaguagccacugucgugcgacguugucgggugcugggggcaccggccgcaaagguggaacucugaacugcuggggugucccgggugggggcaggauguggggacugugcugggugccacaccgguugcugaaccugcucgcucaaaaucuggccacuugggaagaaaaugucuauuuuuuucccccuucucagcaucacuauuuuggguuuuguucuuuuuuuauucuuuuuucauguccaaguaacuguguguugcaggcggcccuggcucugcugggaugaaggggagcccacugaggggacugggcccucccugccuggcaaggccaucucuugugugcuugccucugugucccggucuugucugugaagugggcaugacgaucguugccaccuuccaaccuaccucacagggguguuguggggacaccaugaucugaauguugugacgccgagcugccgccucccuccucugucccccuccccccuggcaacuucuccccugugugcccucuuccacaccucuggcuucugcugcagacuucuccuccucuuccucuuccuccugcuucuccuccaccaaggagcagucuggccaguggaguccccaagacagacagucacggcccccugcuuagccugugggggcuugggcccggccucuuggcccacugccuggaguuguagccuccuguagccaggccgcccuccugccaugaccauuccugucucucccucucugcaggcaaaugaagcaaauggauaugaacuucaucugugaaaauauuuuuuuuucuccauuuuuguuccauuugggggcuucuuuuauugguuucuauauuugauugguuuggcgagagagcagcggcugccuaggggcuggggauccccuucaugccgaggcgcucccucucucacucugugugucucaucuuuuuccuuuccaaaauugggauccuucauguugagccagccuuagaaaauagcaagaauuuaaccucugccccgccccccaaaaaaguuuaaaaauuaaaucacaaagagcagaacaaaaccuauaaaaugauauauguauagaaauauauaaaucucuauuccccagccuccgagcccacccucugagggaagcgguucacuaucucccuacugucuggggcccuauucuuguuuuuaauaaacuuuuuaaaaggaaagaaacagucacuauugcuaucucuuuuuuucuuuuuuuuuucuuuuucuuuuuucuuuuucuuuuuuuuuuuuuuuuuuaguuagaguuggaacauuccuuggaccagguguggguuucacaggccccuccugcccugcccaucucucucugucucucuuucucccugcccccgcucuucccuggcuccuccuuauacccaccccaaccccaggacuggccugguacguugucaucuguugaagaugagauaaacugagaaaaaaaugagaacaaaacaaaaaaauuguauggcaguuuuuacuuuuuaucgcucguuuuuaacuucacaaauaaaugguaucaaaaaccucc

SEQ ID NO: 8692 - RNA, 1972 nt, Mus musculus
uuguccuguggccuuugcugcgugcuuacaugagagacauaagugggggcucccagcuccucgagggguuguacacaagccuggcccaggaggaccuggggaggcugguuucugggguucucugcagaaugagagcaugagggagacgaaauggauuguaaucuuuggacagcaucagaguugggcucuguggagacaagaagcugggggcuuucuggaggacugugccuaguggggacucugaggagcuuggggcaggggcuuugugagggucuaggauccagcuugcugagagagggcccgggguccccuuggcuuggggggcucugcugaaauggcugagaacaggaguucuuugaguagcuuacaaccucugaaaauggggugucuugcagaagugacaggucaccagguagggaccaaggcugaggauccugggaucucuugucuucuuccaguugccaugguaaccccacugggaugucaggcugggcagagcaggauggaagguaugguugaugucagaaaggggaagacacugacagguggggaggggguagcagagaggaaguucucaccaggcuggagcagcucucugacgccgccccucgcugacagcagucuaagcucuggcuggcccucugcaggucgccacucuugguuuccacguucaggcugucuagaaucucacucaguagauccagcucuucuccagaccccagaaagcugccaucuagaguaucuucugcccagggguucugaguguccccagggcucaagguggggcuccuggauugaggauugacauccugggcuuugucuccggagucuagaagacaccccucaucaguugugauccuugcaccucucaacuuugaucugcuucaauucuuaccucucccgcagggguucggaaggucccucuucagucuugagucuccugcuggggcggaggggccuguucugaaaaagauaagagaggaagaaaugggaggagccccaggagcuuuugaauccagggcuagggcuuuccagcuugaauuggaaagugcauuggacaugccacuguauucgagccugaggcaggaggauuguuugcaaguucaaguccuggaugauuccucuaaaaacaaaacaaaggcugggguggaucucugaguuguagaccaguuuggucuaaaauacaaaaaagccccaaggggguugggagaguguaacuggguuaguacaggucuugccucucgugcacagggcccuggguuuaauccccagcaccauuuaagcuggguaugguggaucaggaguucaaacccaucuuuggcuguauagugagugaacuacaugugaacuuccacaaagggagauaguuuggugaacacuggggacaggugcaggauucgggaaggaucugaugugugguggacggugggcauccucaccuguccaaagugcuggcuaauaggcaggcgcuguugcagacgaucagagcggcuggugaggcuugggguucucagggagcccccccucugcaggccagagucuccauccugugaagggaugcaugugugggcuggggucccaccuccacuccccugaaauaucuguggaugaggaauucaccuugggcggucuuaccuuaaucgugagcagguucugcauacccuucaagccacucuuugccuaggugaugacccgacacaguaucagacacaaguguuuucuaaccccauuccaccuuuguaucuuccaagcuauguuuauaccuuugaugcacaauauuccuggagggagucacccugccauaaaccaaagguuugaccacuguauauaggauuaaaaucaaauggacagaucugaaauguaaaggcuggucugaaagaauauuugagcuccagaccuccuucuccccccacucccaaaucaagaauggaagcuaaguaacaaaagguaauugauggaucuuggcugucag

SEQ ID NO: 8693 - RNA, 2441 nt, Mus musculus
ccgggaaccccgcggcugcccucccucccuucccuccccggaaaaggcgccucgguagccuauaaagcacgggcacuggcgggagacgugcacugaccgaccgugguaauggaccagcacacacuugauguggaggauaccgcggaugccagacauccagcagguacuucgugccccucggaugcggcgcuccucagagauaccgggcuccucgcggacgcugcgcuccucucagauacugugcgccccacaaaugccgcgcuccccacggaugcugccuacccugcgguuaauguucgggaucgcgaggccgcguggccgccugcacugaacuucuguucccgccacccaaagcucuauggccuagucgcuuugguuuugcugcuucugaucgccgccuguguuccuaucuucacccgcaccgagccucggccagcgcucacaaucaccaccucgcccaaccuggguacccgagagaauaaugcagaccaggucaccccuguuucccacauuggcugccccaacacuacacaacaggugaggcucaucucaucccuaggggacucuuucuuaccuucuggaagcaucgcugcaccgacagggagagaacagcacuuccuccccacccccgccccgccccgccccgccccgccucgcucugcuccugcuacuccgcuugaagcacccccucuccaucucgcacucagaggaaaucccuuugcgucuugaccccuugaaugaaccuaugaaaccugggggagaacucccgagggugcaccgcaguucccuucagucccacuuaggccuucagggcucuccuucuccauccaaaguuggacgccccaaugugugcugggccguaugaguuccuaucugcuucuuuaggauguaagguaccaucuaccuuuauuuuucuuucuucccagggcucuccuguguucgccaagcuacuggcuaaaaaccgugagugcccccugauuuauuuccagcgggucccgcagggagguugaacaaggggaccuguucaaccuucuagucaugucccucucccucacuuacucagccuuucucacuugcugucacagcuccaacugucauccuugggaccccauccagguuuucagagaauugagaauucucacccccagcugacucugggagaucuccuuuucucuuuuccuuccucuaucccucccauguagcccaggcuuccuccaaauucauuauguagcugaggcuggccgcccugcugccaacaccuccaaugggcugggauaaaugaaugccuuugggcuucaggcacccuauugagcccgagcccuagucucucccugucaagucuuaguugucaaauuauuugcccucagagaugacucucuuccugcacucuccauaucccaccucucucccaguuuuguucaucccucucuuacuccucugauuucucucucuucuuuucuccucucccccuuccccucuuguggccccuuuacucagcuccuuccaggaguccaugugcaucuccgcucuuaacacucuagacccucgccccuuugccucguucuuauuccacaaccacuuucuuaaauuguaucccuucuggguggccccucccuccuuuucuucuguuuugucuccucucuuuccuccccauucccaugguuuccccccucccccacaccccgcaacccucagcaacucaguguucuuuuucuagaagcaucguugugcaauacaacucugaacuggcacagccaagauggagcugggagcucauaccuaucucaaggucugagguacgaagaagacaaaaaggaguuggugguagacagucccgggcucuacuacguauuuuuggaacugaagcucaguccaacauucacaaacacaggccacaaggugcagggcugggucucucuuguuuugcaagcaaagccucagguagaugacuuugacaacuuggcccugacaguggaacuguucccuugcuccauggagaacaaguuaguggaccguuccuggagucaacuguugcuccugaaggcuggccaccgccucagugugggucugagggcuuaucugcauggagcccaggaugcauacagagacugggagcugucuuaucccaacaccaccagcuuuggacucuuucuugugaaacccgacaacccaugggaaugagaacuauccuucuugugacuccuaguugcuaaguccucaagcugcuauguuuuauggggucugagcaggggucccuuccaugacuuucucuugucuuuaacuggacuugguauuuauucugagcauagcucagacaagacuuuauauaauucacuagauagcauuaguaaacugcugggcagcugcuagauaaaaaaaaauuucuaaaucaaaguuuauauuuauauuaauauauaaaaauaaauguguuuguaaauaag

SEQ ID NO: 8694 - RNA, 13820 nt, Mus musculus
gggguagagggaugguggaggaggguggagaaggacucagagucccagugacgaaaaagguaucacacuacggugggaagcuucgcgccagggucagcaaucuaauuaagaguugcaagcuacaacuaggauccagcagcugggacucuuccagaucugaggacucaguaggaauugaggagccuauguuucaguuugaaguagggaacucagcugcugcaagguuacgccuagggcggagucuucagguaggaccuacagcggcauucagccgaggauuagagaucagcauagugcgaagaauuuuaggcuuuucgguggcccagcaaaguugaaacaagguaagcucauagacgcguacguugacuaagucuccacuucuggccgggagcaggguaucggggaagugaggggugggagaggaagugcguccuugggaauacugggaaauguaguuuaugcaugcuucguugcacggaucugcucccucuauauucuggguaauguagucuuggaccguuaagaguugcugaaggaauuccgcuuuaagggacggauauggguuccuggaucauuggugaaucguccuguuccucaaacuacauccgggacaaucuguuuagcgauuggagaguaugaaagccggggcugaaaaggauaagcacgcccauuugggaggccuucugacaaucaaaagaaucucaguugcuaauugggugacuagaccacgucgugcgacuauuggcugaaaaguggguaggccuuaucaggcgucagaggcuguguucggggggcagucgcagccccagagauggcagugagcgagaggagggggcucagcggcgagagcccaacgcagugccgauggggauacuugucgcugcuggugcugacgcugagcggcugcucaggccguauccaccggcugacucucacagugagccccgcaggcuuggccucguugucuccccccauagcuccgccgguggauggagcagccgcaccccccacugcaggccgcuaguggucucgucccggggucuccccgcccggugcucguaauggguuggccuggcuuagagggcggggcuucaucuccugggaccccugacuccuggcgcuuaaacuuucagggaacacuugguaacaaccauaggaccugggaggaagggguaccaccugguaggaucuuccuggaauucacuuaggggagugacaggagacuacuuucaaaauuuagcccagauagaaucgaaaacuuuucuggaaagucgaaacuagucacaccagccuauguagcccgcucucgggguggugcacgucuauauggggacugucaugggguugccaggguuucaccccauggacacacaaccccacccucuagcugccucggacugaaguaggaaaaugucaccagcaccaauacgauguacccaggaaggcuuucucacaugcuccuguccugaauaaaaauguauagagacgcucagggaaacacgccgucgugcuggacuugguggggagagugcccuugugccacugugucuuugguuuccugcagggggagaagcgagcugacauccaacugaacagcuucggauucuacaccaaugguucccuggaaguagagcugagcuuacugcgacucagccuccaggagacagaaaagaaguugccaaaggugagggggcucaugggaggacucagugugcaaguucugggauucugucuuagcucugucccucaccggugugaucuguggccagucucauagccuuccccaccugucaccuaagaaugaauacagugucucaugcagucuggguuugaggguacagauuugucaucuuagugucccugcuggcuuaggcaggaggaucagaaauuagccagccaguauauauguaacauauaugcauguauauaaugcauuuuaaucauacacgcuucucccccuaacuccuccaaaauccauucccaccuucccaaacuccucccaaucucauguccuuuaaaaaaaaaaaaaaaaaaaaaaaagauauggccucacuauguagccccagauagccaggaacucuguguagaccaggcuggccacagacucagagaucugccaaccucugucucccaagugcugggaucuaaggccggugcucuuguuuguuuguuuguuuguuucuccuggggccacacccucacucacucagcaucuaucagcuagcuguccacagcuccccaguuagguguagggguucaaacaccccucuucccuccaugcuggaauguugacugacucgauccugugugggcaaccacagcugcugugaguucauaagcaacagucugcuguguucagaggacaauguuccccucuugcccuccucagccucugccuuuacagucuugacucuuccucuuccucuuucucuuccuuuuccuccuccuccuccuccuccuccucaguuucauucccugagccuugggugaagaggugugauauaaaugacccauugggaguggccuugugguuuuuuuggcagagagguaauguucaagacagggucuuggaacucaauauguagaccuugagcucacagauccaccgucacagugcugggauuaaaaggcgugcacuccugcgccuggcaagcagccucuccugacagcuucucuuaugacagggucucauauaguuagucucaaagucaagccccuucugccucaaguccagagcccuuggaauugcaagcgugcucuguucugcccagcaccauuaaccuuuuaggugggucaaaccaaucaggaagugcauucugcaugagcguuguggguccaggauggggcaggacauugagaagcuagcacauaguggguguucaguaccugugagaugagccaguagcggugcugcaugcugaggcagcaguaggguugcugcaaguuugaaaguucaacuccaaccuggacaauauggugaguaccuuaccacccagggcgaccuggcuagucccugucuuggagcagagcagaacgaggcuucguuucuucugcugcugaggacaguuugggagcccuucccuucuccucuuuuuccaucaggugggguucagcuugagcagaguucggucuggcaguguccgcuccuacucggugaguggagagcaucgggagggaugagggagaaugggcgugguguugggggccucucuucuccgugguacgcuuacagccaaggaggggcagggagaagcuguggguggauggggaagcacacugaacaaggcuggauccaugggcccgcuguaaccccggcccccucuguccacuccccagagacggaacucccaugaaugcccucuggauagaaacagcagcaacuuccugguccuguuccucaucaauaucaaggaccugcagugaguugggguggggcagcccuagggagaaagcgagucacuugcuacaugguacaucaugggugugggguguguguguguguguguguguguguguguguguacaugcugcuggaaauugaacccacugccuuagaaauuauaggcaaguaccauaccacagccacaccaccauccucucacuaggggacucuaaggggggugggggcaguggaaaccuccaucccugagccacacucccagccccucacaggggggguuucaaguacccccugagaaacccccagcccucuuuguacuuuuuaagacaaggucucaauaaguuuuaccgguuugggccuugaguccacucuguagcccaggcugacauugaaccugcaguccuccugccucagccucccgagaaucuugacucacaggccuucccucuguagaccgggccaugugaucuuuuaaauuggugcugaaauggcccaucccagugaucugauaguugcuauuacaggcagccaugagugugugagcuacugugauaggcaauggccaggugcugagaguuggugaccaguggcucagagcaaugaaccaaccccuuaagaagggcauccguacacauucuauaccugaccucccccuuccugauuccuccccucaccccaggguccaaguccgaaaauauggggagcagaaguuguucaucuccccuggccuucucccugaagcucccacccagucaggucccccgaaaccagacccagcaggcacccccaaggacaaccacgguaaguccagguggccugcagagcugugccaaagaccagcuuuaacacuacuggggaaauuaaaccaaagcaggcagccaggugugacaucaguggccggggucagugcagaugacauuuggcaguuuaaugcucgcuguucuggggccaaaaggugguggcuucuaacaguuuagcuccuguggauagcagcaggggauuuagaaaagaaacuuaacuacuugggcucuaugcguugcucacagaccucuugcugaucaggccagaggcucagagaccguuaacucuucaugagucagagaaaaggggaaagaaaaagucaggcacacacacacacacacacacacgcucucauagauaaaauguuacacgaaaggauaguuacagaaggaggauguugaucuuuaguucaaagcugugcuuuggucugucagcuccuaagcucagagcagcaguuucccauggccuugccuuaucauggugcacgcauguggcuucauccucagaucugaccuagaaugacuguuuuuccuuaauuacaaaucugucucaagccuauuucuccucuuaguguaauuucugaaugaucacuguauuccuuauuaugcagccuuuauucuaugagaggggguacauucuguuguuaacucuucuaacuuuauuauaucuuucuaguaaaacaacuaaaaccaucuccuucaacguucuuccuaaaauuauuugaaucaaaucaggaauucuauaaagucauuauuugucuaaacagcacuaauucaugaaaguugaucuucaaguugaucuacaggaaauuuauccaauaggguggauaucacccagaaguaaucucacaccaggcuauaggcagugagggucuccugguguccacucacaccaagucaagugugugacgaguguggcauugacaaacaugaggaaacauaccaguugcaagaagcaauccugggacgaagucucuggggcugugucucaccagagcccucccgucuuagccacgcaagacagugggccaucuccagggagcucacuuguacaccguagcucuuccugcccuggacguaccccgaauuuucugcccauuugucuuuugacagucauucacccaucuccuacagagaugucugcagucaaggagaaucagacagcgccccagguuucaggggauaaaacuaccccaggggaacacaggcacucauccgagagacagccacccacgcaggaccccagugggaaggagaaggaucagguguugggacugggccaccucaaugacuccuacaacuucagugugaguaucugcccugcccucacguccccaccucccccgaaccgggcgggccccggcuaaggaacccuccagacugacauccccuucuccccaugcgaccaguuccacauugugaucagcuccagggcugaggaaggccaguacagccucaacuuccacaacugucacaacuccaucccaggccaggagcagccauucgaccucacugugagugucgggauaaguguagcacacagcugcgcagcucugucugcauucugugguuuucuuuguuuucuaaucacacuuuacuuauuggagcaggggggggggcggggagggagccaucacaguacauguguggagguuuacuuauuggggcgggggggggggguggggggagccaucacaguacauguguggaggucagaggacagcgcucaggagucaguugucucuucuuccaugugggucccagggaucgaacucaggucaucauguuuggcagcaagcuucuuuacccauugagccaucuugccauccacaggauggacuucuuaaaaguccuucauugggcuuuugugggacgugcaagauaggguauccaccccuccucugauugaaagcauuuaagggaagacaaaaauuguaccuguuccagauguauucagaagcguguguguguucauauguacaggugugcuuguaucauguacauauagaaauuaguucaccaagugguauuccccaggaugcugucuaucuccguacuguuguuguuugguuuaguuugguuugguuugaggcagggccucacuuuguagcccaggcuggcccagagcucacuaccagguuggcauugcacucaaagagcuccaccugccucugccucugagugcugggauuaaaggagugugacacugcacccaguucaccuugcuuuuugcaacggggucucugacuggcucaaagcucacagauugugucaagcuagcuagcaaggggaggucucaggcagauggcaccaucccugguggguucuggggaucugaacucugcgccucaagcucgcaaggcaagcaccuuacaugagcugccuccacagccucauguaugcgcagaugucacgagcauccuaaagacuuguuuuacauugauuuugaaugugagugcuugugcagugcguguggaggucagugggcaaggugcaggagucgguucucuccugccuuaaagacaugugucucaaggugcugccugaagcugucauuggccuaaacacacacacacacacacacacacacacacacaggucacacaguaugcccugaaugguccagucacaacauggguacaugguauuagacuacugugggucacuuuuuuccuggugucuccuuuuugggggggaggggguauauuuuguuuuuauuaaacuaauaaaauuuauuuuaaaauauacaacucaguauugacauuuuuuaagucaucaaaauaauuuauaauaguuaaacaccucuuaaauguacaugauaucuucugaaccuaaaaguaauauccacucaaccaguuuuuaaaaucuguuuggaacgugaaacauguuagaaguagaaaaaaaaucucuuaugaaguccucuaugagaggaaauucugacaaguuucugauuagacagaaaccauuccaucuccagggagaauaugcagcauaacuguggcuucauagaaugaauuggguaguguuccuucuguuucuauuuuguggaauaguuugaagaguauugguuuuacgucuucuuuggaggucugauagaacucugcacuaaacccaucugguccugggcuuuuuuugguuaggagacuuuuaaugacugcuucuauuucuuuagggguuaugggacuauuuagaugguuuaucugauccugacuuaacuuuggauuuuguaucucucuagaaaauuguccguuucauccagaauuuucaguuauguuguguauaggcuuuuguaguagaaucugaugauuuuuuuuuaauuuccucaguuucuguuguuauaucuccccuuucauuucugauuuuguuaauuaggauacugucccugugcccucuagugagucuggcuaaggguuuaucuaucuuguugauuuucuuuaaaaacuagcuccuaguuugguugacucuuuguauaguucuuuuuguuucuacuugguugauuucagcccugaguuugauuauauccugcuaucuacuacucuuuugggugaauuugcuuccuuuuaggugugcugucaagcugcuaguguaugcucucucuaguuucuuuuuggaggcacucagagcuaugaguuuuccucuuagcacugcuuucauugugucccauaaguuuggguauguuguaccuucauuuucauuaaauucuaaaaagucucuaauuucuuucucgauuucuuccuugaccaaguuaucguugaguagaguguuguucagcuuccauguauaugugggcuuucuguuguuucuguugccguugaagaccagccuugaucuguagugaucuuauaagaggcaugggauuacuucaaucuucuuauauauguugaggucugauuugugaccaauuauauggucaauuuuggaaaagaggugcugagaagaagguauaaucuuuugauuuaggauaaaauguuuuauagauaucuuuuaaauccauuagguccauaacuucuguuaguuucacugugucucuguuuaguuuguguuuccaugaucuguccauugaugagaaugguguugaaguuucccacuacuauugugugaggugcaaugugugcuuugagcuuuaguaaaguuucauuuaugaauguggguguccuugcauuuggagcauagauauucagaauugauaguucaucuugguagauuuuuccuuugaugaguaugaagugucuuuccuuguucuuuuuaguagcuuuugguugaaaguugauuuuauucaauauuagaauggcuacuccagcuuguuucuugggaccguuugcuugaaaaauuguaguaguguuugucuuugacacugaggugcauuuccuguauguggcaaaaugcuggguccugucuauguauccagucuguuagucuaugucuuuuuauuggggaauugaguucauugauguuaagaaauauuaaggaauagugauuguugcuuccuguuuauuuuuuauguuauuuuuauguucuguggcuaucuucuauuggguuuuguugaaagaagauuacuuucuugcuuuuucuaggguguaguuucccuccuuguguuggcauuuucaucuauuauccuuuguagggcuggacuuguggaaagauauuguguaaauuuauuuuugucauggaauaucuugguuucgucaucuaugguaauugagagguuugcuggguauaguagccugcacuagcacuuguauucucuuagggucuguaugauaucugcccaguaucuucuggcuuucauagucucugacaagaauucugguguaauucugauaggucagccuuuauauguugcuugaccuuuuucucuuacuguauucuuucauuguuuagugcauuugguguuuugauuauuaugugacaggaggaauuucuuuucuggucuagucuauuuggaguucuguagacuucuuguauguuuguucaugggcaucucuuucuuuagauuagguaaguuuucuucuauaauuuuguuaaagacauuugauggcccuuuaacuucggaaucuucacuuucuguuauaccuauuauccuuagguuuggacuuuucauuguguucuggauuuccuggauguuugggguuaggagcuuuuugcauuuugcauuuucuuugacuguugugucaguguuugcuaugguaucuucugcaccugagauucucucuucucucucuuguauucuguuggugaugcuugcaucuaugacucuugaucucuuuucuagguuuucuaaauccaggguucucucucuuuguaauuucuuuauugguuauguuuccauuuuuagauccuagaugguuuuguucaauuccuucaccaguuugguuguguuuuccuguaauucuuugagggacuuuucuguuuccucuuuaagguuuucuggcugcuugccuguguucuccuuuauuucuuuaagggaguuauuuaugucauucuuaauguccucuaucaucaucaagacaugugauuuuaaaucagagucuuacuuuucugguguugugggguaaccagguuuugcuguggugggagaacugggaugaucugaugaucucugguguuaacugguuuuccugucucugacuguggcuugucccucaugcaagccugugugucaguacuccugggagaccuguucccuccaggaggaauuuagauauggagagcuguggcacagggucaucucucagugcagacccuccugaugucuccuaaucaacuucauguaauaccucuguaucccuggcaugcuuguucagcuguucagagccuucuggagaugugggagacccuauaccacaaauacccacuuccuuuuuacagacacugggucauccuuggguguugguucuucuggaguuccagugccagucaucuggcuucugguuuaaggcuguauacccauuugagagacaggaccaacugagguucuagcuagaaaguuggagaucuagagacuagaacuuuaugaaacccaaagcuagagcuacaggggcaaggccaucuaccugaauugucacccccucccuucucuuccaggugaugauccgggagaagaauccagaaggcuucuugucagcagccgaaaucccccucuucaaacucuaccugaucaugucugccugcuuucuggccgcagacaucuucuggguguccgugcucugcaagaacacguaaagccccucucuaccccacccucgccuucccucuccucugugggccucacaugaggguucaccucagcgaacacucucuaccccauucucccucuggcagauacagugucuucaagauccacuggcucauggcagcccuggcguucaccaagagugucucccuacucuuccacagcgugagcacacagggcccggugacaacacaagggugggauggugagaugggacaucugucugccugugcaccuuguccauuucaucucucuuccgcucagcccagcucucaccaccaacccuccaggaacauccauuggcccagucagugcugacuguccacccuauugucugaccauccccccaccuaacuugucucuuggguggagggagcccguggugacugacuguaaccuucaucucaccccacccccaaucaccugcuuguuccauaauuauucucuguguuccuaacugccccccuccccuguacccauccuccucucugacugcucaugcaucugcucaccuccagaucaacuacuacuucaucaacagccagggccaccccaucgaaggccucgcggucaugcacuauaucacacaccugugagucgcccagcugugcgcacaggugggggaggcaggcagggagggcuggguccccaccucauuaucagacacacacccccacccccuggucucccaggcugaagggcgcccuucucuucaucaccaucgccuugaucggcucaggcugggccuuugugaaguauaugcugucggacaaggagaagaagauuuuuggcauugugauuccccugcagguauugugggggaggggggcugggggggggucccaagaaaggugcagggagagaggcucaggagacgauggagacauguaaggagaaauucagagaggaaugcuggggauugauacaggcuggguugcuccggugacauacaggaagggaauuccgucugugguguuggggacaacaccaccuggcacccugccauccccacagguccuggcuaauguagcauacauuguuauugagucccgugaggagggugccagcgacuauggacucuggaaggagaucuuguuccugguggaucucaucugcuguggugccauccuuuucccgguggucuggugaggaccuggaccugccugccugccugccuuccagccccaccgaggccccugcccuacccaacagaagacuccuguacacuggacggggucaauacugagcacuucccauaucccuccaccuguccagguccauucggcaucugcaggaugcauccggcacugaugggaagggugagacccccuccuggacuuugucccagcccugcuuucucucugacaccaggugcugggggccacugucuccacggcugugcgucuuacuccucugucuguacccagucguccagucacccgcacacacuucucaauuacuuuugcuacuguucauccuauugccccgggaccacuccccacaccuugcccccuucuccacugcccuccccuccugccaguuuucguuauccuccccccaccccccuuacccuacucugugcccacccacaguggcagugaaccuggccaggcugaagcuguuccgacauuacuacgucaugguaggaguccugccuucccacaggccugagucccucccugcugcccugugccccugagccccagccuugaccugaccucuguccuguguccauaccucccuguccccugccccccgccaaccccgugcccccaggucaucugcuauaucuacuuuacacguaucaucgccauucugcugcaaguagcagugcccuuccaguggcaguggcuguaccaggugagcaagguggaguccccaggaggggaguccccaggagggugugggucauucacuggaagugugggugaccagaaagccccaccucaccccaugccccgcccccagcucuugguggagaguuccacacuggccuucuucgugcucacuggcuacaaguuccagccggcuggggacaacccauaccugcagcugccacaggaggaugaggaggacguacagauggagcaagugugagcaaagcugugggguguggcaggaccaaggugucuccggagcuggcccagagcacugggccauaggacaggauugugggagguggggccaaaaggggcuuaaagguaagguauggguggcucuaaugcuggucucagugcugcuuaaagaugccuaggagcuggcucugaggugggcuguggagggugagggguaggaucuagguaaucuacagggauguagauuggugggcagcuuggaggauggacaggucuggaauuacuauagaggugggauuagaauauugguaggggauggugggcuguggcacccaugucugcggagccucagaggcaagcugggucaggacuggauaguucuggaguggcgggagcuaggcggguuugacagcagggauagaagacccauguacuaaccacugggcuaggucggggggggggggcgggggaggggaaggaugggaugagagcagguggggcuaaagcggcuccuggacagggucugcucccagucagcugcuagacuuugcuucugcuauguacccuuucccaggaugacagacucuggguuucgggaaggccuguccaaaguuaacaagacagccaguggccgggagcuguugugacuucccuguguccagugagccgcccucagaccuccugcaccucgcaccccuacacuugucccaagugugcagggagcuggaggggaugcugcggacaaggcauccaggauguggauccccaaggagccuucagaaaagaugcccucuccucaccagggagcaagcaguucagccucuugugguacaauaaggaccagucucuugacuuggaggguucugaguaucuacggcaggcugcauuuaugaucucaguucacgggguggcacgugccugucaucccauugcucuggagagcccgggcuucauaaaaccuugauuaguaaacaaauaaagaaaaaguggaauucccagugaggggaggaccaccuguugagcuaaagcugugcggagcccugugcugcuggggacagcacgaccaaguccccacucccaucccaacccuuaaggaucuuucaagucaccagccccagcuugggggucacacaggaacugacccagccacagacgucuggaagggaaaaggaaaggugaugccgaacccguguccccugaagagggcaccaccgggcuguaggaauggugggugaagugcuugccaugucuugccaggacuggagcacagauccuaaagccuccauaaagaucuguguaagccucgaaaaaca

SEQ ID NO: 8695 - RNA, 14264 nt, Mus musculus
cuugccagagcgcaccgagguucaccuccauuuauuccacacggggcucauaagaaagcuuuuaucucauuuuaacuugggcaggauacaugcagguaugagugcgacugccagagucggccagagggggccuaggcuuggaugucugugagcuuugggagcugcuuuugaaaaccaacuccugguccucugcaagagcauccaaaacccgacucccaaaccaccucuccacagagaugccuuuugaagguccauucccgacacuggcggugcagacuccaagaacuuuauauaauuauauauacuuuuuuaauauaaaacaaaacuuggcucaagccaagcggcgggaagaaagaucuuaaaugacaaauauguacaaccacgugggaagccacaaguggguccccguagggugacaggugacaggugagugagggacagcagguuacacaggucucagccaaaagccacgugggcaggaauaaagugcaagguccugggggcccccccuguggcccagaagcagcagcugacagcccugccccucgucccccucuggugggguucaguugagugugacucggagguaagaggugggcacguagcccucagcucccuguuuccuccugacccgcguccauccaucacccuugucuuccuccaucaggcugaggucuucccccucggacauggagacgguucccucgcuggauccuguuggggaguagcgggggcaggucagauuugaugaaucugaucagaaggcauggcuccaagcaacugcuacauccccugguguaaggggaaccugggaucuucuaaucucagagacaaacuucugggauguccgagagggagcuucuagauugucugaauuaagaugggaagccccaccaugaauaugggcaacaccaucccacugguugggguccuguacuauacaaaggaaaauugagagucugaggcagcucuguggguaaagaugccagcugucauguuugauaccgaggacauagacaguaggagggaacccaccucucucacacacaacacaaaaaugguuucaaauaagaaaauaaacccuuccuuaaggugacuccucaggucuuuccuuuggcuaauacuggagacugaauggacagccucaaggacaccgcucaagcacucuaccaccgagcuacaggcuucagacuaaguuccuuugucaaaacagaaacauuuaacuugugcuaaaggcccaccuucaaaaugguagauagccacacacuggccgauaggggaugcaggcuccucaaaguccucaucgaacucaguauagauggggguguccuggccuucugaagggggcucuucugagcugcuugagaaauggaaaaaaagacaggagcaugacccccagggucucugaaucacuucccuggcccucacugggggacucuaggcagagcuccaccucuauccacaccccagcuccucacugggggauucuagguuaguacuccaccccugaccacacugggggauucuagacagagauccaccccugaccaucccccaggcccucacugugagauucuaggcagagcucuaccccuagccagcccccaggcccucacugugggauucuaggcagagcucuaccccuagccagcccccaggcccucacugagggauucgagguuggggcuccaccccccuugccacacccaaaacucucacugggggauucuaggcaaagcuccaccccugaccacucugagggauucuagacagagcuccaccccugaccagccccccaggcccucacugggggauucuaaacuggagcuccacccuggccacauccacaggcccucacugggagauucuaggccagugcuauaccaggccaacaccucauaacuucuucugguuucccgaccuaccucuccuuauuguccugggauccacuguuggugcugcuacugcugcuaucagguggggcaguaguugggggaucagggggccuagcgugacggcuuaggcuguccccucgguuacugaggacccggcuuucagcuucugccaaccaagccuaggguugguuggagaucacagcaugaguuccaaagcaagguuuugaggucaucccacucuggccuggggucaccucaugacaucacccacgcacacccaaaccuuagauaguaggcagcuggauccuauccccccaagcaccucccugucccccaccccacagugacucaugcagcucugccugccaccaggccuccccaggccaugccucugaccucauacuucugcacuuccaacuucagccucucaauguugcccagggucucugcaaugcggggcucuaagcuggcagggucccccauuugugguguuuucucauauacaucuuucaucuucuucagggccucccugcgacaggacagagacagacagacagacagacaggaaagaaggaaaacacacacucuuaugacuuaccaaguaaaaauccaggcucaaggagaggcaagacucuggggauagagacaaaugucucugugucccugcgcugagcuggaggauagcagguuuaaggucagccucugcuacaacacugaguucaaggccaacccaggcaacuuagugagacucugucucaaaaagaucaaaacaagacuauaguugaccucaguggguaacccaagcacauaagcgagaagaccugaguucaaucccuagugcccaggucaaaagccaggcauggugucauacacuuguaaucccagcaucaaggaggcagagacagaaagacuaaaccagccacucuaguuacaucugagcagcaugucaguuaaagacccugucucaacaaaacaaggccgacaggggagauggcuuuguggguaagagcacuugaugcaucagucuaaggacaugaguuugaauccccagcacccauguaaaaaaucagugcagcucacaugggugccuauaacucaagugcugugcaggacagagcuaggaagaggcaacgacuaagagaccugcuggccaugagagcagcugcugguucagugagagaccuuaucucaagggaaugugcuagagagauggaacagccaucagugagacccucugaccuccaugugcacagcuagcuacacgugcucauacacauacaggcugcauacacacccacagaggaaacucccagcaccugaggagccgcucucaaggucggccuguggccaccgcaagcaugacugaccacacacgugaaauaaacaaacaagccaggcacggguggaagacuaaaguuccaaggcaaccuggaaaaguuagcaagaccccguucucgaaauaaaauaugaaaguaaggggccagcaagaugguucggcagaugaaagcaccugcaaccaagccuaaugaccugaguuccaucccugggccacauguaguagaaagagagaacccaccgacuccagcgagcuguccuccgacuucugcauaggagccauaucauggguaagcccauccacaaaauaagagaaugaauaaaaacacgauaaaagauaaaauaaaucaacugaaaagccagcuguuuuuuuacucucggcaggcagaugcuucacgccacuauaaacacccaggcugcaugcaguuccaagcacggcuucugucccaugacuuccauucuguggagaaggccacaugugagcagccaaacagaauuuggccagccaccugcuaacaaguggcaagcgucacugcuguuauauaaggaggcugggcagaggauuuuguugcuuggaaagaaugacuaaagaguuccuuguccuuuucaaucuggcagauuuuucacguuaauauuuuggguuucggcauuagauaacucggcucuccuuuuccuccuaucaagacggugacucagacugacugagcuccugauggugauuagacagugagcugucuuggcauuaaugggggaaggcucucuggaaugggcauuuuguuuuauuuugcagucuacuaaaaacuuugaaacugagucuaggugccaguuuugucauuccagcuacuugggaaacugaggcaggagaauucaaaguuccagaccagccucggcaauuuacccagaucuagucucuaaauaagaauuauaaaaacaaauaaagcugggcggugguggugcacaccuuuaaucccagcaccuaggaggcagaggcugguggaucuaugaaguuuaaaaggccagucugguguauggagcaaguucuaggacagacagcgcuacacacaguaacccugucuuggggugggcauagggaguuuaaaaaaaaagagagagagagggcuggggggcauggucagggguugaaucguugucaagagucccccagugagaggcugagggcgugguuaggaacguaucacaccccccccccuuucauguccccuaccccuagaauccccuagugcuguuaagggcagcuccuagacuacagagaacaauccugucuuagaaacuauauucaacaguuuguuguggcaaaguauauauuaccauaagcuggcuauucuuuaauuuaccuauuugcuuauucauuucuuaucauacaugccacggcaccuguuugaaauggguucucuccuuccaccaucugaguucaaacuaaggacuucaggcuuacgugacaaguaccuguagccacugagucagaucacuguggggaccaguaauuuucuugucuuuugcucagugaugcguggaaagagaccgcacaaagggcucaccagauuccauccgcuggagugauuuacaggaaauggaaaauaaaggacucuuuccagcuuuuaugcuuuuguucuucacugcuauuguuucgagacagugucucaagaagcccagacuggcuucgaacuuaggauucuccugccucuggcucuggaaugcagagaauuacagacacaggcuaccacaccuagcuauauggcaggaaucuccuuuaaaaaccaucagacguggccgaggagauggcuucagccaauaguguucacugcacaggcacaaggcaggacucugauucccagcuccauuguacaaagccuggcaugagacuucauauuuguaaucccagcauugggugaguggucaaucauuggccaaucagccuaggcuacucagcaagcccaggucccagugagagacccugacucaaagaaaaaaaaaaugucaagugaagccaguguggugguguagguccuuaaugccaucacuugacaucucugugcuuucaagaccagccuggucuauauagugauguccaggccagccagggccacuuggugagaccuagucgaggccccgaggccuuacacuauuacugaugcuauggugugcucacaaacaggagccuagcaugacugcccuccgaaagacccaacaagcagcuuaaagagucagaugcagauauuuauacccaaccaauggacagaaguuggugaccccugugguugaauuagggaaaagcuggaaaaagcugaggaggagggcaacccuauaggaagaccagcggucucaacagaccuggacucccgagauugcucugacacuaagccaccaaccaggcggcauacaccagcugauaugaggcccccaacacauauucagcagaggacugccaggucuugacucagugagagaagaugcaccuaaccuaaagagacuugaggacccagggguuggggaggucugguaggguggggguagggagguggggauauucucuuggagauguggaacagagggugaaccaggacggggauaaaaacuggaccauaaaaacagauuaaagaauauaauaauaauaauaauaauaauaauaauaauaauaauaauaaauacuuaacuuuuuaagaaaagcaaaaacgaacaaacaaaauggacaagguauggggcugaagagacugcucagugguuaaaagcauuuacugagcaaccuugaggaccagaguuccgauuccugcauccauguagaaaguuggguauacagccacacaccaccugcaaccuugauaggcagaaacuggauauccagagcuugcuggcugccagccuagccgaaaagacccaaagacccugccucacagaaaaagaaugaagaaagaggaugcugaccuccacgcaagaccuucagagcccagauuguguuggcaaaagagacuugugcaccauugaaacacaguagcagcagggauguggcccucuggaagcccgcaagugcucuucugaggaggcuauuauaccccaguccuugagcagccuugcuuaguucuguauuuaacucuggucuccuucagccuuacacgcucaccucugguccuccuccuucugcaacucucgguuccgcucuuccagcuguugcugaagucgcuuucucugcugcuccgggggcaagugacugaaaucuucgguagccacggucugcaaggugagacagggucugaguucaggauuugcgacccuauguuucccaagcacuucucucgcuccugagauaccagguccaccuuccuccccuagcagggauuuuagggagugaggccaugcacagagcaaagcuggaaucugggggggacccagcaggcggcaggaaagagcccagggucccaccauccggccuuaacuuaccccacggccaccucggaagcugcggaaggaugcuagccgcgguuugaccgacuuacugaucucgcucaguauggccaaggggucgcggccagaacggggggaugaggguccaucagacaguguggaggguaggugaccccccaggagggacagggaugggggacguggcuaaccgugggagcccaggaaggggggucagguauggaggcgcgaggauguagucggagaaggauggacggacaggacacaggaaacaggaaaaacaaaauggagaaagagggaaaaauaaugauaagaaaaccacaacugaaugauaagaucacacagaaaacaccuauaaaagcaacaacggaagguuugggcggugccagagaaggcaagagaaggggagccagggccagcaagagggcucagcagggaaaggggguugugccaagcucugaguuccaccucuagcacccaaggauagaaagagaaaacugauacccauaagcuaucaucugaccucuauacaccccaaaauauaaaaaguuaauaaauuaaagacugugaggcaggugccagucacuccccaagccuucuuugucccuugagucuuagggacucauacaggaccccaggaggugagacaccugccaggcuuucugcgauuacagucuagaagguaggggugcaugacagaacuaaaggcuggggacaaagcgauggcucaguacaaaaaacugcuugccaccaccaaguacaaugaccuaaguuugaucccugggaccagaagaaaacuguguccugaaaguccuuccguggcaucuacaugugcuugagcaaucacacauacacauaauaaacaaauaaauaaaagcaauaaucuuuuuuuaaagaaccaggguggucagacacauaggcuaagggggacaggcagguagaugagaggugggagauaucaggugcuugccuacuccagaaguccaaguucaagagaggagggauggcaggugggaggagggauggcaggugucagguaagagaagucuaaguuaaaugggauggaaaagaagaagagggaaaacaaaaagaaaaaaaaaaaaacaacugcaagguauagcuaaaagaaagaguaacugugggagggauaaaccaaggggugucaagguauacacuggacccuaaaagucaaauucccaaggagaaaaugcacaggaaguggaggguccccaaaaucauagaggcuggagauagggaaggacgacucccagggauuggguggcaaugccacagcugucaggccaacaugagcucuucaagggucuuaggauucagcagaagaugccacaggcccccaacccuguccccucucaugcucaaagggacucggaagccagcgaguaggcucucgggccugccuuccucuguuuccuucccuccagccugggcccacagccaagaggaaaauuccugccccaggacuuuguguuccauguggcuggagcugacucaaugaggaccucggcugacuauccccccuuuccacccacuccucaccccaagagcuccggaccccaccuuguucuuuuucccgaaaggccaacgcuuggcgcggcuacggcuggaggcugcucggagcucaggccugccauccggggugcccaggcugcuguccgaaggcacucgguugauaacuuggcuaaagucuucaaauuccaaguccccugggcgggcaaacccggacuuguguaauucgaugaggaccugugaguccuuugggaagggacacggagugaauggcaaccaguggcuaguuuaagaaacucuuuggggagccacccucccucauccaucccccccgggcgcaugcugaguacccacguucuuagcauccacagacucggcggccaccuucaugcccuccaagcauuugccaauaaugggaaccaccugcaguucagccucugauaagagcccauacccggcccccaggcggguggcccggcguucguccauguccugcagcuucuggagagcagaggagaguaaaggguaaguaagccaacccugcaaacaccgccaaacugaagccuucagcccucgagccccaggcuugauagggaagucagaaucagaucugcccucaugagcccaggggcaggggugacgaugcauggccaggaguguuuggugagcggaccgaggagcucagaagagucuucucaaaggagguuacaaagagacagagccuggauaaagaauacauggaauauagacaauccuaacaccaggguugggacagagagugggaaagaaggcuagggaaaguugagaccugaagcuuguuagagcuagggcuuagaaggaugaauaggaguuucaaaaaucgaagagugucuuccuuucuuucuuccuucuaucucuccucuccuuucccacuccuuccuuccuuuccacccuuuugagacagggucucucuauuaagccuuggcuccccuggaacuugcuugcuauguaaaccaagcuggcuuggaaacacacuggcaggcuccacucucucaaucuaggcacauaaggacauaggagcugggauucuaacacccaagugggagcuaacgaauauucagggacuuugucaacaagcuuaacgcacucacaucgaauaucuggggcaucugugagaaguagaagugagccuggucucgguugaagcgcugcagcugggccgcauauucauucuugcucucuucugccaugugguuccgaaggugagcuugcugcuuggccugggcagugggauggcaggguggaggucguggucaggugcuggccucaccacacucaagauggcagaggccugucacggacuucacccgauacacaccuucuccacauccgccuugguggcauuaauguccugaucuaggcgcucagcagugugagccgcuuucucagccucccggcaaucucguucaaacuuccgcuuacucuacgagggagacaaaaguggagugaaggaccugccuuccccaguagcagaaugggcugugcaucggcccagucaaaccaacaccaggagacaggaagauuaggacuucaaggccaaccuggaacaccacaugagacuuugucucaaaaaacaaaacagaaccaaaaggauggcucggcagguaaagauacuuguuaccugaguuuaaucccuagaaacuccucagagguggaaggaggaaacugacuccagaaaugucuucuagucacacaugcaccucaugaugugcaaaucccccccccccaacacacacacacagauagaguucaacggggcuacuccaggccccaccucaaaauaaaagguguaggcucaguaggugugcugaguaccccacaaggagaagggcccugggcacagaacguugaguggcucugugaauaagcagucacacaucuucugggccugagcuaccagcugcccccauacacacucacauucuccagcuguuugaagccauucuccagcugcugcugggcccgacgaccuuccuggaagugcugugcaaacaaaugggagagccucagugagguuccaccaggguccucagugaggagcagggguugcaugggggaggggguccucaccaucuuccucuccugcuucaucuccugugaauacuuagccagcuccagacacacucggauaccgaggcucucagccaccagcucucucuggccugcgaagucauugaccuccuggagaagcuggacaaaugacugcugcuggcugaaccuggcagcaggagacaaacagaguucaggaccagagauggaccuggccuggcacagugacauaggccugucaucccagggcaggguggggcagagguauggagaguuuaaggccagccuugucuacauagugaguuugaggucugccuuugcuacuugagacccuggaaagagagaaagugaggguggggaggcagaagggagggaaggagagaaaggcagaaggaaggaaaagagacaaaaggaaggagaaagcaaaaggaagaaguagaacgaagucuugagcuacaucuguucaaaagucugugucccuaacuuccagccccuuaauucagaagaauuuugcaaacugaauuuuuggaggaacaaugcuuauaacaucuguacuguuguuguuugaggcagggucucacuauguagcucuguccagccuguaaacucucugucugucucugccucucaggugauggaauuaaaguugugagcccaccaugcucagccuuugcaacaucgucuauuagucauucccuggcugguggcagaauacuagaaucaaguguuuguuucgguuuugaagcaggguccaguuacauagccuaggcuagcugagaccccuugcucuuccugccucagcuuccuggcugcacagauuacagaccuaagccacuaugccuagcucccuuaucaaacuuuagagguaugaauacgauaauccuucaguagccauggccaccauuucuaggguacuuagaggguaccaaaauaaaggaugcucaaggccuucuauacaccagcaggauuugcacagagucugugcugcuggcccagacccucucuagaugacucaggacuccucuacgauguaaacacuaugcacuuaauccaaauugucuggauuagggaacagugaccagaaagucugucuauguuccagaaagaaaugacuuuguuggagugucuucaguccuugggcuggggcuagaggugcuaaguggguagagugccuagaucuaucccagcacccuggaggcugaggcagggagaucaggaguuuguggucacccugggcuacagagugaguuugaggccagcuugggcuacaugagaccacacgcacucacacacucucucucucucucucucucucucucucucucucucucucucucacacacacacacacacacacacacacacacacacacaguuuuuuccaauccucggaaacccugaaacagcauucacaucaagccaccaaugaaacuagauauaccaaauaaacaacuaccuuaauuucuggagcuuuuuggaguaaaacuuuuauuuguguauuuguucaaaauacagucucacuaaguggcccaacgugguccagaacucacaaucuuccaaucaagagugcugggacaguagacauuugccaccauacccagcucaccuuuuagauuuuaaagggaaggguuuagaaugaagguuaaaguuucuggaaguaacuacaggcuggcuaccaguuuguuuguuuguuuguuuagaauuuugagacaggguggcauguagccuagacuacccucaaacuaacuacauagcugaggcuagccuugaaccaacccaagggggcuaggaugacaggcaugcaccaacgcgcccagcuuuguccacugcuuuuagacacaaaaagucaguucuucgaacacacaagauagaguaguaaguucugccaucagacccauuucacagaugagaacagaggcaaucaaagucacugauacauuaaagcucuuggguuaagagaccaguccuggcuaaagggaguaacaggacaaccaaaaccuuaucucaaagauaaaaacucggguuggugacgugguauaagggguaaaggugccuguggcuaaacaccagagucugaucccugggauccacauggugagaggcaagaacugacuccuucaaacuguccucugacuuccagaggacuugcguucuguggauaagugggugcaucucgcucuccaaaauauauaaagaauaagaagcccccaaauaacucagcuacagcacagugaggggaaaauagaagcugagaauuuacaaaccaaaaagggcucccugcuggaagcgaguaaauuccaccuuaggacauccagacuaacaggaggugggacuggaagugugagguagaguggccucuaagaaggugagagaccugcgccuccagccccucccucgccccucccccucccauucuuacuugacuucagggucaucuuugguaggucucuugggaagauacuuuuucaccaggcuccuaaagguugggacagaggcagggaggcuaagaacgcggaccuccugcggucuccccuuggagucccagagcagcgagcacccacccucaugcucaccggaguugcuuagcauaagccugcuccaccuccgcgcguucuuucacgaacuucacguauuuguccaacaaauccagcccccacugcguguggcguuccagcaccucaaacugauccugauugcaggagcgcgauuggggaacguuagggucaccuggguaggaggcaccgaaaucccagcgacccggaacagcggagguggggugggguggacaaucucucggggcuuagcgguuccagcaagggcuggcuggcuuccccaggcgccgccccggcguggcgcaggggaggcaggaagcuggcgggaacccccauguccuccuccagggaagggccuggacaacacggccagggccccaaaccagacagcagggucucucggaaucgggguggccagcaaggguguggaaggaggcuaaaccacgccaguucccucaccccuccucuaauccccuccaaauuccaaaaaaucaagagggcuuggcacaaaaaucaggcacagaagggaugaguucgugcagcucaaagugcguggaagcagggucggggggccucuauggccaaauuuccccacucgccaagaucccccgggauccucaguugagugacucaguuuccccugcuucugugaugccuccacuauaguggcucacccccacuacauccuaagauugcaccgccuccagaaagaggaggggucaauaguccgacaaggauucagggaaacuucuagggcuuccugggugagguuaagaggcggguaagggguggcuccgcccagcgcccggggccgaguccuauagccccuuccccucccccucagcguuccaauuguaagcggggaaggaacccgguaaggccccacgugggacagaaggugaccaaaggguccccucccccucccagccggacaggcgggcgacgggcagggacccaggggccguaagauuagccuccaagccaggccagggcgcucaaaauaggugaccucacccagcuguccccccucccuggccugguccagggacuucuucagauggucuuccucucaacucugugccucaguuucccuaugcggguccugggcaaaguaucccuacguccucggggcgucuugaaagucccaaaggaacuuuugagugagugcggagggcagagggcggggacccaagggaucagcugcaagggaaagcguggaguccgggcuaagguacuucggggacaaagagcggagaagccaggaccccagcaagggagaaccgugggaacuggggaaaaagacucacccacaacucgguaccccaauccaugcugcucuugccgcccaggacgccaccgccuccugcccgggucuccgccgcccuccaccggagacucagccccagggcagugugcccaaccucgcccc

SEQ ID NO: 8696 - RNA, 883 nt, Mus musculus
gugcacuuucuccagcagccgagcaagaugcccaaagggaagaaggccaaggggaagaagguggcccuggcccccgccgucgucaagaagcaggaggccaagaagguggucaacccucuguucgagaagaggcccaagaacuucggcauuggacaggacauccagcccaaaagagauuuaacgcgcuucgucaaauggccccgcuacaucaggcugcagcggcaaagagcuauccucuacaaguggcucaaagucccuccugccauuaaccaguucacccaggcccuggacaggcagacagcuacucagcugcuuaagcuugcccacaaguacaggccagagacaaagcaagagaagaagcaaaggcugcuggcccgugcugagaagaaagcugcuggcaaaggcgacgucccaacuaagaggccaccuguccuccgagcaggagucaauacagucaccaccuugguggagaacaagaaggcucagcugguggugauuacccaugauguagaccccauugagcuggugguuuuccuaccugcccugugucgaaagaugcccuacugcaucaucaagggaaaggccaggcuggggcaccugguccacaggaagacaugcaccaccguugccuucacacagguuaacucggaagacaagggugcucuggcuaagcugguggaagcuauuaggaccaauuauaaugacagauaugacgagauccgucgccacuggggaggcaacguccuggguccuaagucuguggcucgaauugccaagcuggaaaaagcaaaggcuaaggaacucgccacuaaauuggguuaaauguacacuaaauuuucuguaccuaaauauaauuacaaaauuaaaaaaaaaagagagaagu

SEQ ID NO: 8697 - RNA, 75 nt, Mus musculus
uggaacuguggggcaagcuuagaggguacagucuugcuggugacaggcuuugggguggauagcuuggccugcuua

SEQ ID NO: 8698 - RNA, 51772 nt, Mus musculus
uaaagaaaggaagccuaagguucuugauaaagguaugcuugguaaagcaaugccaaagucaugguuuucccaaccauuuaauacaagcacaaaguuuuauuuuauuuauuucacccauauugauacauauaacauuuacugcuuauugaaaacuaacuugcauuugauaggcuauuuaugcauuuaauuacagaacuauaaaauacaaacaaaauuaucauuuuugauucuauuaaaaacgaaguuuagaguuccuagauaaggcaguguuagagaagucagacacuuuuauuguuaaauaggcauuaaaacagaaugugcauauaugucucaggcauuaccuaagaaacugcaaagacaugaauuucacccuucuuuauagaugaguagauacaacccauuauuuagauuuucauauugaacaauaacuaguccucagguaagacuacuuggcucuguuugucacaucuaugguggacuuguugggguggccaacagaguuagcuaagagaaaaggcaauccuuaugccugagguaguuucaaaauuuggaguucuagaauuucucagaaacugggugauaaggugaacuucugcuaucugugaacuuagaaaaacaccgacucccagguuuguuaguggcuucccauagccuggcugagguucaucuaagguuucaagugcucuaacaacgauucacaacucuugugcauuccacguucuugaaaaagauauuccuggaccauaaaucugacaagagaacuuuauaauuguuuucugagaaaaagggggagagacucucauccauuuucaacuguaagauaucuguguccuuaaaguauguuuugguuucuuggucuuugaaacugacuuaagugaauaaccauuuagaauuuuaaaaaguauuaauucuucuuuggcucuaaucuaacucaaagguuuaagggugggaggggaaauggagcugucagacuuguugcaggcgacgaaugugaauguggcugagcucacguacaagaggacacugccuuaaaaagcgugcuacagcaaucccgagagugacgcuccaugaacaccuaucacagagcuccagaucaccuacuaagaucuguucagguccaccuuacuccuguuuuguaccaaauuggcaaaggagcgcuucggaaaacagcccucacuggaagaacacaucaguuuaggcccucgcuuucuagacuuuccuagagguaaguacuuucgaggggaccgcucccaggacucgcggcucucuuugcagagcauccucauguuuccagagaaugucagcucguuagcgucugacacugcaggcacaggagcgggaaaggcaguucugagcacaccgcagaaacgcaaagccgauuuaaaggaauccacguuacagcacacgcaagcagagcgcgggaagguagaguucgcugcacagccagcucggggugggaaggagagccggcccucgccggucccccgcgggcgcuccacguuucgucacaccuccuuuccggcagggccgcggggcugacccuuccgggcggccucagcuuaucacccggacaggcuacuucccggcuuuggccccgcgagucuccggaguuuccugucaggcucccucggucuccgcgcccaucccaccgcucaggccgacggcugggcucggagaagcgggaucuucuacgcgagagaccgcaagaacaagcuucgacgggaaacagcacgcagggcgguggccacggcccacgccuccucacgcccgcaacuccagccuccgcccacucgcugagcuccgccccucgcggguccgagccaaugggccgcgcccgccuccugggagguuguagaagaggggguuggggccgguggcagcgcccgccccuugcuccuucucauuggcuaaacucucggggugcccggagaccggaguguagcgggauuggcugucgagccucgcaacgguggcgccuauuggcuggagcaguccccgugacgccggguggcgacuggcucccgggucugaggggcuucugcuugucagguucuagguaggugcguuucacgccgccguccguaggcaccguugcccggggcaacgccccgggaggugggaaggaggccggaaggcgagcgcagcgcggggguaaccguucccgccugcaggggggcgccgggcuuuuggcccagcggacgcgggcugugcggaggcgcuuccucugcccucagccagcucgguccccugccggggcugcggggucacacucgccucauccuacccgcgcgacggaacguuccggguugggcuuggguccgggcugcucacccggcccgccaggcccgccccuccuacccgcccgggacccggaggcugagggggcggugccggccguggcgggcgcuuggccccgccccgucgcgggucgcgggugugcggggcguggggcgggguugggagcugcugcgguggggagcccgcacccuuucccuucuugcgcuccuccgacgcucgcccacggugcccacaccccuucuggucuccucacccgucgccgcccucuccuguggcacccagccccgagaguucccgcagccccuuucaucaggacccucugacccugugucgccucgcuucagcuucacgucccacugccccuuugguucagggcagccuuucagaaguccggcccagggagacuucuggaggcaucuggacuugucaggggugauuuuuucccuaagggcuuuuuaggggucugagguauuuggaggcaccuuugugucuuccuuggacuccucuuaagaucagcccuccgaaaggaguucaugagauuaguuuugguaagagcuagggcuccuuugaacaauuaaguuuccaugagguggucgcuuggaacucugugcauuugugauuuuuguugggcaugccauugcaauuucaguuuguucgggcagccuuucauuuucaauaucuuaugacguaagagcaaugaggcuuuugauacuuuuacuucggaagaagcuguauauauucacaauggucucacggucacccuaacauaugcuacuccaacauguacaggaguuuucaggcauuuuucagaaagaaccuucucaaccugaagucaccguauauaaacgucugaugucagagaaucuaaagauaaggcccacaguauuuuagugguuaacaucuaaaaaauacuuugcaguccaucugugaaauaagaacagguuuaaaggaaaaguauugcaaaauacauggugugguuuagggacuauuuauauacacaccuguguaggcuuuauaaugguguguggaagagccaaaggauguaaaaagguugagugucccuuuuacagccaagaaaagauuuucugauagcccuagaguugagggcuuucaaagguccuggggauguuuucagaguacauaggcauucugggaaucacuuucgguucucuuccauaaaagaccuuuggcaaagaucuguuucuuuucugcauugacaguauuaauacacacuagcgaagaugauguacuauccagcuucuacucuacuucagagguugaagucauuugugugggagaaauaaucuaggguuuuguagacagaauucuugaauuucauucuuaguugccauguggcucuaacuuuucugugaacacuuuuucugcuagcaucaaguaaaauuucaguuuacacagagcaagcuguacguguuacuuuuauggcaguaguaccuuugacauugcugucccauaguaaauacuaacagaggagcuggaaugauaguaaaaauaccguaagguccuuguuuguuuugaaguagaaauagugaaacuaauuaguaacgggaaaaaccaauagaaacauaguuacaggaagcacuacucugugugguugugugagcuacugggaagacuguauauuugaaucucaggcccagauuuguaaauugcauucugguagccacaggagagauaauguacaaacuugccauaaaaauggaaguuuuguuuaagcuuggauuuguguagaugguaggugugcaccauguugcacauguuuuggagggagggcaaagggaugacuagucauucaauguucagauaauguaucugaauaaucuagguacuuauacauacuguuuggaacaguguauuuugugauggaaaaaguuugcaaaugugaacuuaaaaaaaagucaacuaauuuagaaccaauuccuggacuuugcuuacuaguauuucauuaggacuuaaaacuaucuucauuguugucucauaguguuaauaaaagaauaucuuaaugcagaccuucagguuuuuaaaaagauuuauuuauaauuauaucuaaguacacuguagcugucuucugaugcaccagaagagggcaucagaucucaugacagaugguugugagucaccaugugguugcugggauuugaacucaggaccuucagaagagcagucgaugcuguuaaccacugagccaucucuccagcuccgagcuucaguuucuaauaaaggaauaaaaguggaaaugacauuaauucaaaugcauaauaauuguauuuuguaucuuuccugucuuaggaaaguauugcacuuuucuucaacauuuguguccuuuucauuuucagaaagauuuuuauauauaccuuuaucuacuaauuucuuaaauuuuugagagguaugcaucagaguuuacagaugaauaagauagauuuucauugccuuaggcauacuuacuguggucaaccaguuguuucauuaagacaucaaagggaacaggucacagcuuuagggcuuggguagugacuugagcuaccuuggaaaugcugagcugcuccuuaggguuucccccagagcuccacuuucccuuccucuccccccccuccccccgcccccuuaccucuuuuauucccauuuucauuuagaucccagguugaguuuuuuucagaaucgauugagaaaauacagagaagaaacuuagcaauaacugccauaguuaguguauuggaaaagaacuaaagcuugcuguaagcacuccaccacucaccacagcuuuacagggacauuccagugaaucuguaucugcaccuaaguugugguguagcucagcugcgguacucagccacuucagcaucuggggaagcagagcagaggacauguuagagcuguaacaaagagaugaggauaaaauagccacuuugcuuauucugucagaauaaguacacuuguaguuucucauguaugaaguuuacuaaugugugggucccacauauggguuuucaagaguuuuugacauugaaaacauacagguaaacugaaguucacuuaguaucucucuaagaaaauacauuuuaacaaaaaauguuuucauuuuaaggguauuacauguucagcuuuaaaaaauguaauaucaugcauaacuuguaauuuuucuuaaaucuucaucuguacuacgacuaauauucagucuauguuauuaccauucauuauaagcuugauauuaucucuuuccucuguaaguauuaauuaaaagccuggaaauuuuaaugacagaguuccuugccagguugggaaaguguagugaaaagaagaacgguucauuuggaagccauauaacuugggcuucagcuccaguuucucuuuugugggaucuuggacaaauuacuuaauaucaucaaaucauaguuuccucuucuauuaaaugaguaagauaaaauuaccucauaugguaguuauguagaagaaaugagacaauguaaguaaaaaugccugaaguuaggaagggcucagcuucuguagucagcgcuugcauugauuuguaucuguccugguguugauaggauuauucuuucuuaguuuguguucuuacugugaagaaacaccauagccaaggcaacucuuaccaaagaaagcauuuaauuaggcgcugcuugcaacuuuaggagacgggggagagaaaggggcgcagacagacggacauaaagacagacagauagacagacagacagacacacacacacacacacacacacacacacacagagaaagagagagagagagagagcgagagagagagacagagagagagaacacgagagggagcuagcuagcuaacuagcucucacaagggccuuuuaguaccauaaagcuagcccuuagggauagggcauucagaucaguuccaauucaggggccucugggcucuuuuuuuugagaugucucuauguuuuaggaguuucuuggacagcccugguccacagugcaaaagagggcuuauuucugauauugagguuuuugguuuuuuugugagaugcucuuuggcuguugaaggggacaccauuagcccagaugaggaaaguucauuaaaacuauguguauaucuacacacugaauuacaugcaguauagguuuucccccucauuuucccuaucagaucaauagucucaauuaucuauuuguuuauuuuauguacaugaguauacucuuggugucuucagacacaccagaagaaggcaucaagucccuuuacacaugguugugagccaccauuuaguugcuaggaauugaacuuaggaggacuucuggaggagcaauccaugcucuuaaccucugagccaucuuucuagcccccaguagucucaauucuuaaaaguauuuucuuucaucuuggguugucauuuuuguuuguugagugcuguaaauuccuuucauugagcuaaaaguaacaucuugaaauugguagagcugguaaaugcuauuaaaguucuuacuagcacucccgcuuuguaucauucacugaguugguguaaaaguugcuggcuauuggugcacugaguaagucuucaaggauuugggugaacuaugcugcagucacugccccauccugaagugcacauuuuaauuuaaauugcugauucuugauguuuucccuccauccaaauacaagcuauuuacaugugugacaguauagugugaaguuucuagaugccagcugugacuuugucuuccuuucccacucaagcaucuaagaaggaagauguugacagggcaaucacuguaggcaucaacguggaucuacucagggucauugaagaaaguugucagaaaugucugacuuuacaguaacaaacacuugaggcauguuuugcagguuuauccucuuuccuaacauggaagucuguuucguguuuucuggucauucuugucauauaauagaauauaauguuaugcugauuuuuugcaauugugaugaagaauccaacauuuaaaaguugaaguaacuguuaaaaaucauuggaaagugcuugaaugaaagcacuacagucuuuauuauuaaacgacacuaauauagaagcauggaaauuaauuuuauagugaaauuagucucuguaguguaacaguuuuagggaucuuguauuccaggcacuuuaccuuuaaaaaugccuuuuacuuuggcccaguccagagggguaucuuugaaauuacaauacccaagugggaguguacucauuuauuuauuuuaaaauucaguuuuaacuuuuugagaugagguaucaccauguagaccaggcaggggucaacucagagagcuuggccuuccucagccuccugaguccugggauuaaagguaugcacuguuauguccuuugagauugcaauuagaaaugaacacaaaacuuuuaaggccaguagacuuuuggaauuugcaaaagucauuuccucaaacauuugcaaaucaaagaucuacaccaagaagagaaaacacauuuaauuaaacauucuaagcagcacccuuuagacuuuuuagugauucuauagagucauagucaucaaaguugguaaauauuuucuuuccuuuuaaaaugagugauagggaacuuugcauuaugcgauugguacauagguaaaggcucuugugugcuggugucccagagguugcaggacaagagaacauucuggcuuagaaagccuccuguuugucacagagucuaagguuuggcuugauuucuuaaguguucacugaugcuggcuugcuguuuauugucuauggauaguucucuucuugaagcugaauauuauuauggucuauauccuugcugcucucccacauguggcuugggggaauuuccacaacuuaguugauggggguucuugcgguaguaucacagugcguucaaaggaaagugugcuuguuaaaaaaaaugggcagcaaccguccagcaguuacauuaccucucacaucacaaaauguuuaugagugaugagugucuuaucucuugaauuguguuuccuuuagaaucuggcguuuucuguguacagucagccucauccagguuaaccaucauuuuaaguuucacuaagguuuuauaaauuuuguuuugcuagaaggaaaggaaacauuucugugauaugugugugaguacaugccuguaugugugcugccuaucuauauacuugugugcuuguuucgcuucuccccuccucuuuucuccccuucccuccccucuucucuucuuguguagguacacaccccugucuuguacuacagcauuaguguggaggucagaggacaacuuucuggaguugaguuuucuucuaccuuguuguggucugucuucuccuuucuaguauuugcuuuguagucuaggauagcugacccuuaagcuuccagaugauuguaauucucuuguccgagccuccuagcuugcauaggagugcuagaauuacagauguguaccacugccucuggcuuucuauggggguuucugagacugaacucagaucaccagacuguguggcacuuuuacccucuggauugucuuccuaucccucuccacuuuguuuuagacuuuguuuugcuuuaguuauguguauuuguguaugcccaucuguggguaugugcauucaugcagaugcauucagagcgcagagguaucagaucccuuagugcuagauauaguugugaacugcccagugugggugcugggaauugaacuugggucuucuggaagagcacuauuuuuuucuuauccagugagccaucucucaagcccuucuacuuuguuuugagacagacucucucauuaaauaggaagcuggaugucuagacugguuggccagcgagccccagggauccuucugucuccauuuacgggcguucauugcugcaucaggccuuuugcauggguguuggggauauaaacucugguuccucaugcuuucguggcaagcacuuugccagcugagccauuuuuuucuuagugaaacuucacucaagguguaguuuuuuuuuuuagugaaucagccuaccggauguucaaguuuaauugucaguuuuggugcuuuaaugauaauggccucuacgugcucauguuugaaagccuggucagcaguugugggcacuguuugggaaggauuaggagguguggccuugugggagaagguguguugcugggggugggcuugagguuuuaaaacucaugccauucucaguguuucccucucugccuguggucacauguggucacaugugagcucucagcuacugcuccagugccaagcuggucuucugucauguucucugccaugauggucaugaacucacccuuuaaacuguaaagccaguccccaguuagaugcuuucaguuauaaauuguauuguucauggugucuuuucacaacaauagaacaguaaccaaaacaccaguauaccaagauccucaauuuuuuucguaauuauuuaaccuuuucugacucuuuacggauuucacaucaugcaccccagucccacucaucucccugucucuuuauucuggcuccccccccugcaacuucucccucaaaagaaaagaaaaucucauugaggaagcuccagucucucauucuaacuagacuuagucuacuuuacaaagcagcaauuuacauacuagguauugcugauuucuuacccugcgguagugaaauaccaaguuucuuccacuuucugucguuucaguucuacauguuaagcagcugugacuugcugaugauuucugccguaguuuuacauuugccaggguaauuuuagaacucaaaacaaaugaccgaagucauuuuauaaaaccguacuucccgccucugaauguggcagugccauccugguuuugcuuaaauccuagucuuugaaauuauccuuaguucauuuuuuuuuuguaauguuucccacauaccauucaauauaauucuuuugcuuccaaaaaaucuggaaaugugacuaaaucuuauaccuccacuuccuccauccuaguucaccaucaucuuucuucaguauaacuccuucugagacucucugcuggucugaugcucucaaaaaguagccuuucauccuucugaaaagccggggaccauuuacucagagccuucagugcuucccaggcaucucugagugaagcacaagcaugucagaugaagucuaguucauggucccagucucuuucaugcaggaucuuuaugaagaguuuuauucccucuaccagucaccacauccuugcuuugccuugcacaggcacucugaacucacuaaccccuuuggcuggggugccuuuucucuguaucucaguauaacuuucuccuccucaggucuuugcucuuaucccuuaggcuucuuacuaaguguuccuucuucauacugauuuuuuucuuuuuaaaguauaaucuccguggaggcaggguuuuuuaaauaggaaauuuuugcauggcuaauagcuuucagcaaguaguuguugagugaaauaauaauuaagauaguuauuuguuucguguaacaucauaggaagugagacuaccuugcuugccguccaagaccagcuugcuauaguugcaugucuaucucugggugugucuugugaugugugcaugugaguguguaggcacauguagaagccauacaggacauagaguacuuucucgugucacccugccuuacugacuugagacaggcucucucccugaacugaggcuagcuggcuaacuggguugguugggcagugagcuuuuggaucugcccugucuccacccugcagugcuucagguacagacaugggcaggccugaccagcauguuuauacagaugcuggagauucaagcucagauccucaugccugcagaacaagugcuccuacccacugagccaucuccccagcucuagccugcuacaguuuauauauucauauauuacuagaggccuauugguugguagaggaauaucacagcagcgguuacuuuccuccucuguccuuuuugauuggucaugagauggugccagauaguuacauaugugggcaguggauuugcaucccaggagggaaggcugaaauugcucuuucuccuuagggagacacugugucuguuuccagcuuugucccauaugugaaacccuugcaccuuuugcucagauugcccuuucuguaggaauaugaguaguccuuggagaauuguuucuuagcagugauuccaaauaccagaaauuucaucuguuaauacuugaaugcagacuuagggugagagguuuucagaaucuucuccacuucccuuuccaucucuuccuuuuuccucuggguugguucauuguuaagaaggaacuuaagcuuuuaguuuagcaacuucagcugaaagagaacuuuccugcuugaagaaauguugggugagcgaagcuggcaguguagcucagugguaggguguuugagcaguaugcaugaggcuaugggacccucagccaagaggguggaagagauguccaguggccugucuacuguaggaacuuuagaaagucaaugaucagugccaucuaaaccaugaggaaggaggaugagaaagaucuagccuaauagaagaaaauugagugagaugugguacccccagaaagggagagagggauacaagcuucagagucaaaugagcaguaauggauuacaggucccuuauucacaugcaacucaggcugauuuaaaaaaaaaaucuagguuauuauauaggcauauuuacuccuguucuuuaaaauaaucacaccaugaacaagacauuuucuuuaaaaauacgaccuuaggagucuguaaauuuauauuaaauauguggcauaauuuauauaucuguuugaucagaauucaauuuugaaauaaaggauguuuauuggagaagaggagaagauacaggaaaauguaaucgggucagugagacaguggugauaauuggcguuguguguuuguagggugucacucacgugacccuggaauuauuccuccauucuccacuccaguggcuccaccuaguccccguuucugaagagaaacauauuugagaagugggaauucuguuugggucugagugcguuagagaugagaaucuguggcucugcagaggucagggugggagaugaaggugauggcuacagaugacuccaccauuucaguuguccaguucagucugcugaguucuggggagaaugguagugcgugugaaguaauacaaagggcagauuguuauucacagauuuauaguagcuuaaaauacagucccacuugagcaugucacugaugaaguuguuacuaauuuuuaaaugaagccacuucaauauuaaugaaaaugcuuuuucacugaaaaaaauuguagcgaagacuuagcuggaaauuuagagaaagcacguuggugcuuugacuagcugucuugaggcauuugagcuguucaguguugaacaugggucuagcugaauaguuuucucuguuucauguaguguguugagcaugaccauuucacagcaaaagccagauacaugaaauuccaaauaacucaguuaucuguacugacaagacaguaaaaauuuaaaccucaagaauuaaauggaugaccccgugauuuagggguauauuuggaaaggaacuaauuauuuauacaauguauacaguggugcacacuuaccaaaaaucuuaaaaaugggaacacugggugcuaggaacacuugcuguucuuccagagaaccugaguucauucccagcaccaaugcccagcgauucacacugccuguaacucuaccucccaggugucugacguucuuuucugaccuccauggggacuuguacauaugugacauacauauagacgaacauaccuauauauaaaugaaaacaaguguacacagggcuugguacauaugugacauacauauauauagacuaacauaccuauauauaaauggaaacaaguguacacagggcuugauggcacacuuucaauuucaacacaaagguaaaauacaauacuacagcagaggcagguagaucucagaggcagucagaucugugugaguuucaggccagugugcucuacauagugauuuccaggucagccaugcuacacaguggcaccuugccuaaaaagaaucuaaaauaaaaagagagagaaacagaggaggcagugagacggcuuagcugguaaaggugcuucccagcaagucugcagaucugagcucacucccaggcagcucuccaccguuacuauguaguguguacagucauaaaugcuauaucacaaguauaacauaugcucuuuugaaaucauauaaaagagguaauguguagcaggauuuucccuguccaauuaauuuaaauauuaauacaacaagaagccugcaauuggacacggaacagggaugcggaacuaagaguugcagaaacagggagugacacaggagaagggaaggaggaaaguggaacauggccaggaggauucagauucugcauaguuuuaaauagccacagguggcuacaguaccauauaaagacagaauaauugggauaacuuguccaaucuagguggcagcuuguaucauuaucaauugucucugaaauuauuaugugagcaucuugugaauugagaauuuauugauauauaaaugugacugauuaauuauaagccucuauaguuuugauuuuacuggguuacugggaauugugacagcuaacugagaggugggcaggcggucauugcauggggcugguguggcagugauccaccaagggaacuuagcgagucagguggagaugucuugggagcuuggggccaaagagucugcugagaugagaacacccugcuggagucauguggccugcuggugcccagcauagugcaggaacuugccuuucaauauaauauuuuccacaacaguaguaauuacaaagucauauuuaaauaucaucuuaaguuauacauuuuacugccuaccagaauuaauucagugccuuccuuggcucacucuacuuugucacucauucaguuacaauuguuuggugacuacugugucucaggugugauuuggaggacuaagucuuagaauagaaaaccaucccucaguuaccauuuaguggaagaaggggauaaaaugacauuuuaaaucauguagaaguuagauuuccaaucacauuagcaugacaaaucugaaaugaaguaaaauguuuggaagcaaugaagguaucuuuggaaacugguagaucauuggaagaaugggagauguggagaauaugacuaauaaaagugguuaguuuccugacuggcagggaaucagauacgucugguaaagugugaaaugccuuuguguucuuaugaaagucgaggggaaugacagaacacagaauugguaagcagaaaggguggggucggagggauagcuccagguaaaggcacuugccccacccaagucgaaguggaaggagagaaccaaguccacacucaugccacagauggacggauggauggacggacagggacagacacacacauauacacacauugcacacugcaguggguguugggggagagguuauggugggaagaggagaggauagaggauuauagacugggaagccaggguuagaaacagguuucuauggggaagaagauaaaguuacaaggauguaacuacauauauauggcucucgguauagauguuugaagagucaaucagucauuguucagaaauguuauacaaaacauugcguuuauauuguaaacacacaaauuuguucuuguccccccucaaauacuguacaacaacugauucauagcauuuauauuauaauagauaauaguaguaaccuagagaugguuuaaagaauauaggauaaugugggcaguauuugagacagagaauauaucuuuguugggaaaaaucuuccuuaacuuuuuaucguccuuugcauaccuaagcgcuucuucagacucccccuaaguuuuuguacuuaguauauaauggcauaauucugcugcuucccuuucccccuucaaucucucccgugucuuccuuucuuugauugugugugcguguguguaugaaugcaugcacgcauaaguacauaaacacaacccugauuucagggcugacagcuugguauuggauacccaauuagggagucauuccuagggaagaccgagucucagacuuagcaguuguuaguugcauguggcucuuugucugaaguggguccugcuguuuccacauggaacacauuuuuuaaaguguacuaacucauuacuucugcugugcuuuggcuugaaguuuuaugcuuugaaaauggagaaaaacaagaguaggugcuucaagaguggggacgcugggugggagagaaaauggacauugggguaacuguggagagagagagagagagagagagagagagagagagagagagagagagagaagaaagagaaagagaaagagaaagagaaagagaaagagaaagagaaagagaaagagaaagaaaaagaaaggagagagcgagccaguuaggucaguguggcauucuuacuuggugaaggugaagacccguggaagucaguuucuaggaguagcuuugcugugcuucacacacacacacacacacacauacacaaauuuucucuuuccucucuauugaguggcucugacuccuuacauuucuucuugcagcucaguucuuuuggcuagaccuaugaucacucccgugagacuucacugcacccuuucucaagugucuucuucaucccuaaugugucauuccucaccauggaccugcuacguuagcuaaggcaugggccagcggggcuaguaggaagguaggacuccuuuacucuucuuaguaaauuacugaaacuuuuguuuggccucugaaccugugauauuuugugcuaacauuguagugcucuuuccauuagauuacuauacuuugaaacuaucauuuuauguguaguuuguucuuacuuguuguuuagaauaauuuauuucacguaggacacuugugauugaguagguuuuucagcuaagacuuuugauugacagaauuccaguuccuguauuacgucuuuaacccaugugcccaccaguccuacauuuucaaauucuugguaccaaaccugacaugcuuuucuucuugagaaguucuuucuuugucuuaguucugguuucuguaucucuuuguuuccagaaagacucugaagugaugugaaacuaaauuaaguucauaauuaauuaauuaauuauuuuaauuaaaaggcauauaaaauaaagcauuaaauaguauauauuaaaaauauguuggacauggugguguaugcuuuuaauccaagcacuuaaaaggcagaggcaggugaguuugaagccagcuaggucuauauaguuuucaagugccugaagagacuggaaggaaacaucagaccccuugaggucgacuuacaggauagcaguggagugucacaugggugccagggaucaacgcuggguccucucaucagaucaauuuuauagucagccuuuuagaacugguacucgugaugaagcugaaauuuaguaguuauuaaacauaagucugcuauguuacucaugucuucuaaaauuguugauggccuuauuuuccuuuguuucccuuucaaagguuaaaaaauuuaagagauuuuacuuucuuugugugcauguuugccugcaugcguguaugcaugugcaccacauacuugccugcugccugcaaaagagagugucacaucuucuggaacuagaauggcagaugguugugagucaccccauccucugggagaacagcugguacuccuaacugcggagucaacucuccggcccuuuucugaaggaguuuaagaugcuuuguuacaauacaagaguuaauaguuauugauuguucucugugugugagacauuugguuagaugucauaaaucuauuuuuuguccuauuggccuauacguuuuucuguuuucaugugguuagcuucuuaaaauuuauuuuauuuuauuuuauuagguauuuauuuaauuuacauuuccaaugcuaucccaaaagucccccacacgcuccccccacuccacucccacuucuuggcccuggcguuccccuguacuggggcauauaaaguuugcacgaccaaugggccucucuuuccacugauggccgaccaggccaucuucugauacauaugcagcuagagacacgagcuccggggguacugguuaguucauaccguuguuucaccuauaggguugcagaucccuucagguccuugguuacuuucucuagcuccuccauugggggcccugugauccauccaauagcugacugugagcauccacuucuguguuugcuaggccccagcauagucucauaagagacagcuauaucuggguccuuucagcaaaucuugcuagugugugcaauggugccagcauuuggaagcugauuaugggguggauccguggauauggcagucucugaaugguccauccuuucgucacagcuccaaaccuugucucuguaacuccuuccaugcguguuuuguucccaauuccaagaaggggcacaguguccacacuuuggucuucauucuucuugaguuucauguguuuagcaaauuguaucuuauaucuuggguauucuaaguuucuggguuaauauccacuuaucagugaguacauauugugugaguucuuugagguaacccaauuaaaauuuauuuuuaaggucaaaagacaaaagaaucucuuucuccuccucccucucucuuccccucccuccccccugcaccuccuccccuguguguaugugugugugugugugaguguguguguguguauguguuggcugcauagcauguggcaaacucagguccucugcaagagcagccagcuuucguaacccuugagccgucugucuggccuuguuauuguuugaguuguaaggccgagagauuaugguugaaauugggacuuaggagcuggcuugaaucuuuggcccuuacucauuucuacuuccucuccagucaguggaagccuaaagcaaucugugaucugcucgggguccugccccugguucucaggaucuagaaggcaggucugguuguauuccucaagccucagucucacuggauucuccguucugucuucugcucucucuggugcuucauucagcagugugucaugcucacaaacacuguagccguggggcagugaccaugggcaccuuguugucaucaagacucauucugacauuugccccagcuuuuauuccucuuucauuuacauaguuugaaaccauauuaagacauuguaacuaaagcuagguggugauuaucccagcucucaggagguagaggcagguggaucucuggguuugaggccagucuaguccauagagugaguccaggauagccaggacuacacaaagaaacccugucuugaaaaacaagacaaaaacaaaagaaaaaaaaaaguaccauaauuaaaauuuuagcaugcagaucaugcaaauaaggauaauuuccccauauaaucauaauauugaggucauauaaaagagucaacauuaaggaugugguuuguuaaucuuaacccauuugugaugcugcaauauaacacuucauaauagguaauuuauaaacaagagaaauauauugaccauaucucugaaggcuuguaaaaacuguuucaagguaugcuuggagguuuggugguuggugaaagccuguuccuuacauaugaaacuauuugaaugucuucacauugcagaagugauggcaaugcccuggaaccgcuuuauagugagcauuaggcauguccaugugaggggagcccucaucucuuccuguaucaccguggugguuaaauaccaauauagauucuuuuuuugauugaaagccuaggagauuuacuuauuuauacuuauguauguauuugagauuauaucauuuucccaccucuagacccuccuauauaacaguccuugcuuucuuucaaauucacggucucuuuuuaaauugauuguuaauguaugugugugugugugugugugugugugugugagugaguguguauguguacaguuaacuacauauaacaucugcuuagucuguauauuguuacuuacauguauguuuucaaagcugaccauuuggccuaggauaaccaauggguaugcuccucccuggggaagacuguuucuucagcucucuucauucuuuaguggccugcaguuccuuguguagguuugaggccuuguggguuuccccaauccacuuugccgugccuguugcuguccuugcuuagcuuacauuuggguagucauguuggugggacuuuauggguuagugagaguuuauggguauagcuucugauauaauuaggagacccagucuuauagcaaacuuccugauccuuuggcucauacaguccuucugccccacguccacaauguucccugagccuuagguguaggaguguuuuguagagguaucuggugggacuggucucuaucuucuguguuuugauuuguugugguuuucuguaacagucuccauauguuacaaagagaaguuuuccuguugaggugcagggacuacacuuacauguggguauagauaaggauacauauuuagacuauaguuagggauuguguuccuuaaguaaagugacagguguagguuaacaugcaugacuucacuagcccuggggaguuagccaggugcucaggauggagagcuguugguuauugccaagguaugugaaacacuacucacuccuagaguuaguaugccauacugcuuguaguugugguucauagacaugggagcuggguagaaugguugguucuuuuccuccuuggaagcaugucuggugccuucugguaccaugaaaacuagaccuucaugagaaggcuuucaggucaguuccaggccaguuccauugugggcuccuuguuugaagcacagugucuucagcaauggggacuugccuucuacuucucuggggcaaccggggacaauagcaauagccugcaauguuuugggagucucaaugaauccugaccaacaacucuaaaaaggacuucucaugccuguugugagguaucuguuagauggucuuuggcuuuuggagggagcuuugucagcccagaugucaaaauuucauuugaacuauauauguacacucauacacaaacuuagguauauuacagguuuuaguuagguggaucgcuaauagaaugcuuccuuaggacugugaauacccuuacugguauuguacuguccucuccugcuuuuguuuuaucucccuacuuauauuccuguuuucaccaauagauuacuuuguauauuacuccucccuucucuauugcuacccaacccuaguccagcaaugcucccuuuugacuuuacuguucucugcaguuauuucaggauguauacucauagcugaaaaugugagcuagaagccuuagaugggagggaaaugugacaucugucuuucuggaccuggguugccucacucaguaugaucuucucuuguagaaaguucaugucuucauuauucuuuuuggcugaauaguauucuauaguauauauguaccacacuuucauuaugcauuugccaaacaaauuuaauuguguuuucauacaaaaugauuaaaaucucauacuuucucuuguuuuuuuauuuuauuuuuuauuuuuuagauuuauuuuauuuuguguguuugagugcuuugucugcauauauaucugcucccuacauguaugccugguaccuaaggaaguggagagccucaguguggaugcugggaaucaaaccuugguccuuugcaagaacaagugcucuuagccgcugagucaacacuccagccccccucucaaaaauuuauuguuacaaauacauuuauuuauaauaguuauuuauaauacauuuuaaaauguauuaaaauguaucgacaauuucuuacaugcauuuuguguacuggucauuuuuucaugcucucucucauauuccucucaccccugccugaucccuuuuccccaguaaguccccucucacuuugauguuugcuucugugccugcugaguuuacauagcauugcuugcguguguuaggauuuaucuucuggaguuuuggcaaccucacaguggauuucuauucaagaaaaugauacucucucucccggaacccuuaacggccucacaagucccuuugcuuucugugauggguuguagacuggccuuaccuuguacaggucuuauguagguaauuguagcugcugugaguucgucagugccauggcuaugucauauccagaagacagagauuuacacaacuucucccaguggucuagccucugcauauggggccaguguaggaaauuuugagggaaguguauguccagaccagagcagucuguauguggcaaucuguauucaggccucacugauuauucuuggaaacguuucuuugguguuuuaucuaggauucagucagcuuucaugcauuccauuugguucuuauggcucuuaguucuuuuguguuaacucguucccugucuuguuguuuguuucuuugauguugaugaucagguuuuucacuuaaggguuauaguuugaaaagacaaacuuacuuaaugucucuuuugaguaugaucugcuuucuaagaauguuauauaucacgaguuguaaagugguuuggauauaaaucuuacuaguuaaugauuauaugaauucaagugguaccaauaguucaucagaggcagaguggaaguuuucugauuuucuuaaccuuguaugucguauguaaaucuauguacuuuuaugguaugcauguaaagucagaggauguuacccugagccauuucacuugccaauaguuugauuacaugguuuuauuaguguaguugccagacuccaauggugaacuugauugaaucucuguaagaauucuagguaaaggaaacaaaacauuuccccaauaaaaugucuguuuuaaaaauccguguuucuaauuugagagagaagccucagugcagauuaacucuaugcugucaaaaauccaauauucaucaaguauagugguacauacuuuuacauuacauguucucucucuuaagauuucuuuauuucuugauuuaaugugaguacauuguugcugucuucaaagacaauuuagggccuuuggaagaacagagagugcucuuaacugcugagccaucucuccagccccuggcacacacuugggagucagaggcaagaucuuugaauucaaggccaaccugaccuauauagugaguucuaggacaaccagaacuaccuaaugaggcccugucucaaaugaaugaaugaguaaauaaagaaguaaauaaaugcauacauacaugcauacauacaugaaaguacaguauucauuuauuucauucuuucuuaauccccuacccucuucucccuccuuauguuccccuucuuccuuggagacaguuaucuuaugcaucccagguugcucucaaacuugcaguguagcugaggaacuucuuauucucuugccugcaacuccaagugcuaggauuauuccaguguauucuauaaugccagaagaaccaauauuuccgucuuugcauuugcagaaugcaaaagcugacaguuacagagccaaaaacugaggagcaggguacaguuuagaauagauacuucuauauaucuguaugcucguaagauauaccacaggaaucugcucauucugcaaagaaaauagucaucuauuuuauauuuugcuauuuaacaucuuuaauucuguuuaugaaauuuguauauauggauauagccuaauagaauuuaacuucuaauuuucgaaaacuacaguuuuaugauucuuuaaagaauacuuaaucauguuuaugggaaaacaaagucccaaacugaagaucacuaaauaagauagaaucaaauaaauagguuaaauaaaucuaaauaccuagcauuuuaguaggauuuauauuaguuucacuuuuuaaaaauuugcuuuuuaaaaagagauacuguugggguggggauacagcucaguuggaggcaugcuuaccuaccaugcauaaagccuggguuugaccccugcauugcauuaauugagccuguguuuugcuugugauagauaacagaguuaguucuuagcagaggcaggaagggcagauguucaaggucauucucagcugcccauaggcuuaaggucagucuaggcuaugggagaucuggauuuuuuuuuuuuuuaaugauuauguuggcaacagaauauauguacuuuuauauauuauccuguuacagccugguuaguaauugauauccacuaaauuauauaaauuuauguauguauuuauaugauuacuuagguguagaugucugugaagggcagagaugucugguccccuggaacuggacuuacgugugauuguaagccacuuguugaguucuaggaauuuaacugagguccucuaugaaagugggcaugcucuuaacuucugagcuagggcucuagccccuaaauuauagagauuucuauccuuguaauaaccuaagucccagugguauacaaaugaaaagccuaugauauucuuguuucagauagcacaaagucuaauggaaauguacuguaaugagcugggcagugguggcgcacaccuuuaaucccagcacuugcgaggcagaggcaguuggauuucugaguuagaggccagccuggucuacagagugaguuccaggacagccagggaucuacagagaaacccugucucgaaacaaacaaaaaccaaccaaccaaccaaccaaacauaaaaagauagcugcacacagaauuccagaucugaagagaggaacuguuugagaacugguugagaauucagcuuccagacuagguuguugaugauuuuccaggggggaugugaauagaaacuuuagauucagggagggcauagacgugggaaagaucaggggagguuuuaggaacccuaaaguucuaguuuccuccuguugcugugauaaacaucaaggccagaagcaacuuguaggagggaaaagacuuaucagccuucagguggcccucuaucauugagagaagucagggcaagaacucuagcagaaacaauggagaaacauuguuuccugguucaugcuuagcuaguucucuuauaccugccuaggaagugguacugcccauagugggcugagcaauuaacaaccaagaaauucguccacaagauagacccacaggcaaauccgaccugggcaguuccucacuugagacucccuuuuuaugugacucuaggcugugucacauuugacaguuaugggagauggaaguuguauugauuacaggcaaagaacuuugaauuuuaaccuguaagauaugguuguaaaauuaauaccaaauacuaaguacuaauaaguuaauggcaauuauuccugugugguggauagucuuucuuguaaucuuaacugcauuuagacucaccuaaaagaaccccuucuggguaugcuucugagggcguuuccaaugagauuucaauuaggaaagaccuaccauggacaugagcagcauuacuaccugggaugagguccugaacugagguaggaagagaaggagccaccagagcaugugcuacuguuccugcuucucggcuucuuggguggcaucacauuccaagcugcucuuacugccuugccuuuccaagauggacuaggugcucuucuggaacaugagccaaagcaaaccuuccugccuuagcucccuuuugucaggcauuuggcuacaauguugagaaagguaagauaaaguauagaucccugggcauuggagaugauugcgcaauacuguguagcuucacccaguuaauucacuuuguagcuuucucuuaucuacuguaucugagucacuuuucuaagugauggaggugacugguacagaagagaguguauaccugcuugucuagaauuuguauuacaaaucagcacuggauacaccucacccauguaccuuuuggcuguaguugauaauuuaaugucauuuuccauaccuuuuauuacuucuagaauaaggaugauuuugugaccucucucaaccaaaauuguauaguuugagaguuuuuugauuuguuuucaaaaucuuacuacauagcccaggccugauacuaauucuaucuugaguucugguacacaaccauaccuaaggucaagggcuggccauuuugaaaaauugaaauuuuuacugacauaauuauaaguuacucuuuuauuuuuacuuuugagaguauaguguaauuacagcaucucuuccuccaaauccucucauauacucuucccugcuuuccuucaaauucauggcauuuuccacuguuacuguauguauguauauguauguauauguaggauauguacaauaaacagacuauauuuuauacacacacacacacugcuuuuaagucauaagaaguauagagagacuucauguauccuuugucuggguuugaacucccaucuguccacacugagccuucaggagucucauuguauagccuuacuucuuguuggauuucugacuugguaugauuugaccuuuuuuuaaaacccugucuccacagucuagugagaaguaaaaaugcauaagaagagguuuuuauuuucuuaauaugccuuuuucuuuaucgggugggucauugacuuccacauguuauuuuuuuuuguuuguuuguuuuuguuuuuuuguuuuuguuuuuguuuuuucuccuucaaaagcaguauuuucuucugcucacucaggcuuucuguuucugagaauaaaagauuuuccuuuuuuuuuaaaaaauuagauauuuucuuuauuuacauuucaaauguuauccucuuuccuaguuuccccuccgaaaguccccucuccccucccccugcccccuucccuuuuaaacagcccauuuucucuucugaauuguggauuugcucucauaacuaaguguccccuaccuuuagauccugaggauuugguccauuuuuuucuuuuaaucuggaauuuaucaguaaauguguucauguuuagucacuuaaguccaugauucucuuuaguugcuuuugauaaggucuuagguagagcugaaggccaaugcuuuucccuuuagaccuuuguuagaagucucuugugcuuggugaguccauuuugaaguguugcauucuggaccauuauuauuggccccugaacaaugccauguggucuugguuuuuguugcuguagagugugugguauauauguguguguuguguguuguguggguguauauaugugcuguguguguauaagagaguuuguguuguguguguauguguagugguguguggugugugugaauguguguguguguggcauaagugucaauauugaguguacauguguggugugugaguguguguauuguguaagcaggcuugucuguauuuuuccaguuuucucuuauucccuuucuuuccccuugcccucagaggagaguagagcaugcuuugugugagucucccacaggucuccgaguauuucuuuccuguuuucuguugucuggcuggguggacucuguaaacucacugauagugacuucuguugucgccacuguaauguggagcacaacagaacaauuuguguuucuuccuuuauaauuucucucugauuauucuuguagcuugucuuccuugguuauauuuuguauuuuacuguugauuuugagaguuuauaucucauugcugaaguguuuuuacuauggcugcguuaaaacucuuaccuuguugugcuggcaccugauucaucuuuguauuaguauucauuaucuuuacauuaaaauuaggaaaaauuacauuuucuuggugacaggcaacuucugauuguacccuuuuuaauuuauguguuauguuggacuuggggaacacuucacucucuccauagguagcuaucuuguuuaguuuucuagcaugcggagcuagucugcuuuuaugggugucuguuccaaggacaguuucauuuucuccacugcgguuugauuuucuucauuuaucgauagcccgcgcucccagggguucuuaguugugcuaccugaagcuaagauguucuuucuuaggucaagucaugcaucucuaucauagugggggaaugugcuggcuuucuuaccacauccugcucuccugcugucuguggaauggggaagacauguggugucuuagacuuuuguacuuuguguaaaacccggagcccuccugccuguucucuccuccuguucugaaugaggaaggaguuccugagaccugugaguacaaagaggucuuguguaucaggcagaaacaguagagauagcugcagagccaccaaaugugucaccaucacauucaggagagacagcucgguaauucuccugacauuaacuugacgccagaguaagcccaaguuuggauccuccacaucucuccaugugucuuccaucugucuguaguuuguauuugaucuuuguaucugaccuguuccugacaaagagcuuuguuuuguauuuacugaacaacacagaaaucgucacauggcggagcaacuggacacuugaaagaaauccuuaacagaguguuacacgggauuaagucacugaccccaacugagucagauaacaaacaucauugugagcacgugguuauggugcuucuaacauuuaugauggauauuuguuauagaagguugcuuuccaccuaugggcuguucucaguaaaugcuugcgauaacacaccuguccacaugcauugcuguaggucaggggcauggaagaauacauaguuuaagguuaaagcugugcauuagcucaggauuugaaagcugauuacaugggaaauccaacacaaguaagguuauauuauuuucauaaaggcagguuaaacaaauaggcugcauauacacugggauaucaggcuaaguuugaucaccaugugcauuaugaagugggcugugaggcaauaauucuagccucuuagaauggaagagagauugucauaaaaauguacuaccacauccuugacuggauugcuuacuauaauugggucucucuagcagaucccgccugcuugacuugcuuauucuggguagaaaggugaagcgcaggcuggguugcaaucuacucaaucacugcccacggaauagcacaguuaucuaguuuuuuguucuuugcuuguuacugaaaacucuguucuuacauauauccaauuugucaugagugguauuuauacuuuguguugaucugaucauuucuuaaguguaagucaggucagacaaccuaaaaguuggauucaguuaauugacuauggaguuuuacuuuaaaaaacaucauuauuccccuuuuucccaaagagagguauguauauauucugaccuagcauaccaauaaacauaaaucagccucuuaggacaggcuggaacauuucccagauucugccagauuauuuuucccauuuucuuucccugugcucuacacauuuuuugaagcuucugauagcaguaguaaaauauaaaaaugcuuaucaagauucauugagaagcagagaugguguuuaugccacaucaggacuaaaauacauuuaguaguuuuuuuuuucuuaaguaaaauuaaaaauuuuucuagcaguucuuucuucaaaaauauuccuuauucuuugguuagacauagacugagaaggaauguuuucacagcugcagguaaagagcaaaaccaucggcaacaacaacaacaacaacaacaauaacaacaacacauggcuaguuuuugagcccuacaaaugauagucuuuucuccauggaauugagcuuuuacauauuagaaaauguucuaccauugagcuagagccccaaagucauaguuuuaaaauugccgucuggaccuggaagccuggagucaucgugguuaacaauaggugaaucagcugguccccuguagucacugacuuagcuaaagggggcucagucuugguuguugcuuuggaaauuuuagaaaggaguuucuuauaacucaaaauauuuuucccaauuacuuuauaguucacacaauugaacaucuuucaguugaggaacaauuguaguuuauucucuucuuggagaauaauaacuugacauuuguuuagaugaagcaacugaaguuagggagagaaacuuuuugcauuugucuaucauagaugaugucagugucauuaacugcaucgaugggauggccuggcucagugcucaagaggacuugccuaguaugugugagcuuggcccucaauuuccagcaccacaaaaaugagcaaacaaagagccacugccaccacaacaaaacaccugccuucuaguguggaugauccagaacuggaaacaaaggccccuugcaguucuuuugccugaguugaaagguuuacugcuggaaagcccaggaaaccaaagggcaaaauaaauuuugcaauaguuuucaggauuuacaguaaauaagaagaaugucuuggggaaguuuauaauagcugguguauaggugaucauaaguuaugucucagugauuuuuaaauaacuauuuugaguuauuguuuguguucuagucuguuuucuguuaccaagaacauuauaacacagacugaauuuauaaacaaggcagggauauuugggcucagggucuaaagguucaaggucaaugagccacaucuauggguggcauggguaucucucuuucaguaugugugugugugugugugugugugugugugugugugacagagacagagaaacauccucacacagacacacacagagacaaacacacagacagagagauagagauggagagacacagagagacagagacauauacagaaagacaagcagucaggcagagaagacuuucaggguugucugcuucuuauaaagcuaccaggauucaaugaugaggcucccugcuaacaacuuacuucauccugaucaucucccagagaucuuucugguaaguaccacagugggaauaacuuuccccacucuuguuaccucucccaggggguuaaaucccagcacaugcagccuugagggagguaucaagccauagcuaauguaacauucacauacuaaaggauucaccugauggaauugugcaguuuaguuguuucauccacucucagaguugugcugccaucacgaccaguuucagaauacuuccaucaccacagaagaaaaucuaauccuucucagagaucauuccccauuucucuccaaauucauuagcccuagaaaaccacacaucuguccuguagcucuaguuggacuauuuuuagacaugucaugugaauagaauuauacaauauguggucuuuugugucuuaauuucuucgauguacaagguguuuucaauacagauaaugucaaauguauagaucaaaugggaggaucuugccuuauuaacacauuaauucuucuaccuuugaaccugagucuuugaggagcuuauuuauaauuuuggcuuuuuaguuugaagaacacauguuugguuuuaagaaagauuucuucccgagugucuuauucuuuuauucauguuucuguaaauggaauugauuuuuuaacaauuuuugguuugauuuuucugguauguagacauuuagcugacuuuuuaacacugauugugguauguauguuaacgccgugcuggugugacugaauaugugaacaaagccacuuaaggagagaagcauuuauuuuggcucaugcuuucaaugaguuccuuccauuguccuuuggcucuguuucuaagcucaugguaagagaauaaguauaucauaguaggaguguuuuguagaagcugcucaccuuggaaaccaggaaucagagauaaagaaccaggaauaagcuauuaucuuuaaaagcacauuccaaugaccuacuuugccuaccuaggcuccaucaucuagaguuuuccaaguagcaucauuagcuggggagcagguuuuuaacauaggagcccauggaggacaucugcuccuugucuguaguacuugguaauauaacacucaauucuaacacuugcucaagccuucauuugggucucuguuugugaagugguauccucugcaaauggaaaucauuucacuucuuccuugucuggucugauuaguuuuaguuuuaguuauaugugcauguguggguauguacaugugaacacagguaucugaggagucagaggugucagaugcccuggagcuggaguacaggcugucgugugccauaccucacuaagaaaugaacuugggucuuuaggaagagcauuguacauucuaagcgccaucucacaagcccccuaucccaaaugucuuuuauuuuacucuaccaguccaaugucuagagccucuaguagaacaucagugcagugcacauccucagguucuuccugaccuuugggagaagacaucaucccauuuuuccuccccacugucuccaagagggugccccuuccaaccaggccuccccacucccugggaccuaagucucuugaggauuagacgugucuucucccacugaggucagaccaggcuguccucugguguauuuguguugggggccuuggccugguugguggcucagucucugggagcucccagguguuugggcuaguucuucuagccccaacauguuuacuuuuaaacaaauuaauacuuuuggauuuuuuguaaugucaauauacguuggagacaccccacuuuaaacuugagaugccugggacccuugaugacaagggagaaaaacuugccugggguaccauguuucagagcaugaggcuauggucucuugugggccccaguaugaguucagagaggucccaagguugcuucuuuggugcaagcaccucaugaugucauuucugcaauuauucuuaguacuuaccauuuuuuuuuuuuuuuaucuauuuacuguucuuucucucucuuccuuccuugauuaagccgguauuuggugaccuggcaagacauaguaggagcccgcuugauauccagaagcuagauguuaccaauaguauuaaagugaaggcuguucaugaguucacgagaaauguauguuauagucauucaauaauacaaguaaccuagagucacaggcagagaugaguaagucugcagcuguucacccagccuuagugucaauucuguauaauaaaaauaggauaguuuuaucauaaaauugagguuggaauaauauacagauauuucccagaaagucagcaauggguuccucggggguugugguaaaucucuuuccaaauaugcccuagcaaugaaaacacaacacaguuaauauaugcugugugccuagauugggcagaucuaccgcuauacuaccaucuucuccaucuaucggacuccuuagaacuugcaguuucuccaggcaaugugcuucugcuccucuuuucuuccuccucugcauccucuuccauuucuccuccuucucucuccuaccuucugcuccaccuucccuuuuuaucugcccaaucaucagcucuccuuuauuuuacaaauuaagguaggaagcaggaaaucaccugagugcugacucauuccuucuuugcagccacucacaggaggagaacagauuuaacaucaaauauaauuagccccagggcuauccacaacacucggguucagggaugaugguggcagccccguaggauuaagugaggcuguuuuuguagacagacagaugggguccuggauguuugaucuagauugcagauccaaagacugaaggguuagcaguaugaucucauguuuguccuuuuaugaaaccauacugucucauacaugucugagauacugacuuuguaaccccaauacugcuguccccaaccucaccagagacuggggguugggagauacaaaaaaaauugugcuugcuauaaaacuuuuauguuugagauuguauaguucccuuuuuucuguucuaaaucuguacuacucugugucauuagaaaauguuggcacaggaaaauagagaagcauuuacccacccucugugaacuuugggauuccaacuuccuuguaugauuucaauaaaagacuggggcugagucaagucuaggugaacccccugacuuccgaguucaagggcucccaugucaaaaaagaacagccugucaguauuguaugucaauuguacguuuucuuauucaccuaccagguaucccuaguccuugaugaccccugacucuugucgaagcuggacccugggaaacauaaucaguuaauuucccaaauucuauuaccuaacucugaaaugcaauuuguauuuugugacucaacaacaaaaacauacauuuggaauauguguuggugucauauuaauuugauuaaaaaauaauuacaggauuuaagauaaauauaugaauugauuuaaauaauuugauguacuuuauuuuacauuguauuuccucuaaaaacaauuuugaugaauuauauacugcucagguuuguucacaaugaagaaaaucacuuccaaauuugagaaauaaagcaguauuccaaguuaaacaaaccaaccaaccaaccaaccaaccaaccaacccaacaacccagugggccauccuuuugacuggaggauaaacuuccuucuaacugacucacgucuguguucacagauaugugcugacuagcaggcucacgugcacaguguggaggauaagcuauaucuuacaaaaugggauuugggagugaccugaagaacucacaggaagcuguguuaaaguugcaagacugggaacuacgguugcuggagacagugaagaaauuuauggcucugagaauaaagagugauaaagaauaugcauauacucuacagaaucuuuguaaucaaguugauaaagaaagcacugugcaagugaauuaugucagcaacguguccaagguaagaaugaccccacuuguuuuguauagggucacauuuguccuuugaacaaacaucauauuauagaacgagcauacccauggcaacuugcaguguuuuaaauuuucucuuaauacugucucauccgcauccucuaaaggaucuuucugugugugguguacacauguaugcacagaucggggcguauguaggugcacacaccugaacacugcauguggaggccugaggagcauagugguguuuuguauagcuuuccagcucaguccugaguuaggaacuugguuagguuugggcuuagccuagaugcuaggcugugugggcagcaagcuccugggauccaccugauuuugccucaaagccccgggauugcaggcacaugcggucaagucugccuuuguugugugagugggaguuggacccagguuuucaagcuugcacagcuaccaccuuucccuacuaaagcauuguccucauccccgugcccucuaaauuuuuaugugcuuauuuuagaauucuuucaguucagaauacauuuuaauguggcauuugauauuauuauuaacuguaguuaaauguauuauuugaccauuugcuuucuuuuuguuuuaucuuccuuuaauucuuuucauuuacuuaccaccuuuaauugagauuuucuuaaaauuaauuaauuaaaaguuugaggcaaggcauacguaaccuuggcuguccugaaacuuacucuuugaaguuugcaguagacaguacuuggacggccuaaaguuauuuuuauuuuuaaucucuacaguuuuuccaaccucagggugaagcuuacaaucaugaggugaaaggaagagguaguuuugucaagaacaaaaacgauaaaggaauuguacacgacccagugauucucagcuggggugcuaagaacacaguagagaggccagcuucuuaaguuaaagcgacaggaaaaccgcauaaccacacacugaagaaugaaaggcaaacauugcucaucagcuacaaaauucagcccacaaugaacuaaagacaaaugcgguuucuuacauagcuuugauuucucugaugcuugugugcaggucccauguuaacgaguaccugguacacaucuguuaggcacuccuuucugugucuuccauguuucuacuuagugugcgccuucuccuuuccuugaccaauaggaagcagucauagcaacuguucuaucaugugugcuacuuagugucauuccuguccuccucuccauagugcuggggauggaccuagggcuuuguguaugcuaggcaagcaugcugccucugggcucacuccccaccucagcuuuucuggauuagcacuucuccuuauuuugaguggcacuuugcuaauugucuaucuaguaguccuugcuuugcuuucagcaucuuuugagcuuguuggguguguuuguauuucuuuauguauucuugagcuuugcuuugggauguggcugaaucccuugcagacaguuugauccucuugccuuugcuuuuacauuuguuagguccaacuacagagugacuuucugaucacuuuaucuuuuuuaccuagcaacaucuuuccugacacucagaaggguccaguuauuauaaaaaugcgacuucugacuuuggaacacggccaugcauugugagcucuuggagagugucuugcagucuguuuuggggugguuacuuucuggguuuuaguaguuucugcacacaugcaagcugucuacuacucaccuuuauaacugaaggggauucucuguaggucuccagaauuuucucuguguuuguccuuguucuuucucuaggggaccacgaguuugcuggcccacuggauauuuuuggccccuuuguguuuugaagucacucuucucaacaggacauuccugggguuuugcuuaauugugaucuagacauugugaccuagucagccuugguaguguuacaauuuagaucauuauuuucucuaaggaaucauuguuucauuuacuaauaacuagugucuuuagagugguauuauuuuuaucuaguuauuguuucagguaacuggauaaauuaauaaauauuucuccauagucacagggaauguaacaauuuacaaguuaguuaagaauacauuaugucucuuuauuccaaaauauuuguacauguguuuucuaagacuaucuucuauauaaugagucaaaauguaguaguuuuguuaucuugcauauuuuuauauuauuuuuuaguuacauuacauacuauuguuaaagaugaauuucuugggcugguaugaugggucagcagcuaaaagcacuugcagugcaggucuaacaaccugaguuguuagaucaguccauggagccaauguaaaaagcugaguguggugguaugcaucucuaaucugcagugagaugggaggcagaggugugguaauucccuggaugcagacagccuggagugcagaggcaugguagaagcaaggagacacugcuacagugaggugggaaggaggggccagcuccucagggucauccucugguccccacauacccccuucuauagucaaacaugacacccugcccugaccuagauagccagcuuauccagcaguccugguucuacccaaucagcauugacaucacaggccagauuccucagcucuuggcuuuuauguggacucuggggaucuaaauuccagcugucuccaugucuguguguaagagcugucuccuaacccuucaaaucuuguccacuguuccaguauuucagucauuucauuuaguuuuugucuuuucaaugaacuuucauuucaaacauaaacaggagauacaguguuccaugauuuaauuauuuucagcuuuuacuuaaaguuguuuuugaaguguguauaugcugucuuuauucccaagggcacaguuuuguauggcucgcuuuuucauuuguuuugcuuuugaaggacuauggauggcuggagguggcagccuaagcagccaucuuugcuuccaucuguugguucugcuucugcccguuaagcauuuuggcauggcaagaacucccaggcuugucuggaacuguccuuucuacuacccugaacuagacuuuuccuugagaggccaauuaucguuggaagagauauuuuagcauaaaaccaguuuagaagcucuacaguguuucacaguuucaaacaauguuguaaaagugcuauuacauagagacauuuuuguauguuuauguguauauaugauaaauucauagacaugggcuuucuaggucaaaauaugaaugaauguauaguuucauuauauauugccaguauaaauauaaaauucccuauagaacuuguaccauuuuucauauuuaccagaucuguaugagccugccaguuccuaacacucacacuuuaaguuucugugaucuaauaaauacuauagaauaucuguuaucucuaaaagugagcauaaugaacuaccuuuuccauguguuuaagagcuaguuuauuuuuuaauuuauuuuuauuauguguguguguguguguauauauacguguauguguguguacauguacauguguaugcagguacccaaggaguuuagaaagggauguaggguaucuugggacuggaguuauagguguuugugagcuccuugcagugggugcuggcagccuaacugucguugucuguuagaguagcaaggacucuuaaccacugagcauucucuuuagcuacuguggccauuuuauuuacuucuuuuguuuuacucuguacgguagaucauuuuuacuuuguguuuuguuguucauuaaaauuacaacuguccaaguauauucaacacugguucuacacauuauagugauauaagaaauccucaauaacaauuuauuugaaaggagauacugacuaauccuuuaaacacaaaguauauagaaauauuaggaguauuuauauacuacauugaaaaaugucuuuuggaugaucuagaguuaauauuuaauaacuguauaaaacauuguauaugaaauauaauuauuauguauaauaauuaugcaauacuauauaauuuauauaacucucaggauauagaguuaguucuuauuuaauauuugcuuuaaaauaugaauuugguauaacccaagugauguguuaugggacaagugagccugaugugcguuuccuccuguauggcaguggaggaaguacugugugagugcaugaaugguacccaauugaacucaguugcuuagggugcauuucaguugaccauugcaguccuuugcuggcuaccauugcuuagucuuucauugugagccaaacucaccugcauguggacuguagcuuggucugcugcuuuagguaaccucuucucccacuuccaggacccacaggguguaacccuccuuccuugacaggaauguuucuagucaucugauauaaaaugccauggucauuauauuuuuuaaucacuuaauauaugugaaguuguauaaaguugcuguaauuuuuaauacauuccugauuaauguuuugaaugcuaugcaccuaacacaucuauaaacccugugacuuuuagcauauaauugauacaauaaagagauuguuagugagacaaauccuuuguuacgacagaacgugggcaguggaauuacuuagggagcuuuaaagugcugacccuaugcucugugugagaagcaugcuucaucuggcuuucuggucaugaauccccaaagugauauuucuaaaagacucaauuauuuaugauugcagccagguuagagaugggcuggagcaggguaaccaauuugaagaaaauguagagaaguuuuuaugagugggccacaucuaaagauuccuuuguacuuggaguugagucuuugaaaacucuguuuuauggaaauuuaaugaguuguuuucuggauuucuguauccccuaaggacuuagagacucccgcauuuuccuuauguaauaggcaaacucaaauaaaaauaguugcuuuagaggaucauuuauuuugaguuauuguguagugcagaaacuaugcauucuucauggaauuuuaauguugaguuugugaaaauauucaaccaagaugaaagcaaucaaguacauggaggauauaaucuauagcacaaagcuauuucugacaguuauuauuuagguauuuucaagcuugaaucaucuuguugagaacccucagugcuuugcuguaauuauaggcccaguaguaguuguucuuuuacucaguauccuagaauauacacuucuugguauaauaagcccagaacacuucaauuacuaccuguucugagaagcugauucaucuuaccacuuaucugccagcucaaagguaaggcaagaaaggacgugugcuucucuaaaagguguauguuuccuuuuaaaaaugauaugugcaugauugcuuuagccacaauuaugucugugcaccaugugagccccccagaagguggagaucuccuggcauuacagaugguugagagcuauaaugugggugcugggaugcaaaucccuguccuuuggaagaaucgucaguacucuuaacugcacagcuauugccaacccuaaaagguauacauuuucucucucucucuaguuuuuguuuucaguaaucugagcauauaguuuacuuuguaaauguuauauagucagccauuuuaguguaguugauaccauuggccucuauugguuuccaaaggaaaaaaaaaugucauuuuuaccauuuauguugguuauuuuauauaucuugggcuauacuuauuacaugcaauuaaucuuuuauggauaguuggggggcaugaaaauuuucuaaauugaauuuuuuuuaaaggcaauauucgguaaauuuaauuuuuuacuacaaaagaauaaagacugcaaaauauuuaaaaaucagagauuuaauauaaaaguaguauugagucaguauuuuaacuauacuauuacaaauucuuuauaauguuauaaaauuaaaaaaaaucucagacuaguauuuuguuuucuuggggcaaaggaaagugugcgcuaucaguaucucaaucuuaauuuggucuuguuccuaauuauccuguguuggauuuggauugguuagauaguuucauuccuuaaauacucucaaugagauuacaaaggcuaccauuauuucuaguuaguuaaaaacaaaguuacugggagaugugucuuucauuuucaucucuguaguuuuguaacaaaucauguccugucaagagugacauaaaucuggacuuaaaacuucuucaguuggauguaaucauguuagaaaguaguguucugaaguaguggccugcaaguaguucaggguguucuccuuugcuuuagucuccaauacagugguuaagugcaggguaaacaguaaagcuuacaguuuacuuuguaaccacuuuagaagguuugauuuguuuagcuuacguauuuguuuuuguuuguuuuugagacaagaucucauguagccuaggcuguccuugaacuugcugugugccugagggugaccuugaucuucugauuuucuugccucuaccucucaaaugcuggggucaagggcaugcccugccaugcaaagccaugguagauuuucauaaaguagucaagaaacaagguuuugcacuccuuuuuaucuuccaagcuucaaguuuuaucaugccuagcccauuaagaaauaaauuuauguuugcauguaagucuucuauuaguuaugugauauugaaugggugacugucaguuuauaaauuuauuagaugaaguauuugccuaaucauauuauaaaaggaaugaaucagaaagacugugagcuggcagaaagcaaguauuaaagaugaggagcucagagucacuuaaaucagagcugcuuaaaccugauucacuuguagcuccucuuagucugagaaauuuucaugugaccuggguguauaguuucauaaaggagguacacaaaucaaacauuuacagauacuaaaucaugaaaaaauuuauuuuaaagcaauccuuugguauauauaaaauuuuauauuaauuaaacaugaaagcaaauuuaaauucuuagaugaaugaguuuuuguuuaaaauagaaauuaagucuuguuaggauauagaacaaucuuuucagcauuugcuaaucuaugaaauuauauuugucaaugcugagagcacuacuuuaacaaauaguacacaaugggagaaauauguauaggauaauuucagaaauuguuguaaauugucuuggucuuaagccauaauucauugaauaauauuuuuaugagacucaaaucaggagcaaacagauuugaaaccaagcacuuuacuuauucuaauaugaaagcaauuuuauagacauaugcugaggaaugagaggaauaucuucgucuucauaauuaaaccauuguuucuauaagaggcaaaaauuuguaugugaaguauaauugcuacaacucguagcauacaauaaucucgaagcugaguuuaggcauuucauuguuucuagugggaauauguguagagacggcgugugcaguaugguguauacaugucauggguuuagaaccaagggcccuccauggauacugcucucagcaauaccucagucauuaauaguuuguuuuugguugguacauauuuggaaagcuuuugcugguguguguuuguaugcaugcacauggguucuugagccacaguuuaaggagcugagauuuagaugguagaaguuagcuuuaaaggagugagggagagcagauuaccagcuugagugcuccucuaaagagccugcagucgaaaggucucccaggagaucuacugcaugcagggcaacagaucagcagcuucucugccccucuaaagaccccacagucugaaggcccacaggagguuuaccacagccagggccacaggccuacuaggagaccugcagcaacacagggacauaggaggcaagcuccauacacucaaaccagcuaacaucagagauaaccagauggcuagaggcaagcucaagaccauaagcaacaaaagccaauauaguuuggcaucaucagaacccaguucucccaccacagcaagcccuggauacaccaacacaccugaaaaaucaggaagcugacauaaaauccuaucucacgaagauaauauagucccuuaaggaggauauaaauaacucacugaaagaaauauaggaaaacacaguuaagcagggaaaagcccuuaaagaggaaacaaacaaaucccuuaaagaaauacaggaaaauacagucaaacagggaaaggaauugaacaaagcgguccaugaccuaaaaguggaaguagaaacaagaaagaaaacacaaaugaagguaacucuggacaugaaaaccuaggaaaaggguuaggaauuaucgauguaagcaucaccuacacaauauaagagauagaagagagaaucucagguguagaaaauacugaagaagauauugacacaacugucaaagaaaaugcaaauagccccuaaucuaaaacauccaggaaaucuaggacacaaugaaaggaccaaaccuaagaauaauaguacuggaagaaaaugaagauucccaauucaaagggccagaaaacaucuucaauaaaaucauagaagagaaccuccucaauguaaagaaagagauggccauaaauauacaagaagccuauaaaacaccaaauagauugggucagaaaauaauuaaaacacuaaaugcagagaacaaagaaagaauauuaaaagcuguaagggaaaaaggucacaacuuauaaaggcagaccuauuagaauuacaccagacuucucaccagagacacuuagagcuagaagauccuggacagaggucaugcagacccuaagagaacacaaaugccagcccaggcuacuauucccaguaaaacucucaaucaacauagauggaaaagccaaaauauucuagcacaaacccaaauuuaaacaauaucugucuaccaauccagccuuacagaggauucuagaaggaaaacuccaacacaaggagaauaccuacacuaaagaaaaaagcaagauauuaauaaucucucaauaaagccaaaaggagagacucacaugcacauaauacuaccuacagcagauauagauaucugucuuuaauauuucucucuaucaauggacuuaauuccccaauaaaaagacauaagcuaacagacuggacacacaagcaggauccagcauuuugcugcauauaagaaacacuccucaaugacaaagacagacacuaccucagaaaaaaggcuaggaaaaaaaaaaucuuccaagcgaaugguccuaagaaacaagcaggaguugccauucuaauauucaauaaaauagacuuucaacuaaaaguuaucaagugagauugggaaggacccuucauacucaucaaagaaaaaaacccaaccaaaaaaaaaaaaagacucaguucugaacaccaaugcuccaaaugcaagggcaaccacauuaaaaaaagaaacuuuacuaagguucaaaaaacacauugaaccccacacaauaguagugggagacuucaacaccccacucucaccaauggauaggucacugaaaguaaacagaggcauagugaaacuuuagagguuaugaaccaaaugcauuuaacagauagcuacaguacauuucauccuaaaacaaaagaauauaccuucuccucagcaccucaugguaccuucuguauaauugacccuauaauuggucucaaaacaagccucaaccaauacaagaacauugaaauaaucccaugcauuuuaucauauuacuacagccuaagucuggucuucaauaacaacaauaacaagagaaaacucacauacccaucgaaacugaguagcucucugcucagugauaaguuagucagggaagaaauaaagaaaucaaagacuauauagaauuuaaugaaaaugaaggaacaucauaccuaaacuuacgggacacaaugaaagcaguguuaagaggaaaauucauaacacuaaguguguuaugaacuaacagauaaauaaauuggagagauaccauacaaacaacuuaacagcacaccugagcacucuaaaacagaaagaaacaaacacauccaggaggagcagauggcaggaaauagucaaacucagggcugaaaucaaccaaauagaaauaaagagaacaauacaaagaaucaacaaaaccaaagcuaguucuuugagaaaaucaacaaaauagauaaaccccuagccaaacuaacuaaggggcccagagacagaauccaaauuaacaaagucagaaaugaaaagggagacauaacagaaacugagaaaauuaaaaaacaaaacaaaacaucagauucuacuacaaaagccuauacuuaacaaaacuggaaagucuagaugaaaaguuauaaaaguugcuauugcuauuuacacuuuaagacaguauccauguuuuuguuauaaggguuuugaugcuuuaaauauuuauuaaucaacuaaaagcaaccaacuaaaagggauguuaaugaauuaauuauaucaauuuuuuguuaguuuugagacaaggucccaaauuguaguccaugcuggccugacucgcuauguaguucaggcuggcuucaaaccugugacaguuuauauaccuuacccuucugugugccgugauuacagacaggagcuaccaugcucagcuuguuaaaguuuagaucuuaacgaaggaauacuuguguuuuaaauuacuuuuuuucauagcgcacauaucaugguacaugcacaucacaguuuucugccuaggauuucacugacaucugaagcauuuguacuugaggauguuggauacaaaucuuuccuaauucauuguacaguuuugcaaaaaucuacuauuuauaauguaaaaguucuuauaaaacuaaacauuuauaacucuugaacauuuaaaucauaguuaagugggaacuucuaauacaaaugcuaauuuauuauuaucauuauuuuuaagucuuggcuacugaugauucagcagacagaacagcuuaguaggauaaugaagacacaugcagaggacuugaacucuggacccuugcacaggcucaccaugaugaucaaggacaagcagcaagugaagaagagcuauguaggcauucaucaacagauagaggcagagaugaucaagguaugucugccuggauuuagugccuuuuuuauauuucuuauaaaaccuauguuaauauuuuguucugucugagcuuaaaguuguuauuucugacaagaaguguuuguugugguacuuuauuguguacagaauguuacugauuauaagacgucauuucagucccaagaaagagaaaauacacugaccauuaaacggugccucggaaaucuuauaauaacguggaauauguaaauuuuauuuacugaaauaguuuuuagggcgggagagagggcucaguaguuaagagcacugacuccugcuuuucuagaagauccaguuuaauucucagcacccacauggcagcucacaagcgcuguaacuccagcucuaggggaucugauuuccucuucagccucugugaacucugcaaguacaugauacacagacacacacaggagcaagacauucauauacccaaaguaaacuuuaaaacauaaaaaagaaauagcuuuuaacuugugugugugugugugugugugugugugugucuaugucuaucuaucugucugucugucaguuaauguauuucugagugucuuugccuuuagcgcuugucucuucuggguaauuucuuaacccuuguguuacagagcuuccaaacagaagaaaagacuagcaugucugcccuguagcugucaccaaaguucccgcucuuuuguuuuauguacauucacauucuuucccuguauugagucauuuaagggaaacccuugauaucauuuauccaaaaccauuuuuaccaccuauugguaauauagagauuauuuuuaaaauuaaaaacauucugauuaauccaccuaaaaaugacagauauuaaauguuauuaaacacccuauauggguuugcuguagcugggauguaaucugacacauaaguugcauuugaguaauugcucuuuaguuccugggugguucuuucuguuuauuuuugaaaaauaccauuuacuaacuggauaaaugagauaauaugcuauaugcaauggaaucccuuaaauuuugaguuuuucuuucuuucauucuucuguuuguuuguuugaaauauggggcuggcuuggaacucccucuguagaacaggcuggacuggaacgccuagagcucuggccugcccugagugcugggaaguagaguuuuuggggcaccaggauagugguggaugccguuacuccuagcacuugggagguggaggcaguaguacagcuuggucacaugguacuuauggcuguaguuuuuuugagaaaccuccugaucggcuuccauccuggcugucuccauuuacauuucugcaguguacauuuugauuuccccuaguuaauuucucaggguuuuuuuuguuguuuguguauaggaaggcugcugauauuuguguguuaaguuuucaugcuuccacauugcugauauaaaaucauacacucuuuugcagguuuugaugcuguccuuuucuuaucuuuuagaugguauauuagaagauuuucagaugaccaugagucaaguuugccuuuaucuugcaucaugauaguauuuugacuauaggucaagaagguuguuuauaauuaguaacucaguucuuguaagcuugcacugacuuacauaaugacuuuugucugacagucagugucugucucugcaaauggaaaauuccuaucucagagucacuaaaauaugaagaacagagcaucagcaauaauaaauaaaaacaaagguauuagagcugcuaauguaaucuaaaguuucuguccauuauuuucaucaguuuuauacuuacagaaaauaccaccugaacacaucauauuaauuuauuguuuuaaacaaucgagacuauauuuuucuuuuaaagaaaaauauuuguuguucaauaagucaguuauuuuguacuauuaaaauaaaaacuuuuggggcugaggagauggcucagcaguuaagagcacugccuguucuucagaguuacccagauucaguuaccagcacucucauguuaguucaugauugccuguaacucuggggcaucugaugccaucuucuggccugcacaaacacuagccaugcauucaguauacuuacauacaugccagcacucacauauacacagaaaugauuuuaccaaauggacaaacagaaacccuuuucaguuugcucuuuaauauuuuacagugagugaaauuuaccaucgcuacuuucaaacuguucacagcgcugaugcugagcgaauucuucucucccccguccucuuccuccuccuccuccaguacugcucuuuguucuucuuggcaauuauauuucuacuucuacuuucauuucuacaguuugaaacaugugcauaagggaguuuacaugacuauauaaacuuuaagaacuacaaaugugagaaaacaugaaucugagcuggguuaauuugcuuaauaugguuguuucuauuuaacaccauugccuuguguagauaacaugacuucauccuucuaucugguuggaaagaaguucauuguguguauauauaccgcauuuccuuacccaguucuuccuucuuguacacuuaccgugguucuguuuagcugcugugaauaauuucacaacaaacauugauguguaaguauguucuugacauguugaauaggaguccuuuggguaaauacccaggagugguauaugugggucagauuguagauauauuucuguuauuuugcaaaaccuccauaaugauuuuuacagagauuggauggguuuacagcuccaucagcaguguacaaggguuccucuugguccauaucuucagaaucacuugcuuuuguuuuuugccgcuuugacuggggcgagggcgaaacucacuguaauucuuuaacagaggagauauagucuuuuauuaaggagaagcaaaaaagcacugccaggacuucgguaaugcugcagggagcaaugcccucagugguugaugcccucggugguugauuggugccccuggugauugaugcacucagugguuugcucuccucugcugguugcacauuuccuucuucaugauaccggacauuuuuacuucaccucugcuaacuggccauuuauuccauucuaucgggccauuuauugauuggguuauuuguuuuguuucuuacuguucuuuguacauccuagacauaugucagauguauagcugccaaaaauuaaauaaaagguacauuuuaaagcauagauguauacauugaaaauugaauucuuagcuuuuggauuauaaaugauuuuuuucuuuuuucuaacauuaaaacguuuugcgauuauaauguaauugcagcaucucuuccuugccucuucccacacucugucaugugcuccucccagcuccucuccaacucaugggcucuucauuguuagucacuacugcaugcauauauguauguacauauacauucccaaacauaaccuuuccagcccauauaauauuauuuaaauguauauuuuuagagcugaccauugccaaauggaccaccccacuccuguaagugcuuuuuggcuucuccuuaaucuaacacauuuccuguguuauagaacuaaguguagucagaagagugguuauggagaaaggagcauacaugugaggauauggccuguaggcccuuauacccugcuuauacccuuacauacugcccacccguccuggacuucaggcucaaguuaauccuggaagauggggaggaaagaguguaagagcuacaggaucaguguguuugcuuugagagugugucuccugguauuguguucuucuugaucugucuuuugaaggaaguucguguguuuuuacaucauauugaauuuaucauggauuuuaaaacucauuuuuaguuauugucuguaauuuucuggcaaagaguaguugucacuucugaaucauaaauauacaucaacuaaugcuuuagaauguaaacuauugaccaauuuaaauguaaacacuuaaauuuuuuuuucugcauauugugucuuugacaggucacaaagacagaauuggagaaauuaaaauccagcuaucgacaauuaauaaaagaaaugaauucugccaaagagaaauauaaagaagccuuagcgaaagguaugacaacaucagaaaaaguguucagugugauggcuucuauuuggucgucuaauagacaucuuuguaagcagaauuauucagcccagagcaguuuacauucuaaaaaucucacgcucugucaaaaugggcuguugcacugcugcaaguucucuguguauuaagagauucugaguaguucacacgaguggagauuguaaaauugguaaaggaugcacggaauguauauguuguucuuacauucacuuaauuagauaguauuacauuuacugucucuuuuuuaauuucaucagcucuuuauagaaaaaaaaaugaauccauguuuacaguuugcuuuuuauguucuuccaugcaccuuaacuacuuugagauuggcauguccuaauugauuuauaggguucuucaaauuucacauacaucaucauuauuucuuuguauuuuaaagaaugauuuagguacagagagcauuccuuugagugcugagacuucucuuagcccccaguguuucuuguuuucuaaucugucagcagaguuaacuugguaaagugacugcuucuuccuuggcaguuaguuaauuacguuauaaguccauaugaggaccccagcgccagugaugacuugacugacuguagcuggacucuguugcucaagugacucucauaccugcuggagaaugaguaguaagggaaggcacuuacuucaucaccagucgucgagaucuguuucuaaugauguagaccaugugugcuuaaacacaaagucuguugugauguuaugacuuuucacuuaaugcuugucauauagagauaugcucacaggagauucuucugagccuggugaaacacagcaggagggaggcagugggcucgucugaagacagugcuuuuaacucccuuccucccucccuccuucccuccuucccucccuuccucccucccuccuuccucccucccuccuucccucccucccuccuucccucccuccuucccucccucccucccuccuuccucccucccuccuucccucccuccuucccucccuccuucccucccuccuucccucccucccucccuccuuccucccucccuccuucccucccuccuucccucccuccuucccucccuccuuccuucccucccuccuuccuucccucccuccuuccuucccucccuccucuuuucuucuccauguuucucuuucauaccguucucugucuuguguuggaaccagggguaagugcuuuaccccucuccgagcuguaccccuaaccccugagagacucucacagacacauguuuauacauucuaaguucauacugggagaguugaaaccguguguguaugugugugugugugugugugugugugugugugugucugagugugugugugaguguguaugagcauguguaaaugcauaugugugauuauguaaguguauguuuaugugugaguguguaugaguguguguauaugugugaguguaugugucuguguuuguguguguguacauggguccuucgagaucagaagacagcaucagacccucugcaacuggagcuacagggaauugugaaccaccaagugagcuggaaaccaaacucaggucuucuuaucugcugagccaucucauuggcucugacaauucauucuucuuauuuaugagaguuauauucuuuaaagacacugaaaacagaauuagugacuuguugcucaaggggaggaaaaggcuuaauuuauacaagcaagauuacauuuuccauaaucuaugaauauauaccuuuauuaucuauguuuguaugacaacuuguuuaguguauauuuuucaucauuacgaccaauguacuuuuauaauuugugauuaagcaaagcuuaucuaauguaaguguuaacuguaaagcacauuauagccuguguacaggagcaguagguaauguuagacaguaaugagaagauuaauaaauagcagauuuagcuaaggccacugauagcugugaagcugagugggugaaaacugaauguaugaugccauauugacgugcaagguuuucucugcuuagugauuacaaaggaaaauaaauuuaugaccuuacugagaaucaaaagcuuaagcuaccuuagugcucaugacaauuguaauaacuacaaagaaauacaguuucuugagcucaucguccuggaaggcaucaacauugggcauccccauu

SEQ ID NO: 8699 - RNA, 2024 nt, Mus musculus
aagagggcagugugagggcuugaguucaaagcaagccagccuaccuaaauagauacccauagcacugugaaaacaugcucuccuuggugguucccaaaguagccuccuuccuagagaaccagacauuacccccuuucauguuuguggggaauuccuauagcaucagaauaaguauguaauaaaugcuauccagcagauccaagacugguacaguaagaagccagguguccuucuguagccaccagcacacacccaaacuccgccuccuauuuucuucuuguagcacugacuugccugacaaucauuacagagcaaaccgugagcccgucuuccccaaggcucuaaguggccuguguuuggaaccuuguggggucaggaggcuaagagagaaucagacagaauuguguggauggauacccuguguaagaaaccauccuuuuuuagcucaccauucuauguguuuucuuucuuaagccaaaaaucaucuuauuuaagaauuuuucucuuacaaagaauuugguggggaaaacuugcuaccaacucauaagaaaugccagacuaguguguacacacacagggccaggaagcaagcucacgccucacccaggggauggcuguacuuaaauuggauguggggugcugaggaggcccaucccauguuaguuguaauugcucuccuggaggagcauugaacacaucccaguggaggcguguugacucagugucagugagacuaucccacaccuucagcagguuacugcagcuauacaggaccauccagaggcucugaccaaaucaaacauaaacagaagcucauuugcuuccaauccaugaccaaagcggccagagacagaaaaacgcccuuccgucugcuggaauuucacucugauaacacgucuguuguuaacugugaccuguuaagaguucuccauguggacacaguucuugugggaugguuccguuagcauccuccuucaucaaccaccaagacugccuguggaaucagcuucuguagucaaacaccugaagagcccauguuuaaaugccuguagacuuuauguuuagccuguguuucaguguguaaacgauugagcagcuggggaccgaggauggacggugguacacauucuguccucuuugcacuuuaguuuguguguaagcuucuguguuuggucugggugcuuuuggcgaguccacuugugcucuccaaaagcacgaccacgcaaccacgccgaguuuaagggucccuggaaguagcagaaaauaaaagcgagcucucggagacccacgaacuacuccaacuuccucaggaguccaagccaacuaagcacaaaaacaaaauacucaccuggugcccaggcugucagcccacccguguuccuagcacaggcccccagagagcaggugcagaacuaacgcuuuccgagucguuugucugcuuguuacuagauaagcucaguggugagagagauggccagccaccugcaggcgagguguuccaucuguaaucagcaccuugagccaagcaccucuguggcucucggaguuaauucagugccaguggauggccauuucaaugucacguugaagcaccuuuaauguuuuguuguuguuauuauuuuaaaauaauguauuugugaaguggauaaaagaaacacuggaaaccgggugcuucugaaaacaucaaguauaaaacaugaacaaggucuguggugcucuauccagcugugcaaacaacccugaagauggguggagugguuaguucucugcuuuggcugauugugccugagaguguauuuauuuguuaagccuuacguucagaagaaauacaccuugaauuuuggcuaacauuauagaacguucugaaaauugccuucuacauuuuuuaacacaauuuaaucauuuuuauaaauuaaggccacuuuuggacagccuucuuguaccagagaccaauuaccauccguuggucugcaggccucuuuuuauuauguccuuguaauaauguaaaauauuuacagcaaacu

SEQ ID NO: 8700 - RNA, 2024 nt, Mus musculus
aguuugcuguaaauauuuuacauuauuacaaggacauaauaaaaagaggccugcagaccaacggaugguaauuggucucugguacaagaaggcuguccaaaaguggccuuaauuuauaaaaaugauuaaauuguguuaaaaaauguagaaggcaauuuucagaacguucuauaauguuagccaaaauucaagguguauuucuucugaacguaaggcuuaacaaauaaauacacucucaggcacaaucagccaaagcagagaacuaaccacuccacccaucuucaggguuguuugcacagcuggauagagcaccacagaccuuguucauguuuuauacuugauguuuucagaagcacccgguuuccaguguuucuuuuauccacuucacaaauacauuauuuuaaaauaauaacaacaacaaaacauuaaaggugcuucaacgugacauugaaauggccauccacuggcacugaauuaacuccgagagccacagaggugcuuggcucaaggugcugauuacagauggaacaccucgccugcagguggcuggccaucucucucaccacugagcuuaucuaguaacaagcagacaaacgacucggaaagcguuaguucugcaccugcucucugggggccugugcuaggaacacgggugggcugacagccugggcaccaggugaguauuuuguuuuugugcuuaguuggcuuggacuccugaggaaguuggaguaguucgugggucuccgagagcucgcuuuuauuuucugcuacuuccagggacccuuaaacucggcgugguugcguggucgugcuuuuggagagcacaaguggacucgccaaaagcacccagaccaaacacagaagcuuacacacaaacuaaagugcaaagaggacagaauguguaccaccguccauccucgguccccagcugcucaaucguuuacacacugaaacacaggcuaaacauaaagucuacaggcauuuaaacaugggcucuucagguguuugacuacagaagcugauuccacaggcagucuuggugguugaugaaggaggaugcuaacggaaccaucccacaagaacuguguccacauggagaacucuuaacaggucacaguuaacaacagacguguuaucagagugaaauuccagcagacggaagggcguuuuucugucucuggccgcuuuggucauggauuggaagcaaaugagcuucuguuuauguuugauuuggucagagccucuggaugguccuguauagcugcaguaaccugcugaaggugugggauagucucacugacacugagucaacacgccuccacugggauguguucaaugcuccuccaggagagcaauuacaacuaacaugggaugggccuccucagcaccccacauccaauuuaaguacagccauccccugggugaggcgugagcuugcuuccuggcccuguguguguacacacuagucuggcauuucuuaugaguugguagcaaguuuuccccaccaaauucuuuguaagagaaaaauucuuaaauaagaugauuuuuggcuuaagaaagaaaacacauagaauggugagcuaaaaaaggaugguuucuuacacaggguauccauccacacaauucugucugauucucucuuagccuccugaccccacaagguuccaaacacaggccacuuagagccuuggggaagacgggcucacgguuugcucuguaaugauugucaggcaagucagugcuacaagaagaaaauaggaggcggaguuugggugugugcugguggcuacagaaggacaccuggcuucuuacuguaccagucuuggaucugcuggauagcauuuauuacauacuuauucugaugcuauaggaauuccccacaaacaugaaaggggguaaugucugguucucuaggaaggaggcuacuuugggaaccaccaaggagagcauguuuucacagugcuauggguaucuauuuagguaggcuggcuugcuuugaacucaagcccucacacugcccucuu

SEQ ID NO: 8701 - RNA, 51061 nt, Mus musculus
cucugcuuccgccgccgccgccgccgccgccgcugcagccgcugcgcguucggcgggggaggagucggaggcggagaagaaggcggugguggcggguggaggaucgagcgcuguucucgcucuggagccgcugcacaucucggugagggcaauuuuuauuuuuuucucucuccauucuggcugauucugucagagcggaucugggugagggagccgcugcccaggcgccucggcuucgggggucuccgaggaacggaccgagccguggccggccauggugggugggguuggcgacugagaggccuccggccaucccgcccggggccgcgcucuagcccgagccgccgcgcccgccgcccgcucgcucccgccggcugucugcuguccuuggugcccuggucaaggacccggcgccuugccccucgcggcccgccagugccgcccacccucaggcccgccgcggaggaccguggcgcacuaggccugcggggccccugcccggcccggcacggcacgccuuccaucccugccucccggauuugcguccuccccgauugucaccgaggcccaggcacccugucaggcagugccaguggccuaccgucuucuuggucagcguuaggccccagcacgccugucagaggcaccuucagggcuccccuccccgcccccacccgcaccuccacccccaccccaagaugccuccagguuuaucauuuuuugcgcacauuaaaaauggugaguugaaagcugcccagaccaaguugaauaaaauaaaacaaaaaaaaaaauuguaugucuacauagacaacugcuuugacgauccucauucugucaaguauacgauucuuuuuuuuuuuuuuaaagaggccuuacucuauuuuuaucacgaaauauuugcuauuauuucuuuuaagauggcagucauugcugaagacuuaacaggucauuugaugaguguauacaggaacguaaaaaaauaacagaaauaaacguaacauguuugugauugucuucuggauuucaugucuuuuuauaugaaauaauuuuauucuucuauuacagacaugcacccuccguguaaaauucagcaguauaaagagagaaguauuaaauaaauacuaauaugugacuauuuucauccuucagugccccaccaguauuucgguuugguggucaucuuuccaagugcuuucacaaacgcaucuugaaagauacacacacaugcagaguugucuccuucagggaugggggugagggcuaugcugagcacauuuguguaaagcuugcuucuucuaauuauauaucuuggacauagacucccguuuuauguaggccucccuaauacuuuuucuaucuaaggguacauccuauuucuuuaauuugauggacuuuaauuaaguauuccuacugaaagccguuucagugcuugcaguugaaaguuaugcuuuauacuaaagguaacuaacucacguauugauugauugaugcugaacuguaagcucugaaucguuuauuuuagaacauuucacgguguggaagacuguaauguaaaaagagcagcccccacuuugccuucuaguauauugccucuaucccaagacucagacacuguuuuaauaagggggaaaaaccugugugaucauuucuggagcacagauccagacguacaguugcagaaguaaaggguaugaguauuuaaaucugacagccaucuaacccuuauuauuacucuuuuuaaagauauuauuacuauuuccugaguguuucuucuagguggucuucagaccacuugugaguuaaaauuuaaaaacccuauuuugaauaagauuacacauaaauucuuagaacuguuuuacagucuuaagccccuccccaaacuguucucaccauuuuauucacaucuugcuuuauauuaaagcuuuaguuaccccucauauauaucauuccuuuucaauauucccagcuccuuuauaguuguauugcuguaguagaugaaaacuuuaagguaacuuuguuuuccugucucuggcaauaaaaaaaagcuuuugauccuugccaccccccccccccccguuuuucauggagcuaauauuuguauuuacuugacaauuaucugaaaguauuuuuuugguuuccuuuccaguuuuuaugacauucugacauugcauugccccuuaggugcuacauauuguugaguaguagggcuaaugcuacuaagacuagggcuaauaguuaaaauaugucacuuuuucuuuaagguaaaugcuucugagguuagcauuaaauaugauuuuucacaaagcuuuuuaauagucaauauuagguuaaaauaugcccuucuguuuuuagcuugcccagauaauguuuuuguucuuauuuuuaaaaacauuuacugagcgugugugugcacauguguguuguuacagcaugcuuauggagaugaaaggacaacguaugggaguugguucuucugucaugggcuucaggauugcauagugucaggcuuuguggcaagcacccugaccuaccugcugccucucuggcuccucuugcugucauucuuaauauuuauaaaaaaguaguggagguuaaguuuuuuuucuuuuccuucuuucuuuuuuuauuuuuugacaucuuuucaacuauauauaugguuccauuugggugucacuagugguucuuauauacuaguuccuuaaaagagauuaucuuuucaaaaagucaacuuuuuuaaauuagagaguaaauuagaauuaaugaaauguacuuacuuaagauguacaucucauuguguuuucauaaaaguauacuuuuaugucucucucucucuauauauauauauaugcacacacauuguguguguguguguguguguguacauauaauauauaacauaggacaauauuuucaccucucugaaaacuucuauuccuuugaggucaaccagacuuugacccugagccccgggaaaccacuuaccuuucucacaguauacauuguuuucccuuggucuacuauuucauauaaauguaauuauuucuuuuguaucugcuauuucccagcaucaugcuuuugaagaccauuuguguguguguguguguguguguguguaaaacuagcuucuguuuuuugugaaguaguucaugauaguuguugauuuacuacuguuuuagucauuuaaucaauguauuuggguuguugcugauuugggguuguuauuaauaaaggugcugugaacauuuauucugaguucuuaugugaauugaaacauuuuuuaaccuggaaaaucucuagauguaguauuuauugacuuauauagaaaaugaauguuuaaucauugucucauguuccuugucugccagugacacacagcaguuugccuuacccacacccuuacacccuucuaguauauguauaguaguuuuacuauaucacacuggcuuuuauuuuuuguucacauguuuguuaucuuggucuuuucgaaaagaaaucuguuuuguagcugaggcuguaaugaacucaaacuauguaguucaagcuagccuugaacucuuaauccuccugccucaggcuucuggcuucugggaucauuccugggacgcagugaauuuuaacuuauauuuacuggaugacucaugaugcugauaagcuggucugugucuucauuuguaaaugcuuucuucagaucuuucagccauuuuaaaacucagguuauccuaaugaauuuuaaagcuuuuuaaauauguuguuuauauggcuacacugacagacaugaaacacacauuucaauaugaagguuuuuauguuuucuuuauuuccaaacuauaaacaagaggaggagcugaagagauggcucugcagguaagagcaccugcugcucuuccagaggacccaguuucaguucucagcacccacauuggucugcucacaaaugccuguaacucuagcuccauggaaucuaauguugucuucuggcuccacagguaccuucacucauguggcaacacaaauaauuccuuaaaaagagcuuuuaaugggaauuaauuuggcuaaugagcuucuuuuuuuuccccuuuucuuuuuccugugcuucugugcucugaggauucuuuaccaauugcaaagcuguacaaguuuccucauguuuuuggcuauguauuuaauaguuuuggcuuuuacaucacgaugcguuacauauucugaguuauauuuuuguuuuaugaugugagaaaagguuuaaggcuuguuuucuuauccauuggcuaugucguucuaguuccauuugucaagaacauuccuuuucuuauucaguuaaaaguuaguauacuaagaccacaaaugugauguguuucuggacuguccccuugaucucuaugccugaaauuuugaaaauacuagauuauaguggcauuuacuuuguaauaauucuugaaaucaggaacgugaacuccugagcucucuuuaagcaucacuuuggcucuuggcaagauggcuuaguguaguaaaaagugcuuguuucucaagcaggaggccugugcuccagucccuagcacccacguaaaaacuagccucauguggccaugugcuugugauuccugcacugaaggauagaaacagcuagagcagaggcagauggccacccaggguuggcuagccaucuacucuacccuaucagugagcuccaggucccgugaagagacucuguauacacacaaggauacauaaaaugaagcucaagagaaaacguuaccugaguugacaccuaaccuuucaacuagaacuuuguauacuguuaauuagaaauggagauuguuugcuauaaaaaaacaguauuuucacccuucaaugcaauuuuguuguagcuucuugacuaguaaacuuugcauugagaaauuuaguuucuuaaagucaguuuuuuucccugaguguuuucucuguuuccaacuaaguugacagcaaaugguacaguuuaucauacuaaguucauucccauucuguaagagauaauugaauuuuaacuguguaaguauuaaguuugguccagaaaacuagaacuuaucuacuguuaauuaggaauggagaucagguacuuuuaaaaauacaguaauuccaccauucaguguacauuuguuauagcuugucuugagcaaaugauuuuaauuuuuaguuuucuuauugaaagucaaguuuuuucccgaguguguucuuuauuuccaacaaagaugacagcaaacauguaauucaucauaucuaauaaugacuuuuggaagagcuuacuuuauagcauuugcuauaauuacuuggcuuguuaucuuguuuaaauuucuuuguaucuuuauugcuauagcagaucuguaauuuuucauuuugguaauuuugguuguugauuuuuuuaaaaaaacauuuuuuaacuuaaaaaaaaaguuuauuugaggcagaaucuaauacagccuugaacucuugaucuuucugacuuuaccucccaagugcuggaauuacagcuguacccccccuucagauccacccacucucaccccugacucaaccccugauuguucugcgcucauaaagucagcuccauguuuuugaaacuuuauuaaauuauuuugugcuuuuuggagagugauuuaguuaucgcccuugaaugcaugguagaaauuuuuaaguucugugggccaggaacugugagccccgguuccucuuuggaggucagaggaugaacugggggaguuggcuuucuuuacuaccguguugguucuaagguugccaggccugguagcaagugcuguuaucuacugagucaucucucuaagcuugugugaauuuccucagugauauagaauaucccuuuaaaagaucagucaaaugucagacgagagggucagaucuccuggaguuacaggugguugugaucugccugaugagugugcugugaaccaaacucuaggcccaaaaaccuccacaccucuuuguggccuucacucuggauuuuccguaguuuucacugcccuagauaugggaauuauaucuauuuauccugcuuugagagucuuaggcuaugugagggugagaauucacuuucgucuuugacucucaguugacucuggauuauuaacauucauauguucucuuuuggaauauuguuuauauuuuauuucugguuucuuauucuacauuaaaugccuuuucuuuaugcuucuguuccuuauguguuucuauguauuauauccugaauauuuucuuauugucuggcuucuauuguguugacuuucuuuucagcuacuucugaacuuuuuuacuaguguguucuagcuuuuaaaguucugucuuuuuucuuucugauuucuauuuagcuuuauuuaaguguuagcuuuuauuuuauuuaauuuauuauuaauuuauuuuauuuauuuuauuuuauuuaaguguuagcuuuuauacagacucuuaaauaugugguccuucuagucauuccccagcccugucccauucuguaguacuugcuaccuuuauuccuuagguagucucuuguaugucuggggguggggugaaauuauaugugaaaauuccgaccugguugaaagaaaagaaagugacuuucuuucacuagagaggaaaugucaccuguuucugugaggugcuuggcuuacuguccugaggcuagcaguauucucagcuugugauuugaggauucagcagaucauaugaauugcagauccugagcuagaugaaguugaccuuacaacugaauuuguaggcaagucacccuucuuuuucccagccaaagcuaagauauuuuuauguucuuugauuagaaggauuuguuguuguuguacugcacauuacaaaaggaaaacaacaacaacaacaacaacuagucuagugacguuaacucaugagcgcagagugagcugugguugucagugcaagaccagcacaagaucauacuaguuaaaauuccuggguggaugcgagagguguuucugagauccacuccugccugaggagauauuagcaauuaauggcugcuggggaaggagcgucuggguggugguuguugggguugguuuuguuuguuuuguguuuuucaggcaugagucccagcuagguuuacaugcuggagugcauggcccuguacccauguacaugcugacacaacuuacugaaaucaguggguuuuguuugcuuguuuuuaaugaagagcaguuggaggaaggugggugguucugcgaggaguuggugguucuggcaagaguuggagggagggggcaggagugcaaaugaucaaaaugccuuaaauaccuguaugggauuguaaaagaacauaaaaauauuuuaaaaguuacugugaaaauuagaaaacuuuuuuaacugaaaaguaaaauuguauaggucaggauaccuagaacacagcagaagggaugcuguaguuuauaguguuauauaagucggagacuguugaaugauaauagucaaggcuuuuaaaggaaagaugagucaaacccuaaaaauauggaaguaauauaaaaucaggaauuagugaagcagagauuuuagaaccagauuaauaaggcuccuuaaaaaaugaaaaccacaguaaauugauaagggaaaaggaaaaaaaaaaacaaauuaauaaaaccagggaugagaaaaggaaauucgcuauugacaguaaauuuuccaaaagaaauuauaagcaacuuuauucuguuaacauuuucaacuuagugaaaggucauaauucuuuuuaguuucuugagacagagucucucuauuaucuagcuuugacuguccuggaacuugcuauggugaccagguuggcacucugccucugcuucagagugcuaggauuuaguacagggauuaaaggcaugcaaaaccacaccuggacaaaguugaaguucuugaaaaacacaauuugcccaaacucacgugaggaaauaggaagucuuuuucacaaagaauauuccaagcuuacauguuuucacugggaagccacuuaaguaaaauaaaauguuauauuuagagagucuuuuccuaagaauuagcaaauaaauaucucaguaccuauuauaauuuuuuaucauaauugugauaagaaagcuagaugugacaauagacaaguuguaggucauuauuucuucacaacauggauauagaaauaaugaaauguaaucuaaaaauagauauaaccagcauagauuuguaugaagaaugcaguuuugaauuuuuaaaugguccauugcuuuagcugaauaauaaaguccuucauaccuucacauaagaaggaaucauaucacaaaguucaauauuuauguugaauacuguuaacaaaccaagagaagagaaaaaccuuuaauuuguuacuguguuaacaauaauuccuguaguuaacauaaugaaaaacuugaaucuuguccacugccuuuucucucuguucaauauagcguuggagcccuauuuaucacccucugccaaauaaaauaaaauugguaaacaacaaaucccaaauauauuuacuagcaaacuacuaagugauuuuuaaaaggcaaggcgauuagccauaggauuaaugccuccaaaauuaauugggauuugucuaacaguugcuaaaaagaauuaccaauucugaauuauaaaaguauauguagaguagcugggaaugguagcaguugguagcagaaguguguagcucuggccagccuggucuacauaggaaguacaggcuagacaggacuucauaacaagacucuaaccuuuaaaaaacaagaaaaaagguauauguauuauagggggaaaauuaagacuguccagauacauaaaauaacuaaauguuucugauaucuaauguggaaaaguggaaaagacgugaaugcugaaaauuacaaaggcauucagaaacauuuaaaacacuuguguggauaacuauuucauguuuacacaguaggagguuccagaugguuaaaaaugucaauuucuucauucuugguaaguaaaugaaauacauuugcugucagaaaccccagauuauuauuuuuugauauagucaacuuugaauuuuuauuucaaaugccaguagcucuaaggaucacaacuugcuaugacauuauaguaagauaguauuggauuagaacaugcauagacaaaaagacaguagaaagagggcuagagagaugacucagugauuuagagcacuggcugcucuuccaaaggaccagguucaauucccagcauccacguggcagcuuacaagauuuuuauaccuugugcuaugccaacuguguaucaaucaaaaaaaaaaaaaaaucaagccuugacuuuuauuaaauacuauauucaaagguaacuuugaauugcacugugaaacuaaaauaaaaauucaaguaacucuuagaaucaccuuuaagucuuucugcacccuuuccccacaauguucccugagucauaaaugcaagaguuuguauuguagguauaucaguuaggacugggcuccacaacucugcauuuugauugcuuguaguuuacuguaaugggucuucauacauugcaaagaauuuucauggugaggggugaggacuauacuuaucugugggugugaugguuuguauaugcuuggcccagagaguggcacuauuaggagguguggccuuguuggaguaggugugacacugugggugugggcuuaagacccucacccuagcugccuugaagccaucuuccacuagcagccuucagaugaagauguugccaugcucuugcuaauugauugaaccucugaaccuguaagccagcccuaauuaaauguuauccuuauaagacuugccuuggucauggugucuguucauagcaguaaaacccuaacuaagacaguggguauaaggacaaauauuuagagugugguuagggacuaugcaaguuuaguaaaguggcaauugugguucucugccaagguccauaacuuuucuagcucuacguaguuggcuagguuuucaauuccaggaaugucucccucuuguugaguuacuguugguuaaggucaugccacuacuacugaacccucaggucauccugucaucauaccaugcuggucauugcugugauucauaggugucagagcugguagaacuguuagcuucccuccuuuggaaguuugcaugguaucuugugguagcaugaagcuaguuagucuucauggaggaugcguucauucaggucagauguagcccaggagucucugagccaugcaaaaugcauggugucuuuagcaauaggggacacgcacacacgcacacgcgcacacacacacacacacacacauauauauauauauauauauacacacacacacauacauacauauauauguguguguguguguguguguguaauaauaaucuuuaaaaagcccaagugcucaaacucagagauuaaucagauuugcaauucauaggaacaucaaaaagcaaucagccacuagguauauuauuaccgcugcuaagcagaaauaguuauagauguuuaaauacucuucucuaagaaaauuuuuguucauugcuaaagagaaacaaacuuagaauucgugcagaaaaaaauauauuauaaacauaacccaaucacaaaguauaucaucucuaggccaacuaaaaaucuuccuaguuaaaaacuauuaccuccaguucucaucauuaaaacucuaccucacuagaaguuuauaaauuaugugcuuagcugcugaaaaugggaagauaacaguguaagcuaaguuacagugauuuccaagacagguaaaaaaaaagucaguaacauuguuguaaacucauuucacucuuucucugcuaaaacaucauguaaauuaauucuaaaaguaaguguucuuacuucgauaaaaauaucaacaauucugaaguugccaaaaaaacaaaagacaguauauuuaauauugaucugcccuuuuucacgucuuuuuguuuaaaauaaaaagcauauuuucaugagauguauagaaaauuuuuucuaauaugagaaaauucaguaucuaaacacuucuuacaucauuuaugauguuaucuauagaaggauaacuaguccuguguugcccugcaguaaacagcagauacugucucugaagagcagccugacugauaagugguuuuucuucaaggcuucucggaaagucagucaugagggcuugacuucgaaguuauucucgugugagagaagaccucaguaacucuuggcaggaaaaagaaugaucaguauuucaucuuguggcucuuugcauugggcuaguugagugaucuucuaaugggucaccugcuucuccuagaaugagcugagagagcacaagaagacuguaguuccuuuuacccgagcuuguagaucacacaaucgcaguuaccaugucuuuagagacaagucacaagagggguugcuaauaucaagaacaauuacuuguuugagcaucugaguuugacucaauuuauucccaacuccuagccuucuuucuguuaucauauuuccaucaaugaaaagagcucauuuauucagcuccuuucauuguuauuuagaauuuaaauauuaugcguaguauuuuuauuauucaggguuuucuauagggacagaacuuaaagaaugaauaugaacacauacacacacacauauacacacauauauggagagagagauugauugauugauuaauggcuuauagacaaugguccaguuaguccaauaauagcugucuaccaacagaaggcccaagaaucccguagcuguucaguccacaaggcucagugccucagcuagucauuaguguauaccagaaucucaaagaaguagacucuaaugccagugaaggacuugucagcaagagcaagagguugccaucagaagguguggcccagauuacagguggaucuucccaccucaaaaaagauauagauuaaaaauugguucucccacuuccaaugauuaagaaaaaaaaaaaucccucacaaguguaccuagccacuugcauuuuaguuaauuacaaauguaguuaacagccaagaauacucaucauagucuguuagcuaauauaauagacacaguguauucaaauaaaaauaaaaccaggccauuguaaguuuacuguaggcauuuuuuguccuaugcccaugcuugucuuucugguuuauuuaguuuuaaguuuguauagcuuuucuggaacuagugucauaaugucuucaauaaaucaguaauaucugagcuaccaauggguagcucaagauuucagacuugacccuguuuauaguuuuaacuagaacuguauuuaaaaacucaaagcauuugaaauggauaguuaucacaaguagaauacagucauacuaauucuggagaaaaauaccuuuagaaaguucacagaccaaauacuucuguucauuuuaggaacaaaccccaaacuggcaaauuaauaauuuaaucuugacccauuacuauaaacuuuacugugugccuucuuguuuucauaguccagagggguauggaaacagauaaaacugccauagaugguugauuauaauggcauuggagaaaauugguauauacagagacauugucaucuauauaauacaagaaauguuauuaaaaauaauaaagagaaggggaagaagaaaauaauugugaauugcuauagagaguaaagggaagcuaggaaagugauugaaaucugucuauagaaugaaaauauagauguuuuaaaaacaaaagaugaauccauccauguuggucaaauauagaaaaauaggaaagaaaaagacaucuuugugauacugauaaaagucuuaauuaaaauaguccaccuguuauuaggaagaaaaaacacuuaaauaguacauacuguaggaauuacaagauaccagcuuauuaagacaggaucccaaauaacucacauagaaaaaugugguuuuccuacugaagcaguaguaaauuggcaugauguuucccuuucagugauaaauauuucagaaaacaguaccuucaagguuuaccaaagugguuuguuuuuuuuacuauccuaaauugugcuagacuaaugagguuguuuaauaacaugcaaaaaaaauuaaaguuugccuucuccguaaauucucugaaauaauuauuugggaauaugauucagugugcggucaaaagguaccacaacaguaauugguaaugaaucuucacauuuagaucaagauguugaaaggcuuccaagaauuguguuuguuuguuuuugguguuguuuguuugcuugcuugcuuuagucagggucuaaguggaugguucuugcuuuagucagggucuaacuggaugguucuugcugacuuugguauuggauguguagacgaggcuggucucaaacucggugaucugccuggggccuaaggugugcaguaccacauccaguuuaagaggcucuuuaaagggagauuuguuacgcaugguacuuucuaugauuccuguuguuucucauuccuuuccuugcauccacauuccuaucaagguuuugaagacagcagagcugcuuuaucaauaccucuagugucuucuuaccaccuaccaguuguaggucucaucauaguuuacuguuuggcacauguucacucuaaaggggguggaccuggggaaauggugccaacaaaugagguugccuaaagucuuaugcaguagcucacuuuauucagagcaccagacuauuuauuuauacucagaggguuaagaggagucacaugaguaaaguauacaaucacaagaacaagugauuguauacuugguggguaagccacauaugacaggcaagccauagauggcaaaaacauguuuuuccauagagacauauaaacaaauaacaauagccaguuaauagugaguaauuugaaauaaauucauucuuuaugugguauaccuagaagggucacaaaagcaugaaucagaaacaauuccuuuguuuugaagaaacugaggucacagccucuuuaucuugguuccuuggaguuaucucacuggcucucagaaaucucaccugacuccuuccauucuugaccuuguuccuuuagcucucccuuuuugauuuuuuaaaaaugcagucuauugagaggggcuuugauuugagauguuguagauaaaucuaauugcauuugaugcaugauuauccuauaagcaagcaaauuacaaacauaauaacagaacagugagagcguugcauguagugcucugcuggcaaggacagggaucugacuguguccaguccuauugauuacuuacuauauugguaagaaagaucuaggagaauaccuuucaaagagaccuuugugauuaguauaucuggucucuuguagaacauaaggccauauuugcccuuuaauaggaauguaaauguuaaaauguccuauacauauagaaagagauuaaaaucucaaguaaaaauuaagugcaguccuucuucagaugaauaaaugagucuauuacagucccaagguccagucauaaacacagagucacuaguaaagauaaaaggagcuagaucuauccuauugaaacagaggagggugaggaacauaauacacauguucagaggcacucacugcagaugcacaggucaaagcagcuagcaucaucagaaaacaguccucaggaugcauagggcucuguaugucauagaauaaucucuuccuugaugagaugagccuuaacuuggcuccagguggacaaucuugacuucugauauggucgauacucuccuuuuguccuugagcuagauggaguucugcugucuuucuggugacuuuuacugucuccuuacccuccgcugucaucauugaugggcuggggccagaggagccuaagagggccaaagaggaaucgaugauguuucaguggaucaaucugcagugacaugcaaaccccuuuccauuguuuuuuaugucuggaaaaguaaacacagggcagguuaguucaucagcuugcuuauuucccucugcaguaaaaccagagaaguuuauuacugcuaauauccuacaacauaagcagaaccugaaacaauauuuaaggguuuaugaauuagcugcaguaggugaguaaaaacuauuaguuccauguguuggacugaggaaaaagaauaucuagaucacaaaucccaccuauaucauaagaugagccaucaauaaaguaucugucuacagaauaucagaugguuggauaguuuuuauaaucacaaauucaguucauauaaaaaugccauagcuuaucagcuggauaauaauuuccuauccuuccauauuaaucuacaaaugaaauuugaaaguucauaguuauguaaugcuccuuauucaaagcagcagacuauuuuuaaacuggccuaggaggagucacaugcguaaaguauauaaucacaaggguaagcuacacugggagaguaagcugaaugccacaaaaacaugguuuuuuucacugaagcauaugaacaaauaacaguauccagugguauuaauaaucugaaauaaacucacucuuauuugcuacgccugagaggagcaugaaagcacaguccaaaaccacuucugucauuugaagaaacggagaucaugagacucuuguccugguuucuuggaguuuucucaauguacucaaaaaucucacauagcuccaccuuuuuuuuuucauuaauuuauucacuucacauccuggucacagccccuuccuccccagucucauccucacaaaucccgccccacuucauuacccccucuucucagagaagggcaagcuccacuugguuacuguccugcccugggacaucaagucuuagcuggacuaagcacagccucucccaaugaggcccaaguagacaguccagccaguggaaggggauccaauggcaggcaagagucacagacagcccucacuccaguuguuaggaaacucacaugaugaccaagcugcacauaguacaaauguguggggagccuucgguccagucauucaagcucuuugguuggugguucagucucugugagccucuaugggcccagguuaguugacucuaggucuugugguuuccuugacugcucuggcucauuuaauucuacaccuggcucuuccacaagauucccugagcuccaccugauguuugacuguagaucucuggaucuguuucuuucugcuguugggugaagccucucaggagacaguuauacaagcauagcagacaguauuaauagugucagggguuggcucucucccaugggaugggucucagguugggccacucauugguuggcugcuccaucuuuaucucugcauaucuuguaggcaggagaguuuguggguugaagguuuuguggguguauugauguucauucuuggacuguauucugaaaagcacacuugaaauuauuucuucuccacaucuacacugcucagucccuuucucuucacuggccucuccuguugguuugucuucacauuugaggcuuguccucuuagugcuguaaaaaccucaaaauuauacugauugcucaaaauucuccaguuaaguccagucuuagauuuaacacaauuuaauguguaguacuucucuuuuguuuaacacauucaaaacuaaacaagguauuuuguccaaauuugcagcuuuuucuuugucacuuagugucaaacacuagcugcucagauuucaaaaugaacccugugccuucuuuucugucuuguauccguaaugucgccucuaguuuacaguaugucagaccucuuucucacugcucaucuuuacccuagucuaaagcacucagaucuucuguuguugacauuacacccaggcuuccugacaguggccuuuuucuccccugcgcauuuaagauauuugacaaaguagccagguuaaaacagaagucagaugaagucucuuugcucaggacuguucacugguuuucagucucagaguaaaagcccacauuucucccauuagccugugggagacucuguggggaguugcauuauauaaccuuuuuuuauaccuagaauguucuuucccaguguuucccucaucuuuucugaucuuugagucaaugauuccuucucaauaaaauuccuccucuaauaacucuuuguucugugauaguuuguauaugcuuggcccagggaguggcacuauugggagguguggccuuguuggaguaggugugucacugugggcgugggcuugagauccccacccuagcugccuggaagucaguauucugccagcagccuucagaugaagguguagaccucucagcuccuccugcaccaugccugccuggguucugccaugccccuaccuugaugauaguggacugaaccucugaagccccaacuaaauguuguccuuuauaagacuugccuuguccacagcaguaaaacccuaagacaguucuucuuuaucuaaaauaaaggaauauaguauguauguauuccuuauuuuauuuguguuuagcacuguagucuuagguccacagauaaauccauucauuuuauaauucuuauauucucagaucugaaaauacuguuuggaacauguuugaauauaggcuguccuaagaagacuggaucaaagaaauuugugauguaaacuuaaagcugugaggguuuuuaaagauugccguguacuacauauguacuacacagugauugcugaggucagguuaugucacugucuuaugaaagcagugguaaugcgaaugaaccuguggguuuuggcagcaugguaaaauuaugauuucuacauaugccuuugauuugauccagaugcauuagaaaauggcauauuccacaauaugugauuuuuaugaaugaauguagauaugugcucucugauguaaguaacaauagucagguauaauagccuaguuguagaaugcuuaccuaauaauuuuguguugaugauagaaaauugguguuaguuuuggugcuuaaauauuaaaaggauuuaaacaaaaaauauguuaaacuuaaaaaaaccuuguugaaugauaaguuguagucuuuacugguuuaguuauaauuauuuguauacuuuaaauauuucaguuucccauuaaacauuuuuaaggugaagauuguauuuuuaggcuuaacgagaauuuugcuaaugagagcuaaaugaauuuauaggaaagccaaaguagcauaguagacacuaacauacuuaagucacucuuuuaaguuuaucucagugacugugauaaaaacaaugaccacaagcaacuuguggagggaaaggguugguuuggaguacagguuacaguccaucauugaaggaaagcaaggcaggaacuccaggcaggaacugaacuggagaccaugguagacugcuacuuacuagagugcuuucucaguuugcaguccaggacuucugcucagagguggcauuaccaaaguggacuaugcucucaucagucacuagucaagaaaauguuccuaaguauucccacaggccagcccauucuggaggauuccauaacugggcuuucauuuugucagaucugucuagguuuguaucuaguuauacaaaaaguaacuagcuacugcugagucgguucaucaguaauguauuggauuacuuacuuacaaguucuuucagaacuugcuuacagcaugauugcuugggguguuuguuugcuugcuguugcuuuggucaaagcaaguuauacuuuuccaaguaaguaaaaggucaauauucuucacuaauauuaguuuugccauuuuuauuuauucuuuuauuacuaauacuuuguuaaugcauuguuucuuuauaggaauuauucucagcuuauucacugugcaagaaaaaaacaaauuacauccauaauucuacugaacuggaaucauagacgcugccauauaugucacaguacacugaaaaagagccaucagguaaggaagcuuaugcgucuauguucaggauuccuuuguuauuucugcgauacuuuaaauauguaaaaccacgcaaagugggucauaguuuuaauuccagcacuugggagguagaaauugaaugugacauguuauccucugauaaugaucuuauguaaugacucauuuuaagacaucuguagcuauuuaauauuuguauagauuaauuucuaacuuaauaaaacacccucucauuucuaccuuacauuucauuuauuggaggcuauucuuuuagaauaguaguaaaagauguugauccuuauauuauugaggaaagugauuacuuuuuuccuuuuuuguaacaauucauaauaaauaauugaugaagcugugggguggugagcugugcagacagccugguccccagucaagcacaggccuugaaccccagugacccaguaggcuguggcuuccaccuaagagggccugcagguauucggccacuccccuugggucccuggcuccugucucagcuacagccucccacagcggggcccccccccccacacacagagagguguguggccauuagucacauaagcaaugccccacaagcuccuaguauucugucuggacucuacccccauaguuaccuggcaagaggcagguaugcuccuccccaaguuaccuggcaauagccagguaggcccagcccacuauaaaaggggcuguuugcccccuccuuccucucuuacucucuugccucucucuuagcccucuugcucccccucuuuccgccuccccucccccaacaugaccaugccagccucugcuucucuacucuucucccucucucugacuuucuauaauaaacaccuuaaaaccauagacugccucuucucauugugauccgaagugcuagagcaauggagcaggucuuccccuaaccuccugcugggaggccucucugcccuuauucuuuggccugggccagaguccacccacgggcccacauucuguucucagcucuuccacagcagacaguggcagaagcuagaaccugucauccucagccuccaugcaggccuggagacccugagccaauucuggcagguccacggggacccuggacuccaccuucccuacacccauagugggguccugcggcuucucacaucccaauguccacccacuggcaguguggaguuugccacguagucagacuucccucaucccaccuugcccaguggcuagagcccuggaccagacacggggccccauuuuugacccacacuaagcaauauguguauaauacuauacucuuuaguaaaauaugaauuaauauucauguuguuuaaaugcuggugucuguucuaagcuuuauauauaacauccauuuguaauuuuaaagauggaauagcauauguuugauuucuucugugauuguucccuuuuagagaauucuugcccuaggcuucaguacauaacuguuuaguuguuccuugucauccauacaccauuuaaacaaaagccuauucagugguauauaguuuagugaauaauagcauauuuguugaagcacuuguccccccaacuuguugccauaguaaaggucauugcuggcccucuuaauuuaauuuauacuuucaguaauggaucaagaauccagcaaggcugcuuggccuaaaccagcaggaggauaucagacuaucacaggcaggagauauggaagaagacaugcguaugucaguuuuaagccauguaugaccaggcaugaaagaagcuugggucgggcuggugaugacuaugaaguguuggaacuagacgauguuccaaaggagaacaccucagguauguaacauguagccacuuaaagguuauuuacuguaaacuuuauauguuuucccuauaaauacaguauauguuguauuuugaauuuuuuauugaauuuaauagaaguaacauguacauuaacuacagaagaggauucaguaagacuagucacugaaauacaacuaguugucauagugguaauuacauagccacaucuaccagcuaacucuugucccaagucuuucuguuuguuuuuaaauuucaccuguauuuaccuuuacagcagaauguaacuaaacauuauuuuuucuacccacaagccuugcugaauuacaagaccuaggaacuuuagaauuuuguucucaauauuuauugagaauuuuuaaaaauccauuuguuuauggaaacuaggccaugucaagucuuuuuuaugugaaccgaguguguuuuuccugcauacuacauuuaauuaacuuuucuuuuaacuuccucuagauaacugagcuaucuuauuuuuucaucauuuuguacaauauaaauaaacaucaagguaucuuguaauaguuauucaauuaaaccuccuuaacuauucaguaguuugaaauguuauauacagauauucuguaaauaguuacauuguuauguauauuauauaaagucuucugguuucaaauuuuuuuuuuuuuugguucuaagcaaacuggauauaguagcauauuuuccuugucauuuauaugucagaaucugaauugcuaucuaagucauucauagaggaaggauuaucuguuauaagauuaaauuucagguauuucuaugguuuauuuacuuuauuauagcaaaucucaauacugaucuuugugaaauuaaugauaaagauagucaaguuuaaaguaguuauagauuugauuuucuucaggggucagaauuauaacaaaggaugacaaauggaaucaguauauucacuuuauuuuucaguuguaucucuaauaccuaaauuguaaauguauuauaauaauacauuuuuggcauagaaauaugaaugucuagaaacuaaaauguaaguuuuuaauuaacaucaaaguaugauuagaaucucauuucucauagcucuauuaccuuuuauuaaaauuauaucugucaugauucuuuuuuuguuuuuaguuuauaauuaagagauagaugagaacaguuggagacagguuauucucuggcugcuucuguuucuuacuguauauagaaagcuuuuuuuuuuuuuugucauagagaagauuuuugauagugacauuuaaguuaaaaacaaacucuacaacagaaacacaagggauaggguaaugagaggcucuccgggaucagagcugaguucauaaucuaagcagucugacugcagcaaaguuaaagaauauagaagugcuugguguauugucaauuagauaguaaugcgauuuccauggaacagauauuauauacaauuuuaucuaaauuaaucccuccaaaauguuuucuucuauccuuuuuuaugaagguuccaguucauuggaucaaguccauccugcuuuaccaaaugaaccuacaguugaaaaaagugaaacagaaauuucuacuugugguccagcacugaaucaaagcacugagagcaguccauccauugccacaguaugucauagugaggaagucagggagaccuuagaaagcaauacaaaccuucauaaucgcacugagacagagcauacuccagcaguuuguaaugucucaaguguccagaauggaauuauguugguucauacugacucuuaugauccagacagcaagcaugaugagaauggcucucuucaacuuggcgcugaagcuguggaaggugguagacaucagaagggguuaggccgugcagucuuugagcuggaaaauggagaggcagagaucuacgcugaccugucaccaucaguccccucucucaacggugaaauaagugaggcguuugaagagcuagauucagcaccuuuagagaaaaguucuacugccgaugcugagcuuguccaucagaaugggcaggaauuucagaggucuucugaagauggcguuguuagaaagaggcgacaagacgauacugaucagggaagacagacagaaaauucaacugaagaugcagacugugcuccaggccauguugagcaaaauacuagugauagagccaaccaccauggaaguucuccugaacagguaguaaggcccaaaguuagaaaagugauaaguucaagccagguggaccaagaaauugguuuuaauaggcacgaggcuaagcagagaagcguucagagauggagagaggcuuuggaaguggaggagugcaguucagaugacccuauaauaaagugugacgauuaugauggagaccacgacugcauguuccuaacuccaacuuacucaagaguuacacaaagggagacagaacggaaucguguaacaucagaaaauggagcuacagcuucaggacggcaagaaucucgggacaaugccuuuuggaaugccugcggagaguauuaccaacucuuugacaaagaugaagacagguaagcuccauguaguauuugguugacuuagguacugagccaaguuuuuuuaaacuauuauauauucauuauacaaaggauacauguauaucuugcacuuugagcauauucaauacccuauugccacguuuuaccaguucuuucccaucuugcugaucacuuuucucggauaguuccccuuccacuuucauaucuuauauuauuaaagcuauauucugcggaagagagagcaugcaauaguugucuuuccaaguucgacuuauuuugcuuuacaggauaacccccaguuccauccgauuuucuagaaaggcauacauuugucuucaugagugagcaaaaccauauuguauguucacauuuuccuuaucuguucauaagcugauggacaucugggcugauuccucaacuuggcucuugugaauuguguugagauagagccagugagauggcucuguggguaaaggugcuuacugccgagcugggcccgauaaccugaguucaaucccuggguuucacaggguggaggagagaacugauucccaucguugguuucuaaccuguacacaugcacucuuacaucugcauaccuacccaggcauacaugcacauauaaaguaaaugggauuuuaagauuuaaauaaaauagugcugaaauaaacaugaaauguugagguugucugcugucuuagucaggguuucuauuccugcacaaacaucaagaccaagaagcaaguuggggaggaaaggguuuauuuggcuuacacuuccacauagcuguucaucaccaaggaagucaggacuggaacucaagcagaucaggaagcaggagcugaugcagaggccauggagggauguucuuuacuggcuugcuuccccuggcuugcucagccugcucucuuauagaaccaagacuaccagcccagagauggcaccacccacaaggggccuuucccuugaucacuaauugagaaaaugccuuacagcuggaucucagggaggcauuuccucaacugaagcuccuuucucugugguaacuccagcugugucaaguugacacacaaccagccaguauaucugccauaugcugacuuagauccuuugugauauaacuugguuauaugguaguucuauuuucagucuguuaaggaaucuucaauacagauuuccauaguggauacacuaagucguaucacuauuagcaguauuaaaaaaggauuucuccucuugugcaugcuccccagccucaguugauuguuuucuugcuuacagccauucugacuggaugaaauagacuagccgggcauggugguuuccauuuguguuuccccaaaagcuaaggaugcggaacccuuuggccauuguacuuuugagagcuggcuauucaauucauuuggccauuaaaauuauuguuuguauaugcuuguuuuuugcauuaauccccuguuggauguauagcuaguaaaaaauuucuucccauuuuauaggcucuuuacucuguuaauugcuuugucaugcagaagguuuauaauuccaugaaguccuacucaucagcucuugguuucauuucuuuuuuggggggaggggcauuuugagacaguguuuucucuguaaaguucuggcuguccuggaacucacucuguagaccaggcuggccucgaacucagaaaucugccugccucugcuucccaagugcugggauuaaagacaugcaccaccaugcccggcuaugcucuugguuucauuucuugagcuacuggaaaccuuuucaaaaaguccuucccuauuccuguaucuuaaagugauuuaugaugguuuuuggaaagggugggggaagggaaacaacacuguucuacagguagauauucaaugucuccagcacuguuuguuaaagagacugccuuuuuuccaguguaugcuucuggcuucuuugucaaaaucagguggccuaguugauggguuuguuucuagguuaucuguuuuauuucaauggucugugugucuguuaaaaaaguacuuuauugcuaauaagauguuugauggacuaucauaugugaucaagaaauuauacaucuugaugaugagauauucugaguacucaccauacauucaaacugcaaauuauuuugguuucuuuuaggcauuguaauaguuuacagauguuagacuuuuagauacauaaugauuauuauaaagaguaaagucugauuauuuuaauuaacaauuaaauauaauuguuacaauaauaauaauuuaugacauuuuuuaaauuucuuuaaaccaucuguguuuagaacgugauuaagaucacuguugauugacaauacugcauuaaguuuaguacuuaaugucacccauuucuuucuauauuggauccuuauuuucucuuccuaucacuauacuuguuauuuauaaguuauaggcuauaguccccucuugcuuguggcugaaguaggaagaucaugaacucaaagcuagccugaccuacauagggaaaccauaucucaaaacaaaaauucucauuaaguuugguaugguagguacuauuuuuuccuccauucauagaugaaauagguauauaaaguuaacuaguauaauguccuauguauaaguguuacaacugggacuugauuccuugaacugcaaaaggauauauucucuaucauuguacuauguuauugucaggacuuucuaauuccuuuucaaacacauauuucuucaacuuuccccaaacuauaaaacagcaaaaauggguagagguggggaauagagaguuauauuuuguauagcugcucaguuuuuauugacagaguucagauuuuuauguuaucuuuuuaagcuacuuacaaaccuaacaguguuccauuguauauuuuaugagcuguuaaaaaaaaaaaaaaagaacaaaaaaacuuucaacuaggaauguauagagaauuuucugauuugaauaugaaaauauuuuaucucgcaccauaaaaggauaaauacuugauuguccuuauaauuaugaauuaagccauuguaagauguaaccuauuauagggagcaauuuaaauacgauuuugauaacuguuuugaagcuuucaaauguuaagggaaggcacacguuuuuauaugacuguuuguuugcuugcuugcuuuacuuucuuuuuaaagauuuauuuuauaugugagacacuguugcugucuucagacacaccagaagaggacaucagaucccauuacagaugguugugagccaccaugugguugcugggaauugaacuuaggaccucuggaagagcagucagugcucuuaaccucugagccaucucuccagcccuuguuuuacuuuuuaaaucaagagaaaaguuauuuuuuuuuaaauuuuacucucagaguucaguacauuaaugaaaaagagaucagauaagagaaaaggaaaaauggggaaaacaaccacuaagguuuagagacugcacuaucacuaugaaaaugugugcucaauugaaauuggucaaggaaaugggcaauauacaaacucagugucaccuucucacucagaacuaaugcagagauaauuccucaugcacuauauauagaccuuugugaagccauucccaaguuuuuaguaugcuguauuugacagggauuuuauuacagaaaaggagauuagcuaggaggaugccuauauauuuaauuuaucaaauacauuaaauauuugaucagaugacauuguuauaaguagcuauuaaauagauugacaugagcuacaaaauaaguuggauaagucccugaucucugugaguuaggaauugcuagaagacauccaacauaaagaacucuaauaguuaaauucaacacugcucugagcaagcuguaggauaaacauuuuuuaggggagcagaaaaugauagaauuuuaggagguaagucacaagguucaaauugauuuguaagaccaacugucaguuaaauagaauuaagauauuugccauggaggccaugaucuuuauguaaaaucuucaaaguucuaaaaucauaaauuggccacaaaacuugaucugaaauuaacuuuuuugauagauauuauggauccaaacuaaaauaagacauauuuuccaaguaaucauauuuugcuccagcgacauuuacauguuugaaaaguauuugcugaccuggauucuauuggguguugucagccauugcuucugaacuugggagaaaagauuuaaguccuaaacauucagcucuaagaucguuggguuugacugugagucucugucuacuucuagaucacuauugaaaagaaaaaaagagucuuuagcaguuuuucuuuggcaaguggaggguuguuacugguuuuuccuguuacacauuucuugaaaaaaaaaauuacuucacuagugucuucaccauuguggaccccuagagcaaaacaaaaauaaagaccuuuaauauugcugacuuuuuuguuguuguuguuuuguuuuguuuuuuguuuguuuguuuguuuuauguuuuuuguuuuguuuuucgagacaggauuucucuguguagccuuggcuguccuggaacucacuuuguagaccaggcuggccucgaacucagaaaucucccugccucugccuccccagugcuaguauuaaaggugugcgccaccaugcccggcuauugcuggcuuuucaaaugaaaauguuaaaaauuguuuuguuuuuguuuuuaaaucagcccuaaaacaaaaguauaguucucauggcuccugcuuuucaauaauugggguucccccaaguguguucuuaguauguuuagaagugaugucaauauuaugaacaaugguaguuuuguaaauacaguggacaugaggagaaauaugcagcuuuacuaaaagcuugucuuugagccugguugcaguguacuggcugguagaacuuguugggugugccagagcgauggggguaacacagugaaauacgagaauaggucuauguuguuuaagaauaacagaagcugggcauggaggcacacaccauagucuuagcacuuuggagggauauaggagauccuauauagggauauaggauauaucagggguugaugguuuaccuuggaugugcaguaaguucaaggccagccugacauucaugaaaucuuguauuaaauuuuuuucagaauaauuucugaagaauaaugaccuuugacaccauuuguauuuuguaaaaccuuaaaauguauuuuaggauugaauuauugcaauaguaugaaugaaucuucuuguuacugauccuauuucuugcuucuguuucuuacucaucucauuuaauuuugcuaaguguuacuuaccaggaugccuuuuaaucugguaacugcccaaugccaaaaaggagcgccauggacucuagcuugcuuuugaccaugcucaacuacacguuuuccccuguaccgcucugauaguagaacacugggggaacugagaagcagugaccacuuucuaaagugucucuaaaauggaaguauguagaaccuuuguauuugagucugaaaaugaauuaaaaguuaauucucucuuuuauauaacuuaucaaugauuuauuagagauauuuuguuaugucuguauuauaaagguaacaucuauagaacauuuaucaagaauacaaugaaaauucauuugaauacuauuagauauuuuaauuuagcuacuuaaaauaauaagugggccaucaaguaagagcaccuucgcucuugcagagaacccagguucaguucccagcacucacauggugaguuauaaccaucuguagugccgauucuagggaaucugacaccgucuucugaccucugcagacuccaggcaugccugugcacacaccagguaaaagcuaagugcacauaaaacaaauguaucuagaacuuuuaguagugauuauacauucuuuauaaguagaagauuuggucacugucuuccucgaaaaaagucuuaagugaugguuuaaucauaauagaaugcugcagucuaucaggcaaacaucccagccaguagcauugcucugggcuguuugacagaaaaugagugcuacaucauugaauuagacugcaagggaaauuuuaacagucaguguauaauuaccagacuuggaucagaccaaaaaacugagguuagcacuuauucuuuugaaauauacccugagaacuguagugaggacaaggauuggauauggaaggaaggggggaguagaaggauaagggaugggaggagacuccuucagcaguacuauagcacuuuguaaaccuugggcuuguuuugaagagugcugugcuggccucugacuguuucuuagagcacuugaggcuucuuucagucucuccugucacuaggacuuaaccuugccuaaaagguuaaacaaagcaaagcaaaagagacagugagauauagggaaaccuucagagacaaaucguggaaucccagcuacacaggagagcaaagcaggaggacugaaaaaguuguaggcuuaccugaguuacagagucaguucaaggcuaaacuuauuagcaagacccuccucaacauaaaaaauagaaauggguuggagauacagcacagugguagaggcuugcuucccauguguaugacccuaaauuuaauccccauaaccacacagaugcuaacuaaaaccuguuucuuuugauauuguugggagaauaaaaugcaaauuaguucuuuuuuuuuuaaucuuaauuugauauauuaaaagguuucagaugcaguuacagguguucuauaaauauauaauaauucucucuguucccauggugaccaccagccuuacgaagaacaaaacagaauauacagauucauuguugaaagacugagauuacuuuuuucauauaacuugucuaaguagcaaacaggaugagcauuucugauguggcaggcacuaccuuagcaaagaaaacagcagacaucuacaaagaccuuacaccacaugcuuagacauuuucacagacuuuccuauccuguuugcaagaguaauuuaguaaucccagcacucaggaggcugaggcaggcaggucucugugacuuugaggacagccagggcugcuguugcacagagaaacucuauggaaaaaaauuuaaaaacaacaaagaaaaagaucccauaccucuucaaucuucaugugguuuaucaauggcaugguucuuagauaacauuuauaguucuauuaaaucaaacaguaacuuaaugucacccucuuuauacaugcauugacaaccaaaugaaguauuuaaaaguguuuuuuaaugauugagacugucauaugucuuuugauaauaaucacucccaacuccucccagacccaugucuaccuccuacccuaccuuuauuuaguucugugaccuuucuugcuccuuuuuuauuguaaauguuuauuauaauaguccaaucaaaugcaauacuuuauuuguaaaucucagguagaaguagcauaaaauaccaucuagaagcaaccucuuauuuccugacuccccaaagaaguagccgguuuaucuuuuuagccuuauaccuguaaguacgagugguguucagguagaacuguaaucuguaacagugguagccuuuguuuggaccucugcucugaacacagguuuuaaaggaucacaguaggguaguuuuuuuuuuucuuaacuaggaauauauauaauuacuuaaauuauaacuauuuaaaacuggggaaaaaaaaacaccuucuuuucuugcucaugaggaagcaggugaccuaguuuggguaauggucuaggguauaauuuuugaucuuuagugugaaaaaaaagacuaaaguuggauuucccaggagacugaggucaccagaauaauugagcugcuacaguguagcuuuucuuuggcacagaaaagaggaaaauugugguuagccaguaagcaaccugcugacauaucuaaaaugauagagcccauucuauaaaagaaguuaaauguuugccuauucaacuauucaccuuuuuucaaaaauuguauuauauauuuugucuccaauuuuuagucuaaauauuguaggcuugaaacaugaacauuaauaaugucauuuuauagaugaaauuaaucacagaaaaauuuucauggauucuaaagauauuauucaggauucaauucugucuggcuuuaaagcuuguucuuagaaauuugguauuauaaauguuacuuuguuucuccaauaaagaaauuggcuauugcaggucugaaaguuuuaguaguagaaagucaacaugguugugugcuccucugacuuucuagaccaguuaggauuuuaggguuacaaauuauuaauaaauauuagucauaacuauguaacauaaaugucauaauuaguaacauucagauugaaguaguacuagaaaucauucauguguuucagucacuugucacaaauaugcaaaugguuuuuggaacauccuuagaaauaccuuuugcuagccuuuucaagucaaauaauaccaacaaaauucuacauuuaaagcuguaugguugaauaguccuuaguauccacuaagagcuaguaaacauuuagcucuucugucuucuuggaaacugccaguaaguuauuaaggaaacugauuuuauuuguauguaacuaggaaaauaccuuagaucaauuaaauuuuguaauacuguuuguuuuaguaaaacaagaucaaaaugauucaugaauugggcauaucccagaacuagugcaggaugugaggcauagagaacagcuuacuaacuacaucuuagcucguuagucuucacaagucccagcuuaguuaccuggcuaggcuaucuacagccaccagagcuugauggggaaagcucuugguuguucugcuuugcuaagcccaaauccagugugucucacaaauuuuacuuaaugcuuaagaaaaauaaaugcaguguuaaagaaguagcugcaguacagagauuuggaccaaguaagccaagugccuaguccuugcucaaaggcaauuuuuugacaauuaccuucaaagaaaugaagucugguccaguccugaaggggccagguuguuguuaugacauuuugauggagagagaaugcauugaaguacaacacccagaggacagugauagucuguguaaggaaagaagacgaucauugcuggcugcuucaaaguuucuccuugccgggcgugguggcgcacgccuuuaaucccagcacuugggaggcagaggcagguggauuucugaguuccaggacagccuggucuauaaagugaguuccaggacagccagggcuauacagagaaacccugucucggaaaaaaaaaaaguuucuccuuuauaaagaauuacugaguauuaauaauacaggcccagaguccuuuuuuuagaaagggucaguauagaauuagaaaacuguuucauuuacaucaggugaguaauacauauucauuucagacauuguuuuugauucccaaauuguauuuauuuuauuuaauuaauuauuuuauuuauuuuacauucuaaauguugcccuccuuccugguccccucuccaugaguucuucacccauccucccuccacucugcuucugagagggugcugcccacccauccaccuacucccaucucacccugcuagcaucccccuucccuggaacagcaaguuucugcaggauuaagcccauccuuuccugcugaggccaaacaaggcaguaguccucuugcuguauguguaugggggugggagggacagaccagcccaaguauguucuuugguuagucccugggaguucccaggggucuggguuaguugagacuguuguuuuuccuaugggauuccagucuccuucagcuccuucaguccuuacccuaacuuuuccacggggguucccugacucaguccaaugguuggcucuaucuguaucugucuuagcugcuagcagaaucucuguggagacagccaugccaggcucuuuucuguaagcacagcguggcaucuguaauagagucaggguuuggugccugcacaugggauggaucccaaauugggccggucucuagauggccuuuccuucagucucugcuccauuuuuguaucuauuucuuuuagacaggaacaauucugggucaagaauuuugaagguggaugguuggccccaugccucagaugggggccaugucuaucuacuagagaugguccuuuuagguuccgucucgccacuguugggcauuucagcuaaggucauccccguuggguccuaaaagccucucauaucccaggucucugggacuuucuagagguucacacacacacacacaugcacgcacacugcugcauauuucuauucauucuccaggcccucugggcuucucuucugucucccuccauaccugauccuaccccuuguuuuccuuuccacuccccuguccuacccaggucccuauauccaaacucuuauuuaaauaccauuaauuguauauucuaauauaaagaaaaaaugaaaugauauacuucauaaccugcuaugagccaugaucauuugacaguuuuacauuccauugaauauuuauuuuuguuaucuauuuacuuauguuuuauuuuuuaauugaaugagcaccugacucaacguaggcaucagcaguccuaccuagcccauaaugacuccaucugacaaaaauaacuuaguguaugaugguaguuuaugucuguucugauuugcaguucagagugcagugauggggaauggucugcuucucugccucaccgauuuucuggcacagaaaaagaccaguccucaagcgaugacagcugggaaacucugccaggaaaggaugagaaugacccugagcugcagagugauaguaguggccccgaggaagaaaaccaagaguugucucuucaggagggguauguuaaacagagagacucauuuacuuaagugugcauuaugcaagaacggcaucaccacauccaaauguaggguaugcccuugauuauauguaggagcccauguugaacacauaggcucugcauggcgcauugcuacuuuguaggggacacgcuuccaugcuagcaauucuaguauuuuuaugaggauaggauguauguuuuuauugcuuuauaaaggaaauuugaguauuucaaaaguaguuugcagacuuccuagaguuacaagucuuuaauacaguuccucuuguuauagugacacccaaccauaaaauuauuuuuguuacuaauucauaacuauaauuuugcuccuauaaacuauaauauaaauauuuuuggagauagguauuguaacucauagguugaaaacugcuuauuugaaaggucauuucagcugaguuaagaauaacugaauuaauguugcccauugccacacacugaagagacuugggagaacaaucggcuguaaaagguaaaucugugguaaauuacacuuagcaugucuuggaaauucaagugauugaugcaaagaaauggaggcuguugaaguuuuaauauuuuuaucuagcucaauuggauaguauuuccaggacauuggugaccuaugguaaauaucugugacuuuauaacuugaauggaaauauuccuaucuaggaguugucaacuuaaguugugaaaagcuagauaaauauuguugguuauguaugccagugucuguuguagcuacucaucuauccuauugaagcauaaaugcagccauaggcaauauguaaaugaauugacagaauuuuguuuccaaaauguagaaagggccuguggcucucagcuuggcuguccuuguaauauuucaucgguagaacaggcuagaaucuuucuuucuccuagccccauguaugugucugugucugucguuuuagaaacuguugugaaugucauuuuuccccuugauuauuucucagcaagaucauuuacugccauauagaaauuacugauuuuuuuguuuauuuauucuauucugcuacuuuguuucaggugcuuagugaaucugcucucuuucugguagaaaucuagguccuuuaagaauagaaacauacugucuccaaacagggacuaauagaccucuuccuuucuauuucuuucuuuggccauauuaaacuagguaaggcuuagaaaagcacgaaauugaauaagaggagagaguagacaccaucauuuuauuccuaauuuuagaggaaaacauuguuuaaaucaauuaaggaauaacagcuuuuuaauuuauuuuaugggauucuaccaagaauauugaauuuuaaaucuuuucaauauaaaaauuguaacaaaaucauuuuggccuguugaucauagggaauuuuauuucuuaaacuucuuaaugauaaucaugcuacuuuuuaaaaauauacaaagccugacucuguggucacgguuuacugauggauuguuuguauuauuuuguauagaacuucucuguuaaagauauuaaucucuaaguuagcaugauuuguagauauugauaucaguaucaauuugcuuuccuuuaaaaacauaauauuuuucuuucuuuucuguacucucccucuguuguuaaaauaaauuauuuauucugguaaauguuguuagcauugagugaugaaacacuaucuagcuacuuuauaagugaauaucuuugauuauuuaaacauuuuuugaugacaacuaaauucuuucaauuuuuaguuucaaaagccauaugcugggaaacaauaaucaaguccucuugcaaguucacucugauuucuguaagaugugaugacgugccugucccagcacauacacacacaauaaauuuuuuuaagauuuuuuaaaauaaaaaauaacuuuagaaaaaagagugaauuguucugauuagugauacuugugaguuuuagaaagcaagcuuuauaucugaggcuaugacuuugugguagaguucuuggcaguaugcauaaaaaccugggguugauuaucagcucaggcgcucuccuuuuaaaaaacaaauagucuuaaguuugagaauauuuugaaguuuuaaguaauaaaauaaguuauuauauugagggagaaugaggaaucaccaauaacauagguuuucauuuugaucaccaaauagauggacaaggagaacuagaauauaggaacuuauuugugaaacuuaguuaucaguuaugcacugucaaugacacguaggcaacugaauauaguuuuaaguuuaagagaacauucuugcuugagauuguauaccauugcauaagaauaaauaaaauacauuugagggauauuagcuguuuucaucaaaaucauccauuauguaacuuaccugguaauuuguucuguuguuaaguauaguagggauauaauucaacauuggacaccauuaguuuuuaaauggcugggugaaggcuauaguaucaguugacuuuauuauguugcauguguauaguaauuuucuaaggauaacuauugcaaugaggaaaauaaugccauauguauuaggaacuggaaauauaguuuagugucagaguguuucaugguauacacaagacaugaaauuuuguccccaguaccagagggaaaaggaauuaaaacuugaaucaaaacauuaaaauccacccaaaaagaaaagacaaaagagugaaaagguaggcuguagaaauaguucuugcaguuacguguguguguguguguguguguguguguggagagagagagagagagagagagagagagagagagagagacugaucuuugcuuuuauaagaaaagguuuaucaguagaauuaaaaagcuaaagaagacacauuuaaaguauagauauauauaaaaaccaaaauggcaguaugguauuuuaggcaaacacuaaccagaaaagaacuagaagaguuauguuaauguuugcaaaauaaagaauaaaauguauaaguagaggcuggagacauggcccaugguuguaaucacuugcugaacaaucugaagaucagaguugagaucccugcaucuaggguaacaagucaggaguggugguuggcuuggcuugacccagggaguggccccguuaggacagguaaagagaauuugcaaaacacaugaaacucaagaagaaggaagaccaaaguguggauacuucgauccuucuuagaagggggaacaaaauacucauggauggguuuacagagacaaaauucagagcugagacugaaggaaggaccauccagagauugcccuaccuggggauccaucccauaaacaaccaccaaacccaggcacuauugcagaugccaacaagauuuugcugacaggacccugauagagcuucuuauagucuccugugaggcuaugccaguuccuggcaaauacaggauucccaaugaaggagccugagaaaguacccaagcagcugaaguggucugcagcccuauaggaggagcaacaguaugaacuaaccaguacccccccccccccagagcucccuggaacuaaaccaccaaucaaagaaagcacauggugggacucgugucucuagcugcauauguaacagaggauggccuaguaggccaucaaugggaggagaggcccuuggucuugugaagauucuaugcccuaguauaggggaaugccagggccaggaagcaggaguggguggguuggugagcagggggaggagagaggggauagggaauuuucggggauagcauuugaaauguaaaugaagaaaauaucuaauaaaaauauauuaaaaagaaaaaagaaaaugaccggaggccacaggaguugcuucuuacauauuucacuaacuuuacuauugaacaugagaagcuauccaaguugagguugaaacaagcucgcgcucaugagcgcacucucccucucuguccucucugucucuccuccccccacccccccacgcacgugugcuuucucugucacaugacuaacaucaucaacaagguauacauggcuauucaucuccagauugguucaaaagauccuaaggugcaucauuaaauuauuuauucaaaaauaaauaaaaaggaaggguaaagaggacagagguagaccauagcuggggcugcuggcuuacagagaaaauggaagucccaaguucaagucccagagagacccugccucaucggaacugguggagcauuacagaggaggauccuuaaugucuucuuuuggcuucuguguuguguguacaggcaugcacaaucuggguacucgcauacacccggacacacacacaugcgagcauacacauaaaaccuuuuaaaaaagguuuuguguguguaugugugacggugggggagggagaggaggaggguggggaggauggggagagagaaaggacuacuuguaagaauugguugucucuaccaugugcauucagggcuugaacucaaaguccuuaaguguggcagcaggagcuaugacccacuguuaucucaccugcccuuuuguuuuccauugaaaugcagauaaggaaaacagccauuuugaauccugaguaccaaggacuuaaaacaacaagaaugcaaguuacacauacuaaguagaauggcaacaaaaugcugcaugauauguuuaaagcaacauuguuuuauuacuugcuuuugaauguuugugucagggaacagacauccuuggaagagggagagaucccuugguuacaguacaaugaggucaaugagagcagcagcgaugaagggaaugagccugccaaugaguuugcacagccggaagcuuucauguuggaugggaacaacaaccuugaggacgacucgagcgugagugaagacuuggauguggacuggaggucagugccuugcugcugugugcuuaguuaccgcugaggagacuauaggagcugcuucugcuaggcgagcugagguucccccccccccccaucgcagaugucacuguccccagagaugggcuguuucccucuuucucacccuucuuugacuuucacgucuuuguagcauugauuuuaagagaaaaaaauuaaggcccugguuuugaaugucaauaccugaaauaauuucagacuuacagaaaugacagcaaaaaugaugcagauauucccauauauccuucacuaagaucucuuaaauguuaauauuuuaaaacaguguuuacaccauucucccuuuccuuuucucucuguauuuaugguaugaauucuucuggccauuuuauaaauaaguccacagaaauuauuuuuuaccuauaaaaacucuagaaugaauugcugaaaagugugagcauuuucuuagaugauauguaaucgcuaaaucauacaaauaguauugguauaguacuaauauuuuaacccccagggcuuacucuaguguucguuguuaucucaugacugacuuuauaggaaauguuuaucugaucuaauccaggaucgucauuacacucagcuaacauguuuuuguaaucuggccaucucuucaguuaaucuuuguuuuuuaauucugacaaauauuuuaaaaguuuaggccauuuauuuauggacuauccuucacauuguaauuccaauaucauacauagcguuacuaauuuuuagcagaaagaacaaaaaaaaaugauacauuuuguccuaaguacauaccagaagacaaacauggcagacagcuuugaaguguccgauuacauuuccucuuuuuagccaguggcuacuuugagacuguaaguacccuguuuauucuccaacugucaaacuucugucugcuaguuuagcauccauuaguaauucauaucugaaacaugaauuuauuuguucguuuguuuguuuuucgcgauaggguuuuucuguauaacccuggcuguccuggaacucacucuguagaccaggcuggccuugaacucagaaauccauccgccugccucugccucugaaacaugaauuuuuaacacugauuauucuuuaguggcccaauuacaacuagauaucauguccugaguguccagguuuguuuaugcuacugaagaaugauauggaaguaauuuaccucagccauuuuggauggauuuucuguaggaaguagacauguuuguguuguuucagaguuguaaucugaccuguugcagagcaguauucauggaaggacuauuucuucaguuccuuggguaucugcaguaugcuauuugugugccuauuuaauuuauuuuauagaugaagagcuagucagagucauaaaaugcauuucucaauuuaacugugauuuaauuaaauccuguuugacugaucacaagccacucucuuugcauucuuguucacuguuagauaaaauguuguauugcaagaguagacuggugauuccuuucauuuuaaaaugucuggauggguaagaaugcuccuguauucuaugugauguuuguugauuuccaguacuccuaaacuaaauuuccuuaauauaucuccugugcacuuuauuuguaauucaauaguagccaacugguuaacuguuuuaagcuaccuuguaugacaguuucugacucugauacucaaaugcugagaagauaucgaagucagcagaaguuagccuuuagacaaaccauuuuaggcagugaugugaguccaucuacacagagcaccccauaggcaacuggaaugugagucaggagcugcagagagauuggaacuacauaagaaugugggaauuaccugcagaggaaaccauagaagaagugaaauugaauuaauucccaaggcagcaagauuagagagcaaauggccaauggcauacuuggugcuuuguuuuguuuuuuaagacagaauguauguaauuuuagguagccaggaacccacuggaauccacugccucugccuccacaaugcuaggauaaauaaaggcauguacuaccaugccuggacguccuaauuuugaaauacuuaauucuaaggccagggaaaauuuguaaucugacuuaaggauaaaggaaauagcuuuacaccagacucaaaccuuuuuuuucuugaugggcuuauaguucuuuagcaccagaagucauaaaaaugaacaguuuggugaaaaauaguuuucuggcuauuaauaaaugaaggugcucugauuguuagccaaggggaagaagagagauuggggaaggcuugagaaaauaaaauccuguaaaacccaaagaaauuaagcaguucagagugugcaggggcuuggggagagcucuuauuuagugauagaauucaaauacaauaauuuuuguucucauauuuucaucuucacccagauugaaaacuaaaauuaacagagaggaaaauacagggacaggauugaaugaguaaaaauacugcuguaaagcaggcuucugagucaguagcagacagggaggaucgcacacuguaugcacugagaucacagacuggucagccaauaggcuauauuaacucuuuauauuuaauacuuagcuuuucuguuguucuucauguucuuugguccauagaauucacaugcaaauauuucaaaaguuuucugcuugcaaaauuuguacagccuaccaauaugguaguacaaaauuaucuucacuguaagauuuccgaaaugauacuuaugggucuuuugguuuuuuuuuuuuuuuuuuuuuuucagccuguuugaugguuuugcagacggacuuggaguugcugaagcuauuucuuauguggauccucaguuccuuaccuacauggcacuagaagagcgcuuagcccaggcuauggagguaucuuucuaacggauaacucccacugugauuguuuacacaugaacgcacacagacacagagaggcucugguguccacagagcacagacuuuugcaguuagauuggcuuccuuucacacauugcacacuuucagcagugggacacauuuguuaccucuucuuaccuucuuuuuauuuucuuaaacuaaaacauacaaacuuauuuugaaauguauuuauccacaauuaaaaacccagauauuuucauuuaggucuccccuuauacuguugaaccucaacacuggaauucuuuucaaaacaaaaacaaauccugcaugcuuucauuuauguguguacuaagcaacacaucucuuuugucaguacuugcuuuuauuucuauuucuuuuccaguacuagacccauaguagcuuuuggugcagaucuuugcaauauguauuagacucauauuagcaucucacguuugagugagcacaaaauaaaauagcaaacaucuuuaauuuuuuauagcugauauuagaacuuucuacauagucuuaaguaauaacuucuugagcaucuuugcaaagaaaauguuuuuuaaaaauuuuaauucaaggcugaaaagauggcucaaugggaaaaggugcuuucuacaagucuggcaggcagaauucaaccccagggacccaacacguugugggcgagaaccagcucgggaagaugugcucugcuagccauaccccugcacacacacacacacauacauaggcacacaauaaagauguaauuauacaaaauuaaugcagaaaauugguuuaaacugaguuacaguuuucucauuuaugauuacaguacagauaaauuaaaaauuuuagcuaacacuuaaacacaaaauuuuacugggcaugacauuccuuaaugaaauagggggaggccuuuccucugccugcuuacuuuuuggguuuauaccuagagaaauguauucagcaaaaaaaauauuuuuuuaucuuuaugaauauaugugugcagaguauuugaguguguguaugugaguguguguaugugaguguguguuuuaucagugcacauuugguuugcuccgucuuucccacuguaugaccauuauaagccagauacaucugugcuagucugugcuuucagcuguuuugagaaguugaauugcuggauugcauaguaacuguuuuuauuuauuuauuuucauuuaguuauuuauuugguuuuuuugagacaguguuuuuaguguguaucauuggccauccuggaacucacucuguagaccaggcuggccuugaacucacagagauccaccugccucugucucccaagugcuaggauuaaaaagaguaugccaccaccaccuggcuaaguaaucuaguuuuaauuguuuaagaaguuaccauacuguuucuguauuagcuacgacauuuuugaauucauaccagaaaggaggcccauuuuugauagccaucucaaaaauaaaguauuaagcuagauugauggaguguuauagcuuugugaucuuacaaugugauuaggauaugccugcuaacaaguaauaaacuguguaguauuaguugucuugauugagagcagaucagaaagaagauuccauugugacuugggauuacuggccuagguuuucuggaagaaugggacuuagaggauggacagagagcgccaggcaaaggaaacagcagcaugugcaguaagaacgcacagugagagccgccgcagcaggagacagccugccugucgaugaaagggagaggaugagucauacaaaugugcugugcccacuugcuucucccagccuucccuggauagucacuuacagggacuuagccccuaaauaaagguggcuggguaacuugugaacuagugugugccggugcugaucccgugcaaguaaauaaagccacaggggucaguuuguuacacagcugucaguguaagcaccaaggcgcuccuuuuucugacauugcugaucccacagaggagaucugaccauucauuugaaaaaugcaguuauaaugagcaaggagcuuauuacuaaaacuaaaaccaagcuuacgggcuuucuacagacguguaugugugugcuuauguacgugcgcacacguaaaggagacguauuuggcuuaaugaucuuggugguuaaauaggcaagggacuaacaagaaaagaaugugggaaugugauaaauauagguugaugagacaucuuaaagaugguuucccauuacuauuuuacaguuucuucuaacaaagaacuauacuuuuuccuuuucagacugcgcuggcacauuuagagucccuugcaguagacguugagguggccaauccaccugccaguaaggaaagcauugaugggcuuccagagacucugguucuagaggaccacaccgguaaugucuaaguucucaagguggaaugcauggcauguaguagacuuugaugugucauugggcucuuaggagaugaaguaguuaaguaauauauauaaguauauauauuuauuuauauaaauauauauaaaauauaaaauuauauuacaaaauauauuuuuaagccagaagcugacaaacuuucaccuaguagaaaauguguaauaaaaucacaaagauuaaguguuaaccagcugucuuuuuaaaagaggaaugcugaugaaauuccaaauuauuuugcuagucguacuugccaguuaacugaucaaccucugccucuuucaucuuccauggcugucacaugggaucagucuuauuccuguugaaugcuaugcuugacacaugugcacuguuuguuguucuuagccaucggccaggagcagugcugucccaucugcugcagcgaguacaucaaggaugacauugccacagagcugccuugccaucacuucuuucauaagcccugugucuccaucuggcuacagaaggugaguuucaagaggacuucuuaaaacuuaaugcauaauaguuucacaauacuuaauacaaguaauaauaauagugaccuuuaagcuuauuucaucuagacacauaucuagacaacagcuauuuaauguauuuucauuuacggggcccugaaauuguuuucagaaguaucucaaaaggcucuuuuauaccacucaaaguguauugugauaauaaaacgguauuuugcaaguaugcacagauguuacuagaaauaauguaugagacaaauacaauaaucaagugacccccuucucuaguuuuuauagaccuaccuuaaugacuuaccaguaauuuuaaguguauuugaguuacuuaauaaauaaagaguuucacuaacaucccaugaucucuguugucacaugaggagugcucaccgucuaacuuaguagaagccccaaguugcuuuccuggcauugucuugcaguuguagcucugucuucccuggaacagcccugcccugcccccacacuucuucccuccucucuucucaucuguugccuuguacugucacuauguucuuaaccuguguuuaaagucccuguaauccaguguagagauggucacuguuccuuccagcaucuguugccauugcauccuggguuguggacuuucuaguuugcugaaauauuuucuauuauuccucugccucccucagcugcuucuuugcccugucuccaguaccuguaccccacccaccagugcacacaucuaugcuguccccaguuguuggcauuugugggauugguuuucuuuauuuuuuuuuccuccaaagugauuguacagguuuucuucuaauaccuaauagauuuuuaaaaauauauuucuaaguacuuuuuuuuucuguucaaacuuuaaaaacauuuuauuuaugugcuucugcaccuccccuccuacccccccccaacucauuuugguuagaauuuuuuauugugauagcacuaaauuucuucauucuguagaacacuugcucugaguuggauaaauggaacacaaaaauguccaugaaauucagugcucuuuuacguugaaguugaguguucuacgugauuacugcuggcuuuucaguuuuaauuuuaagguguuuuuuaacaucuauuccuauggugauauguauaucacaguguugugagagcuagugugauaaccuaggaggcagccagugccuaguaaguguuaaaagcauaaauaacagcagcucuauuaguaaaaguuagagaugacuuguuaaagaaagaaauggcaaauaaaccuuaauuuaugguacaaauuacaaagacaugucagaaacuugagugaauugcauguuaacacaaggauugcuaauggaugagugcagaccaugugugcaucgagucucaagacuucccgcacuguggccgaugcuuucucuuagccuguuuauuugcuguuauguugaugauagcauagguggcuauuucaaacaauagaauaucuaccucacauuuuauauaaaguugaaauaguccguauuauauuuaauguguguguguauauauuauauaucauaguauaagcaccugguguggagaaguaacaguaaguuagcagaaguuaagaucagaauuauguaggaaagaacuuguaauucuagugcacgguagcagaggugaugcuaguuagaagauauuucugaaauuagaaggacagcagaaauagaggcuacaaaucugcacaguguguaccugagccuaugacucauguccaccccugcacacccgccagcccuucaaccuucgccuccuugccugugguaguaccugcuucauuucucaucucauucuagcaaacuguggcucugguccagugauuucccuuuccuuaaacaagauagacugaggugauuuucuuuaacuugaagaauagugaguggauuucugucuuggcuuucaaggccuucuguucucaggccccuaagccaugcccucagauaagcuuuucugugcauuugcuccugaagccuggcucuccucuauaccaucugugagaugagacacauaacuagauaaguugaaacccuaccuuuucaauauaacaagcuuucuuuacacucucaguuaguuauagagacuuaggaaggacucuguguuuuguacaauugugguuaccaccagauguacugacguucuguucccuauugcagugguuguuacauggguuaaggugacagagcugguacauccuaggccaaaacuacacuuguuuguaugauacugcuguuagaagccacucauuguggcaaguuauggacuugaugucauuggcuuuuugaaauagcgugggcuaacaaucuaguuuucgucaccugaggaaaaacuuagcaugaagcuacuccuggggaaaagguuccuaagauaaaacucuuugucacuuucaacagugugauagcuucaccacccuucuaucagggagaucuacugggacaaagguuagauuugcaaggaaaugaucugucaucuguuagaugcuagaucucuguuguccuccguugguccuaagacccuuccuuaccuucucuuccaggucugugguuggcuuguuauuuacauagcacauagcuuggucuuuuuguagaaauggauucccugguaaauacaguaaggucugaaguccaaguguuuuaucacaucugucuauacuaacauguauguagcuacauguuacuacauguauauaacaaggaagggacugguggcaguauacuuuggugagccaauugugugguauucccaugcgccuaguagauaaaguaacaguucgauucaagcuguuaggaaguuacacugugaccuccaugagggucacacacugacucuccacuccucuuugaccacagcagccaugccaagcauggaaguuauaaauaaauauucugugaacaaaaagugaguugauucaagguacaaacaugaucauaacacacuuuuuauauaagagaaugugagaagccauggugcaaacauacacaguuuucucuaaaagaaauuugagucuggcauuaaaauguugagauggcguuaaacagaaggcuuuaaaguguuguccuacgucaguggguuugagguguguuuuuuguuuguaaauauuugauuuggggggaaagauaacugcaguuaaaaaugcaugugccuuuuacagagaugcugagugugguucauaacagccaggucaaaugaauuacaguugcuguaucuagcucuugguaaaucuuaacacacuguggcuccauggguaccugaccugauguacacacacacacacacacacacacacacacacacacacacacaaguuaaaacaaaucuuuucuuaagagacacuugacuugcuucgaggauaaugauacuaugauuucugacugacugguugguugguugguuuguucccucucuccaguccggaacaugcccugugugccgccgucacuucccaccugcaguuauugacgcaucugcagcugcuuccucugacccugacccugaugccucgccugcaaaugacaaugcugaagaagccccauaaaccaucacguggaaaugagaucaaaauccuacacaguaaaucugcaaauuccuucuaaaucugaugugcaaauaauuauauauaaauauauuuaaaaugcucuauauaguauaugccauaguuuaggaagagaauauuacccuuucuaaacugaacuuagguuugcagaacacacuaaacauuuccagcugaguguugaagccgugcaucccuuuucuucgguugaccaugguguugauugugacgucagcagucaucucuguggcacaccuuucccuuuugucuaaagugcugccacuaagagaucauccuuacgcucccuucccacaugagaugugaagacuguggucacaacaguaguaguacaacuugguuucauugaaaauaaacugaauucuaaagcaugcuuucucacuggucccuuugcuuuugcuacaucgaaaccucuugguuuauaacaauacugagaagguuaagauuggagcuuuucagaaugccaaacaaagacuaaaguuuugaccagaacaccaaaaaauaaaaaaauaauaauaaaaauacaucuuggauguaaaccuccugaaauggucacguaauaaacucuucagugagcacuggauguguuuaacggcgaguaaaacaugugaauaaucggaugugcuccaugcauggcacaguucaugguuuggccuuaugaagcacugucuaagccccgauccagucugcuucuacuuguuaaauacuugaagguccaggacacucuugacauguuuguuuaagaaguuggauauaguuagcuuaaaguaguuuggguucuacuuuagaaggucugaagguuugcacauggucauguucauaacuauaucacccccauaagaggugcacagcuuuuaggugaucacaggagugggcaaguguguauagacaucgguguaacgggucgcucacgagugaaaccagacaucagcacuggggaacaauggcuuagacggcauagagcgagugugcacccaccugcuccucugcucauagugucgggaauguuuauguagcuuccgaaaugcaguuucauuuaauagcucuguguaauaucucugagcauuuuauauucuuucuuuuuuuccagucuuaaaaauaaaugaauuuucacuuuuggcacauuugaggcuuaaauauaagaaacauaacacuugcuuucugauuuuugcauauauuguaaauguggcugguauuuacagcaaauacuguguauccuuuuauggguaaaacacaagugaacauugcaugcaaguaauguggugaauuuguaauuuagagguuuucuggggcuucugugacuuuggaugcuuaaauugaggccuuaauguugcucuagcuagcauguuuccuccugauguauauagucagcguuguauaaacuaaucucugcuuguuuucuacucugugaucuuuccauaccguauuucauugaucaguuagugucagaagucauaccagaguaacauuaguuccuauguguauacuguggauauuugugaauugugugguuuguuuguuuguuuucuuuuauguacuguugacuaguuauggcacuuacugauuaaacuuacacugcugcagauugcuguguaacaagccacauguuauguuuagucacuauuaugggaccuugguuuuucuucuagauagcagcugucccaaagaaaauauuucuucuuugccuauuaagauguagcuauuaucugccaguuguuaaagggguuugguuccaaacucaaccagagaguugaacguaagaaagcuguuguacuuuuugcuucccaucuguuaccgucccucacuguuggcuccuuacuacgcauacacagcugcuguggggagaaagcugaaugagacuuguuucaauuuuuuuagaaaagaaaaugaaguuuuaggacuuucaugguaacaaaccugacaaguucagaccccaguauauuauuugaucuuaucuuggauccuuuugaaaaguuaagaauauaugaagguaaauuagaaauagugaaaauauugauaaaaugucauuuaucuuauuucucuauuuuauguuguuacuuggccuauuaauuuuaauuuuuugaacauuuucuuauuucucguaugugaaugcugauauuuaaaguucaacucauguggauuucuuuuguguuucuuaguuguuaucucuaagcuaacuaacuuuuaagauuauuugugauauggauuuauauauaagcuguuaaauauauaugaacuguuaaaacggaaugcaagguuuucaaaagcccaggucuaacugugaugauugguuuauuggucuacaaucccagccuggcauuuuccguguaaaucauaaacaauaaacaggauauacucgguguucauuucuaauauuuaauugugugacccuaucacuucuauaacauaacccugaaggauuuagagucaguaacaaaggacagaacucuuaaagaaccgcagcuugagcugacaggguggggucuuuccuaagggaccacauggucacuua

SEQ ID NO: 8702 - RNA, 154384 nt, Mus musculus
agggcugcgggcgccuauugacccaacggccgcugcgccgccgccgcugccgccgccgccgucuccuccggcucguggcgggcgguacaggagcgccgaguggcgcuggggaaccggcucuuccuuucgcggcugccgccgccaucuccgcguucucggggcgggaaggagggggugcuccacggcugcagcuggagcgggcuccucuccggggacgguccucuccuccucccucggcuugccuccucccggcgcugcccgcccccugcgcccuccgcgugcagcccgggcccgcgagggggaagguaggggcggcgggggccgggagaggccggggaucggacgcacacgccgaggaaaguccuggauugcagcgcuccggcgcacagggugcacccgggucgggcccccgcaguagccgcggcaggaagggguucuucggcgggcacgcgggggcgguguggcgggggugggccugggugucccggcgcuaaguuguggggcacggcgccuccagguccaguuccuucuuccgcgcgcuccuugcucccagcgccgcacacucggccccggagccgcggaacccgcgcguucucugggcgcggaggacacgccugcccuugucgagaaaacuuuuccugccgacucagucgugccggcccguggcaggaagucgggcagagaccucuccucugacugcuccgaccgcccuaccggguagcgcuauccugcaggaaagcaaguuuguggggaccuuugccuugcucuccaggagucugccuugcagggacggccggccuuggggagggcagcgggccagggcguaggccgagggcgcgugguggcuccggagacgaggugcggagcgcagccgggacccgcgccguagcgcgcgaagggugugcggccgggagcagggagcccucggcgaucgccggcuggaguccucagucuucugccuccuucgggugaggaccgcguccuggccccgaguccaucgaggaaaaugaaguuaagucgccaguucaccguguuuggcagcgcgaucuucugcgucguaaucuucucacucuaccugaugcuggacaggggucacuuggacuacccucggggcccgcgccaggagggcuccuuuccgcagguaagcaccugguggcgggcgcaagcuggagggcuggucccggggcucgcacuucucggcaccggggcagggugaggccgcacccgacgaccggcagagccucauccggcuugcugagguuucggaccgcugaguuugcaaagugcugggcgucaugcgguggcagccuuggcaccgggcaaaagaggacauauucccacauuugcacccgggccuguggaagugggcucggccaccugcugguggggaaccggugugagugucgccccuaagcuagcucaggguuaaagcugccagaggccgcccagaucccugaacgcaccgaggcgcggaaauugauuaaacacagcccaccuaggcagauuucuguuucugaccccuuucccuuucacugucucuuaagagauaaaaaaguuuauuuccuguugcagcccuuugagauauggauaguaggguugauuuuagugucgucaugcuucagcuguuaccucggguugguuuggagcagaguggggaagcgccuguuauucucucacuggaagcugugcggcgcucaguucucugcggggugguccagcuggcagaggaguugaacaaacgacccacccgaagucuuucaggaaaaguuacuagcaaauaacaagaaauggaugcaauagguucugugugggaggugaccacguagcaauugagaguggccuuuacggcuuuucucuguugacacacauacauuuuaguagaagcagauguguggagaaauccgaagaauccaaguguugacaagcuaacaacuaguugaccagagcaaucuacaaccuacccgaauaaggcugauguuuugccuuuuuuuuucuuuuaauaugacaguuuaaaugacuggaaauagcccuugccauuucuucugauaugccagggucaauggcuuggugggaauuuaaugaaaucggaacgaggacuugcggauucugucauuaguacacagcacuagaaguauuuuuuucuuuuagaaguguggaaauaaaaagcuggccacagacagauguuuccaaauguuuacagcuucugcuuccccuauagagcacagagagaaaauauauaacacaugcucucugcugccuuuaaauuuugaacuugggaguuugcaccggccuugugcaaaggcuggaguaaacuggcagccagggcccgggagaucugagcuuugucccacaugcucucuaauuuuggaguuaaauguaccuuucuccccccaaccccauuuucagaguuuucucuuugcacgaaauauauaaauggaacuccucuugcccagugacgucuuaauaguguccucuagcuuuggcugggugaucgcuugaacaugauuuaugcgaacaucugcaugggguucucuggcaaccuugacauuucccucuguuucuaaagcagcgagugacucauucuguuacugagacaucucaggcaguugguucucccauuuucguaugaacccccagcucacugagaaguugaggguuugccuagaguguacagcauuuggcagagcggugguggugaccuuaggaaguggugcguugucuguuccgagagagagagagagagagagagagagagagagagagagagagagagagguggggggggcuugggaguggcauccucugugcuuuaucuggacuucauuguagagagaagguuuagaauaggugggccacugaaucucccaguagcuaaacuccauaagcccucuucguaagucucacguguuugaccauuaacuucaugugaugaaccuaucuccccagcuacugcucaguuggugggaaacugaggcuugggagcuuccugagcccaaggucgcuuaggcaaagucugggacuugaacaggcagcucucagaguauagucucagagucacaaagcugucuugcuagaacugggcuccagccugccuguugucggaauuguguagaacagaaauagacuugcugguggugacuuagcuuaugauccaccccccacccccccacccccggaaaaguaagcucuaguaugaagacagaaugaaugugguccuuuucagggcuucagauuuacgcuuucccagagagucuucuaauuuacuuuuacagccaaacauuauuacgaugcaaaccauuaggaagcagagcauccaaacgugcacauucuuucauuuuauuucuaugucugcacuguauguuaaccuuaauuucacaacaauccccagcauuguaaaacuauguugcccuccguuucuugaacagguuuuggugcgauucuugaguuucaguagagcuaauuuggucaguguaugcugagguugcuuggugaccuguauccacucaaccagaaagguuaucuuguccauucuaguuucucucucuugauguggaaacuucaguuagguaugcgguccauuugguuugcaaacuguaguuuuaggccauccccgggugagagcaaucuguuuuuuguuguucuuuggacuuuuguucauuuaccuucuuuagcaacucuuauuuccugccaccuguucaguccuggggcaaggguaggcaccgccucauccaugccccgcccccugccccucaugcccucccccugccccccucccuccaaauuuggccugccuaagaagaacccuuagagggcuuucucuugaguguuacuuuaagaauuccuuauggccaaggcagcagguagccuacauuuuuagaguuauuugaucucaguuuaaaaaaaaaaaaaaaaaguaaaaccaagcaaaaacaaaccuccagucugccugagaggugggccagaccuaaugccuugaaaauacuuuaugcuagcuaugagaaagucagcagacuggguggagaaauguuuacaucucccuggaagggcaggccauuccaacaggcaaucucgugugcacaauagaaauaccacuaggcucaugcugcuaucuagaguauuaagacaaggaaucaggauuuuuauaacagagagucggucuuuaacuaguguaucacaugauguaggggcugauguugcuuuugaacaucucuucagaaguuggaaagucaugaaaauguacaggccaaguccagacuugaucuuugggcucagagaacauuuaucaagugagaaaagugaaaacguguugaaguaguugauuugaaaguuguuaugauaagaacuuuggugcuguaaaaaaaacaaaaaacaaaacacaacaaaacacaggaucuugcaacuagauguauauauagacguaugcuuaaaugcuucauaccacuugggaaacugaggcaggaguauuggugcauguccuggggccagccuaagcuauguagacauaagccaacacccucacagaagcaaaaaccacacccaugauuuuugagucccacaaagaacguguuaauaaaaauugauccacagcaguaagugugaugagaucuucaucgcccggcugcuguauccuuguuucuuauaaauuguuuagucugaagcauaucuaauaaaaaugaucuccuacccccugcccccuccgggcagugcuguacuguauuuaggacaacagcccucgcugcuuggguuuguuuagggagcauaauagggggguugccuggguuccugggcuauaaugguugagaucuaagacuucugggaagggauggagcucugauugcaaucacgauuagaaauucaaguauugugagguggacccucuccauccccuuccgagauuaguagucucugggacuccucugcaaagcacaggucucagacuugagcuucugggaauaaagugggccagaugcccuggcuaugucugauccaaaggcuuuuauuaacaggugucaugauugcauucacugaaaggggauuguuccauuagucauucauuagccuuaagggauugcugggcucuggacagaacacuaaugaagugaccacuucuguaugguuuuuacucugagcuugcuguugguuuugugauguuagaacauucaccuaaaaacugaggggugguacuugcuggccccucccauucuccaguuuucucuguucagagaccucagcuucuccugguuguuucccuauuucuauagaaaacucuuuaagaaaaucaaaggguauucaucugcucuggugagcagauuucugauuucugaaggggucguuauauuuuuggaccuuguuccuuuggggucaagugccccaugaggcagccucuugauuguaaguguuucuccagaacuacagagaggaaugcuguaaaguggagacccucaccuccuuuuauaguaguugauagaagauugaucaagggaggaagcagaacacuugaauccaaacagguuuuaauugcccucccuaagcccuuccuaguuucgugguugaaaccauguuccaguucagacuuugagaauugacagcauugauguggaacucacacccugcccuuuaaugaugcugcugguguugccuccugauacagaagaaguaauuuaucuugaauaaacuguugaguaagacuagauggaauauuggagagagaguguuuaaggucauaucauuuuauacagauaacaaguaucuaacaaaguauccuaagccuaacaguaucuccuaaggaaacccccguguagaggugcugggguuuauaacugcaugugcuaucuuuccuccuccacucuagggcuuuauaacucuuugcuguugauacuugggucagauaauucuuugguguugaggcuuucgucugugugguaggguaucuggcaguacuccguucucuuccugguauauacuggcagccacuugucuucuuucuuguccucauuuguagcaaucagaaaucuucccagacaucugcuagauauaaauagccucuguuugggguuuggggggacuacugucccuacugaaaaucaguuuggcuauggucuggacaaaggccuauuuuuuuuuuuuuaacacaguguacuuucuagguauuuuccacuuuaggagagugagacugaaaggcccugguucuaaugcucagaaggauaagagguauauuuacauauucauacuguauuuuuuuuuccucuggauacauaaaauucagugacauaucuaggaccacaauauguuacagaaaacauacagauacaucauguucgugcacaagguaaagaaaaaaauggaagguuaacuuaccuuugccaccugguuguacacggucugauaaaagcgaccuguucacaucguagcuccuagguggcuuugcuuucuccaaguucauuggagguuggcagaagccucgauuuacucuccuugcuguuuagagguaagauacauagaucauuugcaagcuuuauuugaaagucugaaguucucucagcuuggauuucuuuuugggcagugugaugaucuggcugaugcauuucgagugccuccuugagaugcauagaagcgggugggguggggaacuguggaaguaaguguucacuguggcuugccuuccaaacaaugucuuuaaagaccggaugggagaugagcaggaagccuugagguuguuguccuuacgccuaaaccaacugugagguagaugauuggccucgugucuuuguagggccacagcuaaaagggauuuuuacaucuuuaauauuucuuuucauuucauguccauagcuaguugcgugugaauccucuuagaacagucaaauaaauggcugggcagaaaccuucugggccacaaaccccaaaacauuuauuaccugaugccuuucagaagacgacuugauaauccugggucuaaauucuucucuucguucuucucuguuguuggaggcagacauugugcugaagcaaaagguagaacccuugaagauaaaauucuuauaaauuggguauuaaauaagcauuggucaaaauuuauaucucaaaggcaggguucaaaacuuguguuuaucugcaugccucauagauuuccagguauccguggggcauguccaugcuagagcacagaggcacgugauacacguaaguuucaccugagauuuaaaauuaauuaauuauuuacuuacuuuuuuacuuacuagcauugcuaaugugcuaggaauugaaccuugggccuuacacguuagguaagugcucucccacugaaccacaaucccaucaccaccccaccucccuguccuucuccuuuccuauuuuuauuuugaggcaaggucuuuaaagaguuguauagccuggccuagaacucacuguaguuuaggcaggcccucaacuuguuuucuuccugccucagccucuagaguagccaggaugacagccuguaccaccagacccuagacuuugaaaguuucuugcuagaggacugcccugugugugaguguuccggaccgugcaccaggcaggacgaguauauaccuucaggauuggaaccuauaacucuguugagucuugcugcuugcugugacucccagguggaguacagagcucaaucugaauauuuggguuagucaguaaggcugaagcagagaccacacguggguaucuuucauaaccuauuugcacagaacaggacaguucucucuguuguccggaggguugcccaggguguagacugcuguucugcucacuaaagaauacuuuguuuuucccuauaauugauugcuccuaaagcuuauguauagcuuucuucuugguugugucucuagagguuguaccaucgucuuuaaaccauaguacacuugguuugaacuaaauggguguggcaucucucacuguuuauggcugguguuuuaagucuuuuucucuuccuuuauuuucuuucccccuucagugugugcuguguguauuuguccagauggcuuucuuuuucagucuaggaauauuuuccucuccuuuccuuuccuuuccuuuccuuuccuuuccuuuccuuuccuuuccuuuccuuuccuuuccuuuccuuuccuuuccuuuccuuuccuuuccuuuccuuuccuucgaagggcaaaauggauccugaaccagaccuuaugcugugcucuuucuagugaaccacuucaucuuggaucaggagaacuggcagucuuaacagugaucugucuuuuaacuccuuuagugaagguaaauaauaaaagaaacagccucccccacaccccacaagcacagaggugugcauugacagcucuuucuucuuuguuggccaacccaguccagcuucaguucagugagggcucccuuccucauacugacauucacuugcacaacuggaaaacauauugcuccaucuugagcccaugcuuccuuguauaaaagacgaaggacucuucucccugccguauacauauuaguuugguacuuaauucuucugcuugauauccuuaauaacuuagaaggauauaucucuaucugccuuccugaucugucacccuuagauaugagcuccugacuccuaccggucagaugaggaaagugguguuuucaaucgucuuccgguugauucugucuucucuacauucuccauauuccuggaaccagcaguuuguuguuguucugauuuaccccgucagcuuuaagucacuugcaucuaauuccaggacuuccuguccucucugaucagccacagagauugggaaccaauaaacaaaggauacagaauuuccuguagaggaaaaagccuaagagauuuauuguauacuguaauaacugguuaagagcccucuucaaaacugcucagaguagauucaaaggguucuuaucacagagguuauacauauguuaacuugacugaaaauuccaaaauguauaggcauuucaaagcagcauguugugccugguaaauguguaugauuuuuguuuaccaaucagaauacaccagaguguuugaacauaaugaacacuguaaauauugauagcaugguguuguucccugugucagguaacuuucccucuugggaaggaagcaugacacugcauucuuaaauaugcuucucuuggcaucugggcaagugaauucuuguaucuuagauuccagcugucagaagcaugcuguuuccauauccuucacaucuggacugugacuuccuuggauagcuuauuguuuucuaugucuauuucuaauucauuuucccucuacguuacugacagaggaaauagaagucauugaauacugucucuugcaucucguuuuguuaaaaguaguuuuccagcucagcgugugucaguacuuaagacucucaggguuuagugggaucaaaagaaagaaguguugcccuuucagcuuguuguucacaguuaacacugaggguaaguucuguuuugucuccuuucccaugagaagucccuuucugucagugugggcacuuggguuccugcauccuuggcuguguucccucugaguucuuuuauugauugauugauugauugauugguuugguuuuuuuauuagacuuaaauacauuuuuguuugcgauggaaugcuugcauaaaaauuaaaaugagaguuuacauucuuuaaaaaaaacaguuuuaaaaacuaaaauaucauuauauuguuucuucuccccccuuuaacccuuuccaucaccccaacuugcuuucaaaaaucauagcuucuuuuucuuuaauuauuauuggugugcacagguaucuguguguaugugcaugcuagugcaugcucccacuugugagugcuuagugcuuuguguguaggugugugugaguggguggguguguucaguguagcuuauauauauauauggcuuauauccucaccucucaagcaagcuucuuuuugcagcagauggagcccauuacagaaagccacagcuggccaacauauggagaacaacugaccagaggguugcuguacuuacaacacaacaacccuacacugaggugcagaguacauggcaggaugucuuuuagauaugacaggaaaccuacacucguaaaaucucagcaauaugacugacugaagacuugaacuaaugacgacacuaguugacaugccaguagaugugguaaaacucugaguuccuuugugccacucauguggaaugcaaggguagggccuuaugaccaacuuuucucuuucauaguuuucgguuucacagugaaacuuguuuuuuaaacaaucuaggucugcguccuagauaagucguauauaaaaaguagauauagaauucaaggggagaaaagguuuguagguuaguuaauuugguuuuuuguuuuguuuucuguuuuccacuauggucacuaggugacauaaauuugaccuuggaaaugugccagucauugccaacacuuaccugggcaugcccaguggccuuucuggugcaccaucacuagccuagguuuucaaacuuagaaggauggcagagcuuacagagauuucagugggcauacuagauaugcuucucauugaaacacacagugcacagauuaugugcccugcagacugcugcagacccuggggacacaggaguaaaaaccaaagaguagucuccggcaucuaaccuuuugaucuugugauaugauauggacgucuacagaugucggccuuuauuuauguucugccuagccugacuucugaauagguugcuggccuguagauuggaccugcgugcaguuguccauguucuucuuucucaagaccuggacguagaagggaacucagaaacacagcuguguucugacgauggccaagauaacuggacuuggaaagaaggggaggaguugaguauguguaauugaccuuggcaacaguagcauccuugcuagacucaaguacagcacuucuccagccuugcagucuugaacuuggcauuugagaaggggcaaggagacuggcuggaucuagagaagacuuuugguauuuaguuuugagccuggugugguggcacacgccuuuaguuccagcaguccagaggcagagaggcagagaggcagagaggcggcagggggcaggggggacaggggacagaggcagagaggcagaggcagagaggcagagaggcagaggcagagaggcagaggcagaggaggcagaggaggcagaggcagaggcagaggcaggggcaggcagaucuggaguucaagggcagucuggucuacaccaugauuuccauccaggacagagagggcugcauagagugacucugucucaaaaacaaacaaacaaacaaacaaacaaacaaacaaaaaugaacaaaaagaacaguuugggaugaaauggcgaguugcuuggagucaggcuccaguugggagucaggcagaggcaaucuucucagagucacugcgugccaggaagcugcgugagagagacaguauuagagaauucaucucguagaaaauuuuagaccuggaagagagugaagagaauauucaaucucgauuauucugguagcaguguguaggaaggcccagauacaugaaggcugcugagaaucugugugagguaaugaacagacauaaggcaguaaaucuuuuuuccaggguugaauuggcugcaaucagaaaaggagaaaaaguguacagacauguugugaggagaacgccaggcccuucugguggauggcaaaggacaaagaugagugguuugagucacauguuuucccuugacuuuuucuccuuugggauauuggaagcaaguuauacuguuugcaaauaguuugaaagaccagcuagccugugaagccaaguucaguuuuauuuaugacagaguggacguugguggaaauagccaagugggcuaagagaucaaggaaggcgccgucagccgagaccucgucagagccgagaaagaaugaucucacucugagacugugccuggagaggagagcccugggccaagugcauuucuucuagccaaaaucggaaccuuuuacauuaagauucccaugcagcagauguuaauaacauaaagcagccguguucaguuugucagaaacuagcacacggaggaacaugccuaugaaaacacgucaucaggaggaagcguuucagacacgcuuuucaaugggaaaccaaaaggccccucguaccugaugggacaaagacagaaccuggguuauuuuguauguaugguugagagagaugaagagggauauucauacagagucaaaaggcaguuaccccagcuagaugguucauagcucaguguuggccuggaggucggucaucuugcugaaaacacccuccaaauggucuguuacugaugaagagccccuccucuuuggcuggcccacauguggaagaacuaaaaguuguuuuuuggcccagaaccaucucuugaaaacuugcagggccaaaaagcuacaagacuuaaaaugcaaagcauuucucggaauuuccaggguuagaagaucuaaccagcaacuauugaaucagagggugcgagggccaagaauguccuccuuaaugugcucuuaaacauuuguuacugauuuuuacagaaaacgauucaucuuauuuuuaauuaaauguguguguguguguguguguguguguguguguguguggugccuacagagugaagaagagagcacucggugcccuggagcuggaauuccagguggcugggagcugaccuugggcccuuuugcaugggcaguauguguucuuagccacggagcuccuuucucuccagcucacuguaggagucauaacugugcuggcccuugcugguggucacucuccuacucugccucuggccaguugguucagcucauuguuaaauacgacaaguccuuagaaggaauucuguaacccuuuagaaucuucaaugcuuaggcaauucagaguuuauaugaacagaaaugacccuugccuaaaugcauggcuucuuuuaguaaagauuagaaggagccuauuuggggaaugacuccuauaaauaagaucguaggggagacugauaaucuacucacuacaaccccacuguuaaagacuuucccaaaccacuucugaaugagagauuauguuaggcauguggguugcauuuauuuuauuaagcuaagacuguucaguuugauuggcuuuuucccauuacagacauuuauucucuuuuuacauugaaaugguauuuucucaaaaucgcuauguugacagaauuuuugccagcagauucuaagauacaguauagguucuucaucucugcaaagugaguuuaguauaaauauacauucauaauuaccuuguggauaaagagauaagcagauggcauagauaggagucagaaaccagaauagaccagccauucuugaugggugauaucuaucaacagagcuggguaaugugugaacuguugcuaccucaaguauaccaugugagcuuacuugugaguucuuggguggggaguagaucuucucuugauagauuaucucagaaugcucaguauaagcauauaaauauaucagggcuggcauaguagauaaagaugcuugcugccaagccugaaaaacugaguuugaucccagggucccacaugauggaggccgagaaccagcuccugaaggcuguccccuaacuucuacacgaguucucuggcaggugcauguccucccaauaaauaucuacaauaaaaauaaaaacguguuaaaaaaaauauaaguauauucaaaguaagucuugggagaaacaccaguagugugauucuuaaacauuuuugggugugggcgggggugggggguggggagauucaucugcugaacagauuugaaagugcugaguuaaaaaccuauuauuaggugguagauaauuugcacagugcugauuaauuauaguugucaaguggauuuguaaauaauaaaacuacauuuuauuaaaauguuuuauaaucuagauauuuguccagcuuacacaccccucuuccaguaauuguuuuuuuuuuuuuaugaagauggucuguuuugcaaaaugucacuuccuaugauaccuagguaccuaaauuguuaccucaggagagaggauguggcuucaugcagcuguccuggguguacacaggugagaccauuugguuuucaucucaacguacaccugggcacugauaguguggagguguggugcagugacugacaugugacugaggaaggugccagagcuggaggcccagccucugguuuggcguguagcauugggaaaguguucucccuagucagggcugggaucccugccuggugacaccagcagcugccaggggcucccaaggcccccgaguacccagccagagcaugccaggaaccuggacucuucuccuuagccacuuggcacucuugucuucucuguguccaugaguacuccuauuacugucuuaccuagggaguggaguuuaugaagagugaccguguguauugcuccugaguuuugggaggacacuguacaauucuauacucuucauggucacacggugaugccccuucuuucucugacugacugaauggcugcacgacaacagaacccucaaagagauccagguguguuacccuccagauccagacaaguaccaucaggaaaucccugggagcaguggcugugacuuggugacugaccacaggccaggucacucuuccccuuuuuggccucugggggugagguggacauuugaaguauuccuugucauguuauaaaacccaaaugucuuccugugaagcugccugccaucugauugauaggcagcauuuuccuggcuacggggaauagugcugacuacugacuagacauggcugaguaaccaugcccccugugggcugcgaagacgcccuccugagccaaguugcaguuccuauauuuagcuugauugcagugguuccuaauugaggaugcgugagaacugccugguaagccauuucccauauagaaagguggaccugugcgugcucuccaggcaaaccccacuuauuuccaauacuugaaauuccuguccguacuggguauguguauauucagcuuugacuucuccucuuaguuccaaacuagcaucgacacucauaaccaucaugcagacaccuguuagcugcugggugcaucaguuuuccuuccauucucuccuccuucagcauccuguuuuuccugagugauguugucauauccauccuucugccuuuauucuucucauuguuuggccuucucccugccauguucuuuccuaucccucugcuuguauuggccugggccaaagccacaugguuuuucuuggacaaagcuggggucccuucugaacuggaucugucccuucagagcuucagaguagcuugaauacauuuuaaaucucacaacuuugaaacaauguuaggacgaguagguugguguuucuuuucuuggaaaucaauuaaagauauuucuaaugacuuuuauguauauguaugugugcccaggugaguuuuugugcgucggauguauacaggagccugcagaggccagaaaaggacaaccgauccccaggaacuggaguuguaggcagcucugagucacuguguagagugaugggaacugacucuggguccucuguacgagcagugagugcuuucuuaacugcugaucuagcuccaggcuccuggacagucaccaguugcucauuuccuguaugcagaagcacaugguagaccucugacccaacugugcccuggggacaggcugcugcagcaugaccgcucauucuccuuuguagcaaggaccuugagucucuccaggucuggggaugcugcagagacagucugcaguuagaaagcucucucagguuugcucacggcagggccagcccugugguguagcagugugcaguaguaacuguaacagcuuuaccugguguagcagugugcuguuguaacuguaacagcuuuaccugguguagcagugugcaguaguaacuguaacagcuuuaccugguguagcaguguacucuuguaacuguaacagcuuuaccugguguagcagugugcuguuguaacuguaacagcuuuacccgguguagcagugugcuguuguaacuguaacagcuuuacccgguguagcagugugcuguuguaacuguaacagcuuuacccgguguagcagugugcuguuguaacuguaacagcuuuacccgguguagcagugugcuguuguaacuguaacagcuuuaccugguguagcagugugcuguuguaacuguaacagcuuuaccugguguagcagugugcuguuguaacuguaacagcuuuaccugguguagcaguguacuguuguaacuguaacagcuuuaccugguguagcagugugcuguuguaacuguaacagcuuuaccugguguagcagugugcuguuguaacuguaacagcuuuacccgguguagcaguguacucuuguaacuguaacagacacaaaggaagaaaagggaucugguugguuuuggagcugggaagugcggaagcagguggagcugggugggagcuuagaggacucagagccacauagcaucccagggcucuggggaagaguguuucuucuccagcuucuacaaguugugaguucugugcuuugggccgggaugggcguauccuuucauccucucuguccucaggcucccuuugcaggccuugcucucuaacuguucucuuuucuccuugagauccuugugcccuuaagagcccucucuggauauucuaggauaaucucaccaucuuagaaucgaauuucaucagcaaagcucaccauagaugugccauauucuagcuucuggaauugggacauagguaucuuugaguaagcacaguuuaaauugcuuuguguguauuaacugaucuucagcagcuggguccguuuggguuuuauucacugccccuauuuuagggguggggaaguaaggcacagggagguuacauaacauguccagguuucuccgccacuagguagugauguuggaguucacaugucauuucucuuuaaccuucucuaaucagggcagggugcacacuguuuuugcaggccucuaauguaucuuucaaagugaugguuuaaaaccacacagugguuaacaccacaccuccuugagugcuuggcuucuguauuuuaaguccucacauaauuguuucaagcaaugggaguuagcaucugugcucucaguguuccuuccucaaggucacacagauagcaagugcuaacauugcaacacgugaucugaaccagggccagcuugcgucacuguuuuugcuaaagggacuugaccugaugagaacguguuuagaaaaugauuaaccaucauuugguguuauauuaugggcacauucaaucccagacucauggaggaggcaagaacgggacaugggauccccuggagcuucaggauguggguguugggaauggaauucuggucccugggaccagcacuagaugcucuuuagugcugagcugccucuugaaccccuaucagagggucuugauggaguggagugacacucccacaucagugggagugauucccacaucaguaaaguggaaaaggaagauauaaaaagaaaggguggaauugaucaagaguuucagcucaugaauacacauuaggcugaugcguucucuccuuuggugcuuauaccaagcaaucaguuuuuuuucuaauuagaaacuuaggugagaaauguauuguggagaugggacaaagcauuguuuugaguuucuccauagcaugugaaaaccagcuucucgaguuggagcaaacacugagggcuugugguggaauuggacagacuaggaaucuuugcccuuagaagggagccacauauacuguccuugucagaggucaucauugucaaccuguggccaacccuaggucacacucguuuucaacuggaccauaaaguccacucuguuaaugaaggcuuuccauucuuuuaaaaauauuuuauuauuuuuuaaguguguguguaugucugugugugugcaugaauucagguaccacagaggccagagguguuggauaccccuggagcuggaauuauagacaguugugagaugccugaugucagugcugggaauugaacccaggucuuauaagagcagcaugcauucuuaacuguugagcuaucuucccaguccugacauuucuacucuuucuuacuuuauaauuuauuuuuugauacaacaaagauuaauuuuuuucauaagagaucaugaguguuuuguaucauggguuguggauuaugugcccaauacuuucauguccuagagcauggugggcaacagccuuucauguguuccuugguuuucucuuguaaugcauaauugagaugcuccugagagucggguguugugccagccaucaggcauggggagcaaaacagcugcccacuuaguggggaaagagggaugucacgcaugagucauccacugggugauugugauaaugcuguggagaaaaugaagugacguggagaaagaguacuauaccgaaggcuauuuuagauagaauagcugagagggcauuuaagguaucuuuuagggagacaguugaagcauuguacaaagggaaaaaaauaugcauuaagucaagagagucggcaagaaggagcugacuuggagcugggauacaauuagggcaaggcuaaguugggaaagauuguugcgugcaucccgguguuaacggagggggucacucugugcuuugacugugaugaagaaugcuccaaaugcaguaagaagcuacaguggauauuacagcaggcuguuaucugggcaaggcauggauggcuaaacaugcacauagggagacagaguugauucggaaaauuacuagugccuuguagucaggguguugggaggguggagggagagagguuuauugauucaacaaguauguuggagauagauaggaauuagguauggaggcauccugaggacagaggaagaaucaggacaccaacauuuugaaggagcugccuggggagaccagagcugcuuuccggagauaggagaauguuguagcucugggagaaggguguguucagcagguaggguugaugucaaauagagcaaucaguaggugcuugcagcucuggacuugccuuucagagguuucugcagaauauguacaugagcacaacaugacauuuaagccucugaguggaugagcuuauccaguauagagacgucguagacguuguagcuauaggugcuaacccggaggcugacauucagaggucagagagagaaggagccacaggaagaaaguaagggcacauggaaccgcaaaucaggucagucacugcaguuucuaggaugagggcacucugugguguguuccuggagaugacgaggucccagcaugcuuugcaucaggcugggcauauaugcaucgggggaauugaugugggcagucuuuagugagauggacaaaaucugaaugcaaugggccugugagugagcugggaguguaagacaggaagagugcagaguccacgcuuugcaaauccucauguguccgaggagcgugggcugccggcagaugacagagucauggaaacauuuucuggcucucuccaagcacacagacccaggcgcugggaagcccugcugucagucucaggccgagcugggaauccauugcagagaguccuggagauaaaaagcuugaaggaucuguugcuguuaucuagauaacaaagcagggauuugcucugucuacguuuuuuaccucaucaggccuuuggugacagauguugcuccacaugagagcugaucuuccccacucagcccacuggcccaagguucuuuaaaaaugccuucuagacacagagcuaguccugugaugcuacucagggugacaugcuuggauugucccuuuugauagaagaagggagggucccagcaccgauuagcagaagcuaaccaagcuacgaaguacaguagauggcuggauuuugccccuuuucaagaucccuugggaguccaguuuaauggcauccuggugagccaugucuuguaguuaagggaggcacagggguguggcugacuuuuaaagaugcagauaguggggcuggagagacugcucacccuggguucuucucucagcacccacacagugacucagcuauguguaccuccaguaccagggaaccugauacccucaucugucuucccugggcaucacacacauguggggcagagucauacaugccgucaaaaaucucauacacauaauaauaaauuaauuuaaaauuuaaacauauuagacuacauuaugucauaagccuaugagaccgucugcuucccgucgguuggaguaggagaacugccacaccacugggcauggggaguuugaaccugcagccuugagaggauuuccccaggagugaagccucggaggagaugacagaggugggcuugggcuuagaaauugggaggacccuggccucugcuugugaggccucugagcuguggaaggaaagacagcccucuuugcaggugaagccugaaggaagaagaugcacaaucagccgugcuugaguggucacaguaacucucgucgccagcagcccguguccucccuggggcagaucauuauguaauguguuaagaguuggcuguggacagugauggaucucuuuccuaggauggagugggcaccgauccuggucuaccucguuguagacucuaaauuagcucugcccaacgucuuugauaugugccagcuuuucccucagcucuucucuuucaccacuagcagagaaaaaucaaauaugaccuucuucccccuccccggcagaacagggcugaagaugccuccccauagaacugauuagcaaaucaaaggauaacacgcuuuucucaccaguggguuucuugcccuacagaaaacugucuuuuucaguauuccuaucagcauucuuugaccugucagcguaauugaaacauuaucuaucauuucuguuucuuuaaugcacaccacagguacaucccuucaggccacaccauuuccucccagccauguggguggaguuugccuaugagguauaugguaaggauuuuggcuguuuggagggagaccuuauuccgguguguaauauaauuuaaaaaugguuuucauuagaccauuaaugcugacagagccucagggcacacucuucuacccguacuuaaguuacuauagaacccugggcacugguuguuaauuguaucuucagagcuaucaugaaagugaaagccaccuuuaaugucuguuggcucccucuucccaaaccguagcaggugauguuuauacugagucuuucucugacacggaggguuugggagcaaggcccauagcagaagcuuucccuagacugcuccuugcccuccucacugugaguguugagcuacagugggcagcugggcuaaggauguggguccagggggaaccucguccaagcacagagaaccuuggagagguguaucaugcucaggcagccucgcauaguaucguuaaaagcucugagagcacaccaaagcuucauuuuagggagauagugcgacagcucugaaggucugauucugcacagaauggggacuugcuugauugagaccucggugcuacgauggccucuggagggaguuucgguuucgagacuggaacuccucagcaggaugagucagaacaauuguaggaagcuccaggcuguucugauguggucaugugugaagaaucuccccauuuguucccuguaacuauggaaguguggacagagacaccgugcguuugacucucaagccuuuuuauucuuucggguuccauggggagccacagcagaagagggcuuuaggucuuugcauagcacagaacugcuggcccucauagccaacacugauguggccuucguugguauggcgggcauggccagccuuuuuccaguguacuggcauggccaugguauuacaaucuacauguuuauacucuggaauuguacacucuaguuauaaaaacagccauacaggaaaccucaucauguuagaggcaguuuaaacaaauaagcuuuuuguguugggccacaucuauaguucugcgcugcaggcuggaggcuccuggcuaccuuaucacuaaagggcucuggugaucuggagcccacaugauuucucucucuucuagguaugaucagagagucaguccuguguugagacccuaggucuccuuggcuaugcuguguccucuuugcacuuuaucugccuacccaacuuuaugaguauaauuaaaucuuugacucacuguuaaaccaacaaauauucacaguagguuaaaaacaauguagguuuuaguuagauguuuugucaaaauugcaccauuguagauauuaugucuuuccuuuugcuuccuccagguugucaauuuucaucaauauucuauuuagauaaguuuguguaaggucuucagauuuuguuauucauuaaaaaauuacuuagaagcugggcaugguggugcacgccuuuaaucccagcacucgggaggcagaggcagguggauuucugaguucaaggccagccuggucuacagagugaguuccaggacagccagggcuacacagagaaacccugucuaaaaaaaaauccaaacaaaacagaacaaauucuaugauggguguuuuaacugcacgugugucuauaccacuugcauuucugguguccaccauuggguccccugguacuggaguuacagaugguugugagccaccaugugagagcugagaaucaaauccagguugucuggaagaguagauagugcuguuaaccagagccauaucucugguucuuucuucuuacacuuauuaaagauuuuuuuuuaauuuuauuuuaaaguguauguuuguggugugugcguaugcauguguguugcuuauaaugcuaucuuguauauucaaacacacacauacauacacacacauguaugacaguauauaucuuagguauuuuugucuucccaccguguggcauucuucccaacccuagacuuacaguucagagcaguuauugagaaacauuuuacaaaugcaugaauaucuuuccuguacuuggaacugagcauccaggguugaacaagucagagauggaucuuccugccauuagcugcaggaauugggaaagcaagguuguaaggaugucaagcuuuuuaauguggggaucaauuaaaaacaaaaaugcccugcaugucacacagcauaauaaaagcacccugacuggcuuauuagggcaugcuuaugucuguggcaguuaagaguugaugaauugauuuuuuucuagauuguucaguauguguuaacaaagggagguagagcacucucauucagcuuguaugguuuuugacccugcaaauuaaccccagucuauuuugcuuaaauuucaaacuucacucuugaauauaacauguaucugcaguagugguucuagaggcccuaagaucgguuaggccuggauuuggggagacaaggaaaucaucuguaaauaucccggccaucgucuuacacuuuaaagauuagauaaagacagugguuacagaaaggucuuaugcuauaagaagguauuucagaccuagcugcccaugugcuguguguuugugcauauacaaguggacagaggagggugaccgcugguccccugcgugccuuggcagagcccgcagucaugguucccauagccaccucuuccucuucuuucagggccagcuuucaauauugcaagaaaagauugaccauuuggagcguuugcucgcugagaacaacgagaucaucucaaauaucagagacucagucaucaaccugagcgagucuguggaggacggcccgcgggggucaccaggcaacgccagccaaggcuccauccaccuccacucgccacaguuggcccugcaggcugaccccagagacuguuuguuugcuucacagagugggagucagccccgggaugugcagguaacgggcagccgcuggucaucaguggccuguuuguuuccuuguuuucagguuugccucugggucugcuuuacuccguacguuucuaagcucugggcuccagcauugccuuuugccaugauuuguuuggucaucaucguuuuaguuuguuagugauacgauucacacucucagcucugucugauugcuccugagcaccaccauuuuggaugccuuauuguguuucugaaaucacacugccacuuaaagcaaaagaaggagggauucugaaaucauguuuauccagagcagauggggaggccucauuuauccaguaguuacuuggcacaaacagccuuccaagccuuugagugauuaucaaaugccuuuggccuaaaaaguuuccauugauauuuugcagaguuuuuauauacugauaaaacaaaacaaagcaaaacagcaaagagaaucuuugagggaauguuguccagaauuuaguauaaauuaacagugguuaaaguuuaacuuuuuuucuuucguauuuuuagauguuggauguuuacgaucugauuccuuuugauaauccagaugguggaguuuggaagcaaggauuugacauuaaguaugaagcggaugagugggaccaugagccccugcaaguguuuguggugccucacucccauaaugacccagguaaaggcuucccugcccaggagcuccagccagcucguccagcacccacguacugugcugagaggcugggagagcccaugccucucagacuucaccaugauguagucuuuuuaugucauguccucaguuuaccuguuuauaccauuacaggcuaggauguauagagcaggaaacaaugauagccacacauuuuaggguacccauaguuuccuuuacuuacuucuggugaaaucuuucacgggaaguuggagagaucguuauaaguuaaggcacuuuccauucuuagaggacccaaggucaauucccaaagcccacagagugguucacaaccacucauaauuccagucaguucuaggagcuaucucacccucuuuggaccucagcaggagugagguaugcacacgggcaugagagcaaagcagucauaucuauaaaguaaaauaaguguaaaaaaauuaaaaaaaaauaggacauuagagaaucaugccuggaaauuccacuucaacaaggcagggugcucacuggaaaacgugggucuuuaacacagagagguagugagcagcagcuugggagcuuugggguuccuucugucugucagacaggagagcgaggugacggacguuaggcaaguuacuugauccuucggcagaugagguuuuuaucugcuggaauuaggaccguaguaucuucccaggaugaaauguaaaggaaucagacaugacaugaaaauagcugcuaucuuuuguaauuacuguuauuucacaggaaggcuuuuauuuguugaggucaguuacccccucccccuaccccaagguaagggguaauugcuguaauuucaguggagcacgugaucugaugugcuuacuuacaggugugaauacucagcgcagcgugcaguuaguguaccugguggauuuaguacagcauuucuugaggauauauuucuaaacacguugcuuugaagguuaucacuaaguuuguguucuuaccuuuuucaagcacccaguccucuccagcacaguuaguuucgaggauuuccguuucacucacaccuguguguguacgacccagcuacucacauucuuuauucgugugcccaacucucucuuuucuaugacaacguucugugaucuaagugcagcuucccucuuaaggucugaacacgaugcauccagucugucucucgcaguuccucugaagucuuuuccugugcauuuuuccccuccccuggaugcucaguucccaccggcuccuuuucuuguuauucuuagcacucagcuguaauauuaaaggauggaguuuaccaggcagggugcuugaaugguuugcaaacaucuaaugcuuaggaagggcugaugguacugcucacugcaaaggcguuaucuugucaaggugacacgggcagggaggguaccagaaucccacacgucaaggccaccuggauuucucucuagagagcaaacccgagugacaaggaacacguguccccucuugcauguugcuuaugguuagccuaauacuugccauaugauaacuugucaguacgucaggucuuuucugaccugucugcguaguccuuuaugacacguucauaccguacucgcacccacacuugcagguuugcauguagaaauaugcaguguuuuuacugagcccagucccugagguuaagcucacucagggccagggcuuugucucacagacugcccuuuguggaacaggccagccagcagcaccuagcccaucauucugcucacaagucacugcaguaauaacggacucucuagguuaggguuaaacacuuggcuugcugccugucucggguuucccaucgacucccaucuuuucugucuccuuauuccuccuccuguaauaagcaucuuauuuaaaaugugcuuggcacuuuuuagaguagcagcagaauuaagcucuuugggcaggaauuucuuagaucccuguuuguuugcuuuaugguuccugcuguaguauguuguuuuguuagaggacauccuuaauaacuguuucugacugcaauaaaugaaucugucuauugguauccuagcaaccagaguggaaucuuuugucuuaguaggagauguuaaugacccucacccuuaggguuuucuccacuuaaguuaaaaauaguggucagaaacagauccgcuaaaccuaaggcaguuuuugccaugaagcaaaauggcacagaaaagaacccacugacuuuuugaguaauuuucacuauuccuuaacaaaaguagaauauugauaaccuaaauuauccugugaaaaauggaaacauucagucaugaaaaaaaaaucacugucuuaauagggagaaaacagaaaaguaugugcauguguauucuaagucaaaauaugacuguaaugggaaaucuuuguagaauacucccaaaugaaugugcaauuaggcaauuuacuuucuaaaugagauuuauagagaguuguuugcauuuucugcagcaacaauuuaaaacaagcuuuggcucaguaguuuguuucaucaguggauuuaugucuguugggaauagaaauauuugaaauaagauuuuaaaacaaguccuauauuuguccccuaacaaagaauuuaugguguuuauauauacaugcauacuuagacacacacacacacacacacacacacacacacacacacguacauucuuuucuuuucaggccgaguuaguauuagcagauaagacaagguaaauuuuaaaaaagaccaaaacaguauuuuaauaaauuuccuaauuaagucuccuuccaggccacaaggauauaugucauacaauauugaaaugguuuacaagaauuaaaacaaaaauaggaaagaaauuguuaggcauaggcugauaacuuuguacuguuauggauuugaaaaguuucgaaucauagaccaugaaauuaaauaugaguugauggauauauguucauguuauaguuaauaagcugauuagaacacaauuacagcaccuuuguaucuacaaucuuaauucuuuacuucccacuagcuaaccugccaaaauauuuaguugauuuuccuucaaagaaaucacaguguuuggaggaaagauaaggaauacugaaugggaggcugaacagcauauugucaaugaagcaguuuauaaaaugaacauuagaggaaccccucgugguguggcucuaaacaguagggagagcuagugccucagguaaaacuguauaacaguuuucuuuuauaugcagagcauuuauagcucuuuggaaaaaaaauauugacuuaaugugugauggaauuuugccuauucuuaaagggaagaaaauacauuuuugucuguaguauuacauaauaauuagaaauagauuuguuuauccauguguugucugaaguucaaagaauaaacacaugaaaucgcagugugaauuuucaguuuuggucagguguugcacuguuggaauuuaaaaguguuuggccagcuguuguugucuguauagaucaaaguggaggagugaggcagugaggcgcacagcaguagggaggugggggugucaguuuggggaggaaguugacucuguuuagcuaguggaggcaaaacuguguucuguguucuuugguuuuugauagcuucaccucccucaacccacguagccugcgccugagaaggauggagagguaggguucuuuggucuuguaccaaggaaggggagagaagccaguuaagccacguucauuucagugguguaguacuuugucggguggcagugaacaaguucucagaugucugacucuaaaauccauguucuugcaaugaguuauccuguuucugaggauauuuauuuaauacaaauagguucuauaucauauuuuguagagauuagccaauuuagcauguuuaucuccauuucuggauuguuaauuaaauuagcaaguaaaaauucgggacgcccagucaaacuugacugaugcauaguuuuuuuaguuuguguauuucaaauuuaauuugguccuauuuauauuaaguguucacuugcuguucauuugaaauucagacuuaaguugguaucuugaauuuuaucugaaugacagccuuugagaauuaaguaacacaaagcuuuggggauucuguuuuuuaagagacagccaagcccugaguaucgugguuccuuugcagagaaggaaagcucgggugauuugggccaccuguggccuucaugcuugaggaacacacaagccaguuguucuugagagaugcaggugcucauaguccaucuccugacuucucucauuucugcuucccuccguucuagucugagcgugugagaacucacuaaugugcugguaauaaagguuagaacugacacuuagacucuugucccaggcaguucccaccaugcuggcauuugacagauauuagaaccguuacuccccucaguggcacugugguaaucuuacacgcuuguuucauagaagaauggcaagagagaaggugagggaccugccuguggcagagugcacuuggcacacaauccuggcuucugaaccucgacuugagauuugcucuuaaauauaagacaccacuccuggguaacauuacugaagccacaggcagagagcgucuaugaggaaacuagguacugucauggcuaacaucaucuaugcugguuuuauuaaacacaaagauaauuuuauuaacugucuugcagaagugcacacaucgccaugcucguuccuguucuuuuuccuucugauguauucauauugaaaugaugucuuaucuuugauagguggguggugaguggcccuccuuguugcuacauuuuccuuuaugguuagaagugauuuagaagugaaacugagauacuuugcacagcuuguaugaccugaagucugaauaacucagcuauuuaccaaagaguaacccaccgaggucuuuaauaugaaacucuuccacccauuauuuuaagcaacuguguuggggaggacuucucuggcuagguggugguaggagauguucauaaaguccacuuuccagggaaggggaauaagcuuaacauagauguauaguuuguuugggagcccgaucucauaauuuuuaauaucagauaucaaaguacgugguguccuacaggacuuaggcaagcaguaugugcaaggagcucgguugggcacagcacagcugcaagaggagccgccuucagcuauucuuagggagaaugcagaucaguucuguggugugggaugacauuuccagugcuggcuucucagaugcauuaaaacucgccauaccucagacagcuuuacaggagugaagccgauaugcuccaaaggcuguuaggugacgcggagccgcccgagaugaagggaucugcuuuuggaaccugaguucaaagcauucaguuuuagaggacucagcagguuuguaaguuugcagagucuuuucgagagccucagccucguucuuugcacucuucacguccugaacacuuuuagucagccccagaguucucuucccuuugccuugugggccucuggucuccuucagccgguuucugcuccacugcggaaccauuuaaaacagaacugcggaguccuccuguucugcuucaacuuaccauggaguuugagccucccagucuccguguagacgcggccacacaaugagagaagaccguagcuuccuucuuccuguguucucugaagaaaagacagugacaaacuuaguuguuuaucguuucucauguguucuugccucugucugacgaugcgaauccuaacacucuucugcuauccugccaggacuccacuauuucucuucucccacagcauuuuguuccgagauucucuguagacucuguuuucauuuagcucugccuuauuacuuacuuagcccuuauuagauacucaauacauguuugaaugaguaaacuggaauguuaauuaaagcucuuccaguuuauuagggggacagaagggccuaacauauaauagaaacauuggaauuaaaauuaaucagcagcauaaucaaauaaugguaauaacaauuaagauuagaugcugucccuuaaguauaagguugaauguugcaguuugauauugaaggauuaacaagugaugggagaaaccugaugaucauuugcugauauggaaaaacuuuauuaccaagguaaaggugcuuucuuuuaaaaauagagaacucccuuuguauuuaucguuaaauuucaggauacuguaacagggcaguagaaauaauucagaguuuaaguugcuuuuuuuuuuuuuaaaugagaucaccagugugccauuuaccugaauauaauuacuuucagcucaaaaucuuuuuaugaauuucuaaaacuuacugauuauuugacuuuugaguagaauuaaugguauuuuaaaaaugugauuguaguagccgugacccucacaggacaacagugcuuucaagacagguuccuuuugggaggaaugagcccacuugagacuuuuuccccuuuaugacaggguuucucuguguagcccuggcuguucuggacuucacucuguagaccagguugaccucgaacucacagaaaucuucccgccucugccucccaagugcucagauuaaaggugugcacuauuuaggcuggccuacuagugaccuuuaaaauauauauauauaguggaacagcuuaaagauaccaggcagugguuauucgggaagcagacuauaaacaugaaaguugacuguagucaguugugccuuugguuucauucuaacugaauacauuguccugucacccaugagcuuuuguuucaguccuuuggcuuuguguuucauucaucuguaauguacaggcuuagcuaacucuaagagucauaagaaucgguugaagaauugguugugaugucuguccaguccuggcucaaaauuuuucaggaacuagagccaaaguaaaugaaggcccauauucuuuguuucuagauauuuaaaaucauaaaucaaagaaacugauugcaaagaucugagauggagagaugaggcgaguggggagucccucucaccugaagucauugggguagcccagugaucugauagagcaaauguggguuuagacuucucaggcgucaguuucucacacaaauggcauggcauauuuuggaagagacaccuccuugugggauaacccaaacucuguuuauucccuggacugggcauguccccagccaauaagagcugagcaugcauacaguauagcguuauuuauauacuguugaaugguggccucuuggauacucucaggucugaagguucuacaguagggcugaguguccuaauaaaggcuuucuaaggagggaccuagaaggguuugaaagccagcuuggggcuuuuggacucugauuucuaggcuguggaacuuaaugggcaaggcgcacucugauugggcaaauagguacuguuguagaaagggcuaugguccguggaauaaugaacaaauacuccuggagcucuguucucugacuuggugccuucugccuagguucugggguaugguacuuuguuugaaaggaagugucccuucagagguuuggauuucuacacuuccauguugaauccagaauucaaaaaacaaaaauagaaagcaugguuugcuaguucauaaguguucauaaguucauaaguguuagguugcuuaagugcacauagagaauaaacaggcagaguuucagugccaguagaauugggguucacacugucucuguagaacuugugauuauuuacucaacuuaacuuucugacuuauuuaaaauagcuguuaguucucuuacgggugacagcaucgcugcugugaaaagcgcuaagcugagagauauccuugcugccuuucugguccugcuucaaugucugaguguauucaagggagagagaagagcuaugaauugaccauuuaaguaaaucgguuugcaaugcaaugucuucagauuauuaaaucuagagguaggaauauaauuuuauaucacagaaaauucaucccaugcagcuuugcauaaaguauuaucuuucugauuggucucacguuaauaugcaauuguaguuuuuccaguaauuuagaggaagaaagaaccaauucaggguaaaagggaauacuugauuagucuauuguauaagagcaauaaaagcuaauuuacuguuauauuacucaauauugaaagcugcaagaaacucucaguucuuuauucauuaaucgugcuacauuguagcaguauuuguaucaugcuauauuguagcaguauuagugucaauuauagaugaguuuuauggaaggcuuuuuaguugacggcucugagcuuguauuuugccucacguaaauaucuuugacauauuuuuugccugauuguugaagggcaaaugaaguguugaaggcggaguggaugaaucaggcauuguaguuucucccugaaaacucuugugauaaagggucuuugaaaugcacugaucucugucaggaacaaguuucugcuguuggaauacauaguuacacuuuuacaaaggucuuugacaaaagcaauccucuuacuuugccuuuuaugcuggauuuugggagguuuuuuguuuguauuuugcaggcuuuccacugcccagaguuccuuaauuuuguucagaggauuaacauuggcauuugcuagaauucacacaagagguacaugcgauauuuuaaagaugacuauucuaauggagcccuucaggaguuucagugguccugggcccacacaugaggucguaguguuugcuuuuacauccauggauucagcuugaucuugcacuguguagguagagacagacuauuaacucaaacagugugacgggggcugauaaaucaauauaggaauugagcuuuuaaaaagagguaccauuaguaguucucaggcugcauuagucuccgugccucuguaacaaagcaccacagccugagaggcuucagugcaacucaaggucagagacugugagucaaggguuuagcacuggcgggcugggguuuuuuuuuuuuuuuuuuuuuuuuuccccuuccuuucuccuuggcuuuuggcuuuuaaugacuuuuuuuuuuuuuuuuuuuuuuuuucuccucugcccuggcagguuucucugugccuggacccuggguccuaggauugucugagauuaagauccucuuucauuacauuauuuuuaccuuuauuaaucccagcacuggggaggcagaggcagguggauuucugaguucgaggccagccuggucuacaaagugaguuccaggacagucagggcuauacagagaaacccugucucgacaaaacaaaacaaaacaaaacaacaacaacaacaacaacaacaacaaaaaagaccuuauuuucaauacagucacagucugaggaggaggaggaggaggaggaggaggagcuaggauuucaacgcccuuuuagcuuuugccuuucucaaaugugucuagaugggaagggucaaugccaccaggcuguugauaggaaggaagaauaauagucauucucuuacuuuuuagguuccguguuaccuccuccuuccaugcuuggccucgagcacugcuaucuucaaacuugaauauggggagagacgcacccucauuuaagggcagauagcaauuucuuucuucucucugggaaucuagauagagguccuggucuagugccugaugcaggcuugucaucaguguccugaugagacaaggcgggauuccuuacgcgccgcucuuacaagcgaggccuuuuaaucuagcauggaaaaauuaaggucaccaagaaaacauucuucgauaacaagccagcccuagauuaagaaugucuuacaaagaaaaucugaugucauacuccuauuuggcucccagugucaaagcugaguuuugcagguggccagcaaucgggagaaguagccacagcugcagacccuuucaggauacaccuuuggagcaggugucuuauaugcacuucccuggggaccuuuaacuucuucuuuuuuugauuuccacuagcaaaugcaguauaggcccagaguuagaauuauaggcaaacaagugccguuuggacucccuguccuucaggucucucgaauuucaguagcaggugacagcaguucaccauggauguaggaaugcucuucccuuaagauuuuagacaugagaacaagucauccccugugggguccacuuagcccaucaccugucuguauaguugguggcugugugcccuagagccuuugccauccuaggcauacaucugguaguccugagcuugggcuugugagucuuguuaagagugucuugucuagcucaaaugcgaaugguuugggggaccaaucuccacguaauuugggaagucgauggguaaauuagggaagcaaguucucuacuugccggggcggguaacguugacauguucacuuuuguuguuuaguuagugugacuuuaugcuccuagaaaauggcccgaugacaucuuuugggaacaaaagccuguuuuuuggcaggaugcugugcucaguauucauaucagcgcugucaucacgguauugcuuugcugcgggcguuacgacuuagcuugcaugagccuuccuuugucuuaguuuuauuggauggguggggaguucagauguaugaugagagggaccacgaucccagauuaugagaguaauacuuguuaguacuauuuagauaaaaaagccuuaccuggaguggagauaaguaauugaauuaauuguuaaauauaaauaccugcuuuuuaaagccuuaguuaauugcuuucauuucucucugaauuuuugugcaaccucuaaauauuucaucguuuuaguggcaguaguuuuccugucaccuaaaagagaauuucacuaauugaacacaauuguuagcuuuuaaaauguggucuuuauuugaaugaaggagcuaaggguaucuauccaaugguaacucgguggaaugugacuaaguugaaaucagccaucucaaucggaccuuugugguguauuugugucuugauuuagguugguugaagacuuucaaugacuacuuuagagacaagacucaguauauuuuuaauaacaugguccuaaagcugaaagaagacucaagcaggaaguuuauguggucugagaucucuuaccuugcaaaauggugggauauuauagauauuccgaagaaggaagcuguuaaaagguuuguuucaaaacuuuuuguuuuuuuacuuuggugauauuaaagauccauaauaaacguggaguucugaggugaagucuuagcuuuauggcugacagccuucuucucaucuugcacuguauugauuuuagguccuuccagaugaaggggagcaaagccuuuuccgcugaaauccuuaugcucaucucuguccuagaaaugggcguaguuauuuuaagggcuuuucagaagggucacugcuugguuuucuaaauauaaaugugccagugucacugccucuuuucaacgauguaaauuuucaaagccauggccaacaugucugaaaaauaauguuuuuauuuuuugccaauaauuuuguguauuuucuucuaucaaaaaagguguuggcuuuauuuuucuuuugguggcguggcucagugcuucauuuuuauucauuuguagggcuguaucuucuccugaggauuuuauguccaguuuaguucaugauacacagaucagcuuuuuaugugaugaaaauguuagacuuuugucuuuugccauugcugucagaacuaggucuuucucaaucuacaguuaugguaaaaaguugauuuuuuuuaucuucuacuuuuauuuuuaaucccgagauuuuaaaauccucauuuaacgauuuagcaguugauauuuggggagcuuucugaucuaagugcauuugcucugaagagcuaggccuugugagggauuguucauuuauugugucugcagagcucuugauaauguagucacugcuccgaggacugccagucgugacugguaauccucugcccuguucugugacauaggcucuugcuuuccguccagacuggcucagugagggucccugugcuguaccugacagugcuggugucaucccugcucaggacgcugccugcugagcccuuuguacacauggugcagcucuugaguuuuaauguguccagacuuuucuacugauaggaaguggcaucuuuaguucacuaaaauauucaauuacuuaaacuuucugauguguuucauggauuuugaugaugcuugucuaaaauuauuggaauuuuauaauauuucaauagcugacagcuuaaaucugccuuucuguauugaaaaaccuuuucaugaguaacaauuuaauuuucccaaaggguuuuagaaguaauuuaaguuucuuccuaccuaaaaaaguaucuuuagauuuuaauggauugacaugaguauuuaaggguaacuugaggagaacugauggcuaccaaauucacuggagauugucuuuccucauugguccugcauggauagcuaggagagagauacagacuccgaggacaugagaauaaaccgaggaacuaacauggucauaguagaagccauucccccuccaucacaagugcugccauagcaacaaggguugaccgaauccaguucacacaagagauuuuacaaucugcaauuccaaaguguuauauaauguauccugacuuucuauaguaaugcuuuagauuaacaucauauucucucucucucucucucucucucucucucucucucucucucacacacacacacacacacacacacacacagaggagagggagggggagagcagagagguagagagacuaacagacugaaguacaugauauacacaagcauagagcgggagagagagagagagcgccacacaguauucugcacccauaauuuagagccgccuacccuuugcuaccguuuaaaacucugaacucuuacaaaguuacauagagcugguguuugcuuuauugccagcucuucagugccaagaacuccgauuuaagaagaguuuugguuguuuacaucuugcucauugauacauauuuucuaaaaaguaacaaaguuagaaauugcuuaaguuugaugaauccaucccacuuguagguauuuuuguuuucaaaauuauuuaucugauguuauuuucuuuauuuuaaaaaugaaacugccuagaaccuuucauuauuuuugucuggcuuugcuggcccccagaccacccagagggaauuucugguuuacugcuuucacccucucucuuuucagcucuucaucuuuuccuaauucguucucccugcuugcacuagugcuaaauuggcaguccaccuguccucagacaggaugucacugccugcuuuccuuucaguacuauuuuaaauaacgaguguuguggguuguuuuguuuuguuuucucauauuuucucuaaaugcuggaauauuuggcagcuguacuuuacuguuuuguuuuuuuguuuguuuguuucucuuuugguuuucugacuugagcaugcuagagaauacuuugcaacccgugagugcugguuucccaguuguauuuauuuauaauuaucguggaugucuaguggucugugaguaugaccucuacacguuucggucuuccgagagcaguguugaagccuguguuggugccugaagaggggauuguuuuacaugcaucucauggguuagcauuuuaugacugcugugugcaaucagcucuucugccgccauguucccuuccuaaaaaccacugcuaugcacaaucacacaguacaagcaugggggucaugaagaauagguaaguguggggugccgagcauucaacaguguccuucaugacacaaaagacccuggaaaaggagacccaagacagggcccaguccaguuuaguuugccugugcacagucaaucggugaugaguuguacacacauguuacaaaaacgucgguugcagugugcucauggaugcacgugucaggaggacagagcugagcuaccaugggaccccgguaguguuuucuggcagcuaaugcaguggguauguaugagucugacuugcaucauggugagcugagcacauuggucagaguccagaugugugcaucccugcagaacuggacucaccuaggcccagucgucugccuucagcuucccagggacuaaaucguacaaaggaacugcaaguuuuucccuaguugaaccgucagugcuuuggaacagauugauuugugucauuguuuauguguuuuguaugggcaugcagaggucagagagcaacuugugggaguugguucucuccacauggugucuggggaucgaacuuaggucuucagguuugaugguaagcacuucuacccacugaaccaucuuucaggcccaaacuccuuccuuucuaacgcaggcauucauagcagagcugacaacacucuagugcucuuucuuuacuagaguucguucaucauccccugugcuucccgauccuuugcucauccuuucuucaucuguguguccauccauccgucuguccgucuguccauuccccacccuccaccccucucccgacaguccugaaacucauguacaggacagggauuacaaaguucugggcauucccacgcuauuaauucuucuucauaagaaucaaucaucuccuuuggcauugaagaauuggcuucucauuuaauggcuugucuugcugucacuaccacugcugcugcuccuuuuaacuuuaagaccagccuauuugggauggaaaguaugggcaggcugaguauggcggccaggcugccuggguucaaauccugacaaguuucauuauuuuggggcaaauuauuuaagguuucugcauugcaguguacuugucaaauugaguccacaguggagccuagucuguuggaguuuuaugaggacugaguuaauauaaacacgacgcuuacuuaauauauuucauugauuauuuuuguggugcugagagucaaacccagggccucuucaguacuacauaaguccuuugcuacacacacacacacacacacacacacacacacacacacacacaccuagccugacagaggcuuuuaaagaauuacuaauaaauauuaguggcucuuauuuuuaaagcuuuuauuuucuacuuggaauauuuuucuuggacacuuccugcaauuuuuagucuugaagucauguugaaagucuucaucuuuuaauaggaaguuaauuauaaaucuauguuucugcuccgucuuuaaaaagcuugcuuauauaaugcuucauugaagauuuuuuuuuuccugugcucagaagcuuuuugguauucaagaacaugaaacuguuuaaguuuccauccagcuacuauguauggagcauggaacuucuuauucuuuuucaucgacacuucgaccucuuccacauuuguuuucuaccguuuucagcuggggguugcuuuugucucuuuugucuuagaaccccaggaucugacuuuuggucugcugcugcuccuccuccuccucccccuccucccccucccuuuccuccuccuuuugcaucucaguguugcuuuucucacuguauuuuauugcaucuuugguguucuuucucaaggaugcgccccgcccccauucuccauugaguuuuccucuuccucucauugaaugcuuugccuuaacuuuaauuauggaugauuguccauaaggccaagcauuugugcucauucuugagugugaacaguuuuauccaucccuggaaauuguccaggaauccagucuaaagugcuuuacagcucuugcuucuccacacguugucagguuccuugcaguguugaucacaugacuucaucuguuuguccugggagauggucucucaggcaggaagguccuguucucaaccauucuguccuucaccagacaggagagcagacccagucccucagcauaguaauugucaggacuuugaauucccagugagaugaggguugccauuagcggggaggggagcagacagaugcaaucuguacuucccuguucugugcugugguccuguggaccaugccugcugaccucauuuuccuccagcccaucauggagccuggacuuuuagcccuguccuugauuacuugugcucuggcaacuuuccccagugcagguucuuuucugagaaagcuaggugaugucccuccucugcuccuuuguuggaaaaaggaauccuagaagaguuuucaagaguugggaguccagcaggugggccagaggacauggaaauugggaaacgggcuguuuagaaguccuggagaagaacugcccguugcugucauuugucucuuuccuuuggugaagcuguggagcccugagucuggacuagcuuucuugcgugugccugucaccuguaagcuggguaggagauaagggcugugacuccaucagugacuugcauggaguccaucacugauaggagguaggaggguacugugcuugcagcucccugugcuugguaaagugagggcaggcuuggauuccauacauggcgggucagaugcugcaggaagcaaagcuggauccugaaacagcagaccuuuaggaauuaauauuccccaagcuuguagaggaaagggcagaguucccugggcugaugaggaacuggccaaccagaagagacuuuagacaggucuaacaccuuccacacacauaaaucaacacacgccugucccauaugucuuggcucaucucuucuauagaacuguaacacugcuaacacugggaacauaucgcaggcuuucucucuccacuucuggauaaacuauaaauccauccauuuuuuuuuucuucacuaauuaucauuuucuaacucuagaaacacaggaaaaccaagguaggagguucaugguuuggagcugauaaaaguggugugcauggggagaaaauucugaaaggaaagagauugugguuaguguccaacauucagcuuucuuacuggacuuggcucuacaaaagagggacagugcuggagccucugagaaucaaguucauggcagagcacucuggcuuuucaggcagucaucugugagcucagagagaaaugaugguccugucuuggcucaucccugguguguuuucaucucuuguuuucuccuugucguuguccauuuuauguaggcaaugccauauaaaaugguuaauaucugccugguuuugaugggugccaaaaugucccuuuuguaugauucauuucaguauuuaaacccgcaugguaauggugcacucagucugccgucuuaagaaagcucuuuggaagcugcuucuuuggcucaguggagggagcggagccauuuugcuuaaccuaaauaaauaaauaaauaaauaaauaaauauaaauguuuucagaaauuugaguuuuaguuuuauuuaaauuuuuugaaauuuucuucuagcuauaaauacucaccugcauucacuuaugccaccugacuguagaucuaguucagggguucucaaccuuccaaaugcugugacucuuuaauacaguuccucaauacaguuauggggacucccaaccguaaaauauuuucauugcuacuccauaacuguaauuuuaguacuguuaugaaaaauaauaugaauaucuguacuuuucgauggucauaggcaacugccaagaaaggguccaaccuccaaccccuuguccccggggguuccaacccacagguugagaaccagugaucuagggcaauggcauuuguucucuuacuugaacugagaguccacaguguuccuaaacaacaggccaugucugugcauuuugcagcaaacuuaauacagccucagauuuuuguucucgucauuuaaaauucuuaacuaguaaauagauaacuggcaacauuuugggggcuccuguuguaauguuuguacaauguuuuauuuuuccucuuuauaaaaaugagcuacaagagcaaauguugaaaccuaaacuugcaagcuaucugcuguguggcagccucuggauuccacuggaguccacugaagccuuccuugccccuggaagagcacagauugaugcuggacuuaauagaaacagcagacgugucaugcgaucagucccucaucgugaugcaccacucagcauuauaaaccuuuaaaaaugaaacucaaguuagcuaacagagagauccaugcagacauguggaacauguugccuuucguaauucagaacaauuuaaccaauuauaguugcugugcccucuuggagccuuuguccagaggauuucaaagaaacuccccuccauuaagcagucagcacguuuucuguacaggcuuguuuuguuuaccuuccuggcuuuacacguggcuaguuuuggccgucuguggugaagugcuggguaauguuucuaauccgcugggaugugaaguggcugacugaugcugucaaguguugccccuuagcuuuuccuuuggcugacagcucugcccugggccccaagauagugggauggucucuaugcugcaucucuuucugcugucaugaccagugcuuagugcagaaacucgcugacuggcuggaaccugaaacaucguguguucaugucuugaccagcuacacuguguugguuuuugcuuuuguuuuuuuguuuuguguguguguguguguguguguguguguguguguguguguguguauguugugaaauauacauuuuguguuugcugcgcaucagucaguguagacuguauuuuuaucauauuuaugugcucugacacuuucccaagaaggcacaggcuuuucaucugauauucuaagcacccuguuaccuuuucuucaguuuuguauuuaaguaaaaauuucacugagcuuagaagcauuugaugcuucuugcuuaaauccuaagacuuaacucaugcacacuuuggguuuucccagaaaaaugggccauucaugcuguuacacagacucauuauuauacauuuauaccggucagauuuuaugggguuuaaucaaaggcugcuguaaaauuugcagagagcgugaagucaguguguuuugugaaguuugaagucagcugcagauuucaguggugugaggagccugcagcguuucaucagagcagagcaugcagcucugaagugacugcuuccucaccugugaggugacacucgauuugggauguccagucacuguuuuuguuuuugagacaguuucucuguguuagugcuaguugcccugucugugagacgagacuggccucgaacuuguagacaucugcccaccuuuguuuccaggaugcuguuaccagcacuggaaguacuccugagucuaaagcccagacuugacuuccuucaucuuccgugguuaaugguuugguaagaucccaagccuguugagugugugcugugugccagguguguucaaaccucagcaaaccucuggcuuuuacggccugaggugucuuguuagugggcaugcaggaagggccaggugucuuguuaguuagugggcaugcaggaagggccagagcauggaugcuucccuagaacacagugccuugcccaguuaggcuggaaucucagcucagccugcucuggguucuuggacucagaccucuaaucccauccccaguugucuuccuguugccaagccugcacuuugcuuuaucagcacaguuuucuccccuuguuaugucuaugcucuaaggugcuuuagugacgcucaaaggucacaaagugcacccagucuuugacgucgaugucuuguucagcucucaagugucugccuuugucucuggcugccucccaccuuacauuucacccuuauguaugccuccuuaaugcccugacuucuggcauaccgaccugcugcugucuucauacgcguuauuguuuuaugcauugaguaauuucauacguaaucuuucccaugacucagggaagguauuaucuuaccucagaagccuuccccuacugacuauguucuucauuggacaaauauuuacugugcuaauauccaggguaagcucucagugaacaaagagggcacaguuaagcacaccauuauaaaagcauguuguuuucagugagguuuggaagccugcaguauucaggaugugacuaaaaccccagucaaggagaagaugugagaggauggggaagacacuggagguucugaggagaaaacugugaugggcgagaacuuggcaccucagacacuggaagagauuggcuaggugcagccucaccaaagaggauauaagauacccuuccgggcuguuaauguugauagcagcaaagguuggggagaaggugcaacaaugugaacaugguaguggcuugcuguuggaacuuaaaggggugacuuccaaagacuuccaaaugaccauauguguugugugugaggagcugaucuagaaauggaccugagagagagucuuuucauauucacagcagacuugaaaugguucaggugucugcaaucaagaugguagacuaacacaccaauagaauccuauuuggcaagaaaaggugaauuagugaaacacacuuccguuuggcuuuuccagacaggguuucucuggcuagugcuggcuuuccuagagcucuauuuguaggccaggccucgaauuccgagaucagccugccucugacuccugaguggggagaguaaaggcauaugccaccacugccuggccuugaaguacauuucuugaggaacuuuuagaaaguuuuuaaugaaagggacuuagcuuagucacugccagcuggugacccugcaguuuauuccuugucccuugcuaaugcaggguguaucauuugucuguggucugacuuuucugagugacuuugggugucuaugcagacuacaguuggauagaucgugggggcagccugggcuaauaccuuuuucagacaucuggcuucucagacuguuguacaaccuuccgaucuuuggaagcugaugggugagauguggaaugucacucuccauucagccacccaaaugagguuacauuuuguuuuuuagagaucaguuauuucugaaaucucggacacuuacucuuuguuucucuuguguguuauuggugccccuuucuuaccuugcuaugcuguuaggggcuccuacaugguaaaugaucaacagggaguucaugcccuucccgagcuugugauguuuuggauggaaacgacaguggagaugcagguguauaauuagugucaguuaugaaugcuaugaaagagaguuuuagguuuuaugaaaggugauagcuuuguugggguuugcauaggaugugacgguugguagugcguuccuaagagccaguguuagaccaguguuagaagggcggaugcuuuagguugagaagauacugacaacaggucaaggggaggggacacacccaaaugaaaugaggaaggaguaaugcagacgacucaguuguuuuucuuauacuccaucuuugaaggcuggcauucagaauauuagaguauacaaggaucccagauucacauauggaaggguuuaaaacaagucuuccuucugcuuucccacuggauacugcacacagaaggcuuguacaucaggugucugggcaugaauugauucugugggagacaccauguaacuaauuuugcauuuaagaauggaacccagugugucaucuccuaucauuucagauuucucacaaugcacgauuacaaauucaucucgcuuucucaugugagauuaauuugugacucugugaagcuugcuagaugaugcauuguuugcuaccaaguugucuguaacaauuuccccauuagggagaaaagcucuuugaguauauccuucugugugugaccaaauuccaaaugucugaugacucuucguggaggaagacaugacacucucuaaaaaugauuuacagcuucuugagcacugcagucaauccugaaguguaaaaucugugucuugggcaaaaugagcagugacagauucgcucagcuuaucucugaucaguuacuucucugagcgcuuuauacccaaucccccagcacugcaguagagacgugguuaacguccucaaccaagcagcuagccaccauuguagaaagugaugugugagccuuggcgguuuuaaacuuagcagcucucaagugggcucuugaauucacuccaugcguaucucucuuccccuguuugcauguagcucucgugucuauuacuuaagaucaugauguguauguugaaaaguuucccaggaagcugagagccuuccaccaguagagagacuuaagaaaccagcuacacaggacagaccugcauuguuugcuugucccucugcuucucacagaaacgcuucauccgaugcugcugaaagccaaguacacagaagugccaggauuuaagugaacacuucuguagggacaggugaaucccacccuggcucuuuuuuauuauggaagucuagagaguucaguuacagccuuauucauuuucaugugacggcaaacaacagggauuuuaaguaugacaccucuuguacucucacacaguuuuuuuuuuuuuuuugcgugcaaccuuuuuguucuuguugaccauggugagugggugaauggucacagggcagguuuuucugucaccgucagaaagcacuucugucaagcugaaccuuccugagacauuuggcuuuauaaucuguuuugggggauuuuuuuuugcguguuuuuguuuguuuguuuguuuuguuuuguuuuccuuuucuaagggucacauggcagguaaacagacaccgccauggaauagguaaacucacuaaccuggucauuucugucccugauguaguacauaggcuguggcugcaucuuuaagauucaccaccaaucaaagaaaacacauggugggccuuguggcucuagcugcauauguaacagaggauggccuagucgggcaucaaugggaggagaggcccuagguccugugaagguucuaugccccguauaggggaaugccagggccaggaaugggaauagguggguuggggagcagggggagggggcagggguuaggggauuuucagaguggaaacuaggaaaggggauaacgaaauguaaauaaagaaaauaucuaguagaauauauauaaauauguaaauauuuauauauauaaagauucacacuguuuucuuccacuugauauucugccuugucggauuggauaaacgaugcuaagauaacuacaguuguuccuuuuaugucaugcuuuugaucugguuucggccugcucaugcagauuuucuuaagaaccuacuguuuugugggggagaaaagcacacauuuuauaaaagucccuugguuucuaugccaugaucuuggcuuuuucaugugauuuuaaaaauucucucugaugccuauaugaaugccaguauuugaacaacccacuuuucagcuuuagaguuggauucgcuuuuguguccugaauuaguuacucucuuccagauguuucuuucggauguaccuaaaacuucucuucagucgcacuccucucuuccuaccugaccuguagcuguccuuaagacuuccuuuuuaaaggcaccaugcccuuccagccugugagacggagguacuccucaucugacuucccguugcucuccauccccccuggaagcccagcuguccgucacuggcuagcccagacucaugcucauuacugcaaagcgacuucucccaccucucucgcgguauucauuaauaucucucuauuaaacccagacuugggaacuccaagccaccucugugcuaucacaguggucaccuccucuugcucuaguccuacucagauuucccagagauagguuuuuaucaacucccucugcuccucuugcauguuuucuaccacugucaacauaauuggaacuccauucuaaaugaccugauccugacugauuuauguuauaugugagccugaccuaauuuaaucuacucguuaauuacuaauguuaaacggacagucucgugcaucuauuuuucaaagcaggguacucagugccaggcaugugauggcacaugcuaaucccugcucuccuggugcuugccuucuguugguggguaggagggagaggcagauaggaacaaacaggcaauuuuaguuugugauaaaggcuauguuguuguauauggaggagguauggagaagugcuuaauugccuggggacucauggaaacuucuggaucacuuauauuugaguggagacacuaaggcagcuggaaccauccagguugaugaagaggagcaacggugaacuugcuugguaucauguaguaagaaagaggcauagucauuaggguaaccauggcguccagaugagagcccaguauuuaucagaggagcauccauggcuucccaaggaaggggauuggcuaauaacagcugcagcuggagaaacucuugcuguacauacuauuuagggcuucucuugcuggacucuucuuggagagcauucaggucuuuaggauaggaggguuuuuguuuguuuguucuuuuuuuuucaguuuuucauugucaaacaaaacuugacauguugaaaaggggaaaaauugucuuuggacuuauuauuauuuucuuccauuucacucuaguucuuguuaacuuguagguucugucuagucaagcccaggaaauaauuugucuuuaggcaauuauaucugaacauuuccaaaauacauguugauuaggauagucagauaaugaaaucaauagcauguccauguuugaugggcagggguuauacucugcaugccagcccaugcuuacauguagguaccaaccucuccuuuugaggacaacggucagauccguguggccucuggaauguggcaaagauagaccuaaaagucagcacagagcaaauagcuuuaaaaagccuuuuguccaugagagaggagggcuguauugucauggacguaguuggcuucuuaaauaaaugcaaguuuuagaaaucccagcuccuucaggucaggucaugucuugaugaaagccuccugacucucggaacuuccacaccucacaaccugacagucuuugauauuacagauacaggcuaaggcucuucuacuucuucagauacuuucaacuuacugguaguucauaauuuucuuuucuucuuagagaaaguuaugcgaauaauuaacaauuaguacucauugucuuguaugauauuauugcaaaggaaugcucaacagacaaauaacaguaaugacacagcuuuuucaacccaucauaaaaauaggagcgacguagcccacgauuuaguaaaaacggaagcaugguaguuaauuacuauauuugccggagcagugugcuuaauuaccuuaacuguguuccagggacagagguaaaugccgcuuuuuauaugguauauuggaacagacgccauccgugaaauggcagcucuccagccaacaccaagcacauggccugaauacagugcucugugagauucagaaauaaaccacacgacuccugucaugaggagucugugcugugccuguguggaagaaguguccuaggaaaagaagggucacccaagauucuuuaauaugagcacuucaucccaggggccugcaguugaaauucaaugacuuauuaaaaaaaaaacaaaauucccccucccucauguaacuacuguccauuuguaaagauugaucuuagacguuuauguauuguauuuucuucugugagcucuguuaucuuaacucuauuuguuuccucccuaguuuacuacagaauggucagcuggaaauugugaccgguggcuggguuaugccugaugaagccacuccacauuauuuugccuuaauugaccaacuaauugaagggcaccaauggcuggaaaaaaaucuagguaugucuuuauaucuguuccuccucucccccuucauuugggcugucuugggaagggacacucaggggaucugaacuaauuuuccuaauaauuguugaauaauuuauccuucauuaauuauauuuauuaggccucaauuauauagacaugugauaguuucauugaauauuauccaauuuuucuuuauauauuacuuauugacuuucauuuguuuagaaguuuacuauuuuacuuacauguuagcuaagacuuguugcuaagagucaagacccuauuauuagcuucauucaaauugacggugggacagaaaacaauagaaggcauuuauguguuguaucauggagaauccuggaccuagaggaguuaugggagcuccagguaugguuccuuccaggggacguaacuuacacuuuagagauuguuuccuuggucucaccuuguuuguguguuggucuguacccugcuuuuucuagguagcuuauaagaaagaugacccuaggccguagaaauacuaccccccacccccgccuccaggaugaguuuuguuuuguuuuuuuguuuuguguuuuaauacuuuaucucauuggcccacaagccaggugcuuaauucugagaugcaggacugguuucaaugacauugcucuccucgggaagugacugcaucacaccuaccugugauggcggggccucucucugugucacuggacccauggguaggaugcuggcugacagcaucagacaucacguacaauucaccaaaaccgagcaaccacuggcaucuucucuaugccugccacucgacaggaagcccuuugcaaauauuucauaccucaguauaacuuuuaugcuuuucuuuaugaucagcaucugugauuuuuauugaaguuauuuguggguaauuuuauuuugucuccauuaggaaucaaagucucucauuauuacaauuauuucuuuccuuuuuauuuuaacacaauuuuaaaucuacugagaauuaaucccagaaagcuuccacacaugccugacauggcacauucacgucaaucuuuguucccuucccaccccacuguggugguggugguuguuuuggaaaccuggagaauucacugcagauacugcaucuguggaaaugcacugcugcaucugggcugagauucuaaccucaaaagccuuacuugugagucuguccuuggcugcuccuggacucuuggauucuuuacauucaagugaucuacugcuuuuaaaagcauauuguguguuuaacauuugcuucccccaggaaccugaccccuuagugugugugugugcuugugugagcagugcccuguggaaguuccaggcacugaaugugugcugaguuucuuaguugauggugugucacacagcuucuuccuauugguugcuagaggaauuacaugugcauguggggcccacacuuuggaacaugaccuccucuggaugugguccauguuccuuuuauauuuggugcccuuacucuauccuaagucauagcugugugauaguguucugaaguuccuaaguguguauguguguguguggacagggguggggguggggguugggauguaaaaacaggauccauuuuuuugcugcauacaagaaacacaccucaacaucaaggauagacauuacgucaggguaaaggauuggaugaagauaauucaagaaaacagaccuaagaagcaagcugguauagccauuuuaauaucuaacaauagacuucaaaccaaaguuaaucaaaagagacagggaaggacaguucauacuaaucaaagaaguguccauugagaugacauuucaauucuuuuuuuucauguguuauaugcacauauucuauauuuuaaacuuuucauugauucuuugugaguugcacaucauguaccccagucccauucaucucccauccccuuauaucuacauuuuaucauugcaaacuccucacuaaaaugcaacacgcacaccggcacacacacacacacacacacaccaccaccaccaccaccaccaccaccaacaacaacaacaacaacaacaacaaagaccgauguauagaaaauaucucaucauggaagcuguagugugucacagugugucccaccguguauccuccuuccacacaucuucacuugcaaauauucauugcaagagucauuggucugguuguuuaucauuggucugugagaccucuggcuucugugacagcaucaguauugaauccucacuggaacuccuccuaguuauccuguuguugcccugugucauggagauccugcagcuuuggaucugcaggacuugcccccuucaugugauuuugggguaggccaguuccaagccuucagucugagccugggugggagcugcuuuggcuaggucacccaauguugccaucaucaggaggcagggucagcucuuggggccagcuccacugugcagggccgcucucccaagugcuacagccagagaggggccgggccagcucuccugcucucaggacuccagggccaguuuuccugagugcugcagguggugaggcacagggacccuaggcccaguucuccugacugccacagguggugagggauguugggaggggauagcacaggcucauaagcucuaacaacucagcaagccaagggugauagugugggacuagggggaaacuuacugaccuacucaggacauccccuuuccuuaaauauugaaauauguccuaagcuaagagauucacuguauacaaacaugacuuucagauuuuucuuaauguuuaacuuuuguugagauauagcuuacacaugguucaauggauaaaucuugagagacuggugaguuuugacagauauacaugcucauuucaucccuuucucuccaccuuccagccaaaugcucccuguuacuaugacuguagaggauuucugcuuugugaagaacucacauauggacucaucacauacuccuuugcauuuaguuucuuuguucaguauacuuuugucuugauugaggcagauugguguauaauaaagugcguuuaccuauagucugauggguuucugucccaggcuccguuucccuuuuuguaaguaagcccugccuucauggcucuggggauugguucuagaauuccccacagauaccaaaugauaccaaaugcaaggugccuucaacaaaaugauguaguguguacauaaaacuagauguggcucaguucaaggcccugaguucuauuuccagcaucauauaaacuguucaugguggugcgcaccuguagucccagcacuugggagguggaggcaggggauuugggaguuugaggucauccuugucuaccuaguagauuccaggucagcuggagauacacaaaaccuuguuggcucauaacucuucuaacuccaguucuacagggucugaugcccucuucccggcuccuaggacacuucaugcagccugucugugcacauccuuuuacaggcaggcaaaacacucauauauacaaaaugaaugaaugaaugaaugaaugcagggggaauauagggaauccauuggcuaagcaagaaacagucgcaaguuaaccaggcaaaaccuggugcacaaccauaagucauguuugcauuuguguagacccucaguuccccucagcgagguuuucaccgcuuuuauugugaaagcuuugcuucuuuguugaauuugguucuagauucuuuauuuuguuagcugccauuguaagugagauuuacuuucuugauuucaguuaggacucauuacugguauuguguauagcuacguauauugaauugguuuuugguuuuuuuuguauagagaucuuauaucuuucuuuuugugauagguucagguauauguugcuaacucacuucuguucauggcugaguaguguuugauuuuuaaacuagauuccugucagcuguccguaggguacuucuggguaugagcugcaugacacaggcguucauggcaguuaccugccagcucuuucuaggcauguguuucaucgucacugauaaguccugggaauagacuugcuguagggcugaggaagcuuuucaaagugauuuuacuauuguacguucaaccagcaaugaauuuguuccguaguuuggccagcauuucuugugccagucuuuguuagguaacaaucccaggagagagaagugacuguuguuuucccggagccucauucucagccgaggguggggaguguggcugguguucauugcccggggucuugccuguuuugauguuuccaagucucucacucuggucguucaguugggcuguucccuuucuaugugagaaucuaagcuguugcucaugggugugcucuguggagauuuccuaccguccugugaucguucauuuguuguuuaagauuuuauuacucucucugucccugucugggucucuuguucucccucucuguguaugugugugugguguaugggugagugugcagauguguauguaucugguggguguaugguagucagaagauggcuuucaggguuuuuuuuccucccuccacccugaugucugggcagugcuuuauccacugagccaucuugcuagacuguguucuuuugucuuuaaugauacccaucauaguuaauuuuucuguugcugggauaaaauacucugacaauacaacuuaaaggagaaaggguucuugcucauuuauggcugcggguuccuaccuguuaggaugaagaagcggaaggagguacuuguagcagcuucuaaagacaaauuaagagcccagcuugcugucucacacacauagccuaggcccuaacgcgaaauuaagaggugucuccagcuaucaguuaacauagucaagacaauccccacagccauguccaaggcccaucacaggugauuuuagaaucugccaagucuacaaugaacacuggccaugauggauggugucuuguuucuuuuaacuguuuuaacacaaauacuuaagacaucuuuugauuuggaugugugaaugcauaacuguauaaaucuaacuaaggaguuuacuucauguuuuuauuacugaugguuuauauaauuuauuauaaauaguaaauauguacuuccuuaaauauaaagauuaucuguguaauacaguuaguguuuagaccaugacucuguuugcuuugucuucuguagucacauguuaacagugauacuugccuuucuuauuucagauauuuaaugaaauugcuuagacaugccaaauauauuaucuauuagcuuauguagauauuuuuaauaguguugaggaaauucuuuuuaauacuuuucaauuugcaguacauacuguauuuguuucagauaucuauuaccagcauguaguuuuucuaauuuguucuaugagugugauagcaguuugcucgauuaaaaagucauugacuuccagagcaaaucccauuuggcuugggugcuguggaguucaaucuguuuaauguuuuuuuguuuuaugauuuuuauauuuguuuucaaaaacgggauuagauuucuuucauaaugugcuacacuuaugugaauuauuuacuggcuuaugauauuuaauguaauaacuagucagaguucaucccuuacuuuccaagaguuuuauggacauuugaaaaacuuaauguaaaguguuugugcccaaagagccuuuugaucuaggcagauucuuuuaauuuaugcuaaaaauauuuacauaauuauagauauaaucugaucucuaucuaaaaugucaacuaaauuguuuuauuggaaaccaaacuucaccaacauuuuaauuauuuguaaugcaaaauaauaguuauucauaguaaccuuuguauuaaacaauacuuuuauauaaauaauugucauucuauguagaaaaguaggacaguagcuuuuuagcagaauucaggaaguagaugauuuguaaauauaugugauguauacuauuauaguagucuggaucuuuuuauauuacccccucuuacccuuuuauuuagagaaaagucuaaugccagggaaaacaccagcgaguucuagagucccgaagucucuccccagcucugaccuaccuaccuuccuuccuuccuuccuuccuuccuuccuuccuuccuuuuuuaagaaaugcagucucccucuucucuccaguguuaguuuguugguggguugccuuuucucauugcaccuaguugccccucugugcuccagugacuuugauggggaaaagauccucaaugaagcugcaguucuaaacugauggacacugaacucuuuggcauuugaugugcucgcuguccugugaccagucuuaccuuucccuuuauuugugaugauaacccaguccugcuuaaauuucacacucauacaacguucucgggcuuuacuuggggaagacgcugugccuccugaacacagguucaugugcauuuuguuuaaucuaccacgugacaguaagucagaggugcauugucuccaucucuaaacacacaauccugcauuuccugagaaaacagggcacguauaaaaagaagguaguugucaaaccaggaggauuagcaguggugccacgagauaguccguuucauagggggcauccagaguucuucaauuacuccaacaccacuguaguuagagguugcugcuguuccugcucagagucaaguguccaguccagguucuugaguuacauucaguuuccaugucuuuaguuugcuuuaaucuugagcauuuucucauguuagaauuauucagcaaggguguucugcugucuuaucaguuaccuugcgucauagcuauuugaaugauaguauuuccuacuagauccagggucagcuuccacucauuuuuguaacccucgccccucccauauuuguagaugugugagagagugcuaaacaggugcuugaaugaaaaacaacaaaaccaaaagacaccuuugcagaguucuauuaguuaugccaaguuuuaucccguacguagaagucuuaccugggaaucuaacagcugaauggccagcuuuguauaaugcuagaugaauauucaugugcauuaacucuaaccuauacauuuauuuauguuugccacauuucguucucugaaacagagguacauuuuagcugauggcucuuauaacugaucugaggcauguuugaaguauuccauuaaccucauucuagguaaagcaaaaggaagagcaucagaaaccccugagacucagugacacacugugaagucuucucgaucagugcugacagcgugugauagggugauguugggcuguuugaaggugucaguggcagacuguugggaguuggagguguaaguugaguuguagaaucagcaguugcuggguuguguaaccccucacaagacuggguauuggucuccuucugguaguuggcagucacauaaucaucgcugugagguaguauaaucagagccccuuuaucuucaagcccaggagacuggagcucugaugcgucucagugcagcauaacuuauuucacuuaucauuaaaacaaaacaaaaaaugaaaaacgaacauuaacacuuccuuucuuucucaacaggagugaaaccucgaucgggcugggccauagaucccuuuggucauucacccacaauggcuuaucuucuaaagcgugcuggauuuucacacaugcucauccagagaguccauuaugcaaucaaaaaacacuucucuuugcauaaaacgcuggaguuuuucuggagacagaauugggguauguagaaucugaugacaacuggcgacugcacugaccgagcuguaaagucucaggggcucugaacuuacagcaguguggaggucuuagugacuuuucuguugcugugacgagacaccaagaccaaggcaacuuaaaaaaguuaagauuuguuggggcucauggcuccagagggcuggaauccaugacccucaugguggggacauggcagcaggcaggcugacauggcacuggagcaggagccaagaacuuauguguuuagacauaauuacaaacagaaugacccuggcuuucaaaaccucaaagcucagccuagugacggaccuccuccuacaccaccacacguccuccaauaggaccacaccuccuaauuccuucccccaaaguuucaucaagugggaucaacauucaaacaaaugagcugagccuaggaguccacuuucacucaaaacaccacaccacagaggauuuuacuuauaguacagaccuugaauauuagacugcuuuaagauaguuuuuguuauagaacaguuauuucccauuguauuuguaucaagauucuuagacauaucgguaccaauucacguuuggaaaacugugaaguugguuuuaugaccaacaggagcaaauggauaugugcauuuagucuugggccagcugcuguuuuuacucucuugacuuuuuauaaggaugaccauuucuauucauccguguaguaaauauggcacauucgaucagugguucuccacccucucagugcuguggccugccaguacaguuucgcaagcugugguagcucccagccuuaacauuauuuuaguugcuacaucauaacugucauuuugcuacugucaugaaucauaauguaaacauuucugcagagagagguuugccaaaggggccccgacccacaggcugagaaccacugcucuagugggaaaaguauuguuuucuuagaaagugagcaugccuuagaacucaugucucagagcuagcugguguuccuuccuucucucuugucucuguguccuauaagaaauguccuuggaauggcauauauucuguccucccagagguccucauccuaccuauaugcacacaaauuaagauagaauuuacccucuuuucucuggaggagacugcauauaugagagguuauuuuugagauuauaauaugauuucauuaaaauuauaagugaaacauuccagacuucccccuuucuccuuccagacccuucgauguacccugcuagcucucuuucaaauccauggccucuuuuuacauuaguuguuacugcaugcauauauguauuaaauauauuuucuguauuguuacuguauucauguuucagggcugaccuuuugcuauuggaugaccaguuggugugcucuuuccuugggaagccuguuuauccugcuuuuggcauuccuuagucaaguguaguucuuuguguagaguuucgaggccuuuggccuuuuccuaucuacuuuagcauguccaucgguguccuguucagaucucuucugggcaggcauguugguuggcuuuuauggguguagcuuuugacaucagcaggaggcacagccucagcaaacucccuugucuucuggcuuuaacagucuuccuaccucucuuccccaguugguccugcuuuccuuaauagguuucugcaguuaucccgaccauguacucacaucaggauauugggagcuuaguagucuucagucauagagauccugugacauuugucuuucaggguuuaggguaccucacucaguauaaucuuuucuaguuucuagauuuguugauucuuuugcuuuguuuuguuuuauuucuuuguauguuuaaaguucucuaguuuuuauuauuauauucauuggcuagauuugcauuugguuuguucauguuuuuccaucucuuugaguucaaucauaagccauuuauuugcgcucuuccugauuuaaaaaaauguacuguaggcaucucgcacugucagccuccuucguagggugguuuucagagugccucaaggguuuuguuguguuucguuuucauuuaguuccagcaagauuuuuauuccuuucugacccauuccucauuuaguacuuaguuauuuauucuccuugaauuugcuuauuuauuaaugauuuguuugcugccaguuuuauuucauuguguucucaaaggauaaaaggagagacuucuaccuuauugaauuuauaaagauuuguguuuguguguaugugagagugugugugucucugugcacacgcucaacacauaaacacacacacauauccacaugugcaugcacacgugcaagauguagucucuauuggggaagcugugugcugcugaguagaguguguauucuuugcuguuugugugggauauucuguagauaucugcuguuggggccggccagcggcucacauguccgaguucaagccugguaucuuggaacugaaaaaaaaagagggaaccuaggcagguugagaaauaauggaaccaagacaugcuagucugcucaagguucaacaauucauccuuggagccuggaaccagcugcaggugaugaagugcaggauagggcauagucuccggaauagaugggggagaggagguucucagcaggcagcaguauuuugaagaggaacagagacuguggcugaacaauagagugaucuagggaggaaggcuucacccuagauaaucuccuuaggggcaguaagguccaguucuggcucagccugcuucaggcuugugggaggcuacaaucugcaaguccauuugcugugugauaccaauaaauucugauuuuuuuguuuuguuuaauuuuuguuuggauggccaguuuauuggagaaaguguauugaaguuaccuacuauuaauugaguaauguuacuuuguuucuuuaaauccaguaguagauauuuuaggaaauuagauaccccagaguuugguguuuauugguuuccgauaguaaugucuuuuugauuaacuguucccuugacuagaaugaagugucccucucugucucugauuaacuuuacuuugaagucuacuuagcuggcuauucagauagcaaugccuauuugcucugugguuacauuuuacuggagaacucuugucuguccuuuuacucugaggugguuccuaucuuuaaaacccaguuguguuuuugcuuguagguaacagauuuugcuuauucgucuuuaagauuuguuauuauuuguuuauguauuuuauguauauaucugcauaccagaaaagagcaucagaccccacuguggaugguuaugagccaccaugugacugcugggaacuaaacucagguccugcaaugagcagcuaguguucuuaacugcugagucaucucucccacccuagauuuuguuuauugacccauucauucaguucgugccuuuugauuggagaacugaguccauuaauauuuaauguuaguauugaaauauguauguuaauuaugaucaugauauuguugauauuugguauuguuauuuauagucucauuauuuuguauuuuaauaauuguagcuucauauuucuuuccacagucucucugagaugcucaguuuucucuuuggccugaaauaauacuuccugauuuuucuuuguuuaguuacuuggauauauuuuuguuuaagcuguuuauaucguggaaaguuguuuuguuuguuugguuuuuugguauguuguuuucuuuuucaaucauggcagauaguuuugcuggguauauuauuuuagguuggcuaucauagucuuuuaggacuugguuuuuuuuuuuuagagucuugguuuuuaaaguuucuaauuauauaucaguuguuauucuaguugguuuuucuuuauauguaacuuguguuuguuuguuuuuuuuccucucuuacaucuuucaauauauuuucuuuguuauauauacuuagugucuuagcuaugauaugccauggguacuuucuuuucuuaucuucuauuuuagauguucucugagcuucuguuauuccuguaagugugguuuccguugguuuggacagcuuuucuucuaugaucuuguugaagaucuggucuaugccauugacuugggauucaucuuucucaucuaugccuaauugaaaggcuuguuuuuguuuguuuguuugguuuuuuguuuuuaauaguuucccaugauuucuuuguuuuccuuuccuguguuuuacuuuauuuaacucuaaauagauucuguacuuauuuuugagucuuuauauuuugucuuuugcucgauucauucuuccugacagguuuuccuuugaguuucuuaguugaauuguugggaucuccaaaucugucuucauuucagcuugagucuucuucauuguuuguauuuccugacugauuucuauucccaagucuggaauuguccuugucaauuuuaucguacauucuguuucacauuuucuugguuacuacucaggcauuuauuuucuuuaaucuuuuucuccuuaaguucauugaucuuugugugugugugugugugugucuuuaauuucuaaaaauuccuugaauuuuuaaaugaaguuuaugauuuuuuuuaaaauccugauuccugguagguccuggagagaagaaauuggcuugauuuuuacuauugcuuguauuuuugugaugagaaacaguuguguggacuuccuuuguuaguugaguguguucuggacagagcaacuuugucagaagauaggauaugucaacaguguugggcauaaugguuggguauagcuugguuggaaugaagucaaauggacaaagaggaccaggcugguauagaaacugugcuuccucguucaaggcuggaguuuggagguagaucuugcuggcaugagaguuuguauaugauuugggagacucuuguguacuaggguauagauaggaugauccuggcuaaugucuauagcuccuuuguggaguagguaggggaggccagaauaggcuaguucauugguuuugggacccaggcuagaucugaugaauuuuggaaaauacauggauaggaaaguaaggugcucucaccaggcuagacccugguauaggaggacacaggaacucuaguuaccaaguggagugauuggaaacuuugcaggcagaaucuguggguauuuacugauaggguagguccuaauaugaguguaaugguugacuguggcagauaugaggguguucaaaccgauuggguaagggauaugagacucuguagaaacuuagagguugguuacuacacagaugggauuguacagacugggcagggcagggcacugguagugggaccugagauagaucuggcagauuuuggaaaaaucaugguguggaagucaggggguacucaccagcuagacucaggaggaggauguggaaagucuaaaucuggguacccagugggguguuuuauauuugcuuuuauuuguugauucuuuauuguagggcauaccuuauaugaaauccuuuaugaucccccucucagucuuucuaaccauccugaguugauuuaucuuuuuguggcaaugaaauguuagcuuagauuugugaggacauuuguggggagguagaacuuagugucguauaauuccugaaacugaagccucugcuccagugccagugugguugagucugacuuccaucucugcagagaacguccuugcugaaaggcugcaaagaggucacugacuaccuuacacuugcuucccgaguaauucaaccaccaguguuucagaaaaaaguugguuuuauauauaaaaaaaauaauaacuuucccauauguguuccuguguuuuaauaaggaacguaauuaguuauguuaucuauuuaucuaucaacuauugaccuaucaucugucuacaucuaucgauaucuauuuauaucuauugucuaucaucuaucuacaucuauggauuuucuaucucuaacaucaucuaucuagucuaucaucuauaucuauccaucuauuuaucuauccaucuauccaucaucuaucaccuaucuacaguuaaucaaucucucucucugucucucucucugucucucucuuuccaucuuucuaucuauauuuaauucuggaaaacucacccugcagggaggcccagaucucgaagauuauuuguuacaucauguauaguuuaaccaaauacaucuuaaucugaaaaccaauuaauuuguagaagcuuugccuaaacaauugguguguuucaaguuacuuugaauuagcaguuggcaagaaauuauugaauaguuuuucuguauuuaccauagcuagaagauaaucuguguauaaaaaaauuacacuuuacuuguaaacuuuacauguaaaauuacauuuuaauguagcauaauauagacacauccaggagauugaaauguauaaaauuagcugcagaguggaagcuauuuggaaagauacuagguccagguuauaucuugcucaaaaaagaaaguagggguuauuuaccaccaguuuuggaagucaugcaggccugcugguauaccugaagugucagugaccauuguacuuugaugucaaacuugggcggcgggggugggggugggggcgggggaagggggggugagggggugugugguucauugacacuugcaggggacagcacagaagcacagguuuugauuagcuuaaaauuuugucaaagaugugguuaaagccugguagggcuucucugguagguucgagaaugugacuuccugaaagauguuuucaaauuagguguagcuuguuuggguguuuuguucuuaaugaaacaguuauuuucaaaguuuagaaauauuugcugacuccuauguccuuauuaaagaagcaaacccauuggagcaacuggagauccacacauacuugaaaggagggugcugcuaaagccuagcacauccccacaguccucuagucuuccugguggucugcuucugcccuggacugggcaguagucucaugcuaagacugagguccugacuaaagcaaauuccucuaucaguggcuaguauguaauuuccauacugguuugguuugcuuugauuuuugaauuggaagguucccuuuuuuaggaucccuuugugauggaaaauaccacugacucccuccccuuggaccagcaggagagacuccaugaacuuuccaguguugcucuuucucuccugccaggaaagcuggccuuccucuagggcuuuucuccccugcccacccuucuuccuuuguucccucagacccugucuuauuccucuucucaccgagccucccuggcugaccuaacugucacaguauguccccaggaacagauguagcagaagcuggcgccccagcagugacaaggucaagauuuugcaugagccagcuguaacucuuacuuuugcucagguugugugcuccaggucagcaauugcugguucaccagggacauuucuauuucaauucuacuagcuagaagaggggagugggggugagcuagagaucuuccuucagcuguggcugcgaagugcuucuggaggauaaaaaugccugcugauuuacggcacagcuugcauuuccuagauauguauaaaaugauggcaucuggguaguuuuggagagaaacaauuucaugaguggaaauauguugacuuucuauuuuagaucuuggaucugcuacagacauuuugugccauaugaugcccuucuacagcuacgacaucccucacaccugugggccugauccuaaaauaugcugccaguuugauuuuaaacggcuuccuggaggcagauaugguugucccuggggaguucccccagaagcaauaucuccuggaaauguccaaagcagguauuaaaauguauguuuuauaagacacagagaacacuguggccacucacuucccuguuguugaagggccgaauaaguggguguuggcagccagcauuauccucauucaggccagaucuaaugcaacuucggaaugucagcaccccugcgcguuauaauuaaauggcaagugaacaaugacagaucaauauacaauggcuaccuuccaauacacuguuauuaccaucuccuuugcacucacuguaaaagcuuucuacuggguuugauugauuccauauacuucuguugauaauaagacuuuugguccucauuguacgaagugguaagaaaagcagcucaacugcaaaaacacauuuauuaaaauggagcacaugaagaguauaauuaucucuuaccuuaauaacaauuucaguaacggugaguugcacagcucggaugaauacacauuuuuguaucuuucugauguuuuugacuuacagaaaacuuuaauuagaauuauuuauacuuaaguacauuugaauaaaaauugcaaggauggaccacuucuucagaaaaaaaugcaauaaugaaggaaacuucucauuucaagucacauauaguuucucauuuugguuccuuaaaguucaguuacuacacuaaaggugaaagauguguaauacauuguguuguaauauagaaauaccaaauucugcuagggaaagaauacauuugaauaaauugauaauuauguaauaucauccguauuuaaaagcucuuuuaaguaguuuaguaaaguaacaguucuggguucucugguauuuuuaggaguauauaucaaguauacacacauacacauguaugauuaaauggauauaggcuaugaguuugagagagagcaaaaagagguuacaugggcaugguugaguagcuuuuuaaauaaguagauaugauagugcacauuguagguguuaugaaggaugccaggcaugauagugcucauacugucuucucucuguguguaaaccacacauacaagcuuugguuuauuuauuagucaacauuuuuauuauuuauuacuaguauuauuaccucaggaauauaguugagugcucaucuacaguacauguuuuaucugcucuuauauuuuauuuuaauuccucuuacugggggagggaguuuuguuucauuuuucaugugcauuucaaauuagaaguaauaauaagaaauaaauuuagaaaauguggaguuuagguaguugguaauaaagauuaauaacuaucucaccaaaugcuaauccuagaaaacuaugaaucauauauuauuuaaaaucacuaugauuauauuuuacucaucaugcuauuaaaacuaagaauuauauauuauaagaaauuacuaugaagauaauuugaagcuauuaaauuacugcuaaaaauuuguauuugcaaagcaguuucagagaguauaaauuucagaauguccauaugggauucuaaguuuaauuaaauguuauuuuuucauaaaauaaccccuauugauguucuuugagguacuuucauaaguuuuauauugggaauugaaauuuacuuuuggauaaucuuugaagugaagauuggaauccgaggcgagaaacaacucuugucauuuaaacacgagugccucaagcuuugacucuccccacccugaauggcucuggcuuuaucugcuuauuuaguuucauuuugugggucugucuuccuguuuuuucaaugguguuccaacucagugcccccucaaagggaguuccucuagagcacugacucugaaguauaaaagcugucgacaucagcaugccaugcguggcuggccuuucagggucaugguucagagcccaagaggguggaaaccagaauagcaaauucaggugccaagcaggagccacugaccaggacagugugacaguggccaggguguugguggcagcuguacagugaauggcuguuccuuuggaaggaaaauauuaaaauuccaggaaauauuugguaucaugauuuauacuuuuaaucauuuucuaaauaugcuuuuuccauguuuuaccagaguauuagauuuuugauuguuagaaaguaggauauuaaaauagagcaaaggucaguauugauauguaguugagagacuuuacaucuucacauaugagauuauuguaaaacaugggcugucugguguuuaauugcugugguaaggaaggggauuccaggaagacacugguaucucaguuggcuaugacaucucaaagguuaucuauuggaaaaugauauaacuuccguacaguaagaauuuauagccauuuaaaacagacaauaaaugauggagaaaacaugucuuauaaauuucacuuaaccuaauuuuuaaaaggaauuaauaauuuuuuuucauauaauacaccuuugguuucuaagcugucuuuuuccugaguugccgugucagcuuuuccugauauaauuuuuuaauaucucccccuucccuuucacagggcucagaugcuauuggaucaguaccggaaaaagucaaaacuuuuccgcacuaaaguucugcuggcuccacugggagacgacuuucgguucagugaauacacagagugggaucugcagugcaggaacuacgagcaacuguucaguuacaugaacucgcagccucaucugaaagugaaggugaggagagagccuuucugauguuucugaaguugagcuuccauccuccacugaagaccacaguaucuggugucucugucccgugucccuggaaccugccuguauuaaccacaaauguaacuuugccauacgcgguuggugccauuuccaaaagucauccuuuccuccugugugugaggaaauguccugcuuggggauuagagaagcagucuuuuuaugcgauuuuaaaaacgguaccuacuaagucucagcgucuccgucgggaugucugcuucgucuacagcacgugaagguuauugguuucccugcucguugccccugugcuuuacugaugugacuggcugccaggaaugagcguuucauggguuugacaaaugucuuguguucagagaauucacuuucauguuuuccuaagcggaaugauuucacgcuaaguaccucccucgcuggcuuuucaacuuuuuucaccuuauaucugaggcaguaccucacugaagcuggaguuuguguaccuggcuagacggcgugagugaccaaugaguuccagagcuccuccugucgccaccucuguagugcuggcuuacguggaccaccgugucuggcauuuuuuuuuuuuuuuuuuugagacaggguuucuggaacucacucaguagaccaggcuggccuccaacucugaaauccgccugccucugccucccgagugcugggauucaaggcgugcgcgaccacaccgggcugugucuggcauucuuaugugcgcacugcugaucugaacucaaguccucaugcuuugcggcaagcgcuuuagccacugagccauuucuccagcccucuaaaugcaucuuauauaucuuacuugacccuaaagaauuagggcauaauuuugucauuuucccauuucuucuuuuuuuaugcucauuaaagcaaguuuaagaauaauuuuuaaaaaaccauauacauagaauugugcaaccugucagugugcagagaauuuuuaagcaucaucuagaauuaagcuuaagccaucauccacccaaaacaacuucucgggauagugcggcccccacccccccacccccgcccccacaugcauggcacgcaugcaaguaaaaggugcucauguuuuccauauuaaccucugcuucuuccucauaaaagucucuuucuacuccuugauagcccccuuucuacuuccuuuucccuuuagaguccacauaugagagaaaacguucugcuuguuuuucugccuuucugauacugauccggaugaccuccagguccgcccacuucagugcagccagggggaugcucuuguggguuguuucucucccuccaccauccccuccccuccucuucuuccuccuccucuucccucauggcugaguaauaauccauuguguguaugugccauauacccuuuucuguuuacuuacugauggacaucuagacagguucuauaauguggcugcuguaaacggcaucucagcaaaugcggacagacagguagguaccuguguggugcacugccuuguuccuccacguuaguccgugcuucucguguuuagggccguaagugucucuggaacacagugcagugaaugaggccagaucaagacagacuccuccaugagcaugcacaggguuauagcccuguaugucuauguaaacuuuuuaaauuccuacaaaacaaacaaaaccaaaaaaaccuacaaaacaacaacaaaaaucaaaucugaaaaccuugaugucuugcuagagcuguauuucgucggcgguucuggaugagcaaguuacucuuggguaccaugaauuuaaugccaacggaagaagguagagaggauccuugagaugccuugaggcuaacaucgucuccagaucucuggagcauuucccacuuggucagguuuuuacuggugcccugucuacauucaucauaacuacuuuuuguuugaacccuucagcacauugagccuuugggucuauagacuugaagaucuaaacaguucuuuaaacugcuuacauagguguguuucgucuugaauaugggucucaguacaauuuaaagaagaagucgcuggcaucggacacuccccucuuaucauuuacgaguauaacccuugugcccgugccaacauggagcgcuuucuaaauauuuauuaauuuuuccuuucugcauaauaauuaauuauuuuauuaaugaauuaauaacaaagaauuaauuauuagcgaauaacuaaaacaugacuguauuuuccuagauccaguuuggaaccuugucagauuauuucgacgcauuggagaaagcgguggcagccgagaagaagaguagccagucuguguucccugcccugaguggagacuucuucacguacgcugacagagacgaccauuacuggaguggcuacuucacguccagaccuuucuacaaacgaauggacagaauaauggaaucucguauaagguacuagaccuuugggucuuucgguuuguuuauucuauuaugucgccauaccguuuuaauagccguucgaaauacauccuuucuguggugcugugcauuugaguuuuaaugccaucagaauauuucucuauaguguaauuaaauuagcauacuuuuuccccccuucggguucugagggaaaagcaacuuacugaguuguauuuucuucaguuugcacuccguguuuuucuaauuaauuucaguauuguuucugcccuguguugcgauuagaugauaccugugcauccacaggcagauaacccagcaggcugaguuguuagauucgaagaggcacgcagugcuucugagcagcuccaggugggccucuuggugcacgcucuaacaugagugucuuuucugugugggagaaccacagaggcuccagcucaguucugauuucaaguaccuuuccauagaucggacuuuucuucuuagaaaucguugagaguugaugggcaagcaggugacuggaugaauaauucuguagaaaugccaggaggaagcacgguagcauaaacagcugggucaguagaacguccagucacugacagagcuuugucugugauguccauugugacaucugugacaucgucuuuuacacgagaacacuggaaauguggcccguguggccaagaacuggagucuacauuuuguccacaggcuucuagccacauacaaacauguuuggaaacagguuucuaagaaaccaagucagacgcucugugaacugaauuaucuugagaugcccaaaucuuuccuuucaccuuggacccaguagagaaguuuauuuucaagaugauuuuuuuuuccaaagauuuguuuuuacuuuauauauguguguuuugcuuccauguauguguauaugagcaaugcaugugugcaugaugcccgaagaagccagaaaaggguaucagauccuuuggggcuggaguuccagaugguuguaagcuacaacucaugacccauuucuccaggccuuccaagcuaagucuugauauuauaaucaaguuagagcuuaccuguccucuuucauguuuuaguguuuugugaauacauuuuagaaagacaguuuuuuaaaaaaucauaaauuucuuuaagaaaauaucucagguaggaaagaagaguauauuuacaauauguuuauaauauguaucauguuuauauacuaaagaaaugcucaugaagugauguuuauuauuacaaauuuuuaugauaaaauagaauaaauaaugcauaguauaaaaauuuauaccaauggauuaaugaguuuugagaguuauuuucuaauggcaaagacuuguaaauauauuuaacauauugaugaaauauauucaaggcacagugauuaugacuaggaauuuauuuuuauauuauacauuguggcaggaugagguaaaaaguauauaauaaauaguuuuaaauuucugacuuacuucauauaaaacaaauguauugucugaugguaauauuccacucucauuugcaaaguguagguagaaagguauaaggaagaaaaucugguagucuaacauagugguguagcuauuguucaacauaucugaggcucaggucaguucuuaucucucacacacacacacacaagugaaaaaaucauuucaaaaucuucaauggauuuugagauauuccuguaguguaguaggucucauccccccacaguaguugcauaacagauacaguguauauauaggauaguuacauuacaguucauaacaguagcaaaauuacaguuaugaagaacaaugaaauaauguuaugguugggccaccacagcaugagaaacuguuuuaaaagguagcagcaguagaaggcugagaaccagcccuacaauggauuacugcuuucaaaagccacgcauggaagcgagcauacaugauuuauuuaacucgaccugcucacuuccauggcaugagucuggacaagaaauuugaagugggggcaaguuucucucuuuuccuuauuuuuacaauuuagagaacucacgauuuuuuuuaugaaaacacuucuaauaccuccuuuuuccugaguguugauacaauuuugaggugccuucauccauuuucucuagcauguuuaugaugcgggaccuucuucggccuucugguccauguugccuuugaaaacauuuugaaagaaaccuauugugaagcauugaccugcugaucauaagcucauauucuugucgucucaaagccauucuagucuuuaaagcauaugaaaaagccaggcauugugcuucaugccagcaccuaagaggccaaugcaggaggguuugcaggagcuggaagcccaccuaaguucauaaaucugaaugcuuauuccucaguuaguggaacuguuugagaaggauuaggagguguggccuguuggaggagguauggccugcuggagggguuaugucacugcacuuugagguuucuaaagcuaacaccaggcccaguuucucacuccgccugcuuucauuuuucucacuauguuccauacagagaaaccuaccuuccugccaacaagcucuggcauuuuuccaauauacuaauaccuccacuguaaacacaguagucuuuggugauugagaacuuaaauacauuugauagguacaauguuaguuuuauagaaaauuuuaucauuaauauuuucuauaaaaagaauuugcauugaaauuguauauguguguguguguguguguguguguguguguguguguguuuguguguguguguguguguguauacacaucagugagccagguaugguagugcuuguguuuaacccagcacaagugugaaggaaugggggugggcagagagagacagguggaucucuauguuuuuaaggccagccuggucuacaaaguaagaccuugucucaaaaaauaaaaacaaacaauaaaauuaucagugauuguaaguuaaacguuuguuucagaaaauauauuaacggcucuuuucugcacuuagggcugcugaaauucuuuaccaguuggccuugaaacaagcucagaaauacaagauaaauaaauuucuuucaucaccucauuacacaacacugacagaagccagaaggaacuuaggacuauuucagcaucaugaugccaucacaggaaccgcgaaagacugggugguuguggacuaugguaccagguaaugcaguauggaauggaaacacagguucaaguacaauauuuuuaaugugcgugugcgugucuggagaugaagcugcuauuguauagcagagcacauaccaaauguuauuuguucuaauauauauauauauauccauagcuaaacaucaccaacuuugaagaacucuguggaagcgucgucguagccccaguguucaacuucggucccuguccuugucuccagcuguuaagcuuugucuuaaagccaggcuugcgcucuucuuagcccaguguggcagcugagguugucuucuuuauccaauacuugacauuuaaucagucauacauauccugggcagguaauugagugccauucccucguacagcagcuuaauccugucuucuuucauacccagucguccuugaaugcuugacaugucuuagagggacaccgauuggaaagccagauaaggggaaaagcagcaaggacugcaguaagccagauguguggggagaaaaauggcggaagugcgaaugguggcuggaguuaacaggaagggccuuccucaggaggaucucucaggcagcuaaggaagcagggacucagauguuucuaagaaaaauucuuagauuaaagaguacuacuuaagaauuagacgccguguguacccugugacuuggaaaggcugaggucuuuguccccagugcugccuaguaauggagaagcugcccuguccuggcuaagaucucgguccuuacgaauuuugauaagcaggcaugaggaucuacucaggaaggguuucgcauuggccacagguuuucccugcugucucacuauguucuuuccagcuucugccuauuauaaauaaggcugcuaugaacauaauggagcauauguacuuauuaccaguuggaacuucuucuggguauaugcccaggagagauauugcuggaucuucugguaguuagacucuugucucacugagauuuucuuaugguuucauuguuguguagggauaugggacccagugguagagaauuuguguaccauguauguuuuaccauguauauuuguguaccuuauaguuugauccccugugcuaaaaauaugcauaacagaugcuauacucuguaguauuuuaaaauuaucagacauuuacugugcacauuuaaaauguuuauaacuacuugucgugaaaagaguguagagcauaucaaaucaauacuagauaauugauuuacaguuggcauuuccauugugcuaagcccugaaguuuuuaguucuaauauuuuaacuagauuucaagaaaugaaaaggaaacauauucuuaaagcuuuaccacugacuucaguccuucaaaaaguauauuuaagaucuucucuugaauaucuugucaguuuuuccucaauguauucugcacagagguugaacugucacuacuggcaaugcuguggcuauuucucucacagaaaggaaggacagagccugcuugucuuuguucuugucucugacuuacugagaauuucuaagaacaucuuggacacacagggcaguggggaaccucucuccugccugcccacuugcucuauccggccaccauagcaaagguaccugacaggucauugaauuauccaugcacguucugacucgggaccuuuguaggaggccagucacuaaguacccagugugguuucugaugcuuuuagcuuaauaccaggccugugcagaacuguguguuagagguggcagaaagacauaguaauuuucaaauuguacuugacauuuguaaauuuacucugccaguacuucacacuucaacagaaaagucguaaacaauuaucaagucauuagcacagacacuuuuaagaaggaaauuucaaaacacgcgucagagagucagagacaaagaggcugcugcugcuggugcgcucucccacucugcuguugacugccgcucauucggauguuggcaggcaugucccuuugaacaguugugugagugagggaucgguggcugccaagagcaacuccaaacagcauuaauccugcccuguuuauucucaugucauauuuuaaagucuguagaucacccaggcagugugucaacuccacagugcuggagggaagccaggcccuuccagcuucuuccucucccuccugggcugagucugagaacugcucucaacaguagccuaaaugcuugccuuuuuuucugucugucugucugucugucugucaaccccaccuuccauugagacaggauuucuccguauagcuauggcuguccuggaacucagucuguaguucaggcucuuuaccguggagaaagagaauucuucaugggauauuuaaggguuacuuuuaauuauggcaugaaaaggggugacguaggaccagaugauaacuuuuaguuucacauguagauauuggggcucauggagaaggggcagagucagugacauaaagauuuaagucuuccaguuauccccauguuguaguugcgguagugagaggaagcuagaugaaggggagcaggaggggccaaguggacaggugagccuguugacuaacaggcagggaaccagcuguuuaaacaacaggcaugaucauaaaugaauaagcugugacuccagaguacuugcucucugaacccuguucugcguuaaugugaugaguucauguuaggaugccggaggcauuguuagucucacuuugagaagaggucuaaauauuuaaaauucuguucugccccaucuuuccugaauuucugucugugcuucguuugaacaguacaguuuuauauaucccaaggagcuguuuggggaaugcucgacucugguuuacgccucaucucauuaggacgcugcaugugugugggauagaugcaagcguuggucagggccuuucucuugcguuaauuaggacuguuuaauauacugugauccguguauggcuuaagcuguuuucgaacaugacuccuauucuacagguucaacugucugauaaagauagcuauguggauaauaaaaacaggcuuggguugaaggauuguuuuccuuaucuaccuucaguugucuggucuuuugucuguccagaacacuauuacuguggacaaaugugucuaugcugagaaaauuaucuggauaaugguaugaacgaaagcccauaagauuuuguuauuaauguuguagauuuacuauguaaaucuauuugauuaauaauauugauccuguauacuuaaggacuuacauucuacaaaaaaaguugucauuuguuguuauuguuuucuaauuuguugagagaguuuuguuuuuucugaggcagagucucacucuguaguucaggugugaacucaggccuggcugguaugaaauuuguugcguucuuucugauucagccuccugcaugcugagaucauaccuagguccuccugcugcugcugcugcugcuuuuccuccuccuccuccuccuccuccuccuccuccuccuccuccucuuccuccuccuccuccuucuucuucuccuucuucauuuuuuuccugcuguuguuauaugccaacaaaaauguuucagcauauagauacgagguugcucccuguaccagagaaaaugaugguugguaacagaagcaugacaggucauucuauucgauaacugacaugauugacacaguuuauuugcagauuucuaaacaaguauuuguuuaaggaugcuugguccauaaagccuuauagauacauggguuuggaaaauuauagagaauuuacaccaagucuuucccccuggggauugcuccagagcuaggacuuuuggcucuccuccccccccccccccagggagauuguaaaaugaguaguuacuaauggcagugcucagggaaagcaacaaggaugaugccugucccaucauccccaucugugaaaacucuuuguaauugucucgaacaaaaacaugacaugaaaacaacuagacaucacugcugauucuuaggggaguggcuuacauacagauuggguauucuuuuuuuuuuuuuuuuuuccgagacaggguuucucuguauagccuuggcuguccugguacucacucuguagaccaggcuggccuugaacucagaaauccaccugccucagccucccaagugcugggauuaaaggugugcaccaccacgccuggcucagauaggguauucuugcuaacacagaguuaauagcauauuuucuuuugccauucuauuaauagucaauuuuuuccuagguuaaagauguaaaucauggcuuuguccauauuccuugguagcuuuuggaguagucacuguagaauuucuuauuuggcgugauguuuguaagaacugcaagcacuuucaguaaguuagucuagcagaaaacagagagcaagugcauuauagaaucauuauauauuuguaaacauaagauggaaauguugguggcuuguccauugccuuauaaauaaaaauauaugcagaucuuugaguuaucaaacuaauauauuuuuuuccuuacagacucuuucagucauuaaauucuuuggagaagauaauuggagauucugcauuucuucucauuuuaaaggacaaaaagcuguaccagucagauccuuccaaagccuucuuagagaugguuaguugaucccuucugcaguuguaaaaaccaugugauucuuuucuucuuggauuaaaaaaagagacaagaagcuucauuaagagaauguuaaaauauaagaauuguucuccccauuaguuaagaacucuuuaucccuuuauauaaguuaccugcauauucaaacaucucuuuccuauaagugcguuugcauuugauuucuguaugcaauucauucugccuaaaucucagugaaaaaugacccaguaaauucaucucaaagcagguaaaauagaugaguguuagaacacuuaucucauuguuaagccucugggugcugugaucaguuaccuugcuuggcuuuaauuagaaagcucuugauauuugaauuuuguuaagccccuaaucugcuuuugcuaaaacugauuuuacugguccuuuugguggugcgauagguccacugagcucggugggcagcgcucagacauggacaaugauggggcagagauaaaagaguuuagaauagugguucucaaccuuccugaugcugugacccucaaauacaguuccucacauuguguugaucccccgccauaacauuaauuuucauugcuacuacagaaauauaauuuugcuacuguuaugaaucauauuguaaauaucugcauuuuccaaugaucuuaggaaacuucuauaaaagaggcugacccaaaugggucaugacucacaaguugagaaccacagaauuaggagauuagccucugacagagccugacugugggggccuugacagaguuuuccuaguucauuaucuucuaucuguagcauagcagggaauaccugccuuggcuugugcuguugugagcagaagagcuacuacagcaggaagugcacggaagggcuaugcugcucuuugucugggaagagccaucuaggaggcugauuagcauccucuacuccuccuccugacgccucagagaguuaaaguuguaacuuaguuaucauuaguaucuuuuaugaauuuggggacuuggaauuuuauaugcaauucgaaauuauacauuuggaauuagcgaugcagcuucacgauuuucuuagauggaugcuuguaaucaagucaugauuacaaauuuucauuuuaaagugaaaaaaaaaaaaaccacaagaagaggaugucuguuuccuaaggaugggagauagaggacacaaagguuggaggauguucucaagcucgcagauuuauuugguucuaaaauggagcaacucauugugccauugugaacucuugcccaguaaugcaugauguucuugaaucugauguucucuuuuugcuucucucucucucucucucucucccucucucucucucucucucucucucucucucucucucugucucucugucugucugucugucuguuucucuguaugucucugucucucugugucucucucucugucuuucucucucucucugucucucugucuguuucucuguaugucucugucucucugucucucucucacacacacacacaucaggauuacuugcuuugagucuuagcaugcuccaugcacuuugaaggagaauuuuugucuucuggugugcucuuuuuuuaaaauuuugcaagguagcauuggcuagcuaauuuugaugauuaguuuuaaaaaguaaaacuugaaaaacacuaugcuuuuucuuuuaacaggauacgaagcaaaguucacaagauucucugccccaaaaaauuauaauacaacugagcgcacaggagccaagguaagugugugacuccuucucgcuucccuggcccuuuggccuuugugcuucugaccucuacucagccuguguacuucaaggaagcuuuucauuaaaucaauuacuaaucaauuaaauuuuuucugaagaaauaggcuuucuuccaugacugucauauucuguguucagaaagaaguugccacaagagauuccuguguuuaugcuuguaaugauuuuauaaauggaagucaagugacagaaaguguguagcuugugacccaaguauuuccuugucuuucugauacuguugucagauaucugcaguaaccuuuuaugaaguuucuugauuuuccuuaaugcccaaugugaauucuucuaaagaaggaauuuaauuacugcagaccaagguuccuucucuuaugcuuucauaggcugacugccuugcugcugaucaggccacggcucuguugguggacacggaagcuaacagucaaguuguuuauuaaacaaaagccaggauuaaggguggcugccucugacuucuaaaaaagaguagcuguuugcauuggcacccucccaggcuucuguguuuagugaaugagaguacacaguuacugcccaugacuuaauuuuuauugagaaauguuaacucuuacacauugaaggguaaaaggaaucuuaaaggcaauuuaugacuuuuagcugaguaugauuuauuaaaauuaugaaaaaugaauaaagcaccauugaagagagcaccauuacgaugaaugugagguugaggcuguggugaagcgcucacaaagcccauaguguucaacggcuucaccagcagagccuugcccggcucauaccugagaacaagaaauggggcuucuuuagcuacauggaugcuuaaaaucuccccuaagggcacuaaauauuuuacugcauaauggaauaggagaaacaucaacuaugaaauguuuucuuuguuuuaaaagaaauaauucuugagugcaucugaggcuagaugucugcuuuuuaaucaucauauaauaguaagcccuuuggcuucaggaaucaucacaguaaccauuuuccuauuuucuguuuugaccugggaggaucuuugguuuugcuggcccuaaggauucuaaguccuuccccaggugacuguggcagguccugcugcccuuucuggguacguguuguggucgguggaggcaggcuagugucucagcagaucagagggagaaacacaaugcacagcuguuccagagaaggagacgggcuuucacucacauauuagcacagacagaauuuuuaaggaucugguaaaagaugcccuugccaacuccuauguagucaacguuuucacccaugguuucucuucauagacuuucugccauaggucgucgucgcugcgucuguaaucccguuguuggguucuguuucugucucaguuucguaugugagaaccucaugaccauaucuacuuucucauuguuguuuuaaaauuugguuuuuacuugguaucuacaaauuaccuuaguuguuaauauacuaguaaaauugccaaagaacuaaaagaaugucaauggccuuuagaguagaaggacuugacaguuucccuucucugguccugugagguaauagcuauucugagucucuaaauggaaaauguuagaauugagguacugaguuuuuuguauucuuuguaaaucuucuaaaauguucuugaacuuagcagauuuuuaauguaaauaaacaaaacauuuacaguggggaagaugacacacgcauauauauguguguguguguuuguguguguauucauauucauauucauuugguacagguaaacuguuauauguaguauuaauauuaugugggccacuaggaaauaaauucuaaaaagaguccuuagagaguugaucaugcgaaagcaguagaaagaauucuuauauaaauuuaaauaaugcaugcaaaugaaguugaucauguuggugaucauguuauuaauugugacugugaccuaacauaauuuacuucagugacaucaguaaccugcugugcaugguuaauucccaaggcuuggugaguuggaauucauagauuuuguauagcagcaaauacauaagaauuaccauguaggaaccuugaauaaauugucccaagggauguuugauuucagaaagauuuuuuucuuucuguuucuccuauacucuauuuucuaagaaacugacuguagugucuccaaggacauuagugcagggugugcggguaagucaggugacuugaagacugaauuucaucuauucaggaaaaacaagaguuaaccucaucaucaugcaggccagaaggccaugcacuguugcaugaccauuuauaaaggcagcuuuuauauaagguggauuuucugaaacagcacuaagaaucaaagucauguaauaauaacuucauaaacccaagaauggaaaaauuucacguaaaugcuucguuuuacuucauuugugauguugcaacagaaaacugaauuuuaaugaccauaaaucuaaaugguucaugcucuggagguuugaaaguccaaggcagauuugcugcgucuuaggauggacuugugcugaaucauccugucauguugagucagucaucccauacugccgagucauucaucccauacugcugagucagucaucccauacugccgagucagucaucccauacugcugagucauucaucccauacugcugagucagucaucccaaacugcugagucagucaucccaugguagauuagcaagugauugagguggcaaaugcaacauuuuaccagaaacugcuuuccaauagugaaccucugauacuaggcaguccgcucaugauggcaaagcccugauugcccaaacagaucuucagguucucagcauuccacacuguuuacuuacuuaauauaagaacauucaaaccauggcagaugguuuuagcuugagauaaauuuauuuaaacuaccauuacagauuuaccugaaagugguuuuacuuuuuaguaagacauugauuggcaaauaauccucuuaucccauauuuuucuuuucucccauuccuucccuuuucacuuuuuuacuugagagagggaggguggagaaagagagagagaucgaaagcgcacacccgcaccaugcauauuguccgugcccucuguugguuggacaaccacuccugggcaccucccgcagucucaaguagcauccucugguuuucuaaacaagugcuuuccuuuauucuguguacuggccccagaauucauuuugaccucacuuuuguucauuuccaguacuuugugaauguagucuucuaacuuuaccccuucuuccugacaucuggcucucugguccuuagcugccuuuuuuuuuuuuuuuuuucuguuuugagugacuguagucuuuugucuucagccuuuuauagacauaauuuauuaacugcaaguacugguggcaucuacuuaaaaacagugcucucaaaacauuccucauaacauucuccaggaaauguauugccuauuguaggaaguaagacaaauagucaugauuuagcaaucuguuuccuuaaaaacaacgagaaaacaaaagucaucucaauugugucacguugaauacaacuuauuauaccucaggguucuggagaacugcuggccaguuuccacuuagggcagagauugagaccaagccuggcaggcccgaaugucuuggcagacuugcucgccuggcuggaaauggcagcugucugugggugaggguuuauguggggucagucguuugccagcagucauuuacacauguccucuccagagugucuaguucuaagagggagugccugaaggagucuuaagucuacccagacaaagcaaguaguuuuacaaaauaccauugagcuuauguuguguuggccaacuuguccugggcaugggccggcccugaggugcaguaauguacacaccgagacuccacuggagaagacugauuuuuccuuuggaaguagcaucaguugcagauagcuccuugcuuagggguggagguugugucaacaucuccacucuccaugccagaagcuauuuggcuugaaccuguuacagggcaugugcacucugccagacuuugugagcucauguguuguggguggaaggccucuuuccuugaugccuuccagccucucugucuguuagagacauuaugccuccucuugccacauagaucccugaggaaagaggguugaugaagauaucccauucaggacugagaacuucaaagccuuucacucucuauacuuuguucauguguaggggaggauguggaguuagagaaaacacucaucugauguugaugguaaugcagucaugguucccaucagcugccagaggaagccaucugauaaugcucaagggagacccagucauuugcacacucaggaaucccauugaaacccugaacuagaagugauaaaauauacaacagggacuuauaggguaaaaauaaaagaaaaauauauaaaauaaaaauuaaaaacaaccagauaaaauuaaaaauaaauaaauaaauaaauaaauaaauaaauaagaaaggaagagcccugacaugacacuuugagacacggaaccugcaaagauggugccauugaguuaaucuucuguuggccauuucagaugggauugcagccuucccauagaguaguuuguuucucuccauguucaguaaguuguauaggcauuguuuuuggcaaggggccuuguuaucaaguguguggagaacaaccuguaauguuggcaacagccugguuguuuggagauuucccaugggacccuuuaggacaaucagucaauuagauguaaccuaaugcuguuguagaagccucauugagugacaagagauggccaguuauggcuuuguuuuccucauuauuuugugauuucgucuagauugccuucauagcuauauuucguguauauauuugaggaagcuucuauuguguuagguuuccauacuacucuucauauggcucuuaauuuuaguugucucuccuugauuuccuuccucauucucuucuuccuuugccaucccuucuugauccucccauacacccauaaccaucuguuuuauuucucuuuucuagguagauccaucuaucccuucacaccauccucuguuccuaauuucugugguuuuauggauuguggcuugguuaucauugaucuaauagcuaauauccacauauaaacaaauauaugcauuauauuugucuuucuggguuuggguuaucucacucagcaugauuuuuuuuccugguuccauucauuuaccugaaacuuuaauuucauuuucuuaacagcugaguaauauuccauucuauaaguguaccccaucuucuauuuccuuucuuuaguugagcaauaucuaggcuguuuucaguuccugucuguugugaauagagcagcaguaaacaugguugaacaaguguuucugugguaggauaaagcauccuuuggguacauguucaagaguaguauagcuggaucuugaggcagaucgauuccuagcuucuggaggaagcuccuuacugauuucuauagugcuuggacaagucugcauucccaccaacaucagacaagugucuucuguaaucccccauccucgccagcaugagcugucgcuuguguuuuugaccuggccaauucugacaaguguaagaugaaaucucacaguccuuuugauuugcauuuccccggugacuaaggaucaugaccauuccuuuaaguguuucucagccauuugacuuuccucuuuugaaaauucuguuaguguucaugaaaccaaaaaaaaaagaucucgggagcacuggcagugaccccauccccacagucugugcugcacacacugguggaacuggacagaaaaccugcccacccagcagcuggaagugaauaaaggugugagucaugagauacaaguaugagauuaaaccuuuuccuguuucugaacuuuuaccccaauagcuuugaaaacuugguaucuugucuuuagaagaguagagugcuuuuauacgggaaggcgcugcuuucuuaagaaguagaugcaccccuuucuuccuugccuaaagccuuuauugagcagucucuacuucaugguacuuuccaguccuugucugggucugcgguacuuggaaguccaguguauuucuuuccaccaagcuuugaguuguuauuuuuuuaugauuuaauuaauuuuuaugaaacuaauaaauuauagaaaagagcuucuuuuauauuaaguugucuguuuuggaacgaguccaugaaacagagucacugaagaacauuggccaaaugacugaauaagauaugggaagaauccuaaaaagauaaacacaaucuaucaucagauugcucaguaucuaaguucuuagugcacuguacgaaacccaagcuuaauacuugguuuuauauauuuggcuauguagaaaguaauauauaaaacuucaauugguagucucauuaucaaagcaaaggcuuugcucuaacaucaguaguuuagaauaugauacacauucauguguuuuaugcuagaguaaaaugcuaagaauaguuaucuaaggauucgcugcuuacacuuacaggucgacuuuaccucuuugauuugacagaucuggugccagccuuggucacauugaucacaaugcuuucacugaguguauuuuguaaugaauuggaaaacugaaucugcgaggcauaaaugaguuagaaacacgaugagacugauguuagaucaaugauugagggaaguguuugcucuaggaaauugcuguuguuggcagcauaggccagaugugaugcucggugcugaagagagaagcgcuccauucguucagagccccugugcugagguggaagacugaauaucaaucaggcacugccaucuuggaugcuaaccuucuggcaacuugguguuggcuggaucugcuugugagcuugcugguacuccuuucugucuucuuuauauucuucauauucuuuauauaaaugauuuaguccuucccccuucccucccucccucucuccuuccuaacuuucuuccucccuuccauuuccugcuauacauuucccuugcuaaaauauuauuuccauggguacagaaaguaguuugcucuggcaguaaauucccuggcagaugccugacacauuguagguuauucaaaaauacuugucagauuaacuccaucuagaaggacuucaacuaauauuaagacagaaaagacgaagggagccuaagcagauacagauucuggguggguggaggucuacugccuugagaauaagugaagagaaaaaaacuguggaaaacucagaaguagauuaugcaaugacuggaaguaggaaacaagaaaacaugaaacaaauuaccucuuaaaagauuuauuuugagaacauuaaagagaggaaguagcuaccuagacgucgugaaaccugagcauugaccucaaagaugugcauacugaaauacaaagcuaaaaaggaaaagguugauuggagauguagcucaguagcagagugauuuguguaguauguuuaaguccugggcuuagucucaaauacuacacagaauuaacaaaagaaagaaauuagagcuagaaaauuaaaauagaggcaacaagaaaaaccuaaaaaaaaaaucuaaauggcuaggcaguaucaaaaagggggagugauaaagugaaaacuguuagggggauagugacuggauguucaguagggauucuaaacugcaagugacaugaaagaccaucgagagaugcacagagcaggaagaggguaggcauggagggcaggauuccaagccaaaguccugaucuccuauugggaaaaaggacacaacaacagguagugaacacagauaggagacugauggacagcucuuggaagcuagacaguucucagagaggugagaugaaaccccaaaaagaaacucuuuucugguuuucuagcaaagcaaaacagaaaacuuuacaaagaagaacagagaaaaaauccagaguccauuagcgagggagugguguaguuuagagagcucuccccucccaagagcuggccagugauuaaagcuacaacauaauagagauggaaaauccaguuggcuauaagaaggagacauuuuaaagagggggagaaagagagugggcuggagaaaggcgugaaaaguagcauguggcagauggagaagaugcuaagaaaacccucuccuuggcacucauugggaauagcagagaugccauuuuuaaaagagccaggugagcacgcaguuugguugcuggcaagagcuucauuuggggggagugggggacuggagcaaguauuaugggaccaugauaugaaaugugaccaauggaauuccuuuaaacuacaaggauuuuauuuuauuagaaucuagccugagccagaaccuuuuauggucacaggaagagauagcaaguagauuuacugacaucaagaaggacugcccagugguggagccagcauuugaaacuggacuauagaggaccaacuacaauugugacugcauuugugacugaaugucacaaaaacugcugagaggcuugucauguauaugagagacagggaaagagucauagucaagacuggaagcaugagcaggcaagaagugauccuuagauucuauccccaucaguucuuucacaucacauguguuuggccucuguauaauacccagcuguauugaccaggacuucucuguccugcuuugcucuugaauuuucauagugagccuaccuuuugguaaugacuauuuaugagauaguguucuauucucagguuacuacuguggauugaacccaacauuacaaacaccagcucagcaaagaaaaauaacaauuacuuagucucuguugaacauugaaaacacuuccacugaaagaauggagugauuaaaaaaagauccaacagaugaccaaaguaaccacagauaugcagguuauaacacaaaaauaaaagaaacgucucauaucaaguaagaggacugcuucuaaaacuuaauucuggaccacugaagaugccuuagaggauaaacacacccauuauacaagccugaugaccugaguucuggucucuguaagccauuugaaaaucuagauauaguucugugcaucuguaaucuauguuucuuuggugagauggaaagcaaaugcaggaacauccucuggaauacaugugaggccauaguaugagagagacccauccucaaaacaagauagaaggugaagaacaucucuugaauguuuuccucagaccuucacauauguguccugauauaugcgcuuccaaacucacgucugcauagagcaugcacacaugcacacgcaugcacacacacacaacaaauacauaccccuacaguacugucuccauugagagcaaauaacuuacaauccuagacaaagaacucaaaaguaugauuauaaguauguugaaagaaacuuuaaaaagacagaaguaaacugaaugaauuucaagagaauacaaacaguugaaagaaagaaauaaagaaaucaguaccaaagacgaaacugaaauucaauaaagagauggaaauaguauagggaaaccaacagaaauacuaagaacgaaaaaagaaaaacucagcauaaagccuuuaacagaauaagcaaggggaaaacaaaaucagagcuugaagacaaggcugaugcaucagagcauucgggcaaugacagacaaauguauaaaguaugaacagagcauaugagauauguggggugguaucaacaagccaaaucugugcauuaugguccuaggaggaagaaagaaucuuaugguaaaacuguagaaaacaugucaaaacucauaacaaaaacuuucucaaagaaauguccguccauguacaggaggcaucuagaauaccagacaaacaaugugaaaaggaaucuucccauuccaucuuagaauuaaaacauuaaauacacacaacaacgaguauauugaagguuucaagacaucaacuuuuucaacagaaacuuuaaaaaagcaaggagaacuuggagugauguauuuccagcucugagagaacaguaacucccaacccaagcuguuauacccagcaaaacuaacgucaugauggcaugggaaauagaaauuccacagaaagaauagacugaagaaauucgugauuauugagucaucucugcaaauauacuuaaauucuucauacugaagagaaagguaaucacuuucaugaggcuacaggaaagaugaaacuaugcuagaaggcuaauaauuaagcaaacaaggaauaagaaaacaccaaaccaaaaucaauaaacagcaaucaauacacacuuuccaauaauucugaauauuaauggucuuaguuuucgagugaaagucacagaucuguagauugaauuuaaacaaacaaacaaacaaacaaacugaaaaccaggauccaugaauuuguucccuccaagagauacuuuauagcauaaaggucagauccagcuuugaaauggaaggccaucaagcaaacacacuuguacacauauagcauugaacagaaauguugacaaagggaggacuuggaugaauugaucugcaaaacucagcuacaacuuaauguagucauuuuaauuuuacuaaaaagucaaauauuaaaaauuuuaucaacuugccauggaucaaagagguuaauguaagaguugguuuccagaauuguuggagguaaaaauagagagcauacuuaaagauccugacauaggcaaagacuuucucagcagaacuucaguuguuuaggaaagaaugcuaacagcugacaaguugggaccccaugauauuaaaguuucuguagaaucuagagaauggaagacagucuuugguagcuguacacaugacagaggauuagcaucuacacagagaauucaaacaaacaaacuaggcaagcaaccaaacaagccuaacaaaaugaacagaguucccaaaagaugagagacaaauaacggauaaucuuaugaaagaaagaaauccaaucucaccaggagaaaaaggcugguuaguacagugagauuugaucucucucuagucagaaugacaguggucugaacaagacaaauaauaaauaaagacaagaauguggacaaaugggaacccuuaaacacuguugcugggaaggaaaauuauuuuagccauuguagaaagaaguauggcagauccucuaauaacuaaaacacauaugauuuguaugauccagcuauaccauuccugaggguuuaccuucagaauucagagacaacauaccacuagcauacuaguacaucacuguuuacugcagcaucuuauacaguagcuaaauuagggaaaaaacagguguccaucagcagaggaguagauaaagugugguguauaugugcacaaugaauuuuuuuuuucagccauaaaaaaugaaguuguguuguguccaagacuggagauaaucaugcuaagaaaauuaaaccagacucaaaaagacaaaugggcuuugauuuaugguuccuagauauuguauagauaugugaaguguaugacauuugacaugaaaguagacagaagcaaauuaaacaaaggggacuaacagggguguaguggagaggaggguguggagcaaugaggaggaauguccuugaucuccaauguagacuuguauguauagguccuuaguaaacacacuucagaauacagugaguguguguguguguguguguguguguguguguguguguaaaaugaaggauuuuuuuccuuuaaaaaagauguuuguacuaaaaaauaauucucuuuaaauacuuugguaauucaacucaauuaaaugugaagagauaauacugaggaagcagagaaccaguuuuacugcugugugagaaaguguguuauauaagauggacugccucucccucccuccucuccccucuguccccaucuuucuauguuuuccuccaccuuccuucccucccucccccucuucucuaugaugcagauuaaaccuagggccucgugcauauuagacaacccuugucauuaagcucuaucagcagccccucaaaguuacaguucucacucgaaggcaauaaaaagcuacuuucacgaucacaacaggaaacaugcccuuccacuuuuaacaauuaauuuuaggauaguucuugauuaucaacucaguuaauggcuguuugagaaaggagagucaguuuccuugguguuaauggucgaucccugguagguuggccaugcuguaguggaaggccccauacuuauaauuauauguggguagccucuguaucugggaagaggagggauacguaguugaaaauucuguguguaugugugcacuucucaaagaauaaaauguauauguauaaauuaaauuacacaaauaaauugaaagggcauuggaaauaauacugagaagugaaaaagaauuaauguauauuuauuuugcugccgaacuggggguggggguagaugucuauauacgcuuuucauagaacuuuuaaagaauugagcaaguuuacuuacugugccauaggucugcccgcagcuucaggucauccuacugaagcauguacaguuccuuuagagauaguuuugccucaggaaguugacagagugacgcugguggcagagcaaugugcccuguguaauugcuuucauuuaugucacagcucacuguugacuucucuguugggaaaacuuugagucuugcgcacgcacacacaccugcauaugcucccaugugcacacauacacauaugcauacaugcacacacacagcuguugggugauuggagugugauacaguaacacgugcaucuagacauguugaaacaguacuccucuuucccauuugaacauguucuguggugccacgcucuuugaaguucagaguaaccaucuauuacaauguugaugagugguuccuuucguucagauguuuauugauuucuacgauaaaggucuucaagacccccaaccuuucaguuucagcuugucugcagaugcacaguagcucugagaccucuaaacgggucucagucuugucacugaacucuuccucucugcauuaaaugucauuacuccacugcuacuaucugggugacugaaacauacuguugaguggucaagauaaaaugcuauguaugaacauaguagcacaagucuuaacacguaacuagcaaguguaauuguaugcuaaugccugaguucaaaaccuauauuuuuccauugcccuaaguauaaacuguagaguauuuggcaugacuugucugcacuuucuagaauugcuuuccaaucuagccugcccugucugcugcacgcucuuaguaacuguuaauuuucagaguugcuauauuguuauaggagaaauggcuaaggugccuauuuuaauguaucaaaguggaccuggccucuggguucucccagcaucccucagucccuaccuauuacaggguauggcugacauacccagcccuuuacccugaauuuuccagcccagggcuuccucaccuccgguggcauuuugaauucccccaccccauuugccucucugcauuucuuucauccugugugacacacacaaaaacacacacacacacacacacacacacacacacacacacacaccuccaugucuguaaggcaaguucucugaccuccuccuaugagaucagugaauucaccuaagaacugacccccaaaauccugccuuuuaauuuggcucgaauuggcuuauuuugucugcagagaagccuuucaauuaccucuggguccuugcugcucagaaacaaaacuagaccaccaucacccaaaacccuucccaucuagcuuggccacacuggccacaugucuuuuagaacacagcuuaguuguuaacaucauguggaagcuuucuuugacaucccuccuccguggagcaccacagucaugauuccccucugaagagacucugugaaagccuugacaaguaagcuguuucauuauugucaccaguagucaaugaggaaagugguccugcagugugugccaggccauuuuuaucugugaagugcacuggaaggaaugaguccagccaaauaucagguguggagaugagcugacuucuaguagacaggguuugucucucagugcugugugguuacaggggaauaaacaccuugcaagguauaagucagugagaaggggcugaucaaaacccagccuuuguagaauguuacagaaauguaacaauuuuacauuaccauaauagcauuuuauaauuaaagaacaauaugaaaguaguaaauucugagguuuuaacuuaagauuugaucaaguuuuucuuuaaaauuccuuagagaagaaaaagaugauguguuuaaguuaaaggaacuaugaacaguuaacuagguaaggucaacuuaggaacuagggaguauuuacuaaguuagugacuaaaccuuggaaauggaaaugguaaaauauuagaaaaaaguuacacauguuauuugacuaugcaaaacuugucuguaaacuaaauugucucccucuuagaggauuuacccaaagugcaaauccagauuaaauuccaggcuuccugcucuuggauuucucugucaucugacuucagcgugagacugaaucugugccauucugaaggcuguccugugaaucugucagucugucccugugucucugucaguccugucuguguuuguucuguaggggugucucugucugugaguugugugucugugaguugugugugugugugucugucugucuguuucugugugucuguacacaggcuucacucuuuuuguugaguagcacagaaagcaucucaugggggaaggaacagggcacuuuacagaaagcucuaacaguuuuauaagacacuaagugacugacuguaaaugaucccagcuaacccagacauuguuuaucaaccaguauccauaaaugacugcuuuuaugguagauuuuagaaaguagcuuucaacuucuguauuugcuauuuucagcaaauuacuuacacacacacacacacaauuacucucucucucucucauucucucucucucucucucucucucucucucucucucuuucuaucugagucaggggcauuaguuuagguugaaaauguugaucacaugggaaagcuaaagcaaguaggauugaugguuacauuguuuuccucuuuuuaaaaaucauuuuguuucauuuuauuugucucuuuauccuguauguaugggguuuucccugcauguaugucugcacaccaccugcuuacacuacucucugaggccagaagaacugacagaugcccugggaccagaguuacacauggucaugagccaccaugugggugcugggaaucaaacccugguccuggaagagcagcuuccacucuugacagcgagcaucccuccagucuccauuacauugucuucaaagcagauuuagugaacaauuggagaacacaauagugucaguuuuaagucccaacuggccucaagguauguuaaaaacucuggcucugagauccagcagaaguuccagucucagaauguaagacacauuuucacaaugacguuuaaaauaguagucauuuuggagucagugucaccuuagauuauggucuugguguuuauugguuucccuuugugaccugauucugcuccuuguaagcgcagugcuuuauuuugcacuguguccaggcacuguaacagaaacgucaguguuaucacugaaagaagcugauuuguccuaugagggaaguucacagcaggaaggagcuguacaugccaggcaaguggccuaucuaccacugaacuguauucuuaccgacauuuucauaggguuuggauuuuuuuuuuuccuaaauagaacuguugccaacuucaagcaaauugguuuucuauucaucgguaauugccauagggucggcagcugcugcugcuacucgggcuuguuaaccagaucaaacgguagcugccaucuauauuggcuguuuucaccccggcacuauuaacgagaguccuccauuguauaccauuggauauguuuaguaaaugagguuuuucuguaagcuagaaacaucuuaaagcuuugacccccaagacguugguuagguagaaaaauaguauuaaaaacuuauuaauggagaugagagauuucauuuuuacuccaaaaccaagacauaauuggauccugaaaauuuaagaaucaguaaagauaaaagguacaagccagugaaauaaaaccaaaucucuccuacugggacuugggguauucauggguuaagaaaauggaauguguagacaguuucuuagugcuaggaccauggagagaugggguuucuccucgcgcacugucauccuuucagggaaaagucugccuggcauucuuucuguagcguguuugcuugacccuuuagauucuugaguguuacucccccagaaucuacacagugucuuuuuuguuguagucucugaaauaggaucuacaauguggaaugcuggugaaagccagacuccagugucuuaccugagccuucagagagagagagauuugugagggacuuuugcuguuguuguuguuguuguugaugaugaugaguuuaggaaaguaguguguauccguggaauaaacugcagauucuguuaacauuucugaauguucaaaucaaguaugauaaggaugcugcauuggauugugugagcucauuguagguuuuugcaccaaaugaguuaugaaaacucugaccuuuuucuuuccccagagcccuuuggauuuuauagaugagauaucaguaagaguagacuaauggcuuugggaaauuaaaacguugaugaacacaaugacagccacaguguacaccuuagcgauucugaguugugccgaguucuaacuaugcucccagcuguccuguuuggacuuuucucuccaucugaaauuuggggccuuuaaaccccauugaauaccgugugacuccagagguguggccagccaagcugagccgacucugccacuccacaauuucuaagcaugugacacgccagccuugacccucaagccuugcgggcgucuguccuuggugcccucaagcugguucauuaucagaacucauuguucaguuuuucuuuucuuguuccaccguugcaauuccuggaaugacauuucuucucucaucagacaguuuaauguuuaauaacauagcaccucaaaaaaugcaguugugaauuauauacauuuuaauugucauaugaaaguuugaagggagcaugucuuggugggcuauugucucacguugguuuuaagagaugugcagugugcaccgccugcuuggagcuucugugggacaccaucuggguuggguugcuccuuucgucacugucucuugcauucucaggcucgccccugagguuuuauaauuaguccgcugcgauuuuguuccuuggaccaaauuauuuagcuuuuacuuguggaaguaauuagauagauuacauuaaaacgguggcuucaaguuuuauuccuugaaaugugguggcaaagcaguuaaguucacagacucccugccaaguagccugcuuagucuguauccuaauuguccuuuauuauauuuugaaucaaacuuucuuaacuagccaugcaguucucguuuauuaucagauuauuguauaauuaauuaaauuuguacacaguacauuuuagugaugcgguuguucugaugaaauuaaauuggcuaguugggggucaccacauuguguauccucccauuaauagucaucaucaguggagugaagaaaaggaaggaaaauauucaccuguauaugugguacuaugaaauauugugauccuucaugauauguggucagauaugcauaaauaccacacacaaugaagccaagauugugguuaucuauauuucuaggaugcucagaaguuuguaauauuaaggaagucacgagugucagagcugcuguuucugaguuuggugugucuggcaggugcucuaaaugaugacugcuuccauuucugcuauacuggaccgucuuuuauucacuaguuauauagguacuucaagcacuuuagauauauggaauaugcaugauuuuaagugcuuuucaggggagaguaagaguuaaaugauauaacagaucacacugccauucauuuuguucuggcuucucacacacuuaguuucagauccaguuuccagcgucuuggggauuccuucaggugucccucaggccugcuggaguugggaacauaaagcuuuagagaaagcaguuaggaccuuagagagaagugauguggcauuuuuucaggucuuccauuccucugaaccagguggucugucucuuuccuucuaaaugcacguuaauaaagcauacaccaugaugggaacaaggagaaggaguuuaguggagguuuccucguccugagagagucagagagggcuucaagccuaucuaggacuucagagcgcuuuaccacucugugguaaacaaacaaacuuaaauauauagagccuuugacuuacacauuccauccuuauuggacuuauuuuuuuaggcaagaauauuauauauaaaacugggccacuugggcagacaucccugggacucguggucagcugaguaguugggcagugaugucuuucuucagaaugugucucucgugugcugcaacacggaauguguguuccuugacauguggugaugugucuuuggugcccugugucuuccuccaacaguauacuggagaacacaggaaggauucuuuuccaggaccaguguuguuucuaauacuguuugugagaugagaaaucauuguguuugaugugugaugaugaugcacugauaggaagauagauaauaaaacauucuuuucuccucuguucaccuggaaauguuguagaugcuggaugucguucaucaacagagauauauacaagugacuaugagcucugucuuuaacaagagaacaacuuaucuuacuguguuaacugcuacaguuuuuauuugggaaaucauuguuuauguaccguauguucuuccagacuuacagcauugacucaucagagaaaugaaauuuucucccaguagaugaaaauuacguucugacugaaaaaucauuucuuaugcagucacccauaaauauaaugucuuuugcugucauuucuggaaaugacuagagaugugauucugaguagacaagaaaauagaacaucuuaauguuuuaggugaaacagaugguauuuuuguuuuaggcaaaacucuuuagaguaaaagcaacuugauuggugacaacacucuugggaucagcuaaauuaaauauaauuuuucugucuguuuucuuuuuaauugauuuaguaucaaaagaguuacaguucuuaagaaggaauauuuauacuuuuaauguuuucuuccucuuacugcugugcccuggauaaagaaauaagcauccuuuagucuguuuuuacuccugacagugucaggauuccaugccgguucagcuuggcucacaugcauucuuuuggagaugguuuuuaggauguguagaagcccuguagugugugcggccuggcugagggccgaugcacaguucucucauguugcauucuuuugcugcacauugugaucacauuucucauccccaucauuuguguaacacugcggugucagaucuuaacugucagagccugcaacgagcaagacacugagggggcagauucugguccaacauggucccuaacaagugucaaguuucucaaacuuccaucucacuuguugcaugucuugggauagguaggguugacaggaugucacccauggcaucuguacccaguccuacaccuacgggguugcugcacugaagaaucuuugcuggggcugagguuaaagaggggugggaagaaugacaggauucugaggcuguaguuggugucucugugcugaggacacaacucccaaguacuuuaacauuucagugaccaaaacaagcaaguguuuuaaagaggaugaggaggaaggggugaaaccaaguggguaucugcucuagguaaaaacaagagcacaauaaauggaaaggauauuuucucaggucagggguauccaguaucacuagacuccaugcaggaggguggaccacuaaagcauacagggaacucacagggcuuaugcacaugaugugacuaaguggaaggcuuaacaggggcaacuguccguuuucuacccugagagaguguaguguauccugggcuggccucaaguguauuauguaaccaacaaugaccuucaguuucugauccauacaccuccacaccgaugcagugcugcugauaaagauaugcacugccaggccugaguggaaugaugcugaccacuaaguccauaguuucaugcaugcuagacaaaaacacuacccaaaugagauaugucccccuaccucaacaaggucaaguuuuuauuuuuaauaucuacuucuccuuaugaggaggugaugggaugauuuguggggucaacccuuaaguugaagcaagaagaacaagcagauaauucaauaggucaaaacaggcuggugaaaacugaacagagacaaacacaaacacuggaaugaacuuggggacccuuggcagguguaggucagcaauagcuauucucagaagguggcauugugauccauucuuaaaauacuuuauacucuucucauaacuaauauucauaauuuuauaaauuauaauaaccaguuauaauaauuauaauuauauuuauaauuagguaaauuauaaaguucagaaaaauaauuauuaaauaguaucugccuuuuaaucuagucauuacuacuucuacaaauccauuauaagacgauaauagaagcagaggugaaucuuagaacacuuuuggauuccuugacaaauauggacuggugaaaaacaagggucuauagcaauaaagcuuuuuggugcguuucuuucuaugaagucacaacaaacaaugaccaguaaggaauggcaagccgcaccaauaccauacuguguucuucaccaucuguuggguuauauuuaugacaucauguguccuuucacauaucugcuuuagcaaaacauccauucaccugugugcuccaacugaacaucauuugacacacuuacugacguuccaaagaaagcagaagcuuccacgccaagaacuuuaggguuacugaugcuguuacccauaagccugcuguguauuacuaacuauaucucucaauuucaaccaucacgcaacuuaaaaaagaaauucaauacuuaggauagcacuuaaaauauuuacauuguucauguauagcuuugguuuugccuguuaaucucuaauucuguuuuucuccuuauguuucuaaaaguaggguuuacuagauuaaaagggaaagaguauuuucaaaguacauuuuuccugacuuuucuuauucucuuccuuauaaauaugagauauaagaaaggugaaaaaaaaaaaaaaagagcaacaagcaaacaaaaccaauggcuguaaugcuuccuccugaacauagcucuugcuaaaauuuuggaaaacuuccuccauguuuuuuuuuaauagacuuaaguuuugacauugcuucugacagcccugaaggagggagacuuccaguaucuugugccccuccucacagccucccugugccugucucugccuccucacagccucccugugccucucuccuccuccuuacagccucccugugccugucauauccucacagccuccuugugccuaucuccuccucauagccucccuguaccugucuccuccucacagccucccugugccugucaucuccucauagccucccugugccucucuccuccucuuccuccucacagccucccucugccugucucccccuccucacagucucccugugccugucuccuucuccucacagcuucccugugccugucuucuccuccucacagccucccugugccugucaucuccucacagccuccuugugccuaucuccuccucauagccucccugugccugucucccuccucacagccucccuaugccucucuccuccuccucacagccucccugcaccugucuccuccuccuccuccucacagccuuccugugccugucucccuccucacagccucccugugccugucuccauguagcugcuuccauugcccacacuccuguaagggcccuuguggggauguguuggcccagcugaagucugagguaaucuccccacuccaagagcuuggauuuaauugcauugauucuaauugcauuuuccaucccaacucauggcuacagauaauuucauugugauguuagugcuuaucauguggaagcauggaggguuuagugugguccagcucaacuuacagcuuuuguacagcggauuuccgcuugucguuuccuagacgcuagccucccuuuaugcucugcuuuuccuuuuaauugucuacaguuccaugguuccccaagauuauuucuauuccucugcuugagggauuugcauuucauuuaguacaaguuugaugacaaccaaaagucucaauuucugucuaaucauccuuuaaguuucuagagaauuuuuuucugaauacugaugacaaaguuagcggguuuauuauuauuauuaaccacuuuaaauauuacucuuuugucucgaauauguugcugaugggcuuaauuuugccuguuugauuugacacuauugucuugaucucccuggcugcuuugaaggauucugagguuugagaggacaauguggcuuaucauguguacucuguggggaugcacagaggacaacauggccuaucauguguauuguauguguuuggcaaacacacagaggacagcguggccugucauauguacuggggggcacacagguaauuccauucuguaauguguggauuuccugucuuugcagucugcuuguuccccucagugauuucuugugucccucauucuuugccaccuaccuuccuguucugucugucuccacuuggaugcuuagugucacucgcucgacacagcucacucuagggccaacugugcucagccugcacauuuggaaucuuguuuccugugauguauugauuacuauguggaauuuucuaucuucucaagugccuuacucauguguuuucuugaaugucucguagauauguuaaaguuaccagcuuacaccaaaauuugggucauagguacuuguagucguuuugcuuuuuuucuucuuaauguuuagucacauggcuuuguguuuagggacgccuccuaauuuguacugaguguuagacaaugagcugaaacuggaugcuaucacuguaaccuggagugugcugaaucgaggcuaaaggacuucaucucuuuuuuaaucuagcuuucuaacucuugcuguguaggucccacuuuaauauuuaaaauccaacagaaaucaguauguuaauguugacauugaauaagauucacuaauuuaggaggggcucuacguuauuuuuuuguuuucucucuuuguaguucucucagugaaauuuugucaacuuuacagucuacucaguuuggcaucaaaggaauuuguaagacauugauuguucaccugcuuaccuuuuaaccauccuaacuacucuccgucuguucauguuacauaugacauaugucauauguaacauaugacagaaacaugcauauguuugccugacuugauauuggaaucaguuaucagucugcuugaguuucccccuucucuuuuauagaugguucuuccaggucagggacucuguguucacacugauacauuuguagccacucauacaccauccaucucuuucucucccucccucuuacuuuauuuauaaccugugugguuacuucgcaugugcgcaucuucugcacgagugcauggaucucccaucaucaacaccagugugccagugacugccaaguugucaccacuucuuuugucuagauuuacacacacaugcucacacacccacauguacauacuuacacaaucacagacacguaugcacacacacacacacacacacacacacacacacacacacacacgaguuguagaggugcaguauguugggaugauugcuccaucggguaugaugacgaccaggaucuuugaugggcaaccgugacccggaugaaagugauggagaaacgagucauaaucaggcucacuuugugucagcuguuagcacgguggguuucuaaguauuuccccauuuaacucguaacaguaaucuugccucuucauuuuacuauaucuuggagaaaugcaaucaccuaaccucacagugggaauuugcccuuugacucccagauccuaggagucacagcacggguuuuuaaagccugacaucuccauaagaccaccuuuguuuuuaauaucuuuccuuuucuaguaacauuuuauucuccuagaaaaugagauagaguguaaaaggaguucacaucuagaauuugccauguuaauguauuaauggauguauuuccauacagaguucugaauauugaacucuguucuuuagauuaugucucacuaauuagauuuagagaagaugaauauguucuugugcugccgcuguuaagaaucacggaaaaugagcuccugucuuuugcuuguuccuaacacucucugggacccuggaugaguccgucauuucccucauuuucacagaggacuugauuaccuauauuuguauauuuugaggaauaaaaauaaucaaaauaaaaagcacugauaaaauuauaaagccccacacuaguagguauucuuuauaaaugauaaaucuuaugauugaaaauuuucuacauuauuucuuaaucagcuaucuacuaaacauuuuuccaagccaggcuaugguacauagcaaguuaaaauugacaauuuuuuuauagacccuucuugcauuugcuaaaauauucuuaauuugcauguacagaggacuuuucuacuuuaaucuuccuuacacagucauaaaaauaugucauguuuuaagcugucuccucccuccuguuaugguuuacugcaugcaagugcgguaagcacaucuugcaaggauugucuuguucuucuuuuuuguugauaaguuuucuuuuacagcuguaauauacuugaaauguaacucacucuuuguucaccccaaguuuccccacaaugagucuccgugagcuugcuuacggcaacucuauagcuggguaggucuugguggcaugucuaccugucggaacccuccuuaagagacagauggagcgcuaagcuggccagggcuccaccccguccugaggacuguccuaugaagaaggaguacugcacacaauauuuacuaggcccugauuguuuggaccauggggaggacucagugauugcugcagguguccuucugacacaaugucaguuaucccacucagagggugaaagagugcugaagaccucuguucucagugggcuuuccaggacagaccccucugggcagugacauucuggcuccucuauuaguccccagauugacgugaccauuugaguggccuuucauuauuuuucuccuugcugaaauccauuauucuccuguuuuguaauuugauugacagguaacaaaugaguacuuuuucuuccugagaugagcuguucugguaaagaauugaaauaauugcccaugacaccaagucacaaagcccugagaggccagacaugacuuggugacagauaguaucuaaggaccuagugcuaaugugaacagaauuggagaaaaguuauuaacaaaacaaggucccuauucaauuaggaauuacauaaaagagaaucaaacccuucccauuuccagaguaucaauaauacucuuguuaguguagagauaaguaugcaggugaugauaugauaugauaaugaaacuuguucaaguuguucaccuacagcaggacuuaaagagcucaugcuuacucuacugcuaugauguccgagccacuauugcacagucugcacgccucgccagguuaucaguguaguuggcaggguuuguuccagggugagacuggugcugaccggucucuccugguagccugcacagcuccuuccgguacugugaaagcuaucccagagggaggaagcgcccaugucaguucuauuugacuuuuccaugcucucucucugacuguuaucuggugucuucagcaacagucuuacagaaacagauuucugcacagaauucucagagauacacuuuuuuugaagaacucaugcugagaguuuggugcuaccauuuuguugguugcuugaccaccaaaacauggcaauagccauagaauuuaguuaauuuugagggucuacuuauuuaaaagaaaauauaauucaugauuauguguucucuguauuucacuuaaaaugucaaauaggaguuuguauguaugucagauaaauuuguccugugauguccuugagcagcaugcugugaaucucuaauuauguuagagauuacuuucuuaucccugcauuuuacucauuaauauucuacauauuuaguuucuuuaauagauucuuggcacaauaauuacauaaucauucaauacaguagaaacauauucugaucaaauacuaauuaucuacuuaagugaaacaaaaaaaaaaaacuuuguucacagcucuacuguacaaugugauuucauacgguacaaaaccaaauauaugcuuaaaacuguaauuaagugugagucauuuuucaaguuuucuauaaaaggacuaugcuugcuguuaucucuguguacucccaguucugcuccaggccuguacacuucuucacagucuagcuuuggauggaugccucugaaacuguacauguuaguaguaaaguguucauuuacggugcucuggaguaugugaccaucagcucuccccgcccggcuccuuagacucuaauguagucccucugaugacacaaaauccuggcacugugauugcccuucuguguuuaugaucagagaagagccaggacaaaacaaaagcucaaggguggccucccucgagaggguguaaauuaguuguaaaguuugucugugauacaccucucuccaggcgcgacacugacagcccuugaaaauugcuucagaggccaaguuggggcuuuaaugagugcuagcauguuugguguuguuugucaauauguuuguggcugguagcuucuuucaucugcucuuguccaugugcauagaguuccaaugagucagugaaugcaggcuugcaagugagguccuugugucccggugcauaggccuggaagaccuacagggcuggaggcauucuuagaauugauuauaucaccugccguauuuuaaaauaguauuuaagacauaaaugugucaucugcuaagcaauugauaugugaaaugguuuauagacuuggugcuuuaucaucuugauuucauuuuuuuccccuguguccuuuguuuugcucuguuagggacuuuauuccuuaaugagcagcuuguaauguguaugaaaaugaagguguuuaggaaacgcauguacggcgacuuucagauguggcucaacaaauagaagcuaucccagaacaccucuggagcucacgugaaugaggagauggucacaaucugacuaaucuguugauguuucugcacuuaacauauuuuuaggaaaauaaaacauuuuagaucauaaaaaaacauucacuggugggugaaucagugaacagcaggaaccuccauccuuuuggaaacucuucuuuauuuggagauaauacaauguaaaugaacuguaaugcaagauugugagucauguagauuuaccaguccugucaggcugcuaugcagcauuucugcuacacugcaggacagcauuaggagaguuaggaugguaaggagagaaaggaugcuagugccucguggaggauuuaaaugccagagauugagagaagagccacaggaaaaggaggacgaauggcaucagauaccugcuacaaacaguuaugucagaaaccacccuguacaauugaaauauaggacgcuagcuacagugugcuugugcugggugucaaagauucugacaagauugcaguucaagcuuuguuuauacuaagaauuguauguucuugcagauauugacagaaacuaccauuauaguuugaauuuuccuuuguuuggcugaguccccaccaaaacuuuuuuuuucugaguaguauacuuaacauaaaaauuuggcccuucuuauaaguagauuuacuuugaauagacuuguuuuuaucccagaacuaaguuucuugagcauagcaaccugggcccucucaauauaaaacguguguguacugugagauuugcauauauaaucaugcaaguuacuauguuuuacccaucuaaaaugagugucauauuuuuauuggaaguuaauuaugccuaaauugcaaagacaaauuauguugucauuuugauuuguuuuguuuuguuuuguuuuguuuugcuuuuuuaguuaacacaaggcaccaggaagcaggguguuagaguacugacugguucuuuaggugacuaacgcaauccuuagauggcauuuggagcacauggaacauguuuacuaugcauauaaagcaaagcaucaguagucucgucuuagaacaugcuucucucugcauguaugguguaguguguagucuguuucuuugaggguucucucaggauggcccuuuucauucuucccagagaauuuauuugggggaggggggugguguugcuugguugguugaaauuuguuuuuuaaggcagaguuucucacuguaacccuggcuguccuggaauuuccucuguagaucgggcuggccucaaacucagagagccaucugccucuacccccuaagcacugugauugaaggugugugcuacccugcuuggcuuccucguguauuuucuauggcuggaaacugaagccuuaggaagugucagagaaacaauaguauuuugagauugcaguauugacacagcugccucugcagguaccuuguggucuacaaucccuuugaacaagaacggcauucagugguguccauccggguaaacuccgccacagugaaagugcugucugauucgggaaaaccgguggagguucaagucagugcaguuuggaacgacaugaggacaauuucacaagcagccuaugagguacgugauggccacaggcuucuguaacacacuguacaauggaugggagaacaaagaaagcaggauccauaacuuuuaccugcaaauaacccacaacacagccauugaacuaucacgggagugaagucuaauaccagaggauguaacuggguggcuaagugauacgaggaaaaauaguaauauuuuuaaaagguaauauuuuacuagugggguauguguauccuuuuagguaugcauauuuuaacuggauucuaaaauaauaaacuaauaaauuuuagaauuuucauguuuaacucaaugauaauuacacacauagaacugagauaaauggcacuguucuuaauaauaauguuaguuaguugacauuuuuuaauaaugauagugacuuaauacauccuaggagagagacuuuaacuaagaucauuaaaauagcuuucuuuggagauuuaauuaucgaacacuggacugaaucaauagagaaucucucccucucucucucucccucuccguuucucucucuuucucuguguugugucucuguuuuucuguguauggucucuuuguguaugugcaugugugugcgcauguguguguguguguguguguguguguguguguguguguuagauaagcaguuuuuaaacaaaccccauaucacuagagauguuaagcauuuggaguccugagguuauuuaaagaguuauugaaacacaguaauaaacuagcaacuuaagagggauuuaugucugcuguuuaaaaauuacugcugaugcaucucagauaaucauuguccugcaaauauaaaugggaaguaaaguccaaacucaggucagauuuuacaggcagcagccuaucucgaaagugaagcagcucuuggaagacaggagccagaucacacugugccuccuucaggccuugcucagugucugcuaacuccaagauagcacugauggcugguacugacuaaacucauuugugucuuagcuauacggcuguguuuauccuuuuaacauacugaaguauaauuuuacaaaaggauuucugaaaauuaggaagaaaaccaugauuuaccuuaagcccuacccugccugggauguuucucccucccaauaucuguugagagcacuguaggacauuugcaggauggucauagaguuucguaggaagaaugcaaacaugaacgccuuugaagccuuccaaccuggggugauuagauuccuggcuggacugaggugugaacaaccucacuauguuacugaagcauuuguagaguaacaguuuguccccuuucuaagaaccugguugauguucuuaccacaaauauaaauguuuuaccuucgguagauaacuuuucuauauaaucccuuuuucugucuugaaagguuucuuuucuagcucauauaccaccacugggacugaaaguguuuaagaucuuagagucacaaaguucaagcucacacuuggcugauuauguccuauauaauaaugauggacuagcagaaaauggaauauuccacgugaagaacaugguggaugcuggagaugccauaacaauagagaaucccuuccuggcgauuugguuugaccgaucugggcugauggagguauguucugauucguugugacagccauaaaucucacugcguuuacucuguguccaugacagugcagagggggaaggcccucuuagguagggaggcagcagagcucugggagacagggcugaucugcuccugccuacuucuguggucaccugcugucgcagcauggcgcccagcuaagugugguggaugaaaguguuuaccgaagcuguggaagcaguucagcagaauaaaagaccugucggcuaucaugcaaagugaggugguuuuuuuacauuuuaauuccgauuuuuaguucacuuuuacuguguuuuaaaaacaaauugacccaugccuauuggcaauuacacuaugucuccuucugcagaagauuugagcagaggucuaaguucuuuauuccuugcuaaaguauagggcagugcuuuguuccaacuucaaggcuuuaaaaucugaggucaacuaugaaauguugaugcuaaccaaauauuucucaccugacgggcuuacuucagcauuuuuagucucacuccgcauuuucuuuucugagauaggaugagacuauguagcccaggcuugccuugaacucauuauuaagccuaggcuacccuuaaacuuagcccuuccacuguagccuuucaauuuacaugagcauuuaaacuuuuuuaugugaaugcauguuuucuuuucaugcauauaugcaccuggaugccuggugucuuuggcagagaaaaaggccucugguucccaagaacugggguugucagugguagugagcugccaaaugggcacuuggagcacccagguccucugcaagagcagcaacugggauuaacuccagggccaucucuuuagcccuccucgagcauuuuuaaccaacccagguagauuuuauuguccuuuuacuguuuucuucuguuuucuuuuucuuuuucuuuuucuuuuuuuuuuuuuuuuuuuuuuugucuauucacagucccguguucaguuuugucuuacugccucucuacauaucuuggcuuucauucucaacuccaucuggcggcacuuugguaauaaguugcuguuuguuuaucuuauucugugauccucagaaagugagaaggaaagaagacaguagacagcaugaacugaagguccaguuccugugguacggaaccaccaacaaaagggacaagagcggugccuaccucuuccugccugacgggcagggccaggugagugcugccacagagacccauacuaugcauguguacuggaacugccagagacacaggugcuguggcaugcacaguggugagacugucucccuaguuuauccuuggacagagaucagcucuggacuguuuaauuguauuuauccauauuaaagguuggcaguuuguacuggaaaguuagaugugucagagcauaggaagaugcaaaggauguguguuuuccaugaagaaagugagucuucucaacguggcucacggggauguacagcacuguauguagcgacccgacauauuuagccuuguugggaaaccuguccacuggauugccucucucuauucuuuagggauuuaauaaacaguuguuccuauucuugacuaucaaagcaauacacacagucuggcacauuuugaaaauguagcgaaugugaggaaacagauuuacaguagucuacaguccgugaacaccucugcccacauccggacacaauuuucucuucuuugagcaucuccacauuugagcauacccccauuuugaguuuugucuuacuaccuuugcaagugcuggcuugggagauaucacuacuuaggauaauucuauuuccaauaaauaacuauauggacaauagaagaauauagauuagaaauguuugugaggagaauauuuguaaacuaucuaaggccaaucaaauuguaagcauucgcaaauacaggcucuauaauuuuauguaagaaaaaaaucuugccuuauauccauuguuuauauccuguguauucugauaaguuauuacauuuucaugucagguuaugaauauugaacuguaugaauuugucauuuuguacaauauuccuaaauucuucuugggaaaguugagaaaccaauuuguuuuugcugaaacuguccuuuccucuucagccauauguuucccuaagaccgcccuuugucagagugacacguggaaggaucuacucagaugugaccuguuuccucgaacacguuacucacaaaguccgccuguacaacauucaggguaagagaacagcguagccaucagacacacaggcuugcuggugaagucacacuuuucuucugucuuucuuccugaacuaugaguuguuuagagagaguguaaucuuuugaaauugacucuguaccugcagccugacuuccgaugucguguuugccuuuagauggugggaauggugaagccuucucaucugcuaaguugacauucaucuuucugcaucuccuccuuccucauuagcagcugacuuagucaugagauuaucagccagaagccuuauguugaagaccuggaagcaaucuaguauuuagguguagguuuauaaaauagaauguuagcauaguuacuaagaaacccgugacugugguagcuucaaccaucucagaaaagucuuuauagauuccccacuugcauguccugauguuccuaggcugaaacaaaccggggaggagaacauugcacccuugucuuuucaugcggguaggaauacagacguucuccagcugaccccgacugcugacgagcguggauuguuuuuaggucauaggggaaaggcaugcucacagaauuucuuaucuacccauuguucaauuucucaauuucacagucuaaacuuaaucuugcuuuuauugaaugauguugacucauguuuugcuaguuuugccuuuuuucucuguuacgagucauggucaguuuuuuucuccccagagcucuugggaguaaucaagccacuuccuaaucaauccauggaaguccccuagagauggaaaacuaacacuaggcaugauuuugggcucaacugugacuucaaugugacagaaugaccucucaccacaggaaagccuauaauuaugaaauaguuucccuccccccccccguacccccccccccgugccccacccccacacacacauuuugaguuucccaaaaccuccauaaguaagaaccaugggguggggguggggucacuuuggucauuuuuaguaauucacuccuggaagcuuugacaucacauuuucaacuacugccagcuacuuccuauuauaggugagaaauaauaucaugcauaaaaguguuuguguggcuuuugcuuuauaacuuauacacuuagauacuuagacacuuauaacuauaacccaaguuacuugagagacugagucagggggauugcaacuuuaaaccaaggccuggucucaaagaaagaaaaguaaccuaggggugggcugaguaguagaauggugacuagcacgugucagauccuagguucaguccucaggcuugccuucucugagaaaauacagauuauuagcaugucaacuguauaaaggaaagguuucaugaugaaauccccauccucguauaauguaccuuaaucagauucauccccucuaggucuccguguccccucuuuuccuuccacaagaccuaugugccauucccccuuacuuguauuaguagacaaggcauuucaaaauaguuacuggaacguugccucugaaaagucuaaccucauugaaacacauuuccuuaguugcuuuggucuuauuuagcccuucacaucuacaccacagaucuccugagcuccccuggguucuccagggccugugaaguccuguuccaggauggccugaguaacuacuucucugaguaaccugaguagauacuucucuccugcugcugguggcuguggcuuugccugcugucauagaccagcagcugauuuggaaaguaauccgcucugacgugccugcuuccuucugccaagaaacugugcugucacaacuaagugguugccauuuuucccguaccuuuccuguauccuucuccuggcugccgcucuguccagccugacuagcagcuuggcaggaggagcuggggggccucugagguucaacuggcagcugcuggcucucuguccauuuccauuugcuggcucaaguucucucuguucucagcuguauucuguccuuuuauuucuuaguauuuccuuccuggauugugcucucucuccuccuuguuuugguucaggcguacagcuuuuggcaaugccgccaaagggcagguuccucucauuaacagacugacagccuugcacgucagcagccgcuggggucugguucuugaccuaggcgcaccuuuucuuagcauucauaaucuauucacugcaguugcuacauaaguguuuccaaaucuaggaguauaauuucuuaccaguguuugaaaucucuggaagucuggccucuagggaauggagguacucuuaaacuuuaguuaguuuucugaauagggcacaaacaauauugacauaguuuuuugcuguuuuuuuuuuuuuuuuuuuuuuuuuuuuuaaugcaaacucuguauugcgucuggacuucucaguggguagaauaaacuugggaagacacauuuuugugccaguauuaaauuguagaagcucaagaugacaggugggguaacgugaaguuagcugggagugcucuucuggaugaacuuucuccugguugucuggguuaaccccaaaaucagcguggagaccugaagagacagauaagcuuugugcucuuucuagcccugagcauugccgcuuguuuguuuuauccuaacauggaaggggcugcguaggagcugagacaccugaaucaucagaaaggcuuuuuucuaaaccauaucaccucccacaucucagguugaccuccuuccaauaagcaugccucucagaagagaccuagccuuucuuuuccccuuggucucugugacccgcucccgucugacuugcucuuccauugucuucaaggacucuuucuucauguggauuuuugauccacugagggucucaugaagucacucaaagcuugagguaggaguguggagucuucaaauggaugauauuugggguuuaaaauaugaugaaguuucuagauuuuuagaaacauccaagaguucuugacuaugccacaggcuggcuuaccgaauaaacagggauuuagauggcuacaugcucaguuucugauggagcaugagaccuacaggcaguguguauguuucugugcauugacacuuauagcuaauauuucuuaaaauaacaaaauacugggggacuuuugggauagcauuggaaauguaauugaggaaaauauguaauaaaaaauauauuaaaaaaaauaaauaacaaaauacaccucaaauuuaaacuucugagcuguuucuauguccaggcuaauucccugcccucuccagcguguccaguguuuacuggaugaguguuaaugaaugaagccuguuugcuauugguaucaaguuucuuuuucauuuagauuuguaucgacauuuuauuuuuuaauauuuauuuuaaguuuucugugcacacauauacacauggguacugguguuugcagaggccagaagaaggcguuggcucccugggaccuggugucacaggauaggaacaacacucggguccuugcaagagcaguacauucucuucaccauugaacaguaccccuagccccuuuauuaagauuuuaaguuagcauacaaaguaauggcuuuccuuaugacauuucauacaagaaccaaauuuaugagacaggaaguaaugggauuauuaauauuguuuccuuauuuacaugucacuauauuauguugcuaucuguuaguuuuacaacauuuuuauuauuguuuugcaacauugacaaguaaaaagugaguuaauauuacagguugucucuuaauugauagucuguguucaauauucaguuuaaugaacuagucuuucucacuaugcagagcugaccaaguauccucaguccuuggugugucucccaccugcauuuugccuaauguaacuucugucaagaauguaaaucaggcacuucccagauuucacaggccaauuggucauuacugauugauugugagaccagcugggugucgaauguugguccagccaccugcuguacugaauucugguuucucuguuuacaccugccacagaguugcaaacuaguucaguugaaggcucacuguuucucaaagucacuuagcuauucacaaacaccauguuuaagggcuugagaaauggcucaccaaauaagaguaguggcuguucuugcaaaggacccaaguucaaugaccaacacucacgugguggcuccuaagcauuccuaacuccaguuggaaggaaucucuugucacccccucaggcacugcaugccuguggcagacagacagacagacagccccccccacccaccccccacacaaacuaaaaaucuaaauuuuaagaaaagcaaauguuugucuuuuuguugucucucacacgucacauucagaaggguucuggaagaaaucucaaaggaaaucauuugcucacgaacuuaaaaaaaaaucaagaucauaguugcuucagcaaugucuggagaaauucuuugauuuuuuuuuuuuuuuuuuuuuuuuggucagguugacuaagaaauccauuuauaacccacgcaauuuaaucugauacccugggaaccauuuggaaucaucuucuaaaagauuaguuuguacgaaaaugacauuuucucugcugauaaaccauggacaagggaauaggaauuaauuuuucuuuucauuagguugguguuugaagcauccucguguucuccaucuguaggaaauaacaugagaugagcaugugucgugcuuuagacugaguaucuacagaaggagcgccguacgcucagccagccgcaccgccagcuaaagggccacuucuucuucaugcuuguauuuauuagacuuuuuuaaugcccaacucucugacaucaaccacacuuugaaaaauuagguugccauggguuaccagcacaucauguauguuuucacgggcaaaagguuuaggucccaaauccauuaaauguccuccauccagcuccccgcugccuggaggcuuuuuuuuuugggggggggggggacaggugcuugugaaugagugagaaugugugugggagccauguuucagccuuaggagaaauaucuaacgugcaguauuuguauuaucuuucaacaacauauuauaacaguacuuacuaaaagaaagcaaacggccuggggcaaacauguaaugaacugcugaccaaacacaggaggaaagacuccuaagacccugaagacugaggaguaucccuggauggcuguagccagcaagcagaguucucggguucucucugugcagcucugaggauguuauauaaagcccagggggcucaucaugacgcuugccuuuuagaggcucagauguccuuccccuggcaaaacgugggaggugguccccugguaaaacgaagaugagggagccuagucuuaguguaaauccuuucuguggccucucugaaagcuacauaaccuuuuggauuuauccuuuaaguuccugguaacucuguuucuuaaucaguagaaagagcagagggccaacuauaaauaaccaucagagucuucauaaaacuuagaaguauaugagaucucugugcuugucugcuuauucuaaaguugucugcuaaggaugccugagucggggaccuccagcccugggguccaccccuuuguaaccaagaucgcagagcuucaccgaagaaguuguuuuauuauauuucuauaaaaagauucaugagaauguugaaauggccuacaaucaaucuccuguuuucccccagagcuauauucuauauuuaguauaagaguaagaaucauuaaguuacagcuaagcggaccuagguaauuaaaacauuuuuggaauauaauguguaauugccugcuaaggacuuuuucuuuuuaauuggaacuuuuaaaaauugaaauaagucacuauguguggaacuugaucauucccuucaggcaugcaagagaaguuauuuuaagggcccauaaguacauucugguuacgccaauucagacucaggcuguaggcuugguuguagcugcugcaucagacacugcucccuaacagagaaaggacaaugacaucccuggugagugugugcuuugcugaacucugauacuuggucccaggaucggaagcacauagaagugugcaugagcaauccuagcucugacuuugcaauggggacaguugcacauuccacaucaggggcuuuaguggggauaauuaagcuacaggacaggaagccaggugacuuguuaagugccuuauuuguuuaagagacggaguaggccagauaaauuauguaauuuucauuuagaauauaaaaauggccaaagaacggucacuggagcuaagagaggaggaagguuugauguagggagguuuagggugcuaggucuuggcaaacaucgaaauggguagaaagaaaggaaaagaaaagggacguugguuagaucaaaccuuguuuccuagauaaagggcugugugucuccuauguguuuucuaaauugacauguauuuuuauuuguauguuuaaauaauggcaaaguacgucacugugguuaacagugacaaggaaggcaauucauugcacagucaugaauuuuuaagcgguuguacaaacuguucccuggcaguccucacuuccuuaucuucauuuucuuccucuugucguauuuauauucuguguccccagaagauauguccuaauacugcauuuugguguucaagagucuuauuugcugggugacuuuucgugacgucucugagacuguaauccuaucuguugagcauaucugugugcacauauguuuaaacuuuaagaacucauucucuggcucuaaguguuaaugucuuucugcauugaguuauuaagacaauguaaauaauauauuacugucuugagaauuuguuuuagaaaauuuaacggaaauguuucucucagugaacuauacccuuuuguuuucauaaguaccaaaugcaaagguacauuacucauauggguuagaagcugguaauggaaaaaagauuauagggcuaucauuuaauauaggcuccuucugaguuaggcacuguaugucacaaaaugaccaucaagcuuuuuuuuuuuuuuuuuuuugguuaauuauuuuaacgaucacauuacccgauugggcaucccuucaauuuuguuaaaggcaaacaguugaaaacuauauuugacagaaguauuugauggucguuuacaaaucgaaucagacaccgauaucucaaauuauauuugcuuagcaccuguguaagugggaaugggugagaagugugcuuccaucccacacuaccuacucuccuucuccccuccucccuucucccuccucccucccccucucuucuuugugccuccuucuaauuguguugggagaagaacuauacagagugguagaaagguuuauagaugguuuauagaugugugguuccauggcaggauuguuuuggacagaugaacauagaaugauuuaugaacucccugcuucuuuggagggagcaugucugagaacugaacggaaguggguugagaguaagccucaggacccagugggcucagcucucugcucuucugucuuuagccaggacaagucuugggcauggggaaagugccaaggagacuaggagacaagcuccuguauugucuucccaggccagggcucugucucuugccugucuugugcugcugcugauuugaagacugcagcuguuugauguguuauguuccuucccaaaccuguugauucaugaacucguuguuuucuuuuggaaaagcagcuucuggggggugaggggugggggugguccucuuuuaaaccuucuucaaauucaucauucuuuauugcucccaucuuaaccaacauuuugcacuuuacccccuuacgaaguacgugcuucugcacuucuguugcccugguggccugguuuuucccugggccauuccuccuaggcucucaugccugcaguuacugggaugcaucugggucaggguuugugccugggaaagaacugcagaccgccugaaccccacauccuauccucuccuccuguccaaccugcuggcccuuccuuccuuccugauagccucuuccugcuccccauuaacaugugcucugguacccccucucuguguguucugcuccccuguaaagucuuuucuucuuuauuucauagucccuucuagaaucuuaaccugucacucuucuagaaaccacauaaagagaaaaugugacauuucucuuucuggcuuauuucauuuaccacaaugacuacagguucacccauuuucauguaaauucuaugaauuuuuuccucuuucuuaauuuuugaaauaaauuaauaaaauuccauugucaaucgaucacauuuucuuucuccauucauccacugaugagugucuagccugguuccauuucuuauccauuguaccuagugcaacacuauguauagacacacgucucucucucauagcaaguuugguuguuuuguagauagauagauagauagauagauagauagauagauagauaguuuuggugauuuaaguucaaaauauucugaaauuuuuucagggaacuauuuuaaguccaaagacuuaucuucccaacagcugcuguagccaugcuucuucuguauguaauugcucaguccuuuucagugcagacagagaugaagaggaaguggggauagagacagucacaguagaaggccacaguguuuccugagccuuggggagguggggugauguagauguccugucagugggugagcacucaaucacuuaugauccagucagcacuuugaagaguuauaugucucugcaucaacccugacccacugcaauaaaaagcugcucugauuaccgcugagagcagcacagaucuguggacauuuaacacaaauguuuagaagucaguuucaccaaaaucuugcuggcauaugcaauagugucuggguuugguggcugauuaugagauuuugcugaagggacccugguauagcugucucauaugaggcucugccagugccugggaaacacagaaguggaugcucacagucagcuauuggaugaaacacagggcccaauggagaagcuagagaaaguacucaaggagcugaaggggucugcaauccuauagguggaacaacaauaugaacuaacaaguacccccagagcucgugucucuagcugcauauguagcagaagauggccuagucagccaucacugggaagagaggcaggccccuuggucuugcaaacuuuauaugcccccguacaggggaaugccagggccaagaagcaggaguugguggguuggagagcagggcagggggaagguauagggaacuuuugggauagcauuuaaaauuugaaauguauauaaagaaaauaucuaaugaaaaaaaguugccugccuccagccaccagauaaauaaaggauaauuaaaaaaaaaaaaaaaaaaagaagucaguuucacaugacaauauagcacaacaauagccuagaucuagggcccauggccucccuuacuaugaucuuugacuauguuuauagccucaggugugcauguccuucuguggcaaucucaaaucuaaucaaaagagugguuaguguucugauuuuccaucaaugucaacaugcacagcuaggucauuggagagaagucucaaucgaagaauuaccuaguuaagacugguaugcgagcaugccugaauuagugauauugaagcccacuguggguggcaccauuccucaggcagguuguccuugcuugugaguguaugcauguaugugugugcaugucccucagugguggguuguaccugcagguauaauauaaaauaaacucuuugcuggaagucacauuuggucagaguauuuuaccacagcaacagaaaaguagucagagcagcaccaugaauagucuugccacuaauguaccaguggguacaucuugccugcuugucaguauuguaacaugugagggccaccacuagcuaagaugauugaugucuucucucucagacacccguauagcaccuuccaguacuaugcaagcgaggccuagcagggagaguuuccuggucaguuuaagaucgauuucucuguguccugcagugaaagucuguaguguccaggaaucuauggugggcaaccaagagcaauggcagcaucucccuuaauaaacuaucccucagucccccaauucugguuuccugguuucuacauguacuucagguuaaauacacagaugcacaccuaaacaaacaauagauuugaagcuguggaccacauaggagaggacaugugacuuuuuuucuaguugggugcaagccagaugcccucauccuuucuugaccuaaucaaaaggugggggccacuuauaggauucuggauucuuucugggaaguguucagggcucucuugcuuuuuuuuuuuuuuuuuuuuuuuuuuugguuuuucgagacaggguuucucuguauagcccugucuauccuggaacucacacuguagaccaggcuguccucaaagucagaaauccaccugccucugccucccaagugcugggauuaaaggcgugcuuuccucucauuagauuuccucugauuggauguggcaaagugcuaugugauuuugcagagucugucccauggggaaaauacgcugugucuuccagagcuguucaacugagaugacagggaagggccaacaccaaucuguucagcaccaagggaggcugcugcaaguagcuuuggcaggauaaggccaggggcauagggaguggacagaagguaaugcaagcaagcagaggcgguggguggaaacaucaucuuugcugaucagaacugcccccaccacacacacacacacugucaugccaagagucuuuauaccucuguguucccugugccuugccuuccacaccuagggcauacuaaggauggcuuccagcuuugcucucucaagagauauguaucuuaggucaauaagcuaauucuaagcaaauauuaaacagcugaggcuuccucucucuugcccccauucuccugaccuguucugcagggaaggcccugcagauaccagcguauuggucugcacaucggaagcugcuguuccaaaauuagaaugugagaggaccuccugcuggugacccauuguuuucuugacauguaggaaaauugucuuucuuuccaacugcuuuaaaguauuuuuauaaacacaaauaaugcauacauacccccuugccacaguuuuaaugcuuuauacacguaaugucugaacauuugaagauauguagguguguucuugugugcacauaggcaacuccaugccucuggaaaacuguagcaugguguuuagggcacuacacaaaagugcacucucuccagaagccugucugccuggauacacagccaccccauucuuguucuuugcagcacugucccccauaucagagcgguuuucuagucaucucccucuugacagccaucuggcauguucuccuguuguuuacucuuagaaguggcagucaaagggugugcaggggugugcuuccggugugugcuuccggugugugcuacccugugcuccucucagccccgagguggcgaggaucacuucugggccucuuggcuaagaugguguguaguucagucaggaggaacugcacuggagcagucauuuuaaaauaaaccucauuaugaaaagcuugcaagugaaaaccacuggaauuaaccagacccaaagaccgcacaucucacugaaccuaugcgguuagaauagccaggcuuugaaauacauauuauuuucuugacaucuaaagaaaguggccuuuuaaaaauagggcuuggagguuguugaugggauguauucccaggugagucagucucuugauggucaugccuucagucucugcuccacacuuugucucuguaacucuuuccguggguguuuuguuccuccugcuaagaaggaucgaaguauccacacuuuguucuuccuucuucuugagcuucauguggucugugaauuguaucuuggguauuccgagcuucugggcuaauauccucauaucagugagugcauaucauguguguucuuuugugauuggguuaccucacucaggaugauauccuccagauccauccauuugucuaagaauuucauaaauucauucuuuuuaauagcugaguaguacuucauuguguaaauguaucacauuuucuguacccacuccucuguugaggggcaucugggaucuuuccagcuucuggcuauuauaaauaaggcugcuaugaacauaguggagcauguauccuuauuacauguuggggcaucuucuggguauaugcccaggagugguauugcuggaucuuccgguaguacuauguccauuuuucugaggaaccaccaaacugauuuccagaaugguuguacccccagacacuauugugaaugccaacaagagcuugcugacagaagccugauaaagcugucuccuggagaggcucugccagugccugacaaauacagaaguagaugcucacagccauccauugaacagagcacaggguucccaaugaaggaacuagagaaaguacccugaaaagaguacccugaaaagagaaaggagcuuaaagggguuugcagccccauaugaggaacaacaauaugaacuaaccaguaccaccagggcucccugggacuaaaccaccaaucaaagaaaacacaugaugggacucauggcucuagcugcauauguaacagaggacgaacuagucggucaucaaugggaggagaggccguugguccugugaagguucuaugcccccaguauaagcaaugccuggaccaggaagugggagugacugagaggauuagcugugaugccaccagccucaggacugucagcaagugacggggcaggguuacacagugaucugggaagaguguggccucagaaaguaucaaugccagcuggcucccccaugcccucuucgccugugccugucagcagacaugcuagcacacuacacuacagagcccauguucucacgugugugcuugcccgggaugaaaauugcugucccuuuguuuuuccagagucuuuuacuuuaccacacgccaaucugguuuccucccaugccacauuauuucuauuugaugagggauguguuuuucuuucuugguuauuuccguugaguggugauucagcccuuagugugcucagagauucgaaguggaauguaaggaugguguguaagauaguuugucugugagaagccuggaaacucucagaagacacacugccuccguccagggcugaggcccaagacugccuuagaccuggacaacagcucagagagagacuugcuagccucuguugcuuuguaaccugccucuagucuagucuuguuuuauguugcuaaggacaggcauccuccacucucucugcagcagaagugcaggucuuagcacugacuucucauggcugcaucccaguugugacuuugcucuucccucuuuaaaggacuaaccuuguacaaccgaaaccauuuuuucuuucucaagauuacagaaaacccacaagaaccuagaaagccaugguagcacaagccagagaaaccaacuuugguaaauuagcuaucucucugucacuaacuguagagcucagaccaaugguccugacuggccucuggggugcuuuccacucaacccucaggccuccuuggacucacucagggaauucuugacccagcagagguugguagccuuccguccuagccacacuuaugcuuuaccuagucgcuugaaggacucuggcauacugacuggcuuuuauugcaggcacuguuuuuuauuuguuuuuguuuuuguuuuauuuacagaauaggcauuuuaaguuugaacuuaguuuacaagacuaucuugguucugaauuuaaaucaaugccuugcagauuugugaaugaacauagggcuucuuuuuaaggggcuugaaguauuuguugccacaacaggaugugagcacaguacugggcuugagaaagauggcuuucucaauggaauaauuuaucauugccagagguaacaugaaauuauuaauuuuuuuccuuaaagcauguucuuuguaaauguuuucuggagagacaugaauugaaauaaaugauauucucucuuguuaagacuuuauuuuauuucauguauucucuugaccccugagagaaaaucuaaucuagagaaggaaagauaaaacaccaccagaaauccugcaggcacugccagugagcuggagucagcuuccggucaccaucugugcuccuuggagcuacacagcccuuucauuuuugugggggaucuaauuuugagauuuuggguuuguaugcuggagacugaacuuggggccacacuuaugcuaaguacaugcuacacugcaagccuuguguuguguauuuguguaucuuaaguucauuaaacuuccacaugcauuucauuuuagcuuaaaaacauuccaauuucuauaaacauaacaaaaauaauguuugccuccagagucauauauaucauagcucaaagaagauuguauaguauuauguaacacacacacacacacacacauacacacacacacacacauacacacauacacacacacacacacacacauucaccuaagaugucaauaguaguggagguauucuuucuuuuaaacuugcugguucauaguucugauuuauggcuauuaaaaaaugugcuccucauuuucuccccauuccuggcaguuguaccacaugaguugaaaacaugagagacugggguuggaaccaggugggagacuugaauugaagagccaugcgccagagcguuucugugcauuucugcagacucuguugguagaggcuucagcccaguuccuaucuccagcaccauauuauuauuuaauucucuguguugccuguuuucaugucaacuucacacaagccagagucacuugggaagaggaaacuuuagaugagaaaaugcccccaccagauuggcuguggguaagccuaugaagcguuuucuugacugacaggagagaacccagaucccugugagcagugcugccccugggcuguuguccuggaagcucuaagaaaguaggcugagcaagccuugaggagcaagccaggaagcagcccuccuuggcuccugcgucagcucuuccuuccagguuuugcuucaaauucuugucccgacuccccuucauggugaccuauauagggacauauaagcugacauaacucuuucuuccucaaguaacuuuggucaugguacaccuguagugccugaacuagcaguauaugcauccuuuuccaaacccccccaugaccccuucucugacucauugccacuauauaggagugaaugaguucuuuuggcuccuauggaaaagagucgucuuuucucuguucuucuuccuccuucucuuaauguauuuuaucuuguugaagaggcaguauggugggagucacuauacacacacauacagauacacacauacauacaaacacacacgaauauuauacacauacaaacacacauacauacauacacacacacacacacacacacacacacacacacacacacgucuccaggguaauuggaacaucacaaggaucagcuuuggcaagggacuaggacuaggucuccucuugucuucuuucccugcaucuauggagaagaugcaguaauagcuccccuccgcauaacccaucucuacuaaauguguugaauuucugcacaacaccucuccucaucucugaaauugacccaaggcuuuucugaggacccaacaguacaguuaagguagagugccaaguggguacuaauaaacgacuuuaguuuucuucaaaagaauuauaaaaaucuaaguuugauacaucuucaagcugucuucugcucuauguuguaaaaggcagacuggaucgugccauaacaggauacccaaggggacaaggaaacauugacuuaauuucuaagguuccccucaaguuccaaugccuaaauaccaguauguuaacaaagccccuagcuauaaauuaccuuaugggauccuguuucuggauaaaacauugaaagggugguagcacacuguguugugugagcagaguguaaacuccguaguuccugguucuagagaaucaaagagggcaauguuauggugucuuuccuggggagaaugguucaggugagcggcuugccugcggggccucgucugucgucacuugcugucuuccuccccucagaacccauuaagaacuauguggcauguuguucucuugcuuucucucagccuuuuauugaauuucauauagucuucaguaaauacugucuccagacugauagcaagaagaaaauguuaaauuguugcaccauuucauaugugagagaugguuaagagucagacaacaaggaaauauaugggaagaggauuuacaguauguuuaauaaauguggagaaaauaauugcuuuuguuaauguauauuuucuuuuuaaauuuaggaauagaaggucaguccauggaaguuucuaauauuguaaacaucaggaaugugcauaaccgugagauuguaaugagaauuucaucuaaaauaaacaaccaaaauagauauuauacugaccuaaauggauaucagguaauuuucucuaaaaucacugugaugaauguauuuauaugucauuuaugugguauuugugguggauauauauguucauguauggaauguguaauuuuaugcaggauaauugcccaguuaauuuugagucauuuauaagauauucuuaaaguuuccaacuauuucuagaaucaagacagucuuaccaguuguagguucugcugucagaugccugaagguagaagaaaucauuaagagagaugauguuuuagaauaucuacuuauaaaacuuaaaaaaaaauuuaaagcuaaggggcuggagagagugucaaggggggggggggggggcuuguucacuuccuaacacccaugucagcuggcucauaaccaguuguaauucccagccuagggaauuuggccugucuggauaccuagauucaccuagaugcacaugauaaauauaaaaucucucucucucucucucucucucucucugacacguacacauauuuuaaaaaaaucuuuaaaauugagaauuugaugagcaucaauauauugaacacuuuucuaagaguauacauaaaaggaaacguaauuagggauuggcaguuauccuucuuucuucaugaagaacucacguguacaggucauggauucuucugauauaacaacggcaccucuaaguucuauggcaguccuuugcaucuguuaacaucgagucaaugugcucuuuuaugcacccaaguacacagagaggugccugccaccuuaggagugugggcugcuacacauuuagucaaaaugaucauacaguaauuauacauauaguaagaaaauucauucuuauauuuuacuuguguauuacagauucucuuaauugugcuuaagagaacuuuuaggaugcuucuuuaguuucuauuauuuggaguguauaugugugacaacaugccuuuugaaucaaccacucaaaacaugggcauauuuuuguagcauuuacauuucaaaaguuccuggcuaugaacagaaauaauuucacaacauaugcuuuuuacuuggucugauuucucaacuggcuauaaguggaaagggcuggauaauuuucucuucuaugauuuccugcaaaaaguuaaauuugcacuuucuucagagaacaaaaauugcaguguacauucugauuagcacacuaauucugcugcgacccuuugguuuucagugacuuuauggugauucauuuuucuucuguucaaaaagaaaacuuuuucuuaaaaucucacagaaacaaauauuuguauauguugguuuacaugugaaaaagaaagcuuaguaaaaacugaauuaauaaaaauguacguuuuguugccauugauaagacgagauacugauuucugguccacaguguaaauauuucucauaauaagcccuguuuuaacccauggaaauuguaguuaagggcaugucaauuucugaaaucaguugucucaaaaucagaucaguuuuacagguuuaguuaaauaugaauuugaagagacucagccuaaccagugguagggaccagugagggcuugcggcggaugcugaaggccggcucugggaaacgcucuggcaggaccacccuuccauugcuagauacucggcucucaugagauguggcacuaacuuccugcauuuacuguuucugagauucguuuuagacuuucacauguuuagacaaggagguggcauuuugaagcaguagggaguaaaacccagugacaacugaguaugugauggcuuucaguacugacaagccucacagaagguaaaaaucugugucacgcuuucaaacccgaggcugcaauccuggacuucagaacuaucccaauuuaaaauaaacaagaguaaacagugaaaaguuuuaccuaugaguauguacuugauuauaauguaauauguuagaggauuugguggcaagcucugugguguuuauuaaaacugauucaagaauaauagauauuucuugaaugggaauggagagcuauugugcuuagcauuuauuacaaaggcaguaaguuagaucuagaugaaaaaugaauacuuaauaccuucauaauuuguuuuaugcaaaucugagaagccagaagaccucugcugggcauuuuuuuuuuuauugugacuucagauagaaaugccuauuuuaaaauccagacaaggucuaccuuucacaguuaaaaauugucuucugagggccuugugguuucucugcauaugauuuuaaggaguauuuugauuuuuuuauauauaucuuugcuuaaacaagaacagcaacgaugcccuuccucuuugggaaagagauagcuuaauaauguaaucuauaaaagcauauguguaaauaagacuuguacaaauuaaggacugcuugguuuccuagauucagccuagaaggaccaugagcaaauugccucuucaagccaacguuuacccgaugugcacaauggcguauauccaggaugcugagcaccggcucacgcugcucucugcucagucucuaggugcuuccagcauggcuucugguauguauuguuaauauuccacgccgaaagcucgcaguucgaacuacauagcauuucuguggucaaagauauuaauuauccuccucauuaguugcuauaccuuaagaaugagacaaguaguuaacacaggccuuuaugagagcuacauaagaugaguauccucagguaauaagcaggaggcugagacgccucgccuggcugguucuguaguuuucauuagcuucucauuguaacaaaagaaauaccuuugggcaagaaauauauuucaguucacaaucucagaggcuucagguuguaaucacucagcucucuugauuuuaagcuguagugaguugacaucaugguaguuaggaagaagaauaaaagagacaggaaaagggagggcaggagagagagagggugcaccuuuccagcuuucaggcagugaccccauucaucuaagcccugccuguuacagcccaguuagcugugagcucccugugaguuacaauugauggaguuagcuuugaucuccucccuucugaguggcccugauaacuaaggaccaagccuccaacagauuggcuuuggaaauaguuccuguacaaauugcagcugaguuuacuuuugccagccuguugagagcucugugauuuacuggauuggaaaccuaaaacuccggaaguuuaggcaguuugaucacguuugcaaaaaggaugcuguaguucaaacuuagcaguguuggauuuguuuguuguuguuuuguuuuuguuuuucuggauugugguacuaugaccuuuccccucaauggcuuccuguguugaagaccuguuccacaguaaugccacuggagagugauugcugagcaguaaugaaggaaagcagaaaugauaagguguuuuauauauuguuaguagcugcuuugacuuauccagagauagcccguugucucauaagguaucuggauccccuccugaucucaaagggaacuuaacucaaagcaaggcagcuggcuuucuguugaaguggccuccagugaauaccugcagaaaauuauccuggucagauuucuucauuucuuuguuuuaggucagauugaagucuucauggaucgaaggcucaugcaggaugauaaccguggccuugggcaaggcguccaugacaauaagauuacagcuaauuuguuucgaauccuccucgagaagagaagcgcugugaacaugguaggaaacacuaucuagccuuucuuauguugguggcucuuccuccccaaaauguaaggugauaacaaaauuuuaaaugcaauuucuaauguugggaugccuguaugguuuagauuuaguucauaauuauagaaauguuugaguuaaaaauauuaaauaaggucuacauuugggccauauagguuuuuuuuucuuucccuuuacuauguagccaaaaacaauuucaaggaagcuguuugggugaaauuauguucaaagaaaugcugacuuauuuauugagcuaagaauuacaggacagacguuuuaacucuacagucaguguguucuaagccuuagugacuguaucauaauuuauuauucgcaaacagacugacuuuaugguuuccauagucaguauucauugcucuacauaaaacccuagcacuuugugaagccauuggacaagccaaacuacaagcgagcaacccgucuccucauggcuuguggaccccucauguugggucccuugucaccuaggugucaugcaugccucuuaccaguggcuucugcuguuggcucacugguuuccauucaacgccaaguucuuccugugugcuuuugcucugugguguaguuggacacacccuuuccuccuuccugucaggggaacucuuggcaguaguuuggaccagagcuaaugucuuucuguccacauccucuccguguaugccuggucugagcugccauuuccuagucaugccugaguaugauuccuugauagccugcuuuggacuauaaguuccaugccaguccagacuguaucucucucugcuucuaggaucauuucuauuuagaggagggauccaaugugucaugcaaagggaugcccacguguguagugagugaaugagaauugcagagccucgugugcugcauuguugccuggugauagugguccuucuagacuccugaacuguguaugccucaccugcaguuaucaccggcuucucugcccgugucggugguuuauacaucaauagauugaugggaugaagacugauuuaacacaaacgauuuuauaguacugagaauuacuuaggaaaaaaguaauucauauucauuuuagauguuaaaauguguuaucagcucuugagacuucuggucuuaaucacugacaaaagagccugguuugacaaccuaaagcugcauugguuucuucucuugucagcgacacuagcauacaacauucccguuuacuacagcaauaaaaauguuucuuuuagaccuagaaagcuuucacuuagaagcuaaauaauuuguugauucuauucaaaacuccuuacauagcaguugaguuaauuugauccaguauuucuauaauccuauauuaguuaaauuuuucuuuuacuccacuauagauucuagagcuugaauccauagagccuuuuaaauaaaaaaugaacuagagaagaaacuauaaauuuuaauuuguagugagauagauuuaaaagacacuuaauuaagaaauguucuauguccuaugguuuaacuucuguaagcaauuguuuuuaauuucaacuguucuaauguucaaaauacugauggugaaacaguuguggaagguggagagccucagccucauggaaacacuggccaaacugaguggcguggauccuguucucaggcugcucuacagaggcagugaggacagagauguggggguagcaguggagacacuguuucuacugaugguccacagaaguggggaguggaaauuauuucugccguugaccucuucaggguuugguaucuuugacaccccucccccuuucaggcaauggcuggaauagaaagggccgcuggugauguggaagcugugcucguguuuauagucaugcuggggaugccaguucuuuuccuauaaggaagaccgauggggaaaggacaguucagaaccuacuguagagagcuuagcaaguucaaaagcaaauguucaugugagugggaaccagaaugccuaguaagccugaggggacacaucccagaauacccugguaaaccugaggacacauaucccagaaugcccugguaaaccugaggacacauaucccagaaugcccugguaaaccugaggacacauaucccagaaugcccugguaaaccugaggacacauaucccagaaugcccuggcaaacuugaggauacacaucccauugagaguucuacgucugcuccagcugaugguuucuguaugggagugcugguccaaaauaacucuaguucuaguuucuuggucaaaaagcaaauaucuguuuagcaagggcuuaagaguaccuucuuucucucucucucucucucucucucucucucucucucucucuguguguguguguguguguguguguguguaguuguuuuuguuucguuucauuguuacgguuuuuugagacaggaucucacuauguaguccuggcaaucugaaguccguguggucagacuggccucaaauucacagagguccuacugucucugccuccuaagugcuggcauugaaaggugugcaccaccaugcucccccuuguugguuuugaaaucuauguuucuaaagagauagcuuuuuaaaaccuuuaaugccacacagacaugcuaaaacaugaggcuccuaccaugugucaggucacaguacggaagcaaagauggguuuucuacaguggcagaaggcgggacagugguucacugcuggagaauuugcaucccauacaucagacccuggguuccaucuacaacaaaaaaauaacuuaagacuucuuucuuacacauagucagugagguucacuuaggugaagaggaggccucugaugcuuggagacaagacaccauggguaacauuaauacaggacacaaagcagcagccagagaaguuuagcuccugauuaaagacugccacaaugaagaagguuucaacucugcugugugguuuggauucccauaagcuaaaagcuauuuaauggcaagcuguacaaggaaggcuagacucauguaaccugaaaccuucuaacacacaagaaaccaaagaauguuuuuagugccuggcaguaucaguaacucaagggcugacagauucacucauagcuuaaucaaacaguaacaucacuacugcaaagauguuuuagggauuuaaguugcucccaagacuuggaguuuagaacacugccuuucuagugaguuaaaaagcauuaacaguucaucucuaggcauccugccgagucccuuguuacugucauaucagaaagaacaggaauggggaacccuggcugagacuucuauuuacaggccagcccagccccaacacuguuauuuguccaccagacuuuauggagagaacuaaguacacccuucucuuaauucacuugucuugccgagaacaaugaaacugaccgaucuuuaauucugugacuaguugcuuuuaaaacacuuguuuccuuucacaccauuuugcugcaacaucuuugauucugaaccuuguuuguuccaugcagaaguggaugauggcaguucccggcucagauccacagagcagccuggagugccauccucaggucuuaccugcacaaggauuccgcuuuacaucgccaaggucugauccuuggagcuccuaguucuguggauuugggcugggauuuggguuuuguaauggcagcccaagcaggaaaacaccagggucaggggaacagauuuggcuuggaggauugguauagaugcacagcaaucugaauggauaauucaucggugaagugcauccucuguccucaggugucuaggaucccuccaauacagaacaaaaccauagacuguuucccgaaugcaucuugaccuagaauggaccgaaugccucuugacucucuuaaggccguguuuuccuuucucuuggaauuuuuuaucuuucauuacucaaaaaugauuuggucagcaauccugaccuagauuauggagucguuugauccaggaguccauuuaagcgccuugucgagugugcucccuuccuggccguguuauuccgcaagcugcguugaauggcagugcuguuggagaacgcuacuccgugugccuuacucagucuuuacaaagaauguggauacauuucaauacaauucuuucacaacuaacuuuuuugucagaaucauaauacugcagcauuucucugaugccauuaaguauucuucucuccauggucugaauuguaaugacaucggcuguuagcugagcuucuggcacaauguaagucgccuucugccagcacccuucuguccaacgcuagucugacauucugaaaucuaagcucugugucuuguaaauguagucuuuucacacggauauacaagucaaaccuuugagugcugaaucacacaaaaagaugcaaaaccuaaaaacauuagucauuuuaaaaauuaagcacauaaaauguagcuucccacauaucuccuaucauuccugggccaccauuggcuaacggucgacccuuucaaauuuucuuaucuuucuuuuuuugagacaccguuucucaauguggcccaggcuguccuggaacucacucugaauaccaggcuggccuugaacucucaaagaucugccugccucugcuucccgggcacugggauuaaaggcauguacccucauggcccagcugauuuuucaauguuuuauauuaucuagcuuaccagguuccuaacccugauagauuuauuugauguuugacauaaauaaauguugccucauaaggauacauuagaaugaaguauuuuuaaauugugcugaguaaaaggguacuauauaaauguauauauuauauaauaacauacagaaugguuccuguuuuaaaauaaaauagacugaagaaguuagugcuaacuugccaaauucaaagaucacagaugaucuaaauauguugccaguguuuuuuaugucuugaaaacaucagauucuuuugguaauuuuguuuuguuuauauuuuuagguagucucguguggcucaggcuggcuucuaacucaguauuuagccaagacugcuaauuucuguuugcagugcuggaguuauaaacaugugccaauacaaugaaguggacugguuugguuugguuggguuuuaauugcaucaggugauaagguuucaaaggguuuuuuaaaaucauuuaugaaagaaaugcaguuuuaguuucauauaugccucguuaaaugugucaaaugaacucaagaguacgugggugaaacccugaggagggugugacauucgacauugugugagacaugggacauuauguuucuuguacuuugaaggguuuguggucuguugggaguuuuccuaaaaagcuucucauuaucaaaacuguggaauuugucuuuaguaucuucagugcuaacuagguagaggagaugguuaaagugugaguuauugaacacuguuggauuguguucuaugagcuugacacucuacuguauuuucuguuauggucuucugugaaguauaccucacagugaucauguauuuuuguauuuaaacauugucagacagugaacugauuugaugggugcugcagauauaaaacguguaagcuuuuaugcuuucucuugacaggaagaagaaaagaagagcccugucagcuacccuucccuccucagccacaugacuucguccuuccucaaccaucccuuucuccccaugguacuaaguggccagcuccccuccccugccuuugagcugcugagugaauuuccucugcugcaguccucucuaccuugugauauccaucuggucaaccugcggacaauacaaucaaagguaaaugccaaaauaugucuguaugaacucgcuucuuauguucuagacuugguucaagggguaagcuuuggagcaguugcucagcaggccugcucuugcagaggacuuaaguuuaguucccaggaacccggaugaguggcucacaacugccuauaacuaaacuccaggguuccccucccugcucgucugggcuuguguuuauacacacacacagacagagagaaagcaaaaccacauacauagaugaauaaaaacuucaaaauaacauguaguaagcauccuugugcauugugaaauaauuaccagggcuucaccuuuuggccacuauacuguuaauuugcaguuucucugguuuaacaaauauuccaauauugauuuauuuaucucuccgagcaguccuguguggugaauggaucagaguuugacccuuuaccguaccuggaagccugugcugacuggggucucaugaugcgggcagagcugggaucuucaguucucgucacuucguugacuuuuguuuauuagccaauguuuucacagucagagaagcacugaauguauuguccacaagagaugcuuagguuuuuuaugucuuuuguuugaaagcauugcagaucgugcccuuguguugagaaccaacuuuuaggauguuugagaaagagccugggaaggauuucuuagguuuccaguauaacuccuuguguguuuccguuuauauuugcacccauauuuuaaaguagaaaagguugcacguggagugauugcagaucaaguguaauacaacuguuuagauguugcaagccgccgcagagcugaaugcaguguguggcagggauucugugggaaauaucuuguagcacauggacucaguguaaggaccagaaggagcucaaccuaacaugaaaaaaggauuuaagauuaacaaaggcaaacucaguaagaaaggaugggugucuacacgguggguguuagguauuuacagacuucauacccaagagaaggaacuuacgccaggcuaugcaggaagcugcaugaccugaaauaaugaaaacaaacagugccuagcugugugugugugugugugugugugugugugugugugugugugugugcagaaugacuugauugauccugugaggugaccaugcagaaucuguguuaagcauccuagcuguucgccagacaccgcacucacagucggcaacaggcagaugcccugggcuccuugggugucauuucuagugggaggagaaaguuaacugcagaagaaaaacuggguaaacacguuaaauggucgugagagugagggaaagcauacggugccgggagcaguucagagaaggugaugcaugucugcucaggguggauagcggccccugagagagggugagaauugggguagaagccuggagaggucaggauaugaagaagguccauccagguuucugagaggcuguaaggacagugagaggaagcucucggcagacucaagagcaagugugaaagucaugaguggcacauguggccagaaugugggagcuuagcucuucuguccauugcuacagcuccugccuugaacagagcccacacauggaacggggccuucuuugaauaagugaaucaugagauuguuuccucuaguguuuuaucauguucuuuucugccuucucuuuuggcccaugaagaccagaguggcccauggaaagaacagaugagggccagguagcgucuuugaggucacgugucacaaauucauaagcugaaagggaacacaagggcaggaaagguuccgcagcacagguuccuacaucuugacauagaugcagggcucauuagcagccugagaaugccaagggcuucugacaguuggggggauucugcccagugucccucagccucauuuauagaugacucaucuccugggauuguguuaaaggcgugcuuuucauggagucucaguaguugcccaagucacucaguggagaguagagauaccucuguaguccaagacuggccuguuuuucacaucauugcuuuuuaauggcaacuuuauggccuuuuuguuggccgucuuccaguuauaggagucuaauuacuuccuguucuaguuugccucugucucuguugcugugauaaaacacaaaggaacuucugggaggaaaaguuuuauuucaguuuaacacucucagguaucagucucucccugagggaagucgucgggaacucaagaaccuagagcagaagccauggaggacucuuguuggccaacuugcagucugagcuacuguucuuuuauagcccuagaccaccuaccggggaauggcacugcuacaguggacugcauccaucuauaucagucagacaaaagaauuccucucagaccuagccauaaaccaacuguuaacaacagcuccucacucugggguuucccuguagaugacacugggcuguaugaaguugacaguuaaggccaguuggcaccacccaugugaaagucccauucccuaccagacuaguugaugcccuugugcauuugggcucuauccaggcuacagacacucuacuggcugcagccaccugccuucucguggaccuugagacugcugacuuagcuuagucugugucagacauaccugccccaaggauguuaugaaaagcaaaaugauguuuggaaaggcucugaaagacagggacacccaguaaagcagcaguugauccuaaugaugcuuacaauaugcgacugugaggagaaggacagauuuggggcagagggaauagagagaaagcauacauccagagaacagguaccgaaaugucucuggcauggaaccagaaccgaaggcacgaggcuguuucugugugaucggaucuguuggccagguccuguguuagcuuuggacucugagcauguguucagaguugagagcacaggagauugacugguccauugacaccuauaaaaaguugcucuuugucccuuaaccuuuacgaaaggaaagaucauuguuuggugaagcugccuaaaaauguagccauuguaacuccacaagaugccaaagaauugacugcagagcuagagagggauugaccggugaaucauagccuccauuucaggauucugaguuggcuuccuggcuccacgugcuggcagcauucaguauaugacagugugaaucgucuggauucuuguaacuccuuccucacagagcccuguugauguagauauccgugucugagagauacccaaguucgcacugccagugugucacuuaacauuuucccaguacgucugacagaggcacuugauccuuccugccugcuagcugcagguaguggcguuauggggcaccuuuucugcccagaccccauccauggccacucaguucuaaauuucagccugguucuugcugacaguggauaaaagaauuauggguucagagagcagugagagaggucaagggagagcugggcgugcagugagugugagucaagguugggcuggaagaugguucuaugguucaauugagucccagucuccagauucucugaacugagcucaugcccaugaccuucagaaacaaagauuguaacaaauguacccaacuugaugauucugggccuguuugucuauagauagcagagccuagacguguaauaacaauuuaaauaacugcuuaaaguaauuuacuuaaaauagcuuaaaauaaaaauuuagaaaacccuucccauuugagauuagaaaugaauaaguuaccuccauuuaaaauaagggcuagagacuaaauuaagauaaaauccccuauaaggccuguuucugagcccuguuuguggacgcagaagguguuguuugaucuuuuucagaauuacuguuucuguuugugaaaguuccaagcuugugggcaucauccuguuaccaguagaugaccuuaugcuuucauauaggcauauuuacacuugcacuuucuguauuugaaaaguaauuccauacuguguauguguguauguguaaugagaugacaggcaccucaggagcccugucacagaacguggugugagcuaggucauuccagcugcugccugcaaauguaacugcuaaccuucucaccuaacgugccucaucacccucgcuucugugagccuccuucuagugaucauucugcccucccuuugccaucagacacuucaggugaagcuucuuuaaagguuucaaccuggguaacaugaacacugccagaguauacuaagcaggaaagucuagggcaccaagaaaggauaacucuuuaaggaaaagggauuuuugguagagaggaugcugaaagacucaucuuaguuacuucccaguugcuguccuaaaacaccaugaccaaggcaccuuacaaaaagaaagcauuuaguuggagcaugcuugcaguuucagaggucuaguccauugucaucauggcaagaagcgaggaagcaggcagacuagcacagcacugcagcaguagcugagagcucacaucuugagacaacaaucaggagaugucgaaagggaggcuaacuaggaauggugugggcuuuggaaagcucaaagcccaccccagugacacgccuccuccaacaaggccacaccuccuaauccuucccaaacaguuccaccaauacaugagccagugggggccauucccacucagaucccugcagcucccaugggaagacggaucaugauucagaacucuacaggguggacuuacaaaucacucuuagaacagagcaagccaaagagauaugcugcccagcauccagcugggagguggugccauccugcuuuauggcuuugaaaaaaucacauguagcucacguucugucaacuuacuccauuguuauuuuuguuguaacauucucauuaauucgcacauauugcucuguucucugugugauuuuuuuuaagguuaacuguucuugcaaauaguuaaccaaucauuucaaagucagugccgcuuuuaaugugaaacucucuuucucucucuccacuuguuuacaccaccacccccauucucguaaguggcacuuugagguuuuccuuucuccuguuuuauaagaauugauuggugcuuuauugaucuccguagcuucuggaaaggugaaaauugaagggguggguguucuuuguuguacauaucuaagaacaacugcucaccuucccuuaacauccaucgucuuaucuuguucaucaacacuaagaacuguuacugggcauuuuaaugaguguccuggaaaaugaaucuuuaccaguuacuuucuucggucuugggacuugcagugaaaugugggauuuuccaagucucucccugccagaauacaaugaagacggguguuauaugggcuacuaaguaggcuucuauaacugucuaaauucuugaagaauaugagcaguuuagagaagguuuccuacaagguguuuagcuuggccuucguaugugaacgccuugagguccuaugaggaggcuauguggccugugcugcccuuggagagucugaucagagguggggcucauccugugcugccuguuacucagcacggaaggaagaaggaagaaacacugcugggaacguugcggaccauccuuucuuaucuucucuuacagaguguagccaccagugaguuagguaagguccugggguacuaaaccagggucauaucauugcucggacacuguaagagagaaugcuuugugguggggauguuccugcauauucaaacuugcuaacaguacauuauuucauuagccauuuuguuaaccaucauaaaggcuguuguggcauaaaguaaguuuguccaugcaaagcaucauaugucuugucuggcguacagccuguguucaguguguguuagucacugucacuguggugguguacagccugcguucaguguguguuaauugucacugucccugccacaaugcuuugagugagaagaggcucucacccagcucccugcauuuacugaaacuuaacgguuauucaaaaccucaugacuggcuuucuccgaggaaugccuugugaagaucacucucccacauccguuugcaggacuggccucacagcuaaguucuguguagacugaucuuaucuccgagaaugacuucugugaggauugcugacuguggaccgcccagccugaccucagggauucacacuuacaugugaccuggccuaucuggcagacaguugucaccauaguacuuggugcuguuuccauaugauacacacccacaacccucuccuucucugauguccugauauuaauaacauguuagcggauuuuuuaaaaauuauuucaaucuauuugcuuucuaagagcacaucguauaccugugugaauguaugaaguuuucuugaauguauauucaacuuaaauuaacauuuucccauuuuugauuuacuuuauuuuauugaaaaaaaauucauggauauauucugaucaugcucccucuuucuccaacucauccaagauccuucccacccauucaagagaauucucaagaacuccaugcccguccccccucucucuaauacaaacaggcaaaacacuaaaucagaaacuauaaaagacaaauacaagacaaauaagauaaaaaaaaaacucccaaauaaaucaauaugagaccaaagucuacgaaaauucccuuggguuuguuuuguguuagccucugcugcugggcauugugccuguccugagguguguccauugcacauagcuucuugcguagcggaagcccacagcuacuuccccagcucagcacuagcacuaggcagacuugcucccauugcuggaaauggcagcuaucuguggcugaggguuuaguugagggcaguucguuugccaguguuuacacauguccucuccagaguggaaguuccaaaagggagugcccgaaggagucccaagcuuagcccaaaaaaaagccaaguaagauuaaagguuuacaaaaugccauugaguuuauguuguuacccaaugacuccugggcaugggccggcccuaagguguaguaauguacacaccgagacuccacuggagaagacuaauuuguccucugcaaguggcugucacuugcagauagcuccuugguuagggguggagguugugucaacaucuccccucugacuugaaccucugaagguacuaugcacgcugccgcugccgcuguacuaguuccuguguacugcuggaggaaguuucucuagggauugcugagcaagacacugaucuaugauuauaacacgucauuaggaguuauuacuauauuccuuuagcagaauaguaauuucaugaauuuaugaauagcaauuuaagugaagcucaaguuucuacucacugagauacauaaguagugccuuuagcaauaggacuuugccucuuguuugcugaaggcaaucagugagccuuggcaguagcccagaauguuugagcgucuccacagugucccuugaccaaagaaucaacuaaauauaacccaucccugacacuggaagcuucacuugcuggugaaagauaucugucuggggcaucuguucccugucauuuggcaauuccauguagauuucucucauguguguauacaucuuaggaauagucuacagcacuagauuaaguagcuuuuauaaaugguccagagaguuaaaaaaaauccugcauguuuuagguuaauaguggcaagugcuucugaaagaguuugauuaagaggccauuuaaucugugagaccacauauagacaguuuggggcuuugacauguaaccauagauauguaauuuaacaguucucuuauucuuuagcaaaaaaacuauaaugucaguggggaaauuuauuaauaaaaaucuguaauaacuuguaauguuuauaaaauagucaccuauuuuguaugauuaaaaguacaaauaguuaacaugccaacggcaucauaagucaaacacuggaccacaucuuuggauuuuuuuuuuauuuccucuggauuuuauagaaaaaaagaaaaccugguuuuacugaacauagcuacugaauugcagagcacagagccagaauuuaggcugacugaguccaaccgagguucugagccacuagucuuuguaguacauccuguccuuugaagcuccgagagaccacuaucaacagaauuucucagcagucauccagaggaugaauuccugcagaaaguauaccaacauuaguuccaucuuauagacaaaagaugcuuaaaauaaguuguucccagguaccaugguggguagggacuaaguucucuuuguuauucagauggugaucuguuuauaauuagugaaggguuuucugugugcaguuuuuccacugugaaguguaugucagggcacagcauuuuguugaagguucacuagacaucuuuaucauguaaacacuuagagcugcuaugugggucaaagucaccuugugacucgguuucuuaaauggcauuuuuuuuuccucccuucaaacaaaauccugcaaugccauugaaaaccagugcaaacagcauaauguaugcuuucccagccagacucugcucaggccccuuagcaucaaauccagugcaaaugcuagcagcuacucacaaaagacaucucaguagggcacuacacagagccugcccucuagugaagauggccgugagcuugggugugcugacucuggcuggagaggagaaguaacugguguuguucagacucgguagcagcagacggcuccccuuggcauaacuacagcucaucaaaguuccaaugauuuuuuuaaaauucauuuugcucauccgcacaaacaucuuuacacuuuauuuuauuaucauuuguaugugugugaguuuauaugugauuguguguggggggggggcgggcggggagagaauuacaaguggaaguuagaagaagccuucggguguugguuucuucauuucugccuuguuugcugcuaaguaagccaggcuaacuggucugugaguguccagagggucugcugcguccaugucucaucuucucauggggccugccaggauuauagguguguguacugugccucugccuuuccuggagguucugggaucugaaaccaggucaccuggcucacucggcaagugcuuuucgucacagagucgccuccccagauccgucuuuacacuuuagaaaacaaaauauaugaagagaguccuaacuucauagacacccgaaucugaaucguucauggcaucacuauuuaagaugagugcaagaguuugcugcaauaaauaaauauaaauagggaugcuucucacugacugguuauguuugguguuuuccuuuuugcccaggaggacuucugaaaugugaacuuaagugacauaccaaguuaauaaauguggucaggcucagccuaccuaauucagucuaaauaucucuuacauaaaaauaaugaagcaaugcaguaaagauuaagaauguuagugcagcccccaaaugcaguguuucacaaagaaugaccucucuguguuaaggcugcuguuaacucaucaugugaccaaacugggacuaaauuuagguguguuuuauucaaugcauguguauauauauagaaaaaaacuaaaugauuuaauuugcagauccuuugauaaaacaguauuuauauguggguaaaaagaacucuaauccuuuaagggucauaggguaaacaaaggcgugaaguuacauaaccaggauuuugagguaagcuuauggacuuuugggagaagagaagagaaugagccagugaguggggaagcuuugaaggggugaauuaauuaucuaauuguugaauaaaugugccgacaccaagugugcgaggugcuagaaauaaucacuucaguguuugcauggaauaucgguguucucacuuccagaugggcaaaggcuauucggaugaggcagccuugauccuccacaggaaaggguuugauugccaguucuccagcagaggcaucgggcuacccuguuccacuacucagggaaagguaaguuaagagucuaccuugcuagucaagacaguaugcauugggauucucacuuucugcagauaguacaguauagccuuuuauugccucaaacucaguuguucaccuugccugcaagccagcucacgauuucucaccuccacaaaacacuuguucuaccuaaaguucuguucuugucagcugcaaucuguacacuuuugaaggccauguuccuaucauuucuuuggucuuccacucugagacugccaagcucauuacaccucuugucuucaauuucaacuccucugagcccucugugcucacauaccauguagcuuggcccugguaguuuaaagccacauuccacaaaggcuagggcagauuuaagauuuagggaagaugccugguacagccgugaaguuacagcauaaacaucaaaaccauggucagcggauuaacugaacacaaccagagguagcugugccgaggcuaugucaguugacucauuuggagaaauaaaugugucugagucuccugauugaucuagauuuguguaugagucaucacuguggagaucagauaacccuugagucugcacccugcuggcugguugccuguucuugauuuuucuccucaaguucuucuggcgguucaucagcaucuucuuggaaggaugaacauccagucuccugccucuaagagagccaggucucacaaaguaguuaaguacuuagcuggcgggucucugcacauagcuaggucugcacacccaacaacuuaucagagccaacuuucugccagaacuccauagguuacacuacaaaacagagucaagcaaucuugucccaacucuacaugcuagcacacguuccaaggucugagaagaaugcucacuuggaugcauuguuuuuaccccacuuuccuguguguuuccacucugguacugaugaucugaauauaccuaaggaaccuucuagaauuaauguguuaagucuuaagaaggauaaucgagggauauuauuccaagagacacuuuaggauaaccugguaaagugacaaauauauuuuccuaacaucucuauagauugggaccaguaauaaaauaagccauuguuaucaugaaacugucuuauuuuucaauucuguuggaaaggggggggggggaucgucuuaucgccaccauuauuauggagaaauauugaccaaagaaucugaugauuuucaaguccuugggacuguuggaauuucuugguucuuagauguccacucuuuuauugaaaauguccucauguaaaacuaaaggaacugcaaggcggaguggcucacagccaugugucuccagggaugguuuguguucgggaauguaauguccucuccccuucauguucucaaaagggaacuucagcagauaaauauauuucuuccugugcuuuccuuaaacugaguuuauagaugugcuaggagucucccggggcagaucugaaugugcaaaucucaguaccgcucuaaaucugcaaaucuuggcacuugcuuuuuuuagaugucaguucugaaacuuuucaacaaguuugcuguggagagucucgucccuuccucucuguccuugaugcacuccccuccagaugcccagaacaugagugaagucagccugagccccauggagaucagcacguuccguauccgcuugcguuggaccugacccagacuugagcagagaaacuccggcuuuguuaccguccuugguuuaacgugcaauaacuaagcacauuacuuuagcuucuggcuacugugagaacaugaauucugugauucuguuuuuuuguuuuguuuuguuuuguuuuuuaaaccaaucuaguaagaaaaagccaugcuuuaaaaaaagguuucuuucucugaguuugucccacagcuaccguuaucaguaugaacugagguaacaaaaaugaagaacuauugaaagauaagcccucaacagacugcaucucagguuaaaugcuaacuauguuugcauugaggguuguaaagagauucucuagaaguauucuuaucucugaucauguuuuauuaaaaaaauacccauuugacuuaaauagaaagaaaaaucagaaguugguagguaacagcuuaauggccaaaguaguuguaaucauugauauaaauuugaauauuuuguauguuaaaauaauguggaaaagugcaaucccucaacccuuaugauaaauguaguugguuuucauacucuuuuccaaugaaccucuuggcuacccuuuccuacccacacauuuaaaaaaauaagugauaauuuuagucguucaccaguagaaaaagagguguauuuucauuacuugacaacaugggaugggugcaauuuauuccauugucacugaaacagaagaagcaguuccacuuuagguaccacaaggugucuuucuauacagcucauuugaauacagguguuccaaggugggguuuucuauuuuuaaauuaccauaucaaaaauaaaugugccuuauuuuuuuauaagucuuguuaaaucuuauuacuguccauauuacuguuugggaggugggguauugggagguugggauaggggguggguacuuucuaugacacauaaauuauguaaaauuuuuugcuugauaaugcuggccacauccugaucugugucauuacauuuguggugauguuacucuaaacauuuugacuauuugaauguacugagaugucagaaaacgaaacaagggagaaaaauauugcuaauuaaaauaugcugcugccaaggaaacugcaaguugaagcaaggauuucguaacccacaagauccaaguacuucuugcauuucacaguacuuaaccgcguuaaagagagaaugcuuuaaaaauagacuguuuucuaaaauccucuguguguagcucaucuuauguuccuuacuaaagaacacguuccaaacauuugugugugguaaacucagcguguuagucuagcccauguaccaucaugggaccuuugaggucauuugagaucauuguuucuguaauagaauaauaguauuuaauuuugguauagaaagaaugcuuuggcuauauccacuuuugaaaaauucuccucagugucuuaaccuaauuuaguauucuuugacuuuaaaccuccacuuaccucuuaccauuccaguacauuacagagaaaagcauuucugccucacuguuuauucugaucgucaucuggauucuuccucaagaugcagcuccuacauucgcuguucuguugaguuccuaaaauccuuugccuauaaucauuaaggaaauaccagaaugacaggaccauugcaaggguauaauuucaugcaguaagcaugugacguacauucccuuccucauuuguuggggaauaagcaacugaaaguacaacaaaaccacuuccuccuauaaccucugcagacgcuagcuaggacgaccaagcgccagucccacgaauaugaucuauuuucuuguuguaucuuaaguguaugccuuccuguggauguucacugugcucugugguuaaguggcuaugcuuaaucacuacagaaguucugaugaggccaaaugaaaccaguggcugacauaaauaauaaacaaaaacagcagacacaggggacccacucuguguucuggccaccagcuccuuauucacaggugaagcagaaacucuauguaaccagcaagcuucugcuuuuuaaaguuauuuucacauuacaacacuggggaaaugaagagagggugucuuuugcuuuggguuauggucagaaacugguuucucuggcacacgugggcagucagccacacuucagaccugacagcgggggagggggggggcggucuguuuaguuaggcuugguacaucuguuaucacagaugcucaguggaccaagacugucucgcuacucucuccccacucucugaaauuuuaauuuuguuuagaggugcaugguucaaauaucagcauucuaaaaaaaaaaauugauuuaagaaaaugcuguaugauguuagaagacauuguaauuaucaucccgugucuuugcuguacucgugcugaaguguuuucacaguccuuugucuagaagaaaauguuuacuuucauugugauuauuuugcucauugaaaucaacagguuuugauauuuuucucuuggaagauuuuuauaacuuuuugggaauauguaauauaagaucucuaauaaaauauaaucuuauccugugcau

SEQ ID NO: 8703 - RNA, 1002 nt, Mus musculus
ugccggcgccugcagcaggaauugaggaauuccucuauaaaugguucuaagagcgggacaaccagagcugguggccucgcgcuugcuaguaugaagugggugccacugucaaaccugcauguggacgucccaaaggaugugaccagaccuacgauaaccacuuccgaugagccagacacguuguacaaacgccuguccaucuuagugaaagcccaugacagggcuguguuagacagcuaugaguacuuugccgugcucgcugcuaaagaacuuggcauuucuauuaaaguacacgagccaccaaggaaaauagagcgcuucacucuucucaagucggugcacaucuucaagaagcacagaguccaguaugagaugaggacacucuacagauguuuggaguuaaaacauuugacuggaagcacagccagugucuaccuggaguauauccagcgaaacuugccugaagggguggccauggaagugacaaagacgcagauacagcaguugccagaacacaucaaggagccgaugugggaaacgguucccgaggagaaagaagaaagcaagucguaagccucagggauggcggcugugccaggaucccgccggagcauguguuccauggagagcgccccccugaggggagucagggccaccugcccuugcucggcuggggccucacccugggcagccaggugggagcaggcuggguuucagggaagcaccacuguauguucucuauaccagaggaugcuugugucccgauuugaacaaacauuagcaaacuucugcauaacccaaaacaaaagaaccagauuuaaacauuuguguagcgcugcugacuucuuguuagccugugcuaauuuuauuuuguucuuauuuauuuauccauccauucauuccuuuuuauuucuggagcucauggagaucuaucggccucugccucccaaaugcuggauuaaaaguguguccaccaaaaaaaaaaaaaaaaaaaaaaaaaaa

SEQ ID NO: 8704 - RNA, 783 nt, Mus musculus
gaugccgcugaaggggaaaacugguucuggagaaggaggggaaggaggugcagccucugggagugacagugcugacaagaagucucaggguccugaaggcgguggcaaugcaguaaaggucagacacacucuaugugaaaaccaugggggaaucauggaagccauggaaaaguuaaagucugggaugagagucagugaaguggccacacaaaauagugaagauaaacccagacagggggugacucugguuggaugaccagaggcuccaugguggggucauuucaggaagcagcguuugccuugccuacaaaugggauggauaacccuguaguaacagacccaccuguuaagacaaaauuuggauaucauauuauuaugguugaagggagaaaauaaaaucacacgaaacacuggaaaaaaaaaagauugccuuagucaugguuucugaucacagcagucucaaauauaaucaaaagcguaguuuccaccucaagcuguauucaggcugaaggggacguuccucucgauuguaaggaucgaaauguccaccccacccugcuucauguauuagcuagucaaaguaaaguuuguuuuucuaacauaaaauugggcuaauuguagugauaaugcaggcaaauccuuuugaugaaaugauacaauauaauaucauuaauauaauuacugacauuuauuuuguuauaagcauuaauuuuucauaaugcuuuauaauuacacagggcauuauguguucauauuuccuuggucuuucucccagauguugaa

SEQ ID NO: 8705 - RNA, 35868 nt, Mus musculus
ugagguagcgucguagucggcgcuccagccccgcacucgcagcuccagggccccaagaacgacacccccuucccggggcgccgugcaccgcgucuccccgcaaagagccccgcuccgcccccccgacccugcucuacggagauugacagcggcgcggcgcccggagcugcggccaagucggaggugcgcaggcgcacuagcucagcguugaccccucccaccccccaguuaggcccggagggcggggccagcacgagggcuccaggccgcgggggcgcgcacguaggcacguagggcccgucacguggggcgccgaggaucgcagugcgcguggccgcggcggcuggugugggguugagucaguugugacacccggagcugcugagcggacaggcugcccucgggacccccgcggcccggcagcaggcgcggagcuucgggaaucgugagccuggccccguccuagagcuccgcggagccggcgccgccaccguccccucgcccccgccagcgaaccgccgccgcgggcgcgcccccgcucugcgcugcgcugucuccuauggcguccgccuccggggccauggcgaagcacgagcagauccugguccucgacccuccuucagaccucaaauucaaagguaggcuggcugggacgcuccggagcggagcugaggcuggggcuggggcuggcgggcggcggcgggguggccgggccgugcuccccucccccacgccccggccgagcgucggagccgcggccccgcugcgucccucggccccgcgccucgccguccgccgcugccgggccgggccgggccgggcugggcugcgcugcggaggggaggggagggagccgccgggcgccgcggagggcuccgccgccaucuugcggccccgcgggggcgccgugggagcccgcccgcgccuugcccgccggcccgcauggcguccuugccccaggggcggccgcggcgcggcgcggugcggucgggcggugcgggagggcgacugggagccggagcucccuagucggcgggcgccagugggcgccguucggcggcuuugggcaggcgcgguccgccgcgggcgaggaggcguucacggucgcggccucgcccggagucuuucccggucaggugcgggacucuggcugagccgggagaccaggcagcagagucucuggcugggacugaccccgcguguuggcacggcccccaggcgcgcggcagaaagcugugcgucagcuggggcaugcauggucagagguuaaugguagugggucccuugugucagcucggauugucccuagguacggaggacccaguccuugagugcacacugucuuuacugaagaauucuuucagcguuugugacccgcuuacgcuugcgguuucccugcguaucccgagaaagcugcuaaggugccacacagcucuggaacuguugacuuuggagcauugacugugauagacaguggcuuggugauucuuguucagauccaaggcgguuugccuucucaguguguaggaaacgaaacguuacacagaacaauuuacuuuauuuuaaggagaaccaaaagaauggagcuaaagagaaaacgugauccuuccuaucuuuaaauguaaagugccccccucccccccccccgaaaguuaauaccuugcguuuuaauuucaggaacugaugaaaacaauuuuccuuaggcgcacaucgauuccaguacuaagagaaaaaguaaacccauuaauaguaguguaagaguuaguccaaaugaaaauagcugaauuguccuugugggaacaauuuaaaauaguuccagacacuuaaagauuuuauaucuuaaauaguuuuagggcuuauaaacauuggguauucugcuagucacaugcccugcagguguuucaguacauucacaaguuucucuuuacuagacaagaacuugauugugauuuuaaggcagcucuaauaucuuuggaauugggucgugaaccacacuuauaaucccggcauucuggaaguccagaaaccauccaaaguuugaaaucaacccgggcuacaagggagacacuagacagugucucagaaccucggguaguguguauuuuccugcagcaaauuucuguauugccugauugguuuuuuuugggggggggagggggggagggagugggcgggguuugcugagaaguucuuauaguacuguaguagccauagguaauagaagcgauuuaaugaacauuuuuacgauauuuugugugguuugcuuuuucucuuuugacuguaagagaaaauuaucuguaccacauagacaugugugaaaagucuuuuaugagacagguuuuaaaaacgauuggaaauacuacauugugcaguauccauauagaccacuuauuuuugauguuaaauaauaacuguguuuauacaacagacuauguguuaccaaaaaaaugaucccaauacuacugaaaagggcagguaagugguacuuugagggaguagcaugucuguggaagcuuuuaagggaaaaaggcuccuuucaaguugccuagggaaaguuaugcaaaugggagugguuggguaaauccugaggugagaagauacauugaggugaauagacuuaaaugcccaguuguucagagacuucuggaaaggugggugagauggaaagauagggagggagaaauucgagaggauuggaguaggaguuugacauuuggaguuugaugcuuuccuccuuaauguuacuuuguuagucaaagauaauuugguacaaugguagccucugaauuuaaaugcccaguucuacacuaaguagggggauuuagaauccacagugcgcaugaucuuuugguugaccauaucaauaaucacuuaccugaucuuuacauguguuuaaguguagguuguuuacacauccccuuuugcagaauuacuugaugaucugcuagguuuauuugaauuauuuggauucaccauugguuucuucaggagugacucagccauucugagauuaacaguuuucuuuuaauaugaauaaugacuugauaaguaucauuacuuugcaguuuuauuucagucuuagucauaauucuuuuauaauuguagaaugaauucuaaagcagaccuuuuaguggcuuuagugcauaaaaagauuuaucaauuuuuuugguugcuuaaaucauagcaauacuucgaccaauaauuuagauuugaaauuggauauuucacagaaaaaaaaacacuuuuuuguccuuaaagucuaguauguuauaaaguuaguuuauuguuuuuuguagcauuuuacuuuuccuagauguugacaguauuggaaggaaguuugaagaagaaaguuuguaaaaaaagaauuccaaguguguguuuccucauaaagguccuggaaaagaggaaaaugggcugaacuccuuguguugagguagcucuugugaguacugaggaacacagggagcuagcugugcugccacugucagccagaagccacaccccuucuaaggucugagaauggucuccucuuccaucccaggcugccuuuggauuccaguacaccuaugaggaucuugaauucuuuuuaaauauaauuuuuaaaaaaauauuuauuuuuuauuuguguaagucuuuucuuguauauacaugugaacacuacuuggguccugagugcuuguggaggccagaagaggguggcaggcccuuuggaauuggagugacaaguggccauuaguuacuauguggguucuuggaauugaaccugcauccucaagaaguauucucaaccacugagccaucucuucaaccacuuuuaaaauuuuuuaaaaauauuuuuugacaauuguauguguguguugcgugcacacagacacauuaaccugaucaucuuuguguucuccaucugacccucugccucauguuucccuccuaccuuugugucuucacuaaaaaauuaauauuuuauuuauuuauauaugugcgucuucauguggacgugagugcagaugcccuuggaggcuggagguguaggauucccugaagcuggaguuacagaugguuguggugagccaccugaugcggaugcugggagcugaacucagguccucugaaaagagcagcagguuaaccgcucagccaucuccucaggcuccccgugccuuaaaaaauccucuccugaauccaguuagugcuagccuccuguguguugguaugggagcaugagcagcucacuggugccaccucccuuacccuaaagacugacucuccuuucucaguaacggucagcugagaugaucaugugcagcccuguguagauaccacagcugcugugaauuuagaagugcaguggccaugucacguccccagaagacagcauaacaucucucucauugcacucuuuucuguccuccugcucuuagauucuuuucaccuucucuuugacauucucuaagccuugggaguguggcccauuuaggacucagcgcucacuuucaccaaucuuagcacuucugaguccugaauuaauuacuacucauuacagaaacaugcuucucugcuaaagguugagagcagcacuuauggguauaaaugugaauguuuagaaggcaggccaacaaccugcaccuggagugagacuacagugguggguucuacccagggccuaagaucgccccagcagcagucuuuuaaugagguuuaaaagguaucagucuucuuguggaugcgauuucaaauacaauuaaaaacugauugguuaucccccuccccccauuagucaugccacuauuacaccaaugggcauagcuugccugguagguuggcauugucgcacacagggcccaagguuggguaauucuguuaucuucucccuaaguggccugcauagcaucuucaggcaccgugaaagauuguagggaggaaguuucucaauccauuccagauugguuucucuguguucugcgguaucuaagaccuugaauuuuaguucugccuuccucuuccuuccaagugcugggauuauagauaaguaccaagcuucgggaacaucuuugaauagcaacauaucauuaagauaagcacaagcacugaauacuacaguucuuuuaggggggagugggcaaaauaggaaauuuuacaucguuucagaugcucuuauucuacauaaacuacauucuaauucugggaagaucauuucacaaacugccuuuaaauacaauccuuagccaguucuuaaaaguuaagguauuuguuugcucaugggguaagguuuuauuugucguuuuaguauguguauauugcuauaguagacugcuuucuuuaacaccugugucuguauacaccuggcuguugcuagguaacuguuggguggagccuacaaauauccuggucuuuuguauuauuuugcauuccucuuggaaaacuaguucauguuuguaguauuauuacuuaguaaauccuguucaugguguugcuucucaccucaauguuuuacguuccugaaugaaagacacacaacacagccuuuauauuuuaguaugccuuaagcagcacaguaguugggcaacugccuaaccuccgugcuuugagaauccaccucccguugauaauucugagugacuacuuacuaauuucaauguuccaucuugguugcuucugggccaugcucuacuggccccuuuacaugguagcuccgccucccuguccugcauuccucgugaauggugcccuccccucccccguggucccaugccugggaaaccuaaaacccugccucuuucucuuuucaccagcuauuggcugcuggcaucuuuauuuaccaaccagaauuacaggugcagacaguuuugagggacacagcauccgaauacaagcagcuaaaguguuugcuguucuccaguuccuuuaccucccucacuuccaagucacuguagucacacuucuguccucacuacuugauuguuuccugcauugaucauguccaguguauauguaacuuuaucauuuacuacuauagaaaguaguauuacucucuugaaaaaacuuuagacuucaauaucacuaucuuaugucuccccuccucccaagucccauguguggcacuuccuuaaccguuacuguuucugaggcccugacuugguuucaacaccauuguuccuuauucagacuuacuagguuuuuucucccucaacuccauauuccugcuuuugcacauuuuugcagauacccaauucuguauuucauccaggauuacagucaaucaaauacucucuguuuuugguuuuggagauagguuucaccauguaacugacauagaacuguaaaccaggcugaccucccaaacucaaaaagauccgccugccucauccuccagagugcagggauuaaaggcgugugcugcuaagggcuaacugaaaauauuuuauuauuauuaugguuauuguguguguguguguauggagggggaggagagagaggagugcgugugucugcaugcugugucaagguuguucaggauuguuugugaaggucagaggacacccuggauucuaacucaggcguguguuacaagugucuuacccacugagccauucacuggcucaaagacuacacaagucuuaauguacuauuuggauuugaaugucccuaucaagugacagcucagaacccacauaguccuagcucucccacuccuuaaccugaacauccauauuuuauaauuagcacgcauacucauaaucucuuuuugccucuguuggucugacuuuuuaaaugcaucuucuguuaguaaacuuguuauuuuuuagaauuaauucagucaugaauuugucaggaguaaguguuggaacuacaaucgugaacauuugucuuugugggggcaguucuaaaggucaaaaucucaauuuccagauggaugaaauguagggggaagccuucugacaguccaauaguaaauugaaguuaccuagugcagugguucuuaaccuauggguugggacucuuagcagaccuuucuccaaaauauuacaagucauaacuguagcaaaacuaaguaaaacgaaguagccauaaagauaauuuuauggcuggggaucaccacaucaugaugaacuauauuaaacagugguagcauuuaggaaaggugagaaccacugaccuagaagaagaaaggaguacguaaguacacgauccugggguagaagggagcgcaugauguuaacugaaagguuuccaagcagcaguaguagaaaugaccaggguauauauaguucugguuugguaggucaaguuagaaguuucuucuuuucuucuucuucccccucuuccuccuccuuccccuccuccuccucuucacugagggauuaaaugguguguguauaugguauuuuuuuuuaauuggguggagagacagguauaaagguaugccaggcuauuuuguguuccauuaagaaauacuuaauuguagcugugcagauugguauuagaagugagauaauuagaugcuguagugcugcaacgauuguggcaagaggugggcauugguguuggagauaauagaaggucaaaguagacgugugcugagagaaggugcggcuuccuagaugguguucgugaaguggagggaugguggccuucacugagcuaagaaacacagaugucuggaugagacugauaacauuuucuuuuggguauauggaagaaagguaggaggaagaccauacuuccaguguggcaguaugcuugaggcuuguagauaacuaaugagaaugugcuguaaguguguauguguggauugguugaaccuuuaggaauuucaccugugguagcaauucuuuuuaaaacagaacuuggaucucuuugcaauugggauuuucaucugccuguugcacauacuuguauuuugaauuuucauacuucuaaaaaaacaagugcuaagguauuuuguaaaaaauugauuaaguagauugguuuuuuuuuuuuuguaccuuuuguacagucagugagacaaagaguaugggggggcuugacuuuggaaguuuugugacuacauauaaguauuaagucauuuaacuugcuuugguggcauuggugggacaaaguggaaagagaauccagaguuggagcuagcuugggcuacaugaauggaagggcuaggguggggucagggggaugagacuaggaagacggcucaggugcuugccugccauagugagaaccugagucuggauucccagcaacuggguuaaaaggaagguguggggcuccugcuuguaaucacagcacugcacguacugcagagacagcugaggcucugagggcuugcuggccagucagucccauccugguugguaaggccaaugagagacugucucaaaggacaccuaaguuuauucuuuggcuuucacaugcuugcacauguguaucugcaggugcacauauacaauuaaaaauaucaaaaaucaccuuagaaguuauuuuaaucaaauaggaaaauaugcuguaguauuccuuucauuuauaaauuuugauuucuaugguuugugaucaacuguggucccaaaauagaaggggagaaauuuccagacauaaacagucauaaguuuaaauuuguguccuucugagcuagaggcuugccaaggaccugacuguugggccaguuauuuccacacugcaaagcugcccacuaaccaguuauuuggacauuuucuuaccagauuguugguaucacaauauuguuuccuuuaagugcaaaguucucagcuuaguagggaaacagaaacuaacucuauggugugauguugcaaaaaucuacaauaagaaagggucucucugcaugacugaaaaagggaagggauugucucuggauuugcuauugaacuucaaaugauaaaaauggauggcagugguaugugauacaggcuugguuagaauggaaaaggcauuaaauuauaggacuugauucugguuuugauuuuaaguuuugggacaugggaaaacuugacuuaaguucuucagaauuugguauuuuuccaauuguuagcauugguaauuguuaaaauuaugcuuuaguguaucauauucucccccccccacaacagaauuuguuauacauaguuaagauauugguuagcuauuauuguugcugugacaaaauaugggacaggcaaccaaggaagaaagguuucuuucauucacuuuaccauuucagggagauagaguccauuguggggugaaaguuggugacaggaguuuuaggucacacugaauucucagucaggaagcagacugguggugagcucugguguuuacugucuuccuccuuuuuauuuggucuaguacuucagccagugaaaugcugugacucacaguucauguggauuuccuaucucaguuaaccugaccuaagucacccuuuuggugugcacagacuuaauucugcuaauucuagauccugucagguugacaaguuaguauccaucacagguguguguuaugggauguauguaguaaugaauggcugcaugacugaagcagacuagcuuguuuccuuaccccuccucucuugccuuccucacuccuucccccaguugaaguuuugucauguagcaagaauccagacccagcacgguugaauguuuguguauuauuaggucucuagagauguuucaauccuacaugugugcucauuuguauuuuuuugaccucuuucuguccaucaucccucccuuuucaaguuuucuguugaaacuuuuugggggugggguuggugacccagaauucagagaugugccugcuucugccuucuaagggcagaauuaagguguguaccacugugccugggcuaaaaaugcuuugucugugcagaaauaguuugugaagggacccugcugcugcucaggaaucuauuuauuggucacuuccucaucuuuuucuuguuggcuuugugucugucuuuugagggacacucaugugaaagcuuauuugcuuuucugagauggaucuggcuuucuuagaauuauaaagaauuguuuuugggaggacaaccuaaaggaaauauuauuugcaaauaccuguuuacuuccuggguuuucuauaacgaaugugacucagaucauucaaaauuuuaaacuuaggaaaguuuccuaguguuacuacauuguaugcuuuuuuuaaaaaaaugugauuuaauaauuuaaacacuaauaucuugauuuacuuauuuguguauuuuuguuugcccuuuuugaguggggcggguaugcuguaaucaaaccuggacuuuaugcauaggaggcaaauauucugcuacugagauguaucuuaaguacuugccuaauuacaaauaauauucuauaaccuguuucauuuguuacuugaauuucaauuucuaacaacaaaaaggaaacauuuucuuugcaugucauauucuuauuuaaaauaaaacccaacaguaagucuuuagcaucuaaucagucuugaaauuuuuccaauugugcuucugguuuuaguuguuuguuucaguauguguguuguauuagguugcugugugcuguguauugucuugaucuaacguaauguuccucaccacuuuucucugcuccuuuaagucaugccauugauuuuuugugaaaagacuauaucaguugucccaaagucucauaucuagauaucuugauguauuuuauguaagguuuaucuugauuaaaggggguugauuagucuuggauuuccauacuuguggcaaaaaguauuucauagauuacauugugucacaucuguuguccugcuuguagugauaaacugguuggucaugacagucuuaaucuuucauugaaaagguauauaauugugauccaguuuuuguaauauauacaguugauaugcugaauauccuugaauaaacacagguuuaugcuaguguucccauugcaguguuacuuccaauaaauucauugaucuugggagaauguuuuugguuuagguaacacaugucaugcagauuuacaguuuaaauuguaguuaaagucuaaucugaccuggcaagaagacucaguggguaaagacacuugugccugacaaucuugaguuuaaucccaugacccacauagaggaagaaaagaacauacuuuuucagauugcccucugaccuucacauuuguacuguggcaccaauacacaugugucacaugcacagacacaaaguuuaaaaaaaaaaagcaaaaacuuuaaaaacguaaaaccuaauuuguaacaacuuugcaaauguuaauucaaacugcacauaaaugugauguugucaucaguugcuggcuucuugugagaauuuuauugaauguauuugauacuuauuucucugaaaauugacccauuaaacaaguagguuuaagguuccuccucuucagauaguguggauugguucagugggccaauguuuuaggauuaaacaaaacaaaauaucacuaggaagaacaggaucacaucugaaaaacccacuuaacaccauguucacagauuccacagcuugagaucaaacaacuguuuaaaaggaaagguauuuuuuaaaaauaugccuguauugaacaugcaauacaccuuuuuguuauuucuaacauguaauaauugacauaguauuaaccuuuuauuugauauuguaaucuagauauacuuuaaagaauaguaguagauguguguguagguugagaguaaaaaauauauuggcauuuauuucaauggcaaaggaaaauuaggaaaggcuagcuuauaucuacugaugauugacaaguuagaauuuuuuaugccuugauuuuaggcacagauuaaagucuuacagacuuaaagacaaaugacagauuugggccagugugugcagaaacacuuaguugagagaagagacacuaggcaagaacauuuuuauggugcuugcucuuuuaggauguaaucuuugacucuauuucauuucccaugccaccaaauugcaaauacugaacucuuuaaaauagauauuuguucuuuauguuuuuuucuugaaugugguuggauuuuuugagacaggguuucacuguguagccuuggcuguccuggcucuguagagcaggcugacuuggagcucuuacaguuuuaccugcuugugcuuuccaagcacugggacuaaaggugugugccaccuccaguccacccccaucaucuggcugcuauuggaucuuuuaauuucuggaaaagucuacacacgcacacacgcgugcaccucgccccacggcacccccccccuuuuuuuauuugguaguaaguuugaggcuauucugggcuacauaugaaauccuaugaaaaacaaaccaaaacuaaaaccagccuaacaacaaaaaucuagaacaaaacaaaauaacaaucacagaaagaguguaauagaaugucuuaaaaagcaauccuaaauguuugaggaggaauaauuauugucuagcaucuuuauuuaccauugagaaagacacuguugggauaauaaguugauucugucacuuacuuuugaagaugggagggaccuaagagaucuuuuugcauauaaugguuagauuaauuugggggaaucacuguguauggcuuuagacuuuaagccguucaauuuucuacauuauguuguuuuaacaaagcuauaauacaccaauaacagaaaucccuccugccugucuuuucauugagagcaaugaaaggaauaauuguuuuaauuuaacaugcuuucuuuugugaagaugacaaacggguauuggauuuauaugcccaaaauaacacugcagguuugggaaagucggguaaaagaaguaaaagacacgaauccagcucauugguagcuuuuaacaaugauuuugaccuauugggugggcagauguggcauccucccuccucaaaugacugcacacucacugccucucuauuaagugcauuuuguugaguuuuucauaauauauuuguaaaauguuuacuuauauaauacacuauggauggauaagugcaguaagcagcuuaaauaauuaaagcuuugaaauauuagagaggcuuaaguaaaauuaugaagucuuggcuuagcacuaaucucaaaccaauacuuuugugaaauuuuauaaagggcucuuuuuuuaguguuuuaacuaaaccuuuuugaguagaaauagaacucauuuggggcuggagaggugacuuaccaaauaagagcaguggcugcuuuguuaggggucaugaguucaauuaucagcauccacaugguggcucacaaccaucuauaacuaguccugagggaucaaaugcccuuuucuggugugcagauguacaugcagacaaaacacccauauacauaaaauauauaaauaaauccuaaaaggacucauuuuguuuuuccugaaaauggggcuguuuguacaacaguauuuguacaagaaugcuuacuaguaacugaugucagacauuguuguaacugcuguaaguacagcagugcaugaaauagaauuaguccucaugauagcucagcacaguauagaacagggaaauaauuuaagguggcuuccuugcuuuaagaaauuuguagggacuagagauggcucagcaguuuaaaagugcuuguugcucucucagaggaccuguguucuauuuuuccagcaacacauggcagcuuuuaacaaucuguaacuucauuucuaggggcucugacacccccuucuugccuucccaagaaccaggcaaacacagauguacaugcagucaaaacacccauacacauaaaauuaaaaaaauauauguagugaacauguuuagcgcuuucuuggauguaaaauacuuacauauuauuuauuuuaggaaguguuuaacguuggccuuugggaccaaaggaaguaaauacguuauauaaugcuaauuugauugcucuaaugcuccaggaaucuacauguacuuaauggaaauaaguacaguugaggcucuggagucagaccugguuuuacuuuuacuguuuuuggagacaaggucuuuuuacacauccuggcuguccugaaaccacugaguucagucugacugugaacucagauucugcccucagaagaaccaccaugccagcuuaggaaacuauuuagcuaguuuaaguuaauuuggcaaaaccugugaaaagaugguaaauacuaaugaguuuuauuuauguauuuuaaguagggaauauccagcccuccucaggauuuucaccuuuauauucagauaaaaguacagugaagguauaguguggucagagggcaaaauuguaagacuagaaugauuuaugaagaaaaagaguuacauuugaaauaaaaaacaugucuacuuuugccuuuuauuauuucuuguuuaaaaaugacuguuagcuauauuucugguauaugguaauucaacagauaauguauguauugaguagcaaaaggucucaaagcuuguuaacuucuucaaaugaauuaaauguuuaggaguuuaugguguaagagaaugaaugggacaaggcauacauacauauaguaggaaaaaugggaaacaccaggaaauacauauggguuauguuucauaugaauuguauagacaaccaguuaauagauuccuuuaaaggugaauucuuugguauugaagccacuauauaauaguacuauguaaguacacauagucuguguaccauagugaagaaccaagaaagacugucagcaauugugaaaagauugaaauuuucacuugcuacaauuucauggauguuagaacacuugaaaacauuugaauugaaguaaaaaccuuguuauucaugacacuacaggaacuucaguaauugugaugcuguuccaagauggaugagaaagggcuucaaauuggagcuagccacagaguggcuuugcauagagcagagaaacccugagcuuagagaauguuaaucuuucauggugugcugcauggaaauucaccugaccuuugaugcagaguauggggcagagcaguaacuguaccugaucugguccucaggaaggaggcauuaucuuguaagacuauuuucugcuuaacacaucccugaacggagaggaauacagguagaaaugcuagacucuugaagccuugugcccauaguuagauaggaaacaucugacagcacagcauugauaaaaaggaauuggaguguguaggugaguguuuuuuaugaagagugucauaauaaaggacaaaaagcaagcugcuuucuaccccugcuugauucucuuuguagcugagcuuagcaugacaauugaagaaaauuuuauugucaguaauucauuugugaauggaugaaguuuuaaaacuuagaauggcucuauuuuagaaccauaguugggauuucuuaaguuuuuuuuuuuucuuuuagacuuuuuuuuguguuuaugaaugcuuugcuaguaaauauaagcccagagcuugggaggcagugacaggcagaucuuugaguucaagaccagccugguguacagagugaguuccaggacagccaaggcuauacagaugaaccuugccccgcccugcuucugcuucuuccuugggguaaccaggcccauuguacaccagguucuguuggagggagggaaacagccagguguagguaggugcaaugcaagaccuugguuggugauaaguguguggguaaagaacacaccuggggacagccuuggagaacugauuuauucauugcuuggggagaaaggguauuuauuccccugagaugguagccaaggguccagggcagggguggauggaagauacuuuaucugcacagcagggccuuguagggcuggugcugcugcugcuuauaaugucaaacaaggggcgaggccugaugacugucaggguaauauauuucugcuaggguugauggugaggggagcuaucuuuagguugggaguggggaggaagccaacuccugccguccucauauuugaggaauucugaguagaagcuucucaaccaccccuguccccucccuguaagccuggacccuguccugaaaaaacagacauagacagggaacaguguggccaagacaauacguuuugguuggaauuaguggcagaauaaaaccucauagaauguucaagaagaaaagagcuuggaagaguugggucuuucaauccucuaaaaguaugucuuuccucagccagagaccucaguuccucucauuggggccacaucuuagauuuuauugcuucccaguagagccagucacucugggcaguggggacauucaugacccaaguuauagcagcuugaguuuaauaggauaggaauauaauuauucugugggacugcccuaguauugcagaauauuuauuauucuguaucccucacucuuccugguggacgguuuagccauaaugccaagggaaaauauuucauguuuuuauguaaaaggauauguuugcagcuuauguuuuacaccuuuguuuauauaaccucuuuuuuccugagaugugaaaaauguguguguguguuaguagggugauaacagcucccaccacagucuuacuagcuuuuaugaauucaguguuaagauuguguguauaaugccugugcaugcuuuuagcuuucaucagauucccaaagaauucugugucuuaaaaguguggaccagauguuucuuugaaccaagcagcagucuuuguuagccauaaaauucggcuauauuauucacuguuacuaauacucuucaaucuuccguuuuaacaagaaacaauggguuuggacucaugcuagcuuagaggaauccaguggaauaaacaaucuccaauuuacuucuaagguguuuuauaggauuuaugacauucuauuucucaagguuagugugucuaagcauuuuguuuuggagagauucuuuuuccuuuugauauauuauuuuauauuuuuaaaaaaagauuuauuuauuauauguaaguacacuguagcugucuccagacaccccagaagagggcaucagaucucauuacagaugguugugagccaccaugugguugcugggauuugaacucaggaccuucagaagagcagucagugcucuuaaccucugagccaucucuccagcccuaucuuugcauuuuuauauuuggaauauauaauccuucuuggguaauacauuaaguacucuauaaaacauauaauucuuaggcguuugauuaaaaugucauaguuauuuuuaaaauuguguaggcuggucagaagggucagcuguagagaccugccacacuaaagcucucaguuacagucaugauuuaugggcacugacaccaucuauugaucagaaaccaacaauuggguagcagcaaagaguauaagaucgccuacagaagaaaggaguggcauaaaaugaaacaggcacuccaaguaaaagcuuauuucucaaggcuugaacuaaguuuuaaauuuucccacuuuugugaaauuguuuuuuuucucauguuaggcauuaggcacauuuagucugucuuuaaaaagucuuugucucagacaguuuaccaacacucaaaguuuauuguacaugguuggugaauuuucuaaaucuagauuucaaaguaugacuguugcaaaguuuuaaaaaacauagucuuuguuuaugacucaaacagguuagaaggugacucugguucagggagcuugcagccaagcuugaaaauaguucaaucccuugaacccacaugguaggaaagcauugauccugaugaugcugugcauguagacauacagucuaagugacaaauaagggaaugaaaaaggcuagauaaaaauaggaaggcuuuuauaaugucuuuuccuucaggcuucuugacuuuucccucccuuuuuggugcuggugguugaaugugggacuguagccaugcuccaguagucuucuuagugcucuaguuaagaucaucaauaucacuccuuugacaaauaaaaagcaaaagcauaaaauagauguuuaaaaggccauuuaaaaccauuaaacaagaaaaccauuacaagaccauuaaaacaauuaaaaugccuucaaaaucaacaagaaauucuugcugugaaacuuagacuguauaaucuguuuuggcuuuucagaugaaaccaaauaaguuuaucuucacaucucacagcccguuuuaaaaacaaaacaaaaaacugaggauauacugguuaaguagagcugggucagcuuuuugaauucguuuuguugaguacagaauuaaagcuuuaagacaagacuucguauuuagauagagcauaugacauaccacucauaaguacuuaauacacgugcaugaaugaauugagacaagugaguacugucagguuuuaguuuuguaguuggccugugaacguaaagauuagcacuggugaagaccacugggggacuugugucagucaugugauguguuaugaacaugcuauaugaguacaguuuggcugacaagauggcucauuggauggagauccuuguugcuaagccugaggacuggaguuggauuuuuggaccccacauaacgaaaggagggcaccaguuguaaaaaguugucuucugaucuccacauacguacugugacauguacauguucauaugugcaacacaaacaugauaaauguaaccaaaauuaaagaacaaaaaucauaguuauuuuauggaugaaaucaucaaaaguugaaaaaaaagagagacaauuuuuguuuucuuuagaaaagugggauugagauuauauuaacuuaaucuugaauuaugcuuuuguugugacuccaguuaaucuuuucucugucugccccuuaccuuucaggccccuucacagauguagucacuacaaaucuuaaauugcaaaauccaucggauagaaaaguguguuucaaagugaagacuacagcaccucgccgguacugugugcggcccaacagugggauuauugacccggggucaauugugacuguuucagguaguacuccauguccuagaccuuuguagguuugaauauugacauuucaugacuguugcauuugauguuuaguguuuuuaucuguuuauuauuuggcuucaguguuuguguaaagauguuccuuggguaucuuaccguacagacauuuuauugaaccuuuccuccucgagacuuacgugggaguguaugauugccuagggucaauuugaaauguuaucuauucuguauuuccacagcuuuccacuguagcuuguguucuuauuuaucuuugaaauggcacuguuuugugauuaaaucauguucugugcaucuacagaagcguuugagucuuaaaaaaaaaaugccuguuuugggccuacuuuuaaaaucagaugaguuuuuauuccuuucaguguaaaugacaacagugucuuguuccuuguuuauugcuuacaguaguuccuuccauacacaucacguauuccugcugugagaucuacugugcuauccaaauguuccuuucuuagacagccuuuccaaggagacaguacuuuguaacacgugccauagguggcaggucugacagcauguguggcuccaugagacuuuaacuugugggaaaaccucucugugcucacacagacuuacuccuuuuuuuuuuuuuuuaaaaaaaaacaaaacaaaaaaaacaauagcuuucaacuccugcauuuguuaauuacaaaaggcucaggaaaaauggauuaugucauuacagaucauggaguuagaaauguguguauuaaaauucuuggugaccugauaacuuaggugaucccuaaauuuuaagauaacuacagcuuuuauuuucaaguuuauagaauauuaaaauaguaaguuauuuaaggcucagugagacuguuuagaaguagaaccugacuguaaauguauccaauauacauuaguaauuacugauuuguuuaucaccucaucuuggauuuacguaacauaaauugaacuggagccuuaaaacuugguacaggcaacucaggucuggagacguaaaagugaaugcuauugggaucugggaauaaagucuaaagaccaaucaguuauccuuuguuuucuuaaaauuagauuuaaacaaaugaacacauucugaguaauuguuuaaaauccaguuuaaaaauaaguuauauuaaaagugucuaaguuaucuaaauuaaaaucaacacaaaaugaauuuaauaauaauugaaaguuaaaaggcugcuugugccucuugaggauaauuuaaguuuuugaacccaucuugguaugcauuaaguuuguguguuaguguggugguauuaaauaggacguaaacuguagaugacagugugcuuucucuguuuauuuaguaaugcugcaacccuuugauuaugauccgaaugaaaagaguaaacauaaguucaugguacagacaauuuuugcuccaccaaacauuucagauauggaagcugugguaaguguagaaguuguacagaaguuauuuuuggaaauguaguuuaaacuuuguuuagcucucaacaauccauauuuccuugccaaaaauuaaauaucagaacaaaauuaaaauuuaaacaauuaaaagguuuuguuuuuugauauauauuuuuuuccaaggcaugauucggcuuguucuggaacuuuguagaccaggcuggcuuugaaccuacagagauccucuugccucugccucuuccauugcugggauugaaggugugcuccacucaccaugccugaaauacuguucuuuagaaaccauuuagacaugcuaaaguggagaagacagucguguggauugcuugcugaugcuguugucacguuuuucaucacauuguuuuauuguggugucagagauagcuugguggggcuggccuuccauucuacugcauaguaugguuucuaggaugaaagucaggccaccaguguggcagcggugccuuucccugccgagcccgguguccaugaaagcuuuaauuaauggugaugguaggucugcagugacauugguacaugauuguaggcagucugcagucaacucaggcuucaguugucccugaagguuucaggugaagccuccuugccacggugcucucucucuuuucaucuuugaauuuuuguuuuuuggauuuuuuuuuguuuguuuguuuguuaaauuucggggaaugcuuucaaauuuugacaacugaaaucaugucucuuuugucuuuucuuuuuuuauuuuauuuuauuuuuuuuauuuuuauuuuuuauuuuucgagacaggguuucucuguguagccguggauguccuagaacucacucuguagaccaaucuggccucgaacucagaaauucaccugccucugccuccugagugcugggauuaaagacgugccccaccacacccggcuucuuuucuuuuuuuaaaaaauaagacaugcauacauaaauacaacuauaaaaauuagaacuucuuuauggguaacuguaucaacauucuuggaauaaaauauacuaauuuguuuuauuucuauuuucuuuuuaguggaaagaagcaaaaccugaugaauuaauggauucuaaauugagauguguguuugaaaugccgaaugaaaaugauaagcugguaaguaaaaaguaucagauaauuaucagcuuuugauuuuggacuugguguggcuggucauuuuaugcgacuuaaguuuuaaaaagcuugauaaugcuauuuccauuuuaugauauuuuguuugccuaagaagaaauaaauauaacacauuagguccaaauuuuagugugggaagaauuucugggaaugcucucauuuugacaacugaaaucauuucugucuuucuuuguuuguuuguuucucucucucuuuuuuaaaaagaauaagacaugcauacauaaauacaacuauaaaaauuagaacuucuuuuuggguaacuguaucaacauucuuggaauaaaauaucauuuacagggauaaguuuuucccccaguuuaaccucugucaaauauuuugcauauuuuugauuuuugaucaaaaucaauuuuauuuuuuaguaaauaguugcuuauugauuagcauuaagcaacuacaugggggggggcgguaaaggcugaagaauagauauguuuauaauagcagacacuauaaacauaauaguggccugaggucuauacgguggguauagucaccuuaucucaggugucuuucugguuuguaaauuaaaagaaauauaaggaauuuuauuuuaugcaugugguugcuuugccuucauguaugucuguguguaucugguggccuuggggaccugagagggcguagguuucucuggaacaggaguuacagaugcuuuugaguugccaugaguaggugcugggaauggaacacgcuucuuguggaagaguagcuaucucuccaaacccaaggauuuuuaauuuuuuucuaugguuuguaggagggacuauaaaacauuuuauuugaguugaaauauauaaaauaauguggguaaauauaauugauacaauuugguuauauagucugauauaacucuaauaagaaagcugaaauaaaaaugcucuugaauguuaauuagguguugacacauccuuuuaaagugaaucugagucauaauugccaagaguaaaaaguguaguguucauacuuuuauauauuaguuucccuuuuauguuggcuccaaagauguuaauagccuucauugcuuuuuguauuuaacaacaaaaaauacguuuaucuggaucgacauuacugugaaaucauugugggacauuaucucaauaauaauaguuguuguuauuauuacuacuuuugguuuuugaaacaggguuucucuguguaacccugggugucuuggaacuuagucuguagaccaggcuggccucaaauucagaacugcauugcuucugucuccugccaggcuuaguuacuacauuauuauucuuagauugguuuacuaguaggccuuucagguugguucuucuuagcacuuuaacccaaguaaucauuaaugacugaaauuuaguuuuuaacauuuuuuauuauauauguucguuauucauaauauuuuucauuguuauauuuucauauauguauauagucuauuuugaucauguucaucucccaaugcccuucuuuuuccuucugcccacucaugaauuccuuuuucugacuggcccuacugcuacuuagaaucuuuuuugguuaaggcugucacaggagaauuguucaguuuuguuuacauggcuuuguucaccucacuagugacagugaagagaaauaccucucuccaucagcaguaagcaaguaugaaccuucaugauggggcggggggcuccaugagcuccgcauccuucagugacaagguuuuguggggcuccugugaagacaguugcagcugcuguaguugaagagugccacauuugugccaugcugggaaaucagagcagcacauguugcuccccuucuucaggcauuuacauuuuuuuugguuuccauacguuuuuuuccuggagcuguggaggggaugcugucugugucuuguuuaugguuugacaccugacagucauuaucaguauguugacuaguuaagagucucugcagucacuuaacugacuuaagaauuuccuuaaaaauuauauuaagcguauguauauuuuaccuucauguuugucugugugcuauguguguaguugggcaccagaguccagaggaggggacugaguccccuggagcugggauuagagguaguugugagcuaccaugggaugcugaggcucuagccuggaucuauuggaagaagccaguguucuuaacgucugagccaucucucuaccccauuucgaacuuccuuaauguaauguggccaggaguuuuucuaggcucagacuuaaaucauuucuuaaauacuggaaguguggcauuggcugcuuaugucuauuaucccgguacuuuggaagcaggaggauugcuaugaguuccaggucagcuugugcuacagaguaguuaggccuuuucuuauaaaagcaaauaaaccuuuggguucuuuuagucagagaaggcauuucaggaugauggcgugggcaguagguuggcagugacuuuuaaugaagacuguaauagaucguuuuguagaccuccugaaguauguuuugacaucaguaaaacaauguuuguaacucucgugguccuuagccuugcugcuaaauuuuuuuguuuugucauuguuuggaagacggggucugucucuguccuaggauggucaacucacuguaugcauaggcuauccucaaacuuguggcaguccuccugucuuagcauugugaguacuuguauuucuggaguuagcccuuaggauaguugguggacauuuuuaaauguuuugacuuuccauuucaagauucacaugaugagacauuguguggaugucguuuuguggguaggaggcaaguuuagcuuucgacgacgcccuggguuagaugacagccaccaccuaagcuugugcgacggaggcacacuggccuguaaucccgacuacuccagaggugggaacuggaggacaguuaacuuggugggaacuggaggacaguuaacuuggaauguucugaaaguuacuuuuggaagcacuguucucucuuuaaacucauuuuuuuuuuuuaugcaccuucagauucuagaagaagucuauguagaauuucaccuucuuuuuuuccuaauuuuaccuucaauucuacauugugaacuaacugccagaaucagucucauuaguaacuaucauuaauaacuaucacuuugaauacuuacuggguuuuuauaccacaguuacuugagagcuuugaguuuuuuguuauauuuaacuuagaaaacuuaauugaaagcauuucacaguggcuguugcagcucuugucuuuguacuuuuguuuuucagcaugauagagacauaucuaggugagcuugauguacuguuagguugacugcccacccacgcccuuacuuugucugcucugcuuuguauucucguacccugagagaaagaaucaggcauugcauuuaaaugugcugcuguuauacacacuugcugaaggcucuucaucuuuuucgguaguuauuuguuguuuuguguucauggcuucuggaagcaggggaaacauggaauuuugugauuucuuagaauuuuaggaagacccuauaaauuaaaauaauugagguuuugggaucaugucacaagguaacaagcaguaacuaccauuagagaacuaccauggauauuuuugugaaauagcucuaaaauauaugaauuauaaucagggugaacaaggaaaucacggaaguuuaaacuuaguuauaaaguuacuuuuuucuaaacaauaaaauaaucacaugcauugucucucugagguguuugccuggguacaacaagaguuguuuacugggagcgcugaucucuggagagccuuucaguuacuuaagcauaaaauguugacucuugcugggcgugauggcgcaugccuuuaaucccagcacucgggaggcagaggcaggaguauuucugaguucgaggccagccuggucuacagagugaguuccaggacagccaggagagagaaaccaaaaaaagaaaaaagaaaaaaaaguugacucuuucaaaaagugaaguucuguaaaauuuagcuccuuuuaguuauuguucgcuuuagaauacgaaauacucaguguccaguuacuggugguuuuuauuuuauuuuguuuuuguuuuucugaggaagggcuucuuauauaauucugacuguccuggagccugcuaugguagaacagaguggccuugaacucacugaaauccuccugccuuucuagugcugguauuaaaggugugugcugguauuaaguguuucuuaaggauggacugaagcuuucuguuaaccuacucaguaugcguuugguaugaacugcuuggcauuuuccagguuaacauaacaccugauaguaauauauuuuccgcaaaaacuauuuugcuuuagugaugacaguggagcugguuggagcaggggcucaagaacccuuuauaaaggcauuuuauauuucaaaauacaugcuauuuuuguugaaacagaauaggggaugucuguugaauuuauuauuuugugcccaacuuuuugaguuauuuuuaacuauuacgagaauuugaaagguaaguagggaacuguggaauuaugguaggcuagccagaauauuuuaugaaucuuuuaugagucuuuuagugacuuaguguguuuggggguuaacaggguccuggauauaaaggaggcuuacauacauguaucauuaccauuuuuaauccuaaugugaaaauguucauguuaaguguuaucaaagguaagagaauaugaaauugaauauuuuucagguaaugacacguauuaguuuuuuaagccauagaacuagagguagaaauaaguguucuuuagggcauuaugaacuuugcauacauuuaauuaauauacacauuuuguaaaugaagguaugcaguuaggacauaccuacuuuuguguagaaauauuuaugaaaagcuaguucagaaauggauuguuuugcuuuaaugcucugauucugacacuauagaauauguuaucaauauuucacaggcuuaagcuauuucuuguagucauucccaauagacagaagaaaucaguuugguaugaaucugagaauauuuuucccgugcuaccucaggguaaaacuccaccagggauugcuucaacugucgcuucauugagcagcgucagcagugcaguugcaacaccugccaguuaucacuugaagaaugaucccagggaacuaaaagaggugaagcagguuugucauaggagcuaacagcaguaggagucugcuaguguuaguaaguuacuguagauaccuacacagauaaguaauacugaguacauuaacaguuaagaguucaguguuuaugagacagggucucacacaguccagauugaccucagcucagaauauagccaaggaugaccuugaacuccuuaucuuccugccugcugauaucugguucugugcuggggauaggccugaagcacucugcugagcuucuccagccauaggaauaaaguguuaaacuaacuguauuuaaaguuacaaguagaacugaaaagucugcacacaauucuguucuaaaguaguaaccagcagaaucccaguguugagcuggacaugagugugaacagaauuaaguugaugucguuuuuccugugaaugggauuuagagaacaaaugcugaacauugaaucuugugugaauuagcuucgcaaauacauaguaaguaauaaagauagcaagcacugcuuauucacaagcaucugugcuuaaaggaaagaaaaauaaaauuuauuuuguuguuauuaaauauuauaacugucauuguuaacuuguaaugccccgggauugaaaaaagaugugauuaaaaaugaggucauaauuuaacugagcaugucuauacuuggauacuaauaaggcuaggguaacugaguucguugguggaauggguuuucuauaauucuuuuuagaauuuauuacuuccuggaaaguuccaaaaugcuauaauuaauaguuaaguguuauagguuuuuauacuuagacuuggcuuagaagaggguaugcauacuaacaaagcuuuaaauuuuuuaaauuuuauuuuaugugcuuggguuuuucgcuuacauuuguguauguacagcacaugugccuuguacuaguggaggucagaagagggcguuagauccucuggaaucagagguaacagaugguugugagcugccaugcaggcgcugggaauccugcuggugaugagagugcccuuuacuuccccucuuggagcuucaugaccggccuuguagaagaacagcccguucuucaccacugugccaucucuagcucccuaauaaggccuuaaaauaccuagcuuuagggaggcaagcagagcucugaguucagggcuagcuugucccguguagcuaguuucaggcaagcuggguuacauagugagagccuaucucaaaaaaaccaagaaaacaaaacaaaaaacaagcaaacaaaucuuuuuuuuaagucuaaaugucuaacucuugcuuggcuuuauaauuugaaauuacuuacuuugaugaccaugggccuagagaaauuguuuugcuguuaggguagaaaguaaaaaaaucuauggagccuugcucuuugaguauuucaauucaaagauuaaaacuuuaauucugacagcauagacauaguuuuugccuuuagcugcacacugccuuaauguguugacacccuuuacucacagcagugguaagcaugcccauuagcuccugucuuagagcuucacugaaaauaguuacucugccauagguuucacucuuccuuucggugucuagucccuaacuccuuugccccuacaaaguuacugaaagugaaauccuuaugggacuacugcagauagaagaguauaggauaguggaaaguguauaccauacugcuguagcuuauuguaacuugagguguuaaagcaugauguuacucuuguugguaagagucacggcauaucgaaucuguuuauuugguugauccgugguccuaaaagcaguuuguucuuucuggaucaaucugaaguaacuuuaaaaagagcaagcuggcguccugcaggcaaacucacuaguggagguuccaucagaaguauucacauagucaccuguuuaguguacccacaaaagacucagccuucucucuugaucuucagcuaagccagguuguuuguuuauacauuagagaucuuuaaguuuguuuuuucaucugcuauguauuguaaaugaaauacaaauuccauauaguagcugcccaucagacuucuaacaaaaaugaaauguugagugauuuugauaguccuagaauggaauauuuaaugaaauauugugccacuuuaaauaguugaaagauacauaaagcagaaugcacaccuguauaguuacaugaaugcugacuuuuuuauuuuauaguccucggugauugaaccaagguccuuacacaugguauaaaaugcauaugaaaauaucgaggacgauaauaugaauuuguuugguuaaugauauagcaagaauggucauuuuuuuuuuuuuuuggucuuuguaguccugguuguacuggaauaguauugguuguacuauauagaccaggcuggucuugaauucacagagauacuccuggcacacccagcauauguuuuuuaagaauuuauuuaucuuuauuuuaaaaucauuaacauuauuagcuuuguauaauuuuggagucaauauggggcuaacacugauuuuucucucaguuuuuuugcuccuguacuggaggaugagccuaggaccuucugcggggaaacagauuaguacuuucugcuuaguacuuucuucauucuuaggcaaagugugaggacucuauuugccuguuaaguuuucucucuuuacagacagaggugacauguucuuaauugugcaggauaggauuugagaaaucaguuugaagucaauuuaauuauugucaagagaaaacucagaaaauauuguuagcaaaauaugaaguaaagguuuuucuuuuagagauagauuuaguuggacauuggggaagaguaugauaaagaauaagugugucagcaggagaaacuccgaauaaauugaaguaagcagcucuguaacuuugaaguaugcacccuucucagcugugaaacuugcaagugguuaaaugggcuagcaggucagauacuuagcuaagugccuguauuagaauaccuuguugcuuuuauaaaguaccugcccaggcagcuucaggagaacuugaugauggcucacagguggaggguacaguccaaccugguagugguagcaugggcagcugguuggcaggcugccccugcaggcgggaagcagugaugagugcugguguucaccuucuuguggcuugucccacuuuucuuaauacagaugugcccagagguuuguuuacaguccugggugauucuagaucugucugguugacaguguuaaccauuguagcccaacuggcugccagauuugggaugucuuaaaauuuacuuugggaugucaaauaucuugauuagugguuauuaccuggauuaaagcuugccuuuuuaaauuuugugguuaacagcaaacccaaggucuccugcuuguuaucaaauguuacauugacuuaaccugaaaaggaugacuuuauauugauacuguuacuguaugugguagcauaauguuggauuuuaaggauacugaaacacuuuagaucacaggcuuagaaaauaauguugguguugccacagguguccaagugcuugugguguugguaagaccuuacaguuuugaaaguugucuuaaccugccaccuagauagaauaccacaaugaaucacacuaauuggacagucuacaguuuaaaugauccucuguguuaaagaccacagauagcggccauuguauuacuuguuuauuguuucccuucuaguguuugcaucuuuuaguuacuuuauuucauuaauagacauuagauuguuuuugacuguauauccuuagguaguuauaaccuuacuggagugauuaugagauagauuguccuguacuuuccaauuccuaagaccucauuugacugcaugcagucagaccauuagaaaugacccagagcuucucauucagcacauuucacucacugacugcucguggacaaagugugugucuagggguaaauaauaaagagacguagugaauuuccuuccauuugaaauucuggaguaaagaauguaaauaugaguuaugauaucuuuuaaguguuaugcuaagguaaguuccaagggugugggaguagaagacaucggcugcuuauuuugauuagcugcugguguuuuauugacauguuccagugaacauugucugcaggugaucuuaguugcuacuuaauaaaucuuacaauuaguugaaacuugucauauuuucaugacauuuuuagaagagaaauauguagaacuuagguuuguauuaguuuaaaacccauaaauuuuuuguuaaagauucccaauaucuuugaaacacagaaugauauggaaccuagcaaagcuguuccacugaaugcauccaaacaagacggaccccugccaaaaccacacaguguuucacucaaugauacggaaacaaggaaacugauggaagagugcaagcgacuccagggagaaaugaugaagcucucagaagaaaaccgacaccugagaguaaguuuuuuggguugaaaaugagguaauuggaaugaagguauaaagaauauguuaguaucuuuuagcaaucucuauguuuauauuuaaucuuguugccgguuauuuuuuauuuaucucguuugaucuuauaacuuagagcuaauuaguguaggauuaaagaaacgagguuucugaaagccuaguaauggaaauaaaauggucagguauauuuuaguuaguguuaaggguuuuuauuuuuuuuuuuuuuuuuuuuuuuuuuuuuuuuuugaggaacuggagagauggcucagugguuaagagcacuuacugcucuucuagauguccggaguucaauucccagcaaccacauggugguucaagagcaucuauaauggaauccuaugcucucuucuggugugucugaagacagcaacaguguacuuaaauacauaaaauaaaucuuuuaugaaaagauuuguuuuugacacuugauaggauuauuucccauuggaaagugaagauaucccaaguugaaaaugcacccaauacauagaccuuugacuguccuauccuagcuaucacauuagcacugcuaauuagcagcagagugcugggcaccuucugagaggaucccagcacaugucccuagcccggggaagacgaagauucacugcacauuccuaaugccaaaaacaguacauuaaacacuagagaggcuggccaugcuguguaagugguugaggaauggugugaggauaaaauaguuuauuuugagguaguacagauucucuaguuagguuuuauaaacagcaucugauaacagccagccauauaguuaagagguaucuauaauuucuccaggaccuugugacacauacugucacaaauaaccaccugcuuugagaaacuauugcuuuacuaggagaagaagccagggcaaagucacaucuaaacucaaccacaggacuaucagaaauguaaacucaguauaaguagggagcaguucauucuuuuacauggagcagauaagguacuuaaacaaaaagaagcgauugccagcaggagccucagagacggguuccuguacguagucuaaauuacguacagucuaugcuccauggugacccuuuauauaugucccuuggguuuguuuugcgcauauuaaagacucuaaacuacucugcuuuucucuaaaucuugcaauauauuaucuaucuaaaaauaaauccuugugugccucccauguggguuuucagguuuuacugagucaguaaacauggaguauaggugugcuauugauaguuucuugcugauggcuggaguauaggugugcuauugauaguuucuugcuguuggcuggaguauaagugugcuauugauaguuucuugcugauggcuguagccaauccaaaaugcuguagggcucauuggaaguaagcuuacauguuuuauaggaauacauuucucauuuucaguuuuaaaagucauuguuauugagguguaauuuacaucacauaaauguacuaauuuuaauuguuuuagcagauuuauagaauuauucggcuuuauuuaucgcuuuaguacaguuuuagaauuuuuccuaauuccacagguuuccaagguagaugggaauuuauucuugcuccucuucaaagccauacacauguacugaauuccuuuaugaacuuuuagcucugcuacucaccugugugugcuguuuaaaaaucuuuguuuugugucuuuucccuaggaugaaggccuaaggcucagaaagguagcacauucggauaaaccuggauccaccucagccguguccuucagagauaaugucaccaguccucuuccuucucuucugguuguaauugcagccauuuucauuggauucuuucuagggaaauucaucuuguagagugaagcaugcagagugcuguuucuuuuuuuuuuuuuuuucuucucucgaccagaaaaagauuuguuuaccuaccauuucauugguaguauggcccgcggugaccauggcccgcggugaccaauuuuuuuuguguguacagcgucauauaggcuuugccuuuaaugaucucuuacgguuagaaaacacaauaaaaacaaacuguucggcuacuggacaaauuguauauuaucagaucaucacuagcagaugucaguugcacauucaguccuuuaugaaauucauaaauaaagaauuguucuuucuuugugguuuuaauaagaguucaagaauuguucagucuuguaaauguuauuuuaauaauuccuuuaaauuuuaucuguugcuguuaccucuugaaauaugauuuauuuagauugcuaaucccacucauucaggaaaugccaagagguuuucugugggggaaauggugccucuuacuguguaaauuuucuccuuuaccuuugcuaauaucauggcagaauuuuucuuaucccuugugaggcaguuuguugacugaguuuuucauccuuacaauccugucccaugguauuuaacauaaaaaaaauaaaacuguuaacagauucuugcucgauagcuuguuugugucugucaugucauuugugcuggguugggcguagggucagagugggaugagccagcauguucacucugcagugaacuuuauuggacuuaauugauuuguuuguuugcuuugguuugguuuuucgagacagguuuucucuuuguagccuuggcaguccuggaacucacucuguagaccaggcuggcccugaacucagaaauccgccugccucugccuucugagcaccaggauuaaaggcgugcgccgcugccacccacccagugggcuguauaauguguacuguuaccuuguaugaaacucuuuccaguccuugauuauuuguaauuuaaagucuugagacuguuuuaagaaaugacaagauuucaagccaacguagguauuuuggaacaucuuaauugaguuuaugaaauguaaaggugcugugauccucaugaguuuugugugugccagcugccuguauugucuucagggucuccaggcuuguuuuuguuuguuuguuuguuuuuaaaaacugucuuuucaaggaaggcuuaauucuccuguauucuaaauacucaguguacuaaauaguucuacuuuuuaauguauuuaacagcugaaaagaauugguuuuuuucuguuuuagaaaauuaguauuacuuugcaaaccuuggguauuuacuuuuugaaaaacaaacuaagguuaguugugugaaaauuacaaaacaaacaccuguuacaaauguacugaugcuucccuguagucuuaggccuugguguauaucacauguacugagauaaacuuagaaucagaaaguacuguuuucagcugagaauauaguucauuacauggaggugaauuuugugucauuaaaacuggguguugguuuuguaggaauuggacacuguuggggcagagacugggucauagggcuuacugugcaggaaggguaucacaggccugcacggguguguugucagaucuuuggguugccuuuaauuucucagauuauauguaauauauuguuauucccugaugacuuuuauaaaacuucuuguguaguaguuacugaaaaacaaaaccaaccacccaaaccagaagugacgcuuaguuauuccuagcuugcuccugcaggcaguguucuauugguggugugcauuauuacugcuacaguacugcccucccuccccaaagcugaaagugcaugagaaaaaucuuacauuuuaaucccccaaguauggaaucagcaucuccuuucuugguuuaaaguucuuuauaaaaucacucagugauaagcgcaaguuugauauuucuuacaucuuuuuuuuuuuuuuuaguuuauuuuuaagaaauuuucaaaaaugaaaaaucccauuuuauagaaaugugccccacaguucuguuucucagccccuuuguuuuguaggggaggauucaggccuuacaaaggcugaggaaaacuucaugaguggcucacaggcuggcagagacacuuagagcuuccugauuguagcuguaaacaguaaggcauuugaauuugguaaacagcugaaauaagaacccaguuccuucaguccgugggucacaccuccuguccgucuucucugauaugcgugcauucguguucaggcugcaguguccaccgugcgggcuguaaauugcauuguauuuuggcaggcauuuuacaaaguacaguauggaguguuuugaaaauacacaugggccucuuaacugcuuuucuuaggagacuucauguuuuguucuuuuuaauuacuuugagaaaugugaucagauuauuuuccuaccaaguucuuggaaagaaguccaguucuauugacagauaauauaguuucauccuuacauguuaagaguuuuguauguguaagcaggaaggaaaagacuauaguuaacacugaagucagucuagcaaggccucacacugacaugaagugcacugcuucccucauuuuuucuguaaccaguguaccuuaauuuugcucauucuguuuguauuugcaauaugcuuacuuccuuaaaaagauacuuggaaaaaaauguaaguucacaaaaaaa

SEQ ID NO: 8706 - RNA, 2845 nt, Mus musculus
cuuccuuugugaguuguuuugaaaagacuuuccagauuuccucccuggaaucuuuuugcagaagagugugaggcuccuccucugggcugcaguacacacccuggcuccacuccugcagccauggcagggggccaggcacguucacgcucuaaggcuccaaaacaaugacagaggcaacaaaaugaagcugaugaugcggccuccagcugaugaggaacacugagcgcaguccaagagugcaacuauucagagauucccuccugggcuguacagagaggggccuuccccagaaugcuggucuccaaacagcugugucuuguucagcugccuccuguucagugggagaaggggagaaguuguuucuuauucaauauuugauucuucugacucugcuaaugaguuauauagauagacuccaagucuaucuauauuaccuauauuuucaguuacuuucaaauacugaucuuucugcuggagcuauaagcagccaggccugcaauggggacccuucuccaggggagcagagacagcaccuacagagaaugcauauuucccacaggccggggaacugaaggagggcaccucuccuggagcucagagcucauccacaccaacugcauccuggguaggauaucucucccaucauucccaagucagugauggaauggccuauauguauugucuccauaccguugcuggcuaguuuuacgucaacuugacacagcuagagucaucugagaaaugggaaccucaauugaggaaaaaaaaaaugcauuccuaagauugagauuguaggcaauucugguagcgcauuuucuuaauuaaugauuagugaguagggccaacucuguugugggugguuccaucccugggcuggugguucuggguucuauaagaaagcaggcugagccgggcgugguggcacacgccuuuaaucccagcacucgggaggcagaggcagguggauuucugaguucgaggccagcuuggucuacagagugaguuccaggacagccagagcuaaaagagaaacccugucucgaaaaaccaaaaaaaaaaaaaagaaaagaaaagaaagaaagcaggcuguauaagccaguaagcagcacccucuauggccucugcaucugcuccugccuccagguuccugcccugcuugaguuccucucuugacuuccuuugaugaugaacagggguguggaaauguaagucaaggaaacccuuugcuccuaacuugcuuuugaccaugguguuggggaucacaccuucaugcuucucuucuuuccucuccuuuguauguuuguaugugugcugugcaugugugugugcauauguaugugugcugugucugugcauacguguaugugcugugcgugugcauagguguguuucugugugugcauauauguguguguuguauguguguacauauguaugugcauguauguguggauaugugggugcuguaugugugugcauaugugugugcauauguaugugugcuguguguguacauaugugugugugcugugcaugugcauauguauguuucuguguguguuguauguguguacauauguaugugcauguauauguguugugugugugcuguaugugugugugcauguauguaugugcacgugugugugcauauuuauguguguuguguguaugugugugcauauguguggugucauucuucagaagccauauaaauuguuuucugagacagaguuuccaggugaccagcaagccucagagaccaccucugccuccuccuggcugaguugacugggccaccacacaaaacaacagguuuguuuguuugguugguuuggguuuuuguuuuauucuccgugggaccuaggcauggaacccaagcaccucacugacaggguagucuccgccccucucuuuaggaagcacauccaaugaccccuggaacugagaggccaagaaaguaccagggccagggaugagagaugcugggagcaagcaccagaggcugggcugcugacaaggcuaggcacacacagggagggucucaauuaagcagccugggugggaacuuggcuaaaccguucuaauuacacauggcugggggaggguggggcugaugggccgagcaagucacagcugugacgggaagaaaggcuaaaagagugugagaaacggaggacacaagcccagucgcauacaagguggggccacuugacaagcuccuucacugaggcacgcagacccaccuugauuccagaauucuccucagccccagugugcaugccugugccugcaugggccagcagggacuuucuuaccccaauccuguugguucuugagaaauuucacuugauguugacaguccaaacccuaagagauaaaauacucuagacguuuugcuucuacauaaaucuaaguauugcuauaagaugaaaagauugccucaguguuauaagauccaugcagacuugggcucaagccccuguccaacuguuacccacaugguagaauccaauccagugucaucauuauuggauguauguaccugucaccuucaacagaccuaccacugaguuuugggcauucuucuaggcaaggcuaccuuccugcagccuggaccccucggcacccaccugucuggguuccauuagcaggaaacacauagugcuuagcaccucuaggaguuccugcguaaguuuuccguaacagaaacauauuaauuuucauugaagcucgggcaguaaaacgcucaccucacagacgcaccgagacaguuugaucccugccacucaccuacagaguguucaagguaggccucccucaccaucccagagauguggagucg
